US006605709B1

(12) United States Patent
Breton

(10) Patent No.: US 6,605,709 B1
(45) Date of Patent: Aug. 12, 2003

(54) NUCLEIC ACID AND AMINO ACID SEQUENCES RELATING TO PROTEUS MIRABILIS FOR DIAGNOSTICS AND THERAPEUTICS

(75) Inventor: Gary L. Breton, Marlboro, MA (US)

(73) Assignee: Genome Therapeutics Corporation, Waltham, MA (US)

( * ) Notice: Subject to any disclaimer, the term of this patent is extended or adjusted under 35 U.S.C. 154(b) by 0 days.

(21) Appl. No.: 09/543,681

(22) Filed: Apr. 5, 2000

Related U.S. Application Data
(60) Provisional application No. 60/128,706, filed on Apr. 9, 1999.

(51) Int. Cl.[7] .......................... C07H 21/04; C12Q 1/68; C12N 15/63; C12N 15/85
(52) U.S. Cl. .......................... 536/23.1; 536/24.1; 435/6; 435/320.1; 435/325
(58) Field of Search ...................... 435/6, 320.1, 252.3, 435/325; 536/234, 24.1

(56) References Cited

U.S. PATENT DOCUMENTS

| | | | |
|---|---|---|---|
| 5,683,876 A | 11/1997 | Hogan | 435/6 |
| 5,994,066 A | 11/1999 | Bergeron et al. | 435/6 |
| 5,994,308 A | 11/1999 | Lawyer et al. | 514/15 |
| 6,150,517 A | 11/2000 | Hogan et al. | 536/25.3 |
| 6,242,223 B1 | 6/2001 | Hanson et al. | 435/91.2 |

OTHER PUBLICATIONS

Mobley, H.L., and Chippendale, G.R., "Hemagglutin, urease, and hemolysin prodution by Proteus mirabilis from clinical sources," J. Infect. Dis., 161:525–530 (1990).
Buzy A., et al., "Complete amino acid sequence of Proteus Mirabilis PR catalase. Occurrence of a methionin sulfone in the close proximity of the active site," J. Protein Chem., 14(2):59–72 (1995).
Nemec, A., et al., "Conserved amino acid residues in the primary structure of ribosomal protein S20 from selected gram–negative bacteria," Biochim. Biophys. Acta, 1263:154–158 (1995).
Mizuno, T., "Structure of the peptidoglycan–associated lipoprotein (PAL) of the Proteus mirabilis outer membrane. II. Sequence of the amino–terminal part of the peptidoglycan–associated lipoprotein," J. Biochem. (Tokyo), 89(4):1059–66 (1981).
Pretorius, G.H., and Coetzee, W.F., "Proteus mirabilis phages 5006M, 5006M HFT k and 5006M HFT ak: physical comparison of genome characteristics," J. Gen. Virol., 49:33–39 (1980).
Jones, B.D., and Mobley H.L., "Proteus mirabilis urease: nucleotide sequence determination and comparison with jack bean urease," J. Bacteriol., 171(12):6414–22 (1989).
Charles, I.G., et al., "Resistance to chloramphenicol in Proteus mirabilis by expression of a chromosomal gene for chloramphenicol acetyltransferase," J. Bacteriol., 164:114–22 (1985).
Jones, B.D., and Mobley, H.L., "Proteus mirabilis urease: genetic organization, regulation, and expression of structural genes," J. Bacteriol., 170(8):3342–9 (1988).
West. S.C., et al., "Purification and properties of the recA protein of Proteus mirabilis. Comparison with Escherichia coli recA protein; specificity of interaction with single strand binding protein," J. Biol. Chem., 258(7):4648–54 (1983).
Zhao, H., et al., "In vivo phase variation of MR/P fimbral gene expression in Proteus mirabilis infecting the urinary tract," Mol. Microbiol., 23(5):1009–19 (1997).
Thomas V.J., and Collins, C.M., "Identification of UreR binding sites in the Enterobacteriaceae plasmid–encoded and Proteus mirabilis urease gene operons," Mol. Microbiol., 31(5):1417–28 (1999).
Charles, I.G., et al., "Nucleotide Sequence Analysis of the cat Gene of Proteus mirabilis: Comparison with the Type I (Tn9) cat Gene," J. Bacteriol., 164(1):123–129 (1985).
Island, M.D., and Mobley, H.L. "Proteus mirabilis urease: operon fusion and linker insertion analysis of ure gene organization, regulation, and function," J. Bacteriol., 177(19):5653–60 (1995).
Fleischmann et al., GenBank Accession: U32747, May 29, 1998.*
Mori, H., GenBank Acc. No: D90795, May 29, 1997.*

* cited by examiner

Primary Examiner—Michael P. Woodward
Assistant Examiner—Shubo Zhou
(74) Attorney, Agent, or Firm—Genome Therapeutics Corporation

(57) ABSTRACT

The invention provides isolated polypeptide and nucleic acid sequences derived from Proteus fragilis that are useful in diagnosis and therapy of pathological conditions; antibodies against the polypeptides; and methods for the production of the polypeptides. The invention also provides methods for the detection, prevention and treatment of pathological conditions resulting from bacterial infection.

14 Claims, No Drawings

NUCLEIC ACID AND AMINO ACID SEQUENCES RELATING TO *PROTEUS MIRABILIS* FOR DIAGNOSTICS AND THERAPEUTICS

RELATED APPLICATIONS

This application claims the benefit of U.S. Provisional Application Ser. No. 60/128,706 filed Apr. 9, 1999, the entire teachings of which are incorporated herein by reference.

FIELD OF THE INVENTION

The invention relates to isolated nucleic acids and polypeptides derived from *Proteus mirabilis* that are useful as molecular targets for diagnostics, prophylaxis and treatment of pathological conditions, as well as materials and methods for the diagnosis, prevention, and amelioration of pathological conditions resulting from bacterial infection.

BACKGROUND OF THE INVENTION

The genus Proteus is a member of the family Enterobacteriaceae, They are Gram-negative, facultatively anaerobic, straight rods. The species are motile by peritrichous flagella. The genus contains at least 3 species that are often isolated from the intestines of humans and animals, manure, soil, and polluted waters. The genus was first described in 1885 by Hauser (Penner, J. 1984. Genus XI. Proteus Hauser 1885, 12. Krieg and Holt (editors) In Bergey's Manual of Systematic Bacteriology, 1:491–494).

*Proteus mirabilis* can differentiate from short vegetative swimmer cells to elongated, highly flagellated, multicellular, swarmer cells. These changes are in response to growth on surfaces or in viscous environments. (Mobley, H., et al, 1995. Trends Microbiol. 3:280–284.). The swarmer cells have been implicated in the migration of *P. mirabilis* to the kidneys, where invasion of the of the renal tissue can occur (Allison, C., 1994. J. Infect. Dis. 169:1155–1158.).

*P. mirabilis* is the most common member of this genus to be isolated from clinical specimens. Bacteremia caused by *P. mirabilis* is often difficult to treat and mortality rates range from 15% to 88% depending on the severity of the underlying disease. It is most often associated with urinary tract infections (UTI), especially in patients with indwelling catheters, and is second only to *E. coli* in prevalence (Senior, B., 1997. J. Med. Microbiol. 46:407–412). A major complication of long-term urethral catheterization is the encrustation of the catheter by biofilms from bacteria that include *P. mirabilis* (Stickler, D., 1993. Urol. Res. 21:407–411.). The infection usually starts in the bladder, causing bacteriuria and cystitis. It then spreads to the kidneys, where it can cause acute pyelonephritis, chronic inflammation, periurethral abscesses, renal failure, and bacteremia. An inducible urease can cause stone formation in the bladder and kidneys. (Oelschlaeger, T., 1996. Microbial Pathogenesis. 21:1–16.). Other virulence factors include hemolysin, fimbriae, amino acid deaminase, and an imunoglobulin-A-degrading protease. The expression of many of these virulence factors are regulated by the differentiation of the swarmer cell (Mobley, H., et al, 1995. Trends Microbiol. 3:280–284). Although less common, *P. mirabilis* has also been isolated from infections of wounds, burns, respiratory tract, eyes, ears and throat.

While there is still excellent activity of many antibiotics, there has been an increase in antibiotic resistance by *P. mirabilis*. Plasmid-mediated transfer of antibiotic resistance genes has been partially responsible for this increase. Wild-type strains of *P. mirabilis* are susceptible to all penicillins and cephalosporins. (Bret, L., et al, 1998. Antimicrob. Agents Chemother. 42:1110–1114.). The first extended-spectrum β-lactamases were discovered in 1991 (Wantanabe, Y., et al, 1991. Microbiol. Immunol.35:87–97.). With the acquisition of TEM and TEM-derived β-lactamases, strains can be found resistance to any or most of the β-lactam antibiotics (Mariotte, S., et al, 1994. J. Antimicrobial Chemotherapy. 33:925–935.). Strains have even been found that are resistant to imipenem, which has the widest antibacterial spectrum of currently available β-lactam antibiotics (Neuwirth, C., et al, 1995. J. Antimicrobial Chemotherapy. 36:335–342.).

Sequencing and further analysis of this genome will aid in the identification of essential genes for development of drug targets and reduce the emerging health threat this organism poses.

SUMMARY OF THE INVENTION

The present invention fulfills the need for diagnostic tools and therapeutics by roviding bacterial-specific compositions and methods for detecting Proteus species including *P. mirabilis*, as well as compositions and methods useful for treating and preventing Proteus infection, in particular, *P. mirabilis* infection, in vertebrates including mammals.

The present invention encompasses isolated nucleic acids and polypeptides derived from *P. mirabilis* that are useful as reagents for diagnosis of bacterial disease, components of effective antibacterial vaccines, and/or as targets for antibacterial drugs including anti-*P. mirabilis* drugs. They can also be used to detect the presence of *P. mirabilis* and other Proteus species in a sample; and in screening compounds for the ability to interfere with the *P. mirabilis* life cycle or to inhibit *P. mirabilis* infection. They also have use as biocontrol agents for plants.

In one aspect, the invention features compositions of nucleic acids corresponding to entire coding sequences of *P. mirabilis* proteins, including surface or secreted proteins or parts thereof, nucleic acids capable of binding mRNA from *P. mirabilis* proteins to block protein translation, and methods for producing *P. mirabilis* proteins or parts thereof using peptide synthesis and recombinant DNA techniques. This invention also features antibodies and nucleic acids useful as probes to detect *P. mirabilis* infection. In addition, vaccine compositions and methods for the protection or treatment of infection by *P. mirabilis* are within the scope of this invention.

The nucleotide sequences provided in SEQ ID NO: 1–SEQ ID NO: 4172, a fragment thereof, or a nucleotide sequence at least about 99.5% identical to a sequence contained within SEQ ID NO: 1–SEQ ID NO: 4172 may be "provided" in a variety of medias to facilitate use thereof. As used herein, "provided" refers to a manufacture, other than an isolated nucleic acid molecule, which contains a nucleotide sequence of the present invention, i.e., the nucleotide sequence provided in SEQ ID NO: 1–SEQ ID NO: 4172, a fragment thereof, or a nucleotide sequence at least about 99.5% identical to a sequence contained within SEQ ID NO: 1–SEQ ID NO: 4172. Uses for and methods for providing nucleotide sequences in a variety of media is well known in the art (see e.g., EPO Publication No. EP 0 756 006).

In one application of this embodiment, a nucleotide sequence of the present invention can be recorded on computer readable media. As used herein, "computer readable media" refers to any media which can be read and accessed directly by a computer. Such media include, but are not limited to: magnetic storage media, such as floppy discs, hard disc storage media, and magnetic tape; optical storage media such as CD-ROM; electrical storage media such as RAM and ROM; and hybrids of these categories such as magnetic/optical storage media. A person skilled in the art can readily appreciate how any of the presently known computer readable media can be used to create a manufacture comprising computer readable media having recorded thereon a nucleotide sequence of the present invention.

As used herein, "recorded" refers to a process for storing information on computer readable media. A person skilled in the art can readily adopt any of the presently known methods for recording information on computer readable media to generate manufactures comprising the nucleotide sequence information of the present invention.

A variety of data storage structures are available to a person skilled in the art for creating a computer readable media having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A person skilled in the art can readily adapt any number of data processor structuring formats (e.g. text file or database) in order to obtain computer readable media having recorded thereon the nucleotide sequence information of the present invention.

By providing the nucleotide sequence of SEQ ID NO: 1–SEQ ID NO: 4172, a fragment thereof, or a nucleotide sequence at least about 99.5% identical to SEQ ID NO: 1–SEQ ID NO: 4172 in computer readable form, a person skilled in the art can routinely access the coding sequence information for a variety of purposes. Computer software is publicly available which allows a person skilled in the art to access sequence information provided in a computer readable media. Examples of such computer software include programs of the "Staden Package", "DNA Star", "MacVector", GCG "Wisconsin Package" (Genetics Computer Group, Madison, Wis.) and "NCBI Toolbox" (National Center For Biotechnology Information). Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Computer algorithms enable the identification of *P. mirabilis* open reading frames (ORFs) within SEQ ID NO: 1–SEQ ID NO: 4172 which contain homology to ORFs or proteins from other organisms. Examples of such similarity-search algorithms include the BLAST [Altschul et al., J. Mol. Biol. 215:403–410(1990)] and Smith-Waterman [Smith and Waterman (1981) Advances in Applied Mathematics, 2:482–489] search algorithms. Suitable search algorithms are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997). Such algorithms are utilized on computer systems as exemplified below. The ORFs so identified represent protein encoding fragments within the *P. mirabilis* genome and are useful in producing commercially important proteins such as enzymes used in fermentation reactions and in the production of commercially useful metabolites.

The present invention further provides systems, particularly computer-based systems, which contain the sequence information described herein. Such systems are designed to identify commercially important fragments of the *P. mirabilis* genome. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A person skilled in the art can readily appreciate that any one of the currently available computer-based systems is suitable for use in the present invention. The computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the *P. mirabilis* genome which are similar to, or "match", a particular target sequence or target motif. A variety of known algorithms are known in the art and have been disclosed publicly, and a variety of commercially available software for conducting homology-based similarity searches are available and can be used in the computer-based systems of the present invention. Examples of such software includes, but is not limited to, FASTA (GCG Wisconsin Package), Bic_SW (Compugen Bioccelerator), BLASTN2, BLASTP2, BLASTX2 (NCBI) and Motifs (GCG). Suitable software programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology. Tools for Genomic and Molecular Research*, American Society for Microbiology, Washington, D.C. (1997). A person skilled in the art can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A person skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that many genes are longer than 500 amino acids, or 1.5 kb in length, and that commercially important fragments of the *P. mirabilis* genome, such as sequence fragments involved in gene expression and protein processing, will often be shorter than 30 nucleotides.

As used herein, "a target structural motif," or "target motif," refers to any rationally selected sequence or combination of sequences in which the sequence(s) are chosen based on a specific functional domain or three-dimensional configuration which is formed upon the folding of the target polypeptide. There are a variety of target motifs known in the art. Protein target motifs include, but are not limited to, enzymatic active sites, membrane-spanning regions, and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the P. mirabilis genome possessing varying degrees of homology to the target sequence or target motif Such presentation provides a person skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the P. mirabilis genome. In the present examples, implementing software which implement the BLASTP2 and bic_SW algorithms (Altschul et al., J Mol. Biol. 215:403–410(1990); Compugen Biocellerator) was used to identify open reading frames within the P. mirabilis genome. A person skilled in the art can readily recognize that any one of the publicly available homology search programs can be used as the search means for the computer-based systems of the present invention. Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

The invention features P. mirabilis polypeptides, preferably a substantially pure preparation of an P. mirabilis polypeptide, or a recombinant P. mirabilis polypeptide. In preferred embodiments: the polypeptide has biological activity; the polypeptide has an amino acid sequence at least about 60%, 70%, 80%, 90%, 95%, 98%, or 99% identical to an amino acid sequence of the invention contained in the Sequence Listing, preferably it has about 65% sequence identity with an amino acid sequence of the invention contained in the Sequence Listing, and most preferably it has about 92% to about 99% sequence identity with an amino acid sequence of the invention contained in the Sequence Listing; the polypeptide has an amino acid sequence essentially the same as an amino acid sequence of the invention contained in the Sequence Listing; the polypeptide is at least about 5, 10, 20, 50, 100, or 150amino acid residues in length; the polypeptide includes at least about 5, preferably at least about 0, more preferably at least about 20, still more preferably at least about 50, 100, or 150 contiguous amino acid residues of the invention contained in the Sequence Listing. In yet another preferred embodiment, the amino acid sequence which differs in sequence identity by about 7% to about 8% from the P. mirabilis amino acid sequences of the invention contained in the Sequence Listing is also encompassed by the invention.

In preferred embodiments: the P. mirabilis polypeptide is encoded by a nucleic acid of the invention contained in the Sequence Listing, or by a nucleic acid having at least about 60%, 70%, 80%, 90%, 95%, 98%, or 99% homology with a nucleic acid of the invention contained in the Sequence Listing.

In a preferred embodiment, the subject P. mirabilis polypeptide differs in amino acid sequence at about 1, 2, 3, 5, 10 or more residues from a sequence of the invention contained in the Sequence Listing. The differences, however, are such that the P. mirabilis polypeptide exhibits an P. mirabilis biological activity, e.g., the P. mirabilis polypeptide retains a biological activity of a naturally occurring P. mirabilis enzyme.

In preferred embodiments, the polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

In yet other preferred embodiments, the P. mirabilis polypeptide is a recombinant fusion protein having a first P. mirabilis polypeptide portion and a second polypeptide portion, e.g., a second polypeptide portion having an amino acid sequence unrelated to P. mirabilis. The second polypeptide portion can be, e.g., any of glutathione-S-transferase, a DNA binding domain, or a polymerase activating domain. In preferred embodiment the fusion protein can be used in a two-hybrid assay.

Polypeptides of the invention include those which arise as a result of alternative transcription events, alternative RNA splicing events, and alternative translational and postranslational events.

In a preferred embodiment, the encoded P. mirabilis polypeptide differs (e.g., by amino acid substitution, addition or deletion of at least one amino acid residue) in amino acid sequence at about 1, 2, 3, 5, 10 or more residues, from a sequence of the invention contained in the Sequence Listing. The differences, however, are such that: the P. mirabilis encoded polypeptide exhibits an P. mirabilis biological activity, e.g., the encoded P. mirabilis enzyme retains a biological activity of a naturally occurring P. mirabilis.

In preferred embodiments, the encoded polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

The P. mirabilis strain, 16525, from which genomic sequences have been sequenced, has been deposited on Jul. 20, 1998, in the American Type Culture Collection and assigned the ATCC designation #202157.

Included in the invention are: allelic variations; natural mutants; induced mutants; proteins encoded by DNA that hybridize under high or low stringency conditions to a nucleic acid which encodes a polypeptide of the invention contained in the Sequence Listing (for definitions of high and low stringency see Current Protocols in Molecular Biology, John Wiley & Sons, New York, 1989, 6.3.1–6.3.6, hereby incorporated by reference); and, polypeptides specifically bound by antisera to P. mirabilis polypeptides, especially by antisera to an active site or binding domain of P. mirabilis polypeptide. The invention also includes fragments, preferably biologically active fragments. These and other polypeptides are also referred to herein as P. mirabilis polypeptide analogs or variants.

The invention further provides nucleic acids, e.g., RNA or DNA and their respective complements, encoding a polypeptide of the invention. This includes double stranded nucleic acids as well as coding and antisense single strands.

In preferred embodiments, the subject P. mirabilis nucleic acid will include a transcriptional regulatory sequence, e.g., at least one of a transcriptional promoter or transcriptional enhancer sequence, operably linked to the P. mirabilis gene sequence, e.g., to render the P. mirabilis gene sequence suitable for expression in a recombinant host cell.

In yet a further preferred embodiment, the nucleic acid which encodes an P. mirabilis polypeptide of the invention, hybridizes under stringent conditions to a nucleic acid probe corresponding to at least about 8 consecutive nucleotides of the invention contained in the Sequence Listing; more preferably to at least about 12 consecutive nucleotides of the invention contained in the Sequence Listing; still more preferably to at least about 20 consecutive nucleotides of the invention contained in the Sequence Listing; most preferably to at least about 40 consecutive nucleotides of the invention contained in the Sequence Listing.

In another aspect, the invention provides a substantially pure nucleic acid having a nucleotide sequence which encodes an P. mirabilis polypeptide. In preferred embodiments: the encoded polypeptide has biological activity; the encoded polypeptide has an amino acid sequence at least about 60%, 70%, 80%, 90%, 95%, 98% or 99% homologous to an amino acid sequence of the invention contained in the Sequence Listing; the encoded polypeptide has an amino acid sequence essentially the same as an amino acid sequence of the invention contained in the Sequence Listing; the encoded polypeptide is at least about 5, 10, 20, 50, 100, or 150 amino acids in length; the encoded polypeptide comprises at least about 5, preferably at least about 10, more preferably at least about 20, still more preferably at least about 50, 100, or 150 contiguous amino acids of the invention contained in the Sequence Listing.

In another aspect, the invention encompasses: a vector including a nucleic acid which encodes an P. mirabilis polypeptide or an P. mirabilis polypeptide variant as described herein; a host cell transfected with the vector; and a method of producing a recombinant P. mirabilis polypeptide or P. mirabilis polypeptide variant; including culturing the cell, e.g., in a cell culture medium, and isolating an P. mirabilis or P. mirabilis polypeptide variant, e.g., from the cell or from the cell culture medium.

One embodiment of the invention is directed to substantially isolated nucleic acids. Nucleic acids of the invention include sequences comprising at least about 8 nucleotides in length, more preferably at least about 12 nucleotides in length, even more preferably at least about 15–20 nucleotides in length, that correspond to a subsequence of any one of SEQ ID NO: 1–SEQ ID NO: 4172 or complements thereof. Alternatively, the nucleic acids comprise sequences contained within any ORF (open reading frame), including a complete protein-coding sequence, of which any of SEQ ID NO: 1–SEQ ID NO: 4172 forms a part. The invention encompasses sequence-conservative variants and function-conservative variants of these sequences. The nucleic acids may be DNA, RNA, DNA/RNA duplexes, protein-nucleic acid (PNA), or derivatives thereof.

In another aspect, the invention features a purified recombinant nucleic acid having at least about 50%, 60%, 70%, 80%, 90%, 95%, 98%, or 99% homology with a sequence of the invention contained in the Sequence Listing The invention also encompasses recombinant DNA (including DNA cloning and expression vectors) comprising these P. mirabilis-derived sequences; host cells comprising such DNA, including fungal, bacterial, yeast, plant, insect, and mammalian host cells; and methods for producing expression products comprising RNA and polypeptides encoded by the P. mirabilis sequences. These methods are carried out by incubating a host cell comprising an P. mirabilis-derived nucleic acid sequence under conditions in which the sequence is expressed. The host cell may be native or recombinant. The polypeptides can be obtained by (a) harvesting the incubated cells to produce a cell fraction and a medium fraction; and (b) recovering the P. mirabilis polypeptide from the cell fraction, the medium fraction, or both. The polypeptides can also be made by in vitro translation.

In another aspect, the invention features nucleic acids capable of binding mRNA of P. mirabilis. Such nucleic acid is capable of acting as antisense nucleic acid to control the translation of mRNA of P. mirabilis. A further aspect features a nucleic acid which is capable of binding specifically to an P. mirabilis nucleic acid. These nucleic acids are also referred to herein as complements and have utility as probes and as capture reagents.

In another aspect, the invention features an expression system comprising an open reading frame corresponding to P. mirabilis nucleic acid. The nucleic acid further comprises a control sequence compatible with an intended host. The expression system is useful for making polypeptides corresponding to P. mirabilis nucleic acid.

In another aspect, the invention encompasses: a vector including a nucleic acid which encodes an P. mirabilis polypeptide or an P. mirabilis polypeptide variant as described herein; a host cell transfected with the vector; and a method of producing a recombinant P. mirabilis polypeptide or P. mirabilis polypeptide variant; including culturing the cell, e.g., in a cell culture medium, and isolating the P. mirabilis or P. mirabilis polypeptide variant, e.g., from the cell or from the cell culture medium.

In yet another embodiment of the invention encompasses reagents for detecting bacterial infection, including P. mirabilis infection, which comprise at least one P. mirabilis-derived nucleic acid defined by any one of SEQ ID NO: 1–SEQ ID NO:4172, or sequence-conservative or function-conservative variants thereof. Alternatively, the diagnostic reagents comprise nucleotide sequences that are contained within any open reading frames (ORFs), including preferably complete protein-coding sequences, contained within any of SEQ ID NO: 1–SEQ ID NO:4172, or polypeptide sequences contained within any of SEQ ID NO: 4173–SEQ ID NO: 8344, or polypeptides of which any of the above sequences forms a part, or antibodies directed against any of the above peptide sequences or function-conservative variants and/or fragments thereof.

The invention further provides antibodies, preferably monoclonal antibodies, which specifically bind to the polypeptides of the invention. Methods are also provided for producing antibodies in a host animal. The methods of the invention comprise immunizing an animal with at least one P. mirabilis-derived immunogenic component, wherein the immunogenic component comprises one or more of the polypeptides encoded by any one of SEQ ID NO: 1–SEQ ID NO: 4172 or sequence-conservative or function-conservative variants thereof; or polypeptides that are contained within any ORFs, including complete protein-coding sequences, of which any of SEQ ID NO: 1–SEQ ID NO: 4172 forms a part; or polypeptide sequences contained within any of SEQ ID NO: 4173–SEQ ID NO: 8344; or polypeptides of which any of SEQ ID NO: 4173–SEQ ID NO: 8344 forms a part. Host animals include any warm blooded animal, including without limitation mammals and birds. Such antibodies have utility as reagents for immunoassays to evaluate the abundance and distribution of *P. mirabilis*-specific antigens.

In yet another aspect, the invention provides diagnostic methods for detecting *P. mirabilis* antigenic components or anti-*P. mirabilis* antibodies in a sample. *P. mirabilis* antigenic components may be detected by known processes, including but not limited to detection by a process comprising: (i) contacting a sample suspected to contain a bacterial antigenic component with a bacterial-specific antibody, under conditions in which a stable antigen-antibody complex can form between the antibody and bacterial antigenic components in the sample; and (ii) detecting any antigen-antibody complex formed in step (i), wherein detection of an antigen-antibody complex indicates the presence of at least one bacterial antigenic component in the sample. In different embodiments of this method, the antibodies used are directed against a sequence encoded by any of SEQ ID NO: 1–SEQ ID NO: 4172 or sequence-conservative or function-conservative variants thereof, or against a polypeptide sequence contained in any of SEQ ID NO: 4173–SEQ ID NO: 8344 or function-conservative variants thereof.

In yet another aspect, the invention provides a method for detecting antibacterial-specific antibodies in a sample, which comprises: (i) contacting a sample suspected to contain antibacterial-specific antibodies with an *P. mirabilis* antigenic component, under conditions in which a stable antigen-antibody complex can form between the *P. mirabilis* antigenic component and antibacterial antibodies in the sample; and (ii) detecting any antigen-antibody complex formed in step (i), wherein detection of an antigen-antibody complex indicates the presence of antibacterial antibodies in the sample. In different embodiments of this method, the antigenic component is encoded by a sequence contained in any of SEQ ID NO: 1–SEQ ID NO: 4172 or sequence-conservative and function-conservative variants thereof, or is a polypeptide sequence contained in any of SEQ ID NO: 4173–SEQ ID NO: 8344 or function-conservative variants thereof.

In another aspect, the invention features a method of generating vaccines for immunizing an individual against *P. mirabilis*. The method includes: immunizing a, subject with an *P. mirabilis* polypeptide, e.g., a surface or secreted polypeptide, or a combination of such peptides or active portion(s) thereof, and a pharmaceutically acceptable carrier. Such vaccines have therapeutic and prophylactic utilities.

In another aspect, the invention features a method of evaluating a compound, e.g., a polypeptide, e.g., a fragment of a host cell polypeptide, for the ability to bind an *P. mirabilis* polypeptide. The method includes contacting the compound to be evaluated with an *P. mirabilis* polypeptide and determining if the compound binds or otherwise interacts with the *P. mirabilis* polypeptide. Compounds which bind or otherwise interact with *P. mirabilis* polypeptides are candidates as modulators, including activators and inhibitors, of the bacterial life cycle. These assays can be performed in vitro or in vivo.

In another aspect, the invention features a method of evaluating a compound, e.g., a polypeptide, e.g., a fragment of a host cell polypeptide, for the ability to bind an *P. compound to be evaluated with an P. mirabilis nucleic acid and determining if the compound binds or otherwise interacts with the P. mirabilis nucleic acid.* Compounds which bind *P. mirabilis* are candidates as modultors, including activators and inhibitors, of the bacterial life cycle. These assays can be performed in vitro or in vivo.

A particularly preferred embodiment of the invention is directed to a method of screening test compounds for anti-bacterial activity, which method comprises: selecting as a target a bacterial specific sequence, which sequence is essential to the viability of a bacterial species; contacting a test compound with said target sequence; and selecting those test compounds which bind to said target sequence as potential anti-bacterial candidates. In one embodiment, the target sequence selected is specific to a single species, or even a single strain, such as, for example, the strain *P. mirabilis* 16525. In a second embodiment, the target sequence is common to at least two species of bacteria. In a third embodiment, the target sequence is common to a family of bacteria. The target sequence may be a nucleic acid sequence or a polypeptide sequence. Methods employing sequences common to more than one species of microorganism may be used to screen candidates for broad spectrum anti-bacterial activity.

The invention also provides methods for preventing or treating disease caused by certain bacteria, including *P. mirabilis*, which are carried out by administering to an animal in need of such treatment, in particular a warm-blooded vertebrate, including but not limited to birds and mammals, a compound that specifically inhibits or interferes with the function of a bacterial polypeptide or nucleic acid. In a particularly preferred embodiment, the mammal to be treated is human.

DETAILED DESCRIPTION OF THE INVENTION

The sequences of the present invention include the specific nucleic acid and amino acid sequences set forth in the Sequence Listing that forms a part of the present specification, and which are designated SEQ ID NO: 1–SEQ ID NO: 8344. Use of the terms "SEQ ID NO: 1–SEQ ID NO: 4172", "SEQ ID NO: 4173–SEQ ID NO: 8344, "the sequences depicted in Table 2", etc., is intended, for convenience, to refer to each individual SEQ ID NO individually, and is not intended to refer to the genus of these sequences unless such reference would be indicated. In other words, it is a shorthand for listing all of these sequences individually. The invention encompasses each sequence individually, as well as any combination thereof.

DEFINITIONS

"Nucleic acid" or "polynucleotide" as used herein refers to purine- and pyrimidine-containing polymers of any length, either polyribonucleotides or polydeoxyribonucleotides or mixed polyribo-polydeoxyribo nucleotides. This includes single- and double-stranded molecules, i.e., DNA-DNA, DNA-RNA and RNA-RNA hybrids, as well as "protein nucleic acids" (PNA) formed by conjugating bases to an amino acid backbone. This also includes nucleic acids containing modified bases.

A nucleic acid or polypeptide sequence that is "derived from" a designated sequence refers to a sequence that corresponds to a region of the designated sequence. For nucleic acid sequences, this encompasses sequences that are homologous or complementary to the sequence, as well as "sequence-conservative variants" and "function-conservative variants." For polypeptide sequences, this encompasses "function-conservative variants." Sequence-conservative variants are those in which a change of one or more nucleotides in a given codon position results in no alteration in the amino acid encoded at that position. Function-conservative variants are those in which a given amino acid residue in a polypeptide has been changed without altering the overall conformation and function of the native polypeptide, including, but not limited to, replacement of an amino acid with one having similar physicochemical properties (such as, for example, acidic, basic, hydrophobic, and the like). "Function-conservative" variants also include any polypeptides that have the ability to elicit antibodies specific to a designated polypeptide.

An "*P. mirabilis*-derived" nucleic acid or polypeptide sequence may or may not be present in other bacterial species, and may or may not be present in all *P. mirabilis* strains. This term is intended to refer to the source from which the sequence was originally isolated. Thus, an *P. mirabilis*-derived polypeptide, as used herein, may be used, e.g., as a target to screen for a broad spectrum antibacterial agent, to search for homologous proteins in other species of bacteria or in eukaryotic organisms such as bacteria humans, etc.

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it. Preferably, the polypeptide constitutes at least about 10, 20, 50 70, 80 or 95% dry weight of the purified preparation. Preferably, the preparation contains sufficient polypeptide to allow protein sequencing; at least about 1, 10, or preferably 100 mg of polypeptide.

A purified preparation of cells refers to, in the case of plant or animal cells, an in vitro preparation of cells and not an entire intact plant or animal. In the case of cultured cells or microbial cells, it consists of a preparation of at least about 10%, more preferably at least about 50%, of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally-occurring genome of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant DNA which is part of a hybrid gene encoding additional *P. mirabilis* DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA, synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitro-cellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared× 100. For example, if 6 of 10 of the positions in two sequences are matched or homologous then the two sequences are 60% homologous. By way of example, the DNA sequences ATTGCC and TATGGC share 50% homology. Generally, a comparison is made when two sequences are aligned to give maximum homology.

Nucleic acids are hybridizable to each other when at least one strand of a nucleic acid can anneal to the other nucleic acid under defined stringency conditions. Stringency of hybridization is determined by: (a) the temperature at which hybridization and/or washing is performed; and (b) the ionic strength and polarity of the hybridization and washing solutions. Hybridization requires that the two nucleic acids contain complementary sequences; depending on the stringency of hybridization, however, mismatches may be tolerated. Typically, hybridization of two sequences at high stringency (such as, for example, in a solution of 0.5×SSC, at 65° C.) requires that the sequences be essentially completely homologous. Conditions of intermediate stringency (such as, for example, 2×SSC at 65° C.) and low stringency (such as, for example 2×SSC at 55° C.) require correspondingly less overall complementarity between the hybridizing sequences. (1×SSC is 0.15 M NaCl, 0.015 M Na citrate).

The terms peptides, proteins, and polypeptides are used interchangeably herein.

As used herein, the term "surface protein" refers to all surface accessible proteins, e.g. inner and outer membrane proteins, proteins adhering to the cell wall, and secreted proteins.

A polypeptide has *P. mirabilis* biological activity if it has one, two or preferably more of the following properties: (1) if when expressed in the course of an *P. mirabilis* infection, it can promote, or mediate the attachment of *P. mirabilis* to a cell; (2) it has an enzymatic activity, structural or regulatory function characteristic of an *P. mirabilis* protein; (3) the gene which encodes it can rescue a lethal mutation in an *P. mirabilis* gene. A polypeptide has biological activity if it is an antagonist, agonist, or super-agonist of a polypeptide having one of the above-listed properties.

A biologically active fragment or analog is one having an in vivo or in vitro activity which is characteristic of the *P. mirabilis* polypeptides of the invention contained in the Sequence Listing, or of other naturally occurring *P. mirabilis* polypeptides, e.g., one or more of the biological activities described herein. Especially preferred are fragments which exist in vivo, e.g., fragments which arise from post transcriptional processing or which arise from translation of alternatively spliced RNA's. Fragments include those expressed in native or endogenous cells as well as those made in expression systems, e.g., in CHO (Chinese Hamster Ovary) cells. Because peptides such as *P. mirabilis* polypeptides often exhibit a range of physiological properties and because such properties may be attributable to different portions of the molecule, a useful *P. mirabilis* fragment or *P. mirabilis* analog is one which exhibits a biological activity in any biological assay for *P. mirabilis* activity. The fragment or analog possesses about 10%, preferably about 40%, more preferably about 60%, 70%, 80% or 90% or greater of the activity of *P. mirabilis*, in any in vivo or in vitro assay.

Analogs can differ from naturally occurring *P. mirabilis* polypeptides in amino acid sequence or in ways that do not involve sequence, or both. Non-sequence modifications include changes in acetylation, methylation, phosphorylation, carboxylation, or glycosylation. Preferred analogs include *P. mirabilis* polypeptides (or biologically active fragments thereof) whose sequences differ from the wild-type sequence by one or more conservative amino acid substitutions or by one or more non-conservative amino acid substitutions, deletions, or insertions which do not substantially diminish the biological activity of the *P. mirabilis* polypeptide. Conservative substitutions typically include the substitution of one amino acid for another with similar characteristics, e.g., substitutions within the following groups: valine, glycine; glycine, alanine; valine, isoleucine, leucine; aspartic acid, glutamic acid; asparagine, glutamine; serine, threonine; lysine, arginine; and phenylalanine, tyrosine. Other conservative substitutions can be made in view of the table below.

TABLE 1

CONSERVATIVE AMINO ACID REPLACEMENTS

| For Amino Acid | Code | Replace with any of |
|---|---|---|
| Alanine | A | D-Ala, Gly, beta-Ala, L-Cys, D-Cys |
| Arginine | R | D-Arg, Lys, D-Lys, homo-Arg, D-homo-Arg, Met, Ile, D-Met, D-Ile, Orn, D-Orn |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me-Cys, Met, D-Met, Thr, D-Thr |
| Glutamine | Q | D-Gln, Asn, D-Asn, Glu, D-Glu, Asp, D-Asp |
| Glutamic Acid | E | D-Glu, D-Asp, Asp, Asn, D-Asn, Gln, D-Gln |
| Glycine | G | Ala, D-Ala, Pro, D-Pro, β-Ala, Acp |
| Isoleucine | I | D-Ile, Val, D-Val, Leu, D-Leu, Met, D-Met |
| Leucine | L | D-Leu, Val, D-Val, Leu, D-Leu, Met, D-Met |
| Lysine | K | D-Lys, Arg, D-Arg, homo-Arg, D-homo-Arg, Met, D-Met, Ile, D-Ile, Orn, D-Orn |
| Methionine | M | D-Met, S-Me-Cys, Ile, D-Ile, Leu, D-Leu, Val, D-Val |
| Phenylalanine | F | D-Phe, Tyr, D-Thr, L-Dopa, His, D-His, Trp, D-Trp, Trans-3,4, or 5-phenylproline, cis-3,4, or 5-phenylproline |
| Proline | P | D-Pro, L-I-thioazolidine-4-carboxylic acid, D- or L-1-oxazolidine-4-carboxylic acid |
| Serine | S | D-Ser, Thr, D-Thr, allo-Thr, Met, D-Met, Met(O), D-Met(O), L-Cys, D-Cys |
| Threonine | T | D-Thr, Ser, D-Ser, allo-Thr, Met, D-Met, Met(O), D-Met(O), Val, D-Val |
| Tyrosine | Y | D-Tyr, Phe, D-Phe, L-Dopa, His, D-His |
| Valine | V | D-Val, Leu, D-Leu, Ile, D-Ile, Met, D-Met |

Other analogs within the invention are those with modifications which increase peptide stability; such analogs may contain, for example, one or more non-peptide bonds (which replace the peptide bonds) in the peptide sequence. Also included are: analogs that include residues other than naturally occurring L-amino acids, e.g., D-amino acids or non-naturally occurring or synthetic amino acids, e.g., β or γ amino acids; and cyclic analogs.

As used herein, the term "fragment", as applied to an *P. mirabilis* analog, will ordinarily be at least about 20 residues, more typically at least about 40 residues, preferably at least about 60 residues in length. Fragments of *P. mirabilis* polypeptides can be generated by methods known to those skilled in the art. The ability of an Proteus fragment to exhibit a biological activity of *P. mirabilis* polypeptide can be assessed by methods known to those skilled in the art as described herein. Also included are *P. mirabilis* polypeptides containing residues that are not required for biological activity of the peptide or that result from alternative mRNA splicing or alternative protein processing events.

An "immunogenic component" as used herein is a moiety, such as an *P. mirabilis* polypeptide, analog or fragment thereof, that is capable of eliciting a humoral and/or cellular immune response in a host animal.

An "antigenic component" as used herein is a moiety, such as an *P. mirabilis* polypeptide, analog or fragment thereof, that is capable of binding to a specific antibody with sufficiently high affinity to form a detectable antigen-antibody complex.

The term "antibody" as used herein is intended to include fragments thereof which are specifically reactive with *P. mirabilis* polypeptides.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

Misexpression, as used herein, refers to a non-wild type pattern of gene expression. It includes: expression at non-wild type levels, i.e., over or under expression; a pattern of expression that differs from wild type in terms of the time or stage at which the gene is expressed, e.g., increased or decreased expression (as compared with wild type) at a predetermined developmental period or stage; a pattern of expression that differs from wild type in terms of increased expression (as compared with wild type) in a predetermined cell type or tissue type; a pattern of expression that differs from wild type in terms of the splicing size, amino acid sequence, post-translational modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

As used herein, "host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

The "metabolism" of a substance, as used herein, means any aspect of the expression, function, action, or regulation of the substance. The metabolism of a substance includes modifications, e.g., covalent or non-covalent modifications of the substance. The metabolism of a substance includes modifications, e.g., covalent or non-covalent modification, the substance induces in other substances. The metabolism of a substance also includes changes in the distribution of the substance. The metabolism of a substance includes changes the substance induces in the distribution of other substances.

A "sample" as used herein refers to a biological sample, such as, for example, tissue or fluid isloated from an individual (including without limitation plasma, serum, cerebrospinal fluid, lymph, tears, saliva and tissue sections) or from in vitro cell culture constituents, as well as samples from the environment.

Technical and scientific terms used herein have the meanings commonly understood by one of ordinary skill in the art to which the present invention pertains, unless otherwise defined. Reference is made herein to various methodologies known to those of skill in the art. Publications and other materials setting forth such known methodologies to which reference is made are incorporated herein by reference in their entireties as though set forth in full. The practice of the invention will employ, unless otherwise indicated, conventional techniques of chemistry, molecular biology, microbiology, recombinant DNA, and immunology, which are within the skill of the art. Such techniques are explained fully in the literature. See e.g., Sambrook, Fritsch, and Maniatis, *Molecular Cloning, Laboratory Manual* 2nd ed. (1989); *DNA Cloning*, Volumes I and II (D. N Glover ed. 1985); *Oligonucleotide Synthesis* (M. J. Gait ed, 1984); *Nucleic Acid Hybridization* (B. D. Hames & S. J. Higgins eds. 1984); the series, *Methods in Enzymoloqy* (Academic Press, Inc.), particularly Vol. 154 and Vol. 155 (Wu and Grossman, eds.); *PCR-A Practical Approach* (McPherson, Quirke, and Taylor, eds., 1991); *Immunology*, 2d Edition, 1989, Roitt et al., C. V. Mosby Company, and New York; *Advanced Immunology*, 2d Edition, 1991, Male et al., Grower Medical Publishing, New York.; *DNA Cloning: A Practical Approach*, Volumes I and II, 1985 (D. N. Glover ed.); *Oligonucleotide Synthesis*, 1984, (M. L. Gait ed); *Transcription and Translation*, 1984 (Hames and Higgins eds.); *Animal Cell Culture*, 1986 (R. I. Freshney ed.); *Immobilized Cells and Enzymes*, 1986 (IRL Press); Perbal, 1984, *A Practical Guide to Molecular Cloning; Gene Transfer Vectors for Mammalian Cells*, 1987 (J. H. Miller and M. P. Calos eds., Cold Spring Harbor Laboratory); Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Any suitable materials and/or methods known to those of skill can be utilized in carrying out the present invention; however, preferred materials and/or methods are described. Materials, reagents and the like to which reference is made in the following description and examples are obtainable from commercial sources, unless otherwise noted.

*P. Mirabilis* GENOMIC SEQUENCE

This invention provides nucleotide sequences of the genome of *P. mirabilis* which thus comprises a DNA sequence library of *P. mirabilis* genomic DNA. The detailed description that follows provides nucleotide sequences of *P. mirabilis*, and also describes how the sequences were obtained and how ORFs and protein-coding sequences were identified. Also described are compositions and methods of using the disclosed *P. mirabilis* sequences in methods including diagnostic and therapeutic applications. Furthermore, the library can be used as a database for identification and comparison of medically important sequences in this and other strains of *P. mirabilis*.

To determine the genomic sequence of *P. mirabilis*, DNA from strain 16525 of *P. mirabilis* was isolated after Zymolyase digestion, sodium dodecyl sulfate lysis, potassium acetate precipitation, phenol:chloroform extractionand ethanol precipitation (Soll, D. R., T. Srikantha and S. R. Lockhart: Characterizing Developmentally Regulated Genes in *P. mirabilis*. In Microbial Genome Methods. K. W. Adolph, editor. CRC Press. New York. p 17–37.). DNA was sheared hydrodynamically using an HPLC (Oefner, et. al., 1996) to an insert size of 2000–3000 bp. After size fractionation by gel electrophoresis the fragments were blunt-ended, ligated to adapter oligonucleotides and cloned into the pGTC (Thomann) vector to construct a "shotgun" subclone library.

DNA sequencing was achieved using established ABI sequencing methods on ABI377 automated DNA sequencers. The cloning and sequencing procedures are described in more detail in the Exemplification.

Individual sequence reads were assembled using PHRAP (P. Green, Abstracts of DOE Human Genome Program Contractor-Grantee Workshop V, Jan. 1996, p.157). The average contig length was about 3–4 kb.

All subsequent steps were based on sequencing by ABI377 automated DNA sequencing methods. The cloning and sequencing procedures are described in more detail in the Exemplification.

A variety of approaches may be used to order the contigs so as to obtain a continuous sequence representing the entire P. mirabilis genome. Synthetic oligonucleotides are designed that are complementary to sequences at the end of each contig. These oligonucleotides may be hybridized to libaries of P. mirabilis genomic DNA in, for example, lambda phage vectors or plasmid vectors to identify clones that contain sequences corresponding to the junctional regions between individual contigs. Such clones are then used to isolate template DNA and the same oligonucleotides are used as primers in polymerase chain reaction (PCR) to amplify junctional fragments, the nucleotide sequence of which is then determined.

The P. mirabilis sequences were analyzed for the presence of open reading frames (ORFs) comprising at least 180 nucleotides. As a result of the analysis of ORFs based on stop-to-stop codon reads, it should be understood that these ORFs may not correspond to the ORF of a naturally-occurring P. mirabilis polypeptide. These ORFs may contain start codons which indicate the initiation of protein synthesis of a naturally-occurring P. mirabilis polypeptide. Such start codons within the ORFs provided herein were identified by those of ordinary skill in the relevant art, and the resulting ORF and the encoded P. mirabilis polypeptide is within the scope of this invention. For example, within the ORFs a codon such as AUG or GUG (encoding methionine or valine) which is part of the initiation signal for protein synthesis were identified and the portion of an ORF to corresponding to a naturally-occurring P. mirabilis polypeptide was recognized. The predicted coding regions were defined by evaluating the coding potential of such sequences with the program GENEMARK™ (Borodovsky and McIninch, 1993, Comp., 17:123).

Each predicted ORF amino acid sequence was compared with all sequences found in current GENBANK, SWISS-PROT, and PIR databases using the BLAST algorithm. BLAST identifies local alignments occurring by chance between the ORF sequence and the sequence in the databank (Altschal et al., 1990, L Mol. Biol. 215:403–410). Homologous ORFs (probabilities less than $10^{-5}$ by chance) andORF's that are probably non-homologous (probabilities greater than $10^{-5}$ by chance) but have good codon usage were identified. Both homologous, sequences and non-homologous sequences with good codon usage, are likely to encode proteins and are encompassed by the invention.

P. Mirabilis NUCLEIC ACIDS

The present invention provides a library of P. mirabilis-derived nucleic acid sequences. The libraries provide probes, primers, and markers which are used as markers in epidemiological studies. The present invention also provides a library of P. mirabilis-derived nucleic acid sequences which comprise or encode targets for therapeutic drugs.

The nucleic acids of this invention may be obtained directly from the DNA of the above referenced P. mirabilis strain by using the polymerase chain reaction (PCR). See "PCR, A Practical Approach" (McPherson, Quirke, and Taylor, eds., IRL Press, Oxford, UK, 1991) for details about the PCR. High fidelity PCRis used to ensure a faithful DNA copy prior to expression. In addition, the authenticity of amplified products is verified by conventional sequencing methods. Clones carrying the desired sequences described in this invention may also be obtained by screening the libraries by means of the PCR or by hybridization of synthetic oligonucleotide probes to filter lifts of the library colonies or plaques as known in the art (see, e.g., Sambrook et al., Molecular Cloning, A Laboratory Manual 2nd edition, 1989, Cold Spring Harbor Press, N.Y.).

It is also possible to obtain nucleic acids encoding P. mirabilis polypeptides from a cDNA library in accordance with protocols herein described. A cDNA encoding an P. mirabilis polypeptide can be obtained by isolating total mRNA from an appropriate strain. Double stranded cDNAs can then be prepared from the total mRNA. Subsequently, the cDNAs can be inserted into a suitable plasmid or viral (e.g., bacteriophage) vector using any one of a number of known techniques. Genes encoding P. mirabilis polypeptides can also be cloned using established polymerase chain reaction techniques in accordance with the nucleotide sequence information provided by the invention. The nucleic acids of the invention can be DNA or RNA. Preferred nucleic acids of the invention are contained in the Sequence Listing.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

In another example, DNA can be chemically synthesized using, e.g., the phosphoramidite solid support method of Matteucci et al., 1981, J. Am. Chem. Soc. 103:3185, the method of Yoo et al., 1989, J. Biol. Chem. 764:17078, or other well known methods. This can be done by sequentially linking a series of oligonucleotide cassettes comprising pairs of synthetic oligonucleotides, as described below.

Nucleic acids isolated or synthesized in accordance with features of the present invention are useful, by way of example, without limitation, as probes, primers, capture ligands, antisense genes and for developing expression systems for the synthesis of proteins and peptides corresponding to such sequences. As probes, primers, capture ligands and antisense agents, the nucleic acid normally consists of all or part (approximately twenty or more nucleotides for specificity as well as the ability to form stable hybridization products) of the nucleic acids of the invention contained in the Sequence Listing. These uses are described in further detail below.

PROBES

A nucleic acid isolated or synthesized in accordance with the sequence of the invention contained in the Sequence Listing can be used as a probe to specifically detect P. mirabilis. With the sequence information set forth in the present application, sequences of twenty or more nucleotides are identified which provide the desired inclusivity and exclusivity with respect to P. mirabilis, and extraneous nucleic acids likely to be encountered during hybridization conditions. More preferably, the sequence will comprise at least about twenty to thirty nucleotides to convey stability to the hybridization product formed between the probe and the intended target molecules.

Sequences larger than 1000 nucleotides in length are difficult to synthesize but can be generated by recombinant DNA techniques. Individuals skilled in the art will readily recognize that the nucleic acids, for use as probes, can be provided with a label to facilitate detection of a hybridization product.

Nucleic acid isolated and synthesized in accordance with the sequence of the invention contained in the Sequence Listing can also be useful as probes to detect homologous regions (especially homologous genes) of other Proteus species using appropriate stringency hybridization conditions as described herein.

CAPTURE LIGAND

For use as a capture ligand, the nucleic acid selected in the manner described above with respect to probes, can be readily associated with a support. The manner in which nucleic acid is associated with supports is well known. Nucleic acid having twenty or more nucleotides in a sequence of the invention contained in the Sequence Listing have utility to separate P. mirabilis nucleic acid from one strain from the nucleic acid of other another strain as well as from other organisms. Nucleic acid having twenty or more nucleotides in a sequence of the invention contained in the Sequence Listing can also have utility to separate other Proteus species from each other and from other organisms. Preferably, the sequence will comprise at least about twenty nucleotides to convey stability to the hybridization product formed between the probe and the intended target molecules. Sequences larger than 1000 nucleotides in length are difficult to synthesize but can be generated by recombinant DNA techniques.

PRIMERS

Nucleic acid isolated or synthesized in accordance with the sequences described herein have utility as primers for the amplification of P. mirabilis nucleic acid. These nucleic acids may also have utility as primers for the amplification of nucleic acids in other Proteus species. With respect to polymerase chain reaction (PCR) techniques, nucleic acid sequences of $\geq$10–15 nucleotides of the invention contained in the Sequence Listing have utility in conjunction with suitable enzymes and reagents to create copies of P. mirabilis nucleic acid. More preferably, the sequence will comprise twenty or more nucleotides to convey stability to the hybridization product formed between the primer and the intended target molecules. Binding conditions of primers greater than 100 nucleotides are more difficult to control to obtain specificity. High fidelity PCR can be used to ensure a faithful DNA copy prior to expression. In addition, amplified products can be checked by conventional sequencing methods.

The copies can be used in diagnostic assays to detect specific sequences, including genes from P. mirabilis and/or other Proteus species. The copies can also be incorporated into cloning and expression vectors to generate polypeptides corresponding to the nucleic acid synthesized by PCR, as is described in greater detail herein.

The nucleic acids of the present invention find use as templates for the recombinant production of P. mirabilis-derived peptides or polypeptides

ANTISENSE

Nucleic acid or nucleic acid-hybridizing derivatives isolated or synthesized in accordance with the sequences described herein have utility as antisense agents to prevent the expression of P. mirabilis genes. These sequences also have utility as antisense agents to prevent expression of genes of other Proteus species.

In one embodiment, nucleic acid or derivatives corresponding to P. mirabilis nucleic acids is loaded into a suitable carrier such as a liposome or bacteriophage for introduction into bacterial cells. For example, a nucleic acid having twenty or more nucleotides is capable of binding to bacteria nucleic acid or bacteria messenger RNA. Preferably, the antisense nucleic acid is comprised of 20 or more nucleotides to provide necessary stability of a hybridization product of non-naturally occurring nucleic acid and bacterial nucleic acid and/or bacterial messenger RNA. Nucleic acid having a sequence greater than 1000 nucleotides in length is difficult to synthesize but can be generated by recombinant DNA techniques. Methods for loading antisense nucleic acid in liposomes is known in the art as exemplified by U.S. Pat. No. 4,241,046 issued Dec. 23, 1980 to Papahadjopoulos et al.

The present invention encompasses isolated polypeptides and nucleic acids derived from P. mirabilis that are useful as reagents for diagnosis of bacterial infection, components of effective anti-bacterial vaccines, and/or as targets for anti-bacterial drugs, including anti-P. mirabilis drugs.

EXPRESSION OF P. Mirabilis NUCLEIC ACIDS

Table 2, which is appended herewith and which forms part of the present specification, provides a list of open reading frames (ORFs) in both strands and a putative identification of the particular function of a polypeptide which is encoded by each ORF, based on the homology match (determined by the BLASTP2 algorithm) of the predicted polypeptide with known proteins encoded by ORFs in other organisms. An ORF is a region of nucleic acid which encodes a polypeptide. This region may represent a portion of a coding sequence or a total sequence and was determined from stop to stop codons. The first column contains a designation for the ORF ("ORF Name"). The second and third columns list the SEQ ID numbers for the nucleic acid ("NT ID") and amino acid ("AA ID") sequences corresponding to each ORF, respectively. The fourth and fifth columns list the length of the nucleic acid ORF ("NT Length") and the length of the amino acid ORF ("AA Length "), respectively. The nucleotide sequence corresponding to each ORF begins at the first nucleotide immediately following a stop codon and ends at the nucleotide immediately preceding the next downstream stop codon in the same reading frame. It will be recognized by one skilled in the art that the natural translation initiation sites will correspond to ATG, GTG, or TTG codons located within the ORFs. The natural initiation sites depend not only on the sequence of a start codon but also on the context of the DNA sequence adjacent to the start codon. Usually, a recognizable ribosome binding site is found within 20 nucleotides upstream from the initiation codon. In some cases where genes are translationally coupled and coordinately expressed together in "operons", ribosome binding sites are not present, but the initiation codon of a downstream gene may occur very close to, or overlap, the stop codon of the an upstream gene in the same operon. The correct start codons can be generally identified without undue experimentation because only a few codons need be tested. It is recognized that the translational machinery in bacteria initiates all polypeptide chains with the amino acid methionine, regardless of the sequence of the start codon. In some cases, polypeptides are post-translationally modified, resulting in an N-terminal amino acid other than methionine in vivo. The sixth and seventh columns provide metrics for assessing the likelihood of the homology match (determined by the BLASTP2 algorithm), as is known in the art, to the genes indicated in the description frame ("Description") defined further below. These genes in the Description were identified when the designated ORF was compared against a comprehensive non-redundant protein database. Specifically, the sixth column represents the Blast Score ("Score") for the match (a higher score is a better match), and the seventh column represents the probability ("Probability") for the match (the probability that such a match can have occurred by chance; the lower the value, the more likely the match is valid). If a BLASTP2 score of less than 100 was obtained, no value is reported in the table. The remaining fields below the columns contain additional information relating to the potential function of the sequence based on the BLASTP2 analysis. Where a match was discovered, the field "Protein name" list the protein's name identified from the match. In addition, one skilled in the art would be able to identify the match and elucidate its function using the "Locus name" and where available the accession number, "Acc#" from the database. Lastly, one skilled in the art would appreciate the "Description" field to further describe the potential function of the protein based on this analysis. This information allows one of ordinary skill in the art to determine a potential use for each identified coding sequence and, as a result, allows to use the polypeptides of the present invention for commercial and industrial purposes.

Using the information provided in SEQ ID NO: 1–SEQ ID NO:4172, SEQ ID NO: 4173–SEQ ID NO: 8344 and in Table 2 together with routine cloning and sequencing methods, one of ordinary skill in the art will be able to clone and sequence all the nucleic acid fragments of interest including open reading frames (ORFs) encoding a large variety of proteins of P. mirabilis.

Nucleic acid isolated or synthesized in accordance with the sequences described herein have utility to generate polypeptides. The nucleic acid of the invention exemplified in SEQ ID NO: 1–SEQ ID NO: 4172 and in Table 2 or fragments of said nucleic acid encoding active portions of P. mirabilis polypeptides can be cloned into suitable vectors or used to isolate nucleic acid. The isolated nucleic acid is combined with suitable DNA linkers and cloned into a suitable vector.

The function of a specific gene or operon can be ascertained by expression in a bacterial strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression can be accomplished in a mutant strain which lacks the activity of the gene to be tested, or in a strain that does not produce the same gene product(s). This includes, but is not limited to, Eucaryotic species such as the yeast *Saccharomyces cerevisiae*, Methanobacterium strains or other Archaea, and Eubacteria such as *E. coli, B. Subtilis, S. Aureus, S. Pneumonia* or *Pseudomonas putida*. In some cases the expression host will utilize the natural P. mirabilis promoter whereas in others, it will be necessary to drive the gene with a promoter sequence derived from the expressing organism (e.g., an E. coli beta-galactosidase promoter for expression in E. coli).

To express a gene product using the natural P. mirabilis promoter, a procedure such as the following can be used. A restriction fragment containing the gene of interest, together with its associated natural promoter element and regulatory sequences (identified using the DNA sequence data) is cloned into an appropriate recombinant plasmid containing an origin of replication that functions in the host organism and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by, for example, electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into an expression plasmid after treating the PCR product with a restriction enzyme or exonuclease to create suitable ends for cloning.

A suitable host cell for expression of a gene can be any procaryotic or eucaryotic cell. Suitable methods for transforming host cells can be found in Sambrook et al. (Molecular Cloning: A Laboratory Manual, 2nd Edition, Cold Spring Harbor Laboratory Press (1989)), and other laboratory textbooks.

For example, a host cell transfected with a nucleic acid vector directing expression of a nucleotide sequence encoding an P. mirabilis polypeptide can be cultured under appropriate conditions to allow expression of the polypeptide to occur. Suitable media for cell culture are well known in the art. Polypeptides of the invention can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such polypeptides. Additionally, in many situations, polypeptides can be produced by chemical cleavage of a native protein (e.g., tryptic digestion) and the cleavage products can then be purified by standard techniques.

In the case of membrane bound proteins, these can be isolated from a host cell by contacting a membrane-associated protein fraction with a detergent forming a solubilized complex, where the membrane-associated protein is no longer entirely embedded in the membrane fraction and is solubilized at least to an extent which allows it to be chromatographically isolated from the membrane fraction. Chromatographic techniques which can be used in the final purification step are known in the art and include hydrophobic interaction, lectin affinity, ion exchange, dye affinity and immunoaffinity.

One strategy to maximize recombinant P. mirabilis peptide expression in E. coli is to express the protein in a host bacteria with an impaired capacity to proteolytically cleave the recombinant protein (Gottesman, S., Gene Expression Technology: Methods in Enzymology 185, Academic Press, San Diego, Calif. (1990) 119–128). Another strategy would be to alter the nucleic acid encoding an P. mirabilis peptide to be inserted into an expression vector so that the individual codons for each amino acid would be those preferentially utilized in highly expressed E. coli proteins (Wada et al., (1992) *Nuc. Acids Res.* 20:2111–2118). Such alteration of nucleic acids of the invention can be carried out by standard DNA synthesis techniques.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See, e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

The present invention provides a library of *P. mirabilis*-derived nucleic acid sequences. The libraries provide probes, primers, and markers which can be used as markers in epidemiological studies. The present invention also provides a library of *P. mirabilis*-derived nucleic acid sequences which comprise or encode targets for therapeutic drugs.

Nucleic acids comprising any of the sequences disclosed herein or sub-sequences thereof can be prepared by standard methods using the nucleic acid sequence information provided in SEQ ID NO: 1–SEQ ID NO:4172. For example, DNA can be chemically synthesized using, e.g., the phosphoramidite solid support method of Matteucci el al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Of course, due to the degeneracy of the genetic code, many different nucleotide sequences can encode polypeptides having the amino acid sequences defined by SEQ ID NO: 4173–SEQ ID NO: 8344 or sub-sequences thereof. The codons can be selected for optimal expression in prokaryotic or eukaryotic systems. Such degenerate variants are also encompassed by this invention.

Insertion of nucleic acids (typically DNAs) encoding the polypeptides of the invention into a vector is easily accomplished when the termini of both the DNAs and the vector comprise compatible restriction sites. If this cannot be done, it may be necessary to modify the termini of the DNAs and/or vector by digesting back single-stranded DNA overhangs generated by restriction endonuclease cleavage to produce blunt ends, or to achieve the same result by filling in the single-stranded termini with an appropriate DNA polymerase.

Alternatively, any site desired may be produced, e.g., by ligating nucleotide sequences (linkers) onto the termini. Such linkers may comprise specific oligonucleotide sequences that define desired restriction sites. Restriction sites can also be generated by the use of the polymerase chain reaction (PCR). See, e.g., Saiki et al., 1988, *Science* 239:48. The cleaved vector and the DNA fragments may also be modified if required by homopolymeric tailing.

The nucleic acids of the invention may be isolated directly from cells. Alternatively, the polymerase chain reaction (PCR) method can be used to produce the nucleic acids of the invention, using either chemically synthesized strands or genomic material as templates. Primers used for PCR can be synthesized using the sequence information provided herein and can further be designed to introduce appropriate new restriction sites, if desirable, to facilitate incorporation into a given vector for recombinant expression.

The nucleic acids of the present invention may be flanked by natural *P. mirabilis* regulatory sequences, or may be associated with heterologous sequences, including promoters, enhancers, response elements, signal sequences, polyadenylation sequences, introns, 5'- and 3'-noncoding regions, and the like. The nucleic acids may also be modified by many means known in the art. Non-limiting examples of such modifications include methylation, "caps", substitution of one or more of the naturally occurring nucleotides with an analog, internucleotide modifications such as, for example, those with uncharged linkages (e.g., methyl phosphonates, phosphotriesters, phosphoroamidates, carbamates, etc.) and with charged linkages (e.g., phosphorothioates, phosphorodithioates, etc.). Nucleic acids may contain one or more additional covalently linked moieties, such as, for example, proteins (e.g., nucleases, toxins, antibodies, signal peptides, poly-L-lysine, etc.), intercalators (e.g., acridine, psoralen, etc.), chelators (e.g., metals, radioactive metals, iron, oxidative metals, etc.), and alkylators. PNAs are also included. The nucleic acid may be derivatized by formation of a methyl or ethyl phosphotriester or an alkyl phosphoramidate linkage. Furthermore, the nucleic acid sequences of the present invention may also be modified with a label capable of providing a detectable signal, either directly or indirectly. Exemplary labels include radioisotopes, fluorescent molecules, biotin, and the like.

The invention also provides nucleic acid vectors comprising the disclosed *P. mirabilis*-derived sequences or derivatives or fragments thereof. A large number of vectors, including plasmid and bacterial vectors, have been described for replication and/or expression in a variety of eukaryotic and prokaryotic hosts, and may be used for cloning or protein expression.

The encoded *P. mirabilis* polypeptides may be expressed by using many known vectors, such as pUC plasmids, pET plasmids (Novagen, Inc., Madison, Wis.), or pRSET or pREP (Invitrogen, San Diego, Calif.), and many appropriate host cells, using methods disclosed or cited herein or otherwise known to those skilled in the relevant art. The particular choice of vector/host is not critical to the practice of the invention.

Recombinant cloning vectors will often include one or more replication systems for cloning or expression, one or more markers for selection in the host, e.g. antibiotic resistance, and one or more expression cassettes. The inserted *P. mirabilis* coding sequences may be synthesized by standard methods, isolated from natural sources, or prepared as hybrids, etc. Ligation of the *P. mirabilis* coding sequences to transcriptional regulatory elements and/or to other amino acid coding sequences may be achieved by known methods. Suitable host cells may be transformed/transfected/infected as appropriate by any suitable method including electroporation, $CaCl_2$ mediated DNA uptake, bacterial infection, microinjection, microprojectile, or other established methods.

Appropriate host cells include bacteria, archebacteria, fungi, especially yeast, and plant and animal cells, especially mammalian cells. Of particular interest are *P. mirabilis, E. coli, B. Subtilis, Saccharomyces cerevisiae, Saccharomyces carlsbergensis, Schizosaccharomyces pombi*, SF9 cells, C129 cells, 293 cells, Neurospora, and CHO cells, COS cells, HeLa cells, and immortalized mammalian myeloid and lymphoid cell lines. Preferred replication systems include M13, ColE1, SV40, baculovirus, lambda, adenovirus, and the like. A large number of transcription initiation and termination regulatory regions have been isolated and shown to be effective in the transcription and translation of heterologous proteins in the various hosts. Examples of these regions, methods of isolation, manner of manipulation, etc. are known in the art. Under appropriate expression conditions, host cells can be used as a source of recombinantly produced *P. mirabilis*-derived peptides and polypeptides.

Advantageously, vectors may also include a transcription regulatory element (i.e., a promoter) operably linked to the P. mirabilis portion. The promoter may optionally contain operator portions and/or ribosome binding sites. Non-limiting examples of bacterial promoters compatible with E. coli include: b-lactamase (penicillinase) promoter; lactose promoter; tryptophan (trp) promoter; araBAD (arabinose) operon promoter; lambda-derived $P_1$ promoter and N gene ribosome binding site; and the hybrid tac promoter derived from sequences of the trp and lac UV5 promoters. Non-limiting examples of yeast promoters include 3-phosphoglycerate kinase promoter, glyceraldehyde-3-phosphate dehydrogenase (GAPDH) promoter, galactokinase (GAL1) promoter, galactoepimerase promoter, and alcohol dehydrogenase (ADH) promoter. Suitable promoters for mammalian cells include without limitation viral promoters such as that from Simian Virus 40 (SV40), Rous sarcoma virus (RSV), adenovirus (ADV), and bovine papilloma virus (BPV). Mammalian cells may also require terminator sequences, polyA addition sequences and enhancer sequences to increase expression. Sequences which cause amplification of the gene may also be desirable. Furthermore, sequences that facilitate secretion of the recombinant product from cells, including, but not limited to, bacteria, yeast, and animal cells, such as secretory signal sequences and/or prohormone pro region sequences, may also be included. These sequences are well described in the art.

Nucleic acids encoding wild-type or variant P. mirabilis-derived polypeptides may also be introduced into cells by recombination events. For example, such a sequence can be introduced into a cell, and thereby effect homologous recombination at the site of an endogenous gene or a sequence with substantial identity to the gene. Other recombination-based methods such as nonhomologous recombinations or deletion of endogenous genes by homologous recombination may also be used.

The nucleic acids of the present invention find use as templates for the recombinant production of P. mirabilis-derived peptides or polypeptides.

IDENTIFICATION AND USE OF P. Mirabilis NUCLEIC ACID SEQUENCES

The disclosed P. mirabilis polypeptide and nucleic acid sequences, or other sequences that are contained within ORFs, including complete protein-coding sequences, of which any of the disclosed P. mirabilis-specific sequences forms a part, are useful as target components for diagnosis and/or treatment of P. mirabilis-caused infection.

It will be understood that the sequence of an entire protein-coding sequence of which each disclosed nucleic acid sequence forms a part can be isolated and identified based on each disclosed sequence. This can be achieved, for example, by using an isolated nucleic acid encoding the disclosed sequence, or fragments thereof, to prime a sequencing reaction with genomic P. mirabilis DNA as template; this is followed by sequencing the amplified product. The isolated nucleic acid encoding the disclosed sequence, or fragments thereof, can also be hybridized to P. mirabilis genomic libraries to identify clones containing additional complete segments of the protein-coding sequence of which the shorter sequence forms a part. Then, the entire protein-coding sequence, or fragments thereof, or nucleic acids encoding all or part of the sequence, or sequence-conservative or function-conservative variants thereof, may be employed in practicing the present invention.

Preferred sequences are those that are useful in diagnostic and/or therapeutic applications. Diagnostic applications include without limitation nucleic-acid-based and antibody-based methods for detecting bacterial infection. Therapeutic applications include without limitation vaccines, passive immunotherapy, and drug treatments directed against gene products that are both unique to bacteria and essential for growth and/or replication of bacteria.

IDENTIFICATION OF NUCLEIC ACIDS ENCODING VACCINE COMPONENTS ND TARGETS FOR AGENTS EFFECTIVE AGAINST P. Mirabilis The disclosed P. mirabilis genome sequence includes segments that direct the synthesis of ribonucleic acids and polypeptides, as well as origins of replication, promoters, other types of regulatory sequences, and intergenic nucleic acids. The invention encompasses nucleic acids encoding immunogenic components of vaccines and targets for agents effective against P. mirabilis. Identification of said immunogenic components involved in the determination of the function of the disclosed sequences, which can be achieved using a variety of approaches. Non-limiting examples of these approaches are described briefly below.

HOMOLOGY TO KNOWN SEQUENCES

Computer-assisted comparison of the disclosed P. mirabilis sequences with previously reported sequences present in publicly available databases is useful for identifying functional P. mirabilis nucleic acid and polypeptide sequences. It will be understood that protein-coding sequences, for example, may be compared as a whole, and that a high degree of sequence homology between two proteins (such as, for example, >80–90%) at the amino acid level indicates that the two proteins also possess some degree of functional homology, such as, for example, among enzymes involved in metabolism, DNA synthesis, or cell wall synthesis, and proteins involved in transport, cell division, etc. In addition, many structural features of particular protein classes have been identified and correlate with specific consensus sequences, such as, for example, binding domains for nucleotides, DNA, metal ions, and other small molecules; sites for covalent modifications such as phosphorylation, acylation, and the like; sites of protein-:protein interactions, etc. These consensus sequences may be quite short and thus ay represent only a fraction of the entire protein-coding sequence. Identification of such a feature in an P. mirabilis sequence is therefore useful in determining the function of the encoded protein and identifying useful targets of antibacterial drugs.

Of particular relevance to the present invention are structural features that are common to secretory, transmembrane, and surface proteins, including secretion signal peptides and hydrophobic transmembrane domains. P. mirabilis proteins identified as containing putative signal sequences and/or transmembrane domains are useful as immunogenic components of vaccines.

Targets for therapeutic drugs according to the invention include, but are not limited to, polypeptides of the invention, whether unique to P. mirabilis or not, that are essential for growth and/or viability of P. mirabilis under at least one growth condition. Polypeptides essential for growth and/or viability can be determined by examining the effect of deleting and/or disrupting the genes, i.e., by so-called gene "knockout". Alternatively, genetic footprinting can be used (Smith et al., 1995, *Proc. Natl. Acad. Sci. USA*

92:5479–6433; Published International Application WO 94/26933; U.S. Pat. No. 5,612,180). Still other methods for assessing essentiality includes the ability to isolate conditional lethal mutations in the specific gene (e.g., temperature sensitive mutations). Other useful targets for therapeutic drugs, which include polypeptides that are not essential for growth or viability per se but lead to loss of viability of the cell, can be used to target therapeutic agents to cells.

STRAIN-SPECIFIC SEQUENCES

Because of the evolutionary relationship between different *P. mirabilis* strains, it is believed that the presently disclosed *P. mirabilis* sequences are useful for identifying, and/or discriminating between, previously known and new *P. mirabilis* strains. It is believed that other *P. mirabilis* strains will exhibit at least about 70% sequence homology with the presently disclosed sequence. Systematic and routine analyses of DNA sequences derived from samples containing *P. mirabilis* strains, and comparison with the present sequence allows for the identification of sequences that can be used to discriminate between strains, as well as those that are common to all *P. mirabilis* strains. In one embodiment, the invention provides nucleic acids, including probes, and peptide and polypeptide sequences that discriminate between different strains of *P. mirabilis*. Strain-specific components can also be identified functionally by their ability to elicit or react with antibodies that selectively recognize one or more *P. mirabilis* strains.

In another embodiment, the invention provides nucleic acids, including probes, and peptide and polypeptide sequences that are common to all *P. mirabilis* strains but are not found in other bacterial species.

*P. Mirabilis* POLYPEPTIDES

This invention encompasses isolated *P. mirabilis* polypeptides encoded by the disclosed *P. mirabilis* genomic sequences, including the polypeptides of the invention contained in the Sequence Listing. Polypeptides of the invention are preferably at least about 5 amino acid residues in length. Using the DNA sequence information provided herein, the amino acid sequences of the polypeptides encompassed by the invention can be deduced using methods well-known in the art. It will be understood that the sequence of an entire nucleic acid encoding an *P. mirabilis* polypeptide can be isolated and identified based on an ORF that encodes only a fragment of the cognate protein-coding region. This can be achieved, for example, by using the isolated nucleic acid encoding the ORF, or fragments thereof, to prime a polymerase chain reaction with genomic *P. mirabilis* DNA as template; this is followed by sequencing the amplified product.

The polypeptides of the present invention, including function-conservative variants of the disclosed ORFs, may be isolated from wild-type or mutant *P. mirabilis* cells, or from heterologous organisms or cells (including, but not limited to, bacteria, fungi, insect, plant, and mammalian cells) including *P. mirabilis* into which an *P. mirabilis*-derived protein-coding sequence has been introduced and expressed. Furthermore, the polypeptides may be part of recombinant fusion proteins.

*P. mirabilis* polypeptides of the invention can be chemically synthesized using commercially automated procedures such as those referenced herein, including, without limitation, exclusive solid phase synthesis, partial solid phase methods, fragment condensation or classical solution synthesis. The polypeptides are preferably prepared by solid phase peptide synthesis as described by Merrifield, 1963, *J. Am. Chem. Soc.* 85:2149. The synthesis is carried out with amino acids that are protected at the alpha-amino terminus. Trifunctional amino acids with labile side-chains are also protected with suitable groups to prevent undesired chemical reactions from occurring during the assembly of the polypeptides. The alpha-amino protecting group is selectively removed to allow subsequent reaction to take place at the amino-terminus. The conditions for the removal of the alpha-amino protecting group do not remove the side-chain protecting groups.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the *P. mirabilis* protein contains an additional sequence tag that facilitates purification, such as, but not limited to, a polyhistidine sequence. The polypeptide can then be purified from a crude lysate of the host cell by chromatography on an appropriate solid-phase matrix. Alternatively, antibodies produced against an *P. mirabilis* protein or against peptides derived therefrom can be used as purification reagents. Other purification methods are possible.

The present invention also encompasses derivatives and homologues of *P. mirabilis*-encoded polypeptides. For some purposes, nucleic acid sequences encoding the peptides may be altered by substitutions, additions, or deletions that provide for functionally equivalent molecules, i.e., function-conservative variants. For example, one or more amino acid residues within the sequence can be substituted by another amino acid of similar properties, such as, for example, positively charged amino acids (arginine, lysine, and histidine); negatively charged amino acids (aspartate and glutamate); polar neutral amino acids; and non-polar amino acids.

The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds.

To identify *P. mirabilis*-derived polypeptides for use in the present invention, essentially the complete genomic sequence of a virulent, methicillin-resistant isolate of *Proteus mirabilis* isolate was analyzed. While, in very rare instances, a nucleic acid sequencing error may be revealed, resolving a rare sequencing error is well within the art, and such an occurrence will not prevent one skilled in the art from practicing the invention.

Also encompassed are any *P. mirabilis* polypeptide sequences that are contained within the open reading frames (ORFs), including complete protein-coding sequences, of which any of SEQ ID NO: 1–SEQ ID NO: 4172 forms a part. Table 2, which is appended herewith and which forms part of the present specification, provides a putative identification of the particular function of a polypeptide which is encoded by each ORF, based on the homology match (determined by the BLAST algorithm) of the predicted polypeptide with known proteins encoded by ORFs in other organisms. As a result, one skilled in the art can use the polypeptides of the present invention for commercial and industrial purposes consistent with the type of putative identification of the polypeptide.

The present invention provides a library of P. mirabilis-derived polypeptide sequences, and a corresponding library of nucleic acid sequences encoding the polypeptides, wherein the polypeptides themselves, or polypeptides contained within ORFs of which they form a part, comprise sequences that are contemplated for use as components of vaccines. Non-limiting examples of such sequences are listed by SEQ ID NO in Table 2, which is appended herewith and which forms part of the present specification.

The present invention also provides a library of P. mirabilis-derived polypeptide sequences, and a corresponding library of nucleic acid sequences encoding the polypeptides, wherein the polypeptides themselves, or polypeptides contained within ORFs of which they form a part, comprise sequences lacking homology to any known prokaryotic or eukaryotic sequences. Such libraries provide probes, primers, and markers which can be used to diagnose P. mirabilis infection, including use as markers in epidemiological studies. Non-limiting examples of such sequences are listed by SEQ ID NO in Table 2, which is appended hereto and part hereof.

The present invention also provides a library of P. mirabilis-derived polypeptide sequences, and a corresponding library of nucleic acid sequences encoding the polypeptides, wherein the polypeptides themselves, or polypeptides contained within ORFs of which they form a part, comprise targets for therapeutic drugs.

SPECIFIC EXAMPLE: DETERMINATION OF PROTEUS PROTEIN ANTIGENS FOR ANTIBODY AND VACCINE DEVELOPMENT

The selection of Proteus protein antigens for vaccine development can be derived from the nucleic acids encoding P. mirabilis polypeptides. First, the ORF's can be analyzed for homology to other known exported or membrane proteins and analyzed using the discriminant analysis described by Klein, et al. (Klein, P., Kanehsia, M., and DeLisi, C. (1985) Biochimica et BiophysicaActa 815, 468–476) for predicting exported and membrane proteins.

Homology searches can be performed using the BLAST algorithm contained in the Wisconsin Sequence Analysis Package (Genetics Computer Group, University Research Park, 575 Science Drive, Madison, Wis. 53711) to compare each predicted ORF amino acid sequence with all sequences found in the current GenBank, SWISS-PROT and PIR databases. BLAST searches for local alignments between the ORF and the databank sequences and reports a probability score which indicates the probability of finding this sequence by chance in the database. ORF's with significant homology (e.g. probabilities lower than $1 \times 10^{-6}$ that the homology is only due to random chance) to membrane or exported proteins represent protein antigens for vaccine development. Possible functions can be provided to P. mirabilis genes based on sequence homology to genes cloned in other organisms.

Discriminant analysis (Klein, et al. supra) can be used to examine the ORF amino acid sequences. This algorithm uses the intrinsic information contained in the ORF amino acid sequence and compares it to information derived from the properties of known membrane and exported proteins. This comparison predicts which proteins will be exported, membrane associated or cytoplasmic. ORF amino acid sequences identified as exported or membrane associated by this algorithm are likely protein antigens for vaccine development.

PRODUCTION OF FRAGMENTS AND ANALOGS OF P. Mirabilis NUCLEIC ACIDS AND POLYPEPTIDES Based on the discovery of the P. mirabilis gene products of the invention provided in the Sequence Listing, one skilled in the art can alter the disclosed structure of P. mirabilis genes, e.g., by producing fragments or analogs, and test the newly produced structures for activity. Examples of techniques known to those skilled in the relevant art which allow the production and testing of fragments and analogs are discussed below. These, or analogous methods can be used to make and screen libraries of polypeptides, e.g., libraries of random peptides or libraries of fragments or analogs of cellular proteins for the ability to bind P. mirabilis polypeptides. Such screens are useful for the identification of inhibitors of P. mirabilis.

GENERATION OF FRAGMENTS

Fragments of a protein can be produced in several ways, e.g., recombinantly, by proteolytic digestion, or by chemical synthesis. Internal or terminal fragments of a polypeptide can be generated by removing one or more nucleotides from one end (for a terminal fragment) or both ends (for an internal fragment) of a nucleic acid which encodes the polypeptide. Expression of the mutagenized DNA produces polypeptide fragments. Digestion with "end-nibbling" endonucleases can thus generate DNAs which encode an array of fragments. DNAs which encode fragments of a protein can also be generated by random shearing, restriction digestion or a combination of the above-discussed methods.

Fragments can also be chemically synthesized using techniques known in the art such as conventional Merrifield solid phase f-Moc or t-Boc chemistry. For example, peptides of the present invention may be arbitrarily divided into fragments of desired length with no overlap of the fragments, or divided into overlapping fragments of a desired length.

ALTERATION OF NUCLEIC ACIDS AND POLYPEPTIDES: RANDOM METHODS

Amino acid sequence variants of a protein can be prepared by random mutagenesis of DNA which encodes a protein or a particular domain or region of a protein. Useful methods include PCR mutagenesis and saturation mutagenesis. A library of random amino acid sequence variants can also be generated by the synthesis of a set of degenerate oligonucleotide sequences. (Methods for screening proteins in a library of variants are elsewhere herein).

PCR MUTAGENESIS

In PCR mutagenesis, reduced Taq polymerase fidelity is used to introduce random mutations into a cloned fragment of DNA (Leung et al., 1989, Technique 1:11–15). The DNA region to be mutagenized is amplified using the polymerase chain reaction (PCR) under conditions that reduce the fidelity of DNA synthesis by Taq DNA polymerase, e.g., by using a dGTP/dATP ratio of five and adding $Mn^{2+}$ to the PCR reaction. The pool of amplified DNA fragments are inserted into appropriate cloning vectors to provide random mutant libraries.

SATURATION MUTAGENESIS

Saturation mutagenesis allows for the rapid introduction of a large number of single base substitutions into cloned DNA fragments (Mayers et al., 1985, Science 229:242). This technique includes generation of mutations, e.g., by chemical treatment or irradiation of single-stranded DNA in vitro, and synthesis of a complimentary DNA strand. The mutation frequency can be modulated by modulating the severity of the treatment, and essentially all possible base substitutions can be obtained. Because this procedure does not involve a genetic selection for mutant fragments both neutral substitutions, as well as those that alter function, are obtained. The distribution of point mutations is not biased toward conserved sequence elements.

DEGENERATE OLIGONUCLEOTIDES

A library of homologs can also be generated from a set of degenerate oligonucleotide sequences. Chemical synthesis of a degenerate sequences can be carried out in an automatic DNA synthesizer, and the synthetic genes then ligated into an appropriate expression vector. The synthesis of degenerate oligonucleotides is known in the art (see for example, Narang, S A (1983) *Tetrahedron* 39:3; Itakura et al. (1981) *Recombinant DNA, Proc* 3rd *Cleveland Sympos. Macromolecules*, ed. A G Walton, Amsterdam: Elsevier pp273–289; Itakura et al. (1984) *Annu. Rev. Biochem.* 53:323; Itakuraet al. (1984) *Science* 198:1056; Ike et al. (1983) *Nucleic Acid Res.* 11:477. Such techniques have been employed in the directed evolution of other proteins (see, for example, Scott et al. (1990) *Science* 249:386–390; Roberts et al. (1992) *PNAS* 89:2429–2433; Devlin et al. (1990) *Science* 249: 404–406; Cwirla et al. (1990) *PNAS* 87: 6378–6382; as well as U.S. Pat. Nos. 5,223,409, 5,198,346, and 5,096,815).

ALTERATION OF NUCLEIC ACIDS AND POLYPEPTIDES: METHODS FOR DIRECTED MUTAGENESIS

Non-random or directed, mutagenesis techniques can be used to provide specific sequences or mutations in specific regions. These techniques can be used to create variants which include, e.g., deletions, insertions, or substitutions, of residues of the known amino acid sequence of a protein. The sites for mutation can be modified individually or in series, e.g., by (1) substituting first with conserved amino acids and then with more radical choices depending upon results achieved, (2) deleting the target residue, or (3) inserting residues of the same or a different class adjacent to the located site, or combinations of options 1–3.

ALANINE SCANNING MUTAGENESIS

Alanine scanning mutagenesis is a useful method for identification of certain residues or regions of the desired protein that are preferred locations or domains for mutagenesis, Cunningham and Wells (*Science* 244:1081–1085, 1989). In alanine scanning, a residue or group of target residues are identified (e.g., charged residues such as Arg, Asp, His, Lys, and Glu) and replaced by a neutral or negatively charged amino acid (most preferably alanine or polyalanine). Replacement of an amino acid can affect the interaction of the amino acids with the surrounding aqueous environment in or outside the cell. Those domains demonstrating functional sensitivity to the substitutions are then refined by introducing further or other variants at or for the sites of substitution. Thus, while the site for introducing an amino acid sequence variation is predetermined, the nature of the mutation per se need not be predetermined. For example, to optimize the performance of a mutation at a given site, alanine scanning or random mutagenesis may be conducted at the target codon or region and the expressed desired protein subunit variants are screened for the optimal combination of desired activity.

OLIGONUCLEOTIDE-MEDIATED MUTAGENESIS

Oligonucleotide-mediated mutagenesis is a useful method for preparing substitution, deletion, and insertion variants of DNA, see, e.g., Adelman et al., (*DNA* 2:183, 1983). Briefly, the desired DNA is altered by hybridizing an oligonucleotide encoding a mutation to a DNA template, where the template is the single-stranded form of a plasmid or bacteriophage containing the unaltered or native DNA sequence of the desired protein. After hybridization, a DNA polymerase is used to synthesize an entire second complementary strand of the template that will thus incorporate the oligonucleotide primer, and will code for the selected alteration in the desired protein DNA. Generally, oligonucleotides of at least about 25 nucleotides in length are used. An optimal oligonucleotide will have 12 to 15 nucleotides that are completely complementary to the template on either side of the nucleotide(s) coding for the mutation. This ensures that the oligonucleotide will hybridize properly to the single-stranded DNA template molecule. The oligonucleotides are readily synthesized using techniques known in the art such as that described by Crea et al. (*Proc. Natl. Acad. Sci. USA*, 75: 5765[1978]).

CASSETTE MUTAGENESIS

Another method for preparing variants, cassette mutagenesis, is based on the technique described by Wells et al. (*Gene*, 34:315[1985]). The starting material is a plasmid (or other vector) which includes the protein subunit DNA to be mutated. The codon(s) in the protein subunit DNA to be mutated are identified. There must be a unique restriction endonuclease site on each side of the identified mutation site(s). If no such restriction sites exist, they may be generated using the above-described oligonucleotide-mediated mutagenesis method to introduce them at appropriate locations in the desired protein subunit DNA. After the restriction sites have been introduced into the plasmid, the plasmid is cut at these sites to linearize it. A double-stranded oligonucleotide encoding the sequence of the DNA between the restriction sites but containing the desired mutation(s) is synthesized using standard procedures. The two strands are synthesized separately and then hybridized together using standard techniques. This double-stranded oligonucleotide is referred to as the cassette. This cassette is designed to have 3' and 5' ends that are comparable with the ends of the linearized plasmid, such that it can be directly ligated to the plasmid. This plasmid now contains the mutated desired protein subunit DNA sequence.

COMBINATORIAL MUTAGENESIS

Combinatorial mutagenesis can also be used to generate mutants (Ladner et al., WO 88/06630). In this method, the amino acid sequences for a group of homologs or other related proteins are aligned, preferably to promote the highest homology possible. All of the amino acids which appear at a given position of the aligned sequences can be selected to create a degenerate set of combinatorial sequences. The variegated library of variants is generated by combinatorial mutagenesis at the nucleic acid level, and is encoded by a variegated gene library. For example, a mixture of synthetic oligonucleotides can be enzymatically ligated into gene sequences such that the degenerate set of potential sequences are expressible as individual peptides, or alternatively, as a set of larger fusion proteins containing the set of degenerate sequences.

OTHER MODIFICATIONS OF P. Mirabilis NUCLEIC ACIDS AND POLYPEPTIDES

It is possible to modify the structure of an *P. mirabilis* polypeptide for such purposes as increasing solubility, enhancing stability (e.g., shelf life ex vivo and resistance to proteolytic degradation in vivo). A modified *P. mirabilis* protein or peptide can be produced in which the amino acid sequence has been altered, such as by amino acid substitution, deletion, or addition as described herein.

An *P. mirabilis* peptide can also be modified by substitution of cysteine residues preferably with alanine, serine, threonine, leucine or glutamic acid residues to minimize dimerization via disulfide linkages. In addition, amino acid side chains of fragments of the protein of the invention can be chemically modified. Another modification is cyclization of the peptide.

In order to enhance stability and/or reactivity, an *P. mirabilis* polypeptide can be modified to incorporate one or more polymorphisms in the amino acid sequence of the protein resulting from any natural allelic variation. Additionally, D-amino acids, non-natural amino acids, or non-amino acid analogs can be substituted or added to produce a modified protein within the scope of this invention. Furthermore, an *P. mirabilis* polypeptide can be modified using polyethylene glycol (PEG) according to the method of A. Sehon and co-workers (Wie et al., supra) to produce a protein conjugated with PEG. In addition, PEG can be added during chemical synthesis of the protein. Other modifications of *P. mirabilis* proteins include reduction/alkylation (Tarr, *Methods of Protein Microcharacterization*, J. E. Silver ed., Humana Press, Clifton N.J. 155–194 (1986)); acylation (Tarr, supra); chemical coupling to an appropriate carrier (Mishell and Shiigi, eds, *Selected Methods in Cellular Immunology*, W H Freeman, San Francisco, Calif. (1980), U.S. Pat. No. 4,939,239; or mild formalin treatment (Marsh, (1971) *Int. Arch. of Allergy and Appl. Immunol.*, 41: 199–215).

To facilitate purification and potentially increase solubility of an *P. mirabilis* protein or peptide, it is possible to add an amino acid fusion moiety to the peptide backbone. For example, hexa-histidine can be added to the protein for purification by immobilized metal ion affinity chromatography (Hochuli, E. et al., (1988) *Bio/Technology*, 6: 1321–1325). In addition, to facilitate isolation of peptides free of irrelevant sequences, specific endoprotease cleavage sites can be introduced between the sequences of the fusion moiety and the peptide.

To potentially aid proper antigen processing of epitopes within an *P. mirabilis* polypeptide, canonical protease sensitive sites can be engineered between regions, each comprising at least one epitope via recombinant or synthetic methods. For example, charged amino acid pairs, such as KK or RR, can be introduced between regions within a protein or fragment during recombinant construction thereof. The resulting peptide can be rendered sensitive to cleavage by cathepsin and/or other trypsin-like enzymes which would generate portions of the protein containing one or more epitopes. In addition, such charged amino acid residues can result in an increase in the solubility of the peptide.

PRIMARY METHODS FOR SCREENING POLYPEPTIDES AND ANALOGS

Various techniques are known in the art for screening generated mutant gene products. Techniques for screening large gene libraries often include cloning the gene library into replicable expression vectors, transforming appropriate cells with the resulting library of vectors, and expressing the genes under conditions in which detection of a desired activity, e.g., in this case, binding to *P. mirabilis* polypeptide or an interacting protein, facilitates relatively easy isolation of the vector encoding the gene whose product was detected. Each of the techniques described below is amenable to high through-put analysis for screening large numbers of sequences created, e.g., by random mutagenesis techniques.

TWO HYBRID SYSTEMS

Two hybrid assays such as the system described below (as with the other screening methods described herein), can be used to identify polypeptides, e.g., fragments or analogs of a naturally-occurring *P. mirabilis* polypeptide, e.g., of cellular proteins, or of randomly generated polypeptides which bind to an *P. mirabilis* protein. (The *P. mirabilis* domain is used as the bait protein and the library of variants are expressed as prey fusion proteins.) In an analogous fashion, a two hybrid assay (as with the other screening methods described herein), can be used to find polypeptides which bind an *P. mirabilis* polypeptide.

DISPLAY LIBRARIES

In one approach to screening assays, the Proteus peptides are displayed on the surface of a cell or viral particle, and the ability of particular cells or viral particles to bind an appropriate receptor protein via the displayed product is detected in a "panning assay". For example, the gene library can be cloned into the gene for a surface membrane protein of a bacterial cell, and the resulting fusion protein detected by panning (Ladner et al., WO 88/06630; Fuchs et al. (1991) *Bio/Technology* 9:1370–1371; and can be used to score for potentially functional peptide homologs. Fluorescently labeled ligands, e.g., receptors, can be used to detect homologs which retain ligand-binding activity. The use of fluorescently labeled ligands, allows cells to be visually inspected and separated under a fluorescence microscope, or, where the morphology of the cell permits, to be separated by a fluorescence-activated cell sorter.

A gene library can be expressed as a fusion protein on the surface of a viral particle. For instance, in the filamentous phage system, foreign peptide sequences can be expressed on the surface of infectious phage, thereby conferring two significant benefits. First, since these phage can be applied to affinity matrices at concentrations well over $10^{13}$ phage per milliliter, a large number of phage can be screened at one time. Second, since each infectious phage displays a gene product on its surface, if a particular phage is recovered from an affinity matrix in low yield, the phage can be amplified by another round of infection. The group of almost identical *E. coli* filamentous phages, M13, fd., and f1, are most often used in phage display libraries. Either of the phage gIII or gVIII coat proteins can be used to generate fusion proteins without disrupting the ultimate packaging of the viral particle. Foreign epitopes can be expressed at the $NH_2$-terminal end of pIII and phage bearing such epitopes recovered from a large excess of phage lacking this epitope (Ladner et al. PCT publication WO 90/02909; Garrard et al., PCT publication WO 92/09690; Marks et al. (1992) *J. Biol. Chem.* 267:16007–16010; Griffiths et al. (1993) *EMBO J* 12:725–734; Clackson et al. (1991) *Nature* 352:624–628; and Barbas et al. (1992) *PNAS* 89:4457–4461).

A common approach uses the maltose receptor of *E. coli* (the outer membrane protein, LamB) as a peptide fusion partner (Charbit et al. (1986) *EMBO* 5, 3029–3037). Oligonucleotides have been inserted into plasmids encoding the LamB gene to produce peptides fused into one of the extracellular loops of the protein. These peptides are available for binding to ligands, e.g., to antibodies, and can elicit an immune response when the cells are administered to animals. Other cell surface proteins, e.g., OmpA (Schorr et al. (1991) *Vaccines* 91, pp.387–392), PhoE (Agterberg, et al. (1990) *Gene* 88, 37–45), and PAL (Fuchs et al. (1991) *Bio/Tech* 9, 1369–1372), as well as large bacterial surface structures have served as vehicles for peptide display. Peptides can be fused to pilin, a protein which polymerizes to form the pilus-a conduit for interbacterial exchange of genetic information (Thiry et al. (1989) *Appl. Environ. Microbiol.* 55, 984–993). Because of its role in interacting with other cells, the pilus provides a useful support for the presentation of peptides to the extracellular environment. Another large surface structure used for peptide display is the bacterial motive organ, the flagellum. Fusion of peptides to the subunit protein flagellin offers a dense array of many peptide copies on the host cells (Kuwajima et al. (1988) *Bio/Tech.* 6, 1080–1083). Surface proteins of other bacterial species have also served as peptide fusion partners. Examples include the Staphylococcus protein A and the outer membrane IgA protease of Neisseria (Hansson et al. (1992) *J. Bacteriol.* 174, 4239–4245 and Klauser et al. (1990) *EMBO J.* 9, 1991–1999).

In the filamentous phage systems and the LamB system described above, the physical link between the peptide and its encoding DNA occurs by the containment of the DNA within a particle (cell or phage) that carries the peptide on its surface. Capturing the peptide captures the particle and the DNA within. An alternative scheme uses the DNA-binding protein LacI to form a link between peptide and DNA (Cull et al. (1992) *PNAS USA* 89:1865–1869). This system uses a plasmid containing the LacI gene with an oligonucleotide cloning site at its 3'-end. Under the controlled induction by arabinose, a LacI-peptide fusion protein is produced. This fusion retains the natural ability of LacI to bind to a short DNA sequence known as LacO operator (LacO). By installing two copies of LacO on the expression plasmid, the LacI-peptide fusion binds tightly to the plasmid that encoded it. Because the plasmids in each cell contain only a single oligonucleotide sequence and each cell expresses only a single peptide sequence, the peptides become specifically and stably associated with the DNA sequence that directed its synthesis. The cells of the library are gently lysed and the peptide-DNA complexes are exposed to a matrix of immobilized receptor to recover the complexes containing active peptides. The associated plasmid DNA is then reintroduced into cells for amplification and DNA sequencing to determine the identity of the peptide ligands. As a demonstration of the practical utility of the method, a large random library of dodecapeptides was made and selected on a monoclonal antibody raised against the opioid peptide dynorphin B. A cohort of peptides was recovered, all related by a consensus sequence corresponding to a six-residue portion of dynorphin B. (Cull et al. (1992) *Proc. Natl. Acad. Sci. U.S.A.* 89–1869).

This scheme, sometimes referred to as peptides-on-plasmids, differs in two important ways from the phage display methods. First, the peptides are attached to the C-terminus of the fusion protein, resulting in the display of the library members as peptides having free carboxy termini. Both of the filamentous phage coat proteins, pIII and pVIII, are anchored to the phage through their C-termini, and the guest peptides are placed into the outward-extending N-terminal domains. In some designs, the phage-displayed peptides are presented right at the amino terminus of the fusion protein. (Cwirla, et al. (1990) *Proc. Natl. Acad. Sci. U.S.A.* 87, 6378–6382) A second difference is the set of biological biases affecting the population of peptides actually present in the libraries. The LacI fusion molecules are confined to the cytoplasm of the host cells. The phage coat fusions are exposed briefly to the cytoplasm during translation but are rapidly secreted through the inner membrane into the periplasmic compartment, remaining anchored in the membrane by their C-terminal hydrophobic domains, with the N-termini, containing the peptides, protruding into the periplasm while awaiting assembly into phage particles. The peptides in the LacI and phage libraries may differ significantly as a result of their exposure to different proteolytic activities. The phage coat proteins require transport across the inner membrane and signal peptidase processing as a prelude to incorporation into phage. Certain peptides exert a deleterious effect on these processes and are under-represented in the libraries (Gallop et al. (1994) *J. Med. Chem.* 37(9):1233–1251). These particular biases are not a factor in the LacI display system.

The number of small peptides available in recombinant random libraries is enormous. Libraries of $10^7$–$10^9$ independent clones are routinely prepared. Libraries as large as $10^{11}$ recombinants have been created, but this size approaches the practical limit for clone libraries. This limitation in library size occurs at the step of transforming the DNA containing randomized segments into the host bacterial cells. To circumvent this limitation, an in vitro system based on the display of nascent peptides in polysome complexes has recently been developed. This display library method has the potential of producing libraries 3–6 orders of magnitude larger than the currently available phage/phagemid or plasmid libraries. Furthermore, the construction of the libraries, expression of the peptides, and screening, is done in an entirely cell-free format.

In one application of this method (Gallop et al. (1994) *J. Med. Chem.* 37(9):1233–1251), a molecular DNA library encoding $10^{12}$ decapeptides was constructed and the library expressed in an *E. coli* S30 in vitro coupled transcription/translation system. Conditions were chosen to stall the ribosomes on the mRNA, causing the accumulation of a substantial proportion of the RNA in polysomes and yielding complexes containing nascent peptides still linked to their encoding RNA. The polysomes are sufficiently robust to be affinity purified on immobilized receptors in much the same way as the more conventional recombinant peptide display libraries are screened. RNA from the bound complexes is recovered, converted to cDNA, and amplified by PCR to produce a template for the next round of synthesis and screening. The polysome display method can be coupled to the phage display system. Following several rounds of screening, cDNA from the enriched pool of polysomes was cloned into a phagemid vector. This vector serves as both a peptide expression vector, displaying peptides fused to the coat proteins, and as a DNA sequencing vector for peptide identification. By expressing the polysome-derived peptides on phage, one can either continue the affinity selection procedure in this format or assay the peptides on individual clones for binding activity in a phage ELISA, or for binding specificity in a completion phage ELISA (Barret, et al. (1992) *Anal. Biochem.* 204,357–364). To identify the sequences of the active peptides one sequences the DNA produced by the phagemid host.

SECONDARY SCREENING OF POLYPEPTIDES AND ANALOGS

The high through-put assays described above can be followed by secondary screens in order to identify further biological activities which will, e.g., allow one skilled in the art to differentiate agonists from antagonists. The type of a secondary screen used will depend on the desired activity that needs to be tested. For example, an assay can be developed in which the ability to inhibit an interaction between a protein of interest and its respective ligand can be used to identify antagonists from a group of peptide fragments isolated though one of the primary screens described above.

Therefore, methods for generating fragments and analogs and testing them for activity are known in the art. Once the core sequence of interest is identified, it is routine for one skilled in the art to obtain analogs and fragments.

PEPTIDE MIMETICS OF P. Mirabilis POLYPEPTIDES

The invention also provides for reduction of the protein binding domains of the subject P. mirabilis polypeptides to generate mimetics, e.g. peptide or non-peptide agents. The peptide mimetics are able to disrupt binding of a polypeptide to its counter ligand, e.g., in the case of an P. mirabilis polypeptide binding to a naturally occurring ligand. The critical residues of a subject P. mirabilis polypeptide which are involved in molecular recognition of a polypeptide can be determined and used to generate P. mirabilis-derived peptidomimetics which competitively or noncompetitively inhibit binding of the P. mirabilis polypeptide with an interacting polypeptide (see, for example, European patent applications EP-412,762A and EP-B31,080A).

For example, scanning mutagenesis can be used to map the amino acid residues of a particular P. mirabilis polypeptide involved in binding an interacting polypeptide, peptidomimetic compounds (e.g. diazepine or isoquinoline derivatives) can be generated which mimic those residues in binding to an interacting polypeptide, and which therefore can inhibit binding of an P. mirabilis polypeptide to an interacting polypeptide and thereby interfere with the function of P. mirabilis polypeptide. For instance, non-hydrolyzable peptide analogs of such residues can be generated using benzodiazepine (e.g., see Freidinger et al. in *Peptides. Chemistry and Biology*, G. R. Marshall ed., ESCOM Publisher: Leiden, Netherlands, 1988), azepine (e.g., see Huffman et al. in *Peptides. Chemistry and Biology*, G. R. Marshall ed., ESCOM Publisher: Leiden, Netherlands, 1988), substituted gama lactam rings (Garvey et al. in *Peptides: Chemistry and Biology*, G. R. Marshall ed., ESCOM Publisher: Leiden, Netherlands, 1988), keto-methylene pseudopeptides (Ewenson et al. (1986) *J Med Chem* 29:295; and Ewenson et al. in *Peptides: Structure and Function* (Proceedings of the 9th American Peptide Symposium) Pierce Chemical Co. Rockland, Ill., 1985), b-turn dipeptide cores (Nagai et al. (1985) *Tetrahedron Lett* 26:647; and Sato et al. (1986) *J Chem Soc Perkin Trans* 1:1231), and b-aminoalcohols (Gordon et al. (1985) *Biochem Biophys Res Commun* 126:419; and et al. (1986) *Biochem Biophys Res Commun* 134:71).

VACCINE FORMULATIONS FOR P. Mirabilis NUCLEIC ACIDS AND POLYPEPTIDES

This invention also features vaccine compositions for protection against infection by P. mirabilis or for treatment of P. mirabilis infection. In one embodiment, the vaccine compositions contain one or more immunogenic components such as a surface protein from P. mirabilis, or portion thereof, and a pharmaceutically acceptable carrier. Nucleic acids within the scope of the invention are exemplified by the nucleic acids of the invention contained in the Sequence Listing which encode P. mirabilis surface proteins. Any nucleic acid encoding an immunogenic P. mirabilis protein, or portion thereof, which is capable of expression in a cell, can be used in the present invention. These vaccines have therapeutic and prophylactic utilities.

One aspect of the invention provides a vaccine composition for protection against infection by P. mirabilis which contains at least one immunogenic fragment of an P. mirabilis protein and a pharmaceutically acceptable carrier. Preferred fragments include peptides of at least about 10 amino acid residues in length, preferably about 10–20 amino acid residues in length, and more preferably about 12–16 amino acid residues in length.

Immunogenic components of the invention can be obtained, for example, by screening polypeptides recombinantly produced from the corresponding fragment of the nucleic acid encoding the full-length P. mirabilis protein. In addition, fragments can be chemically synthesized using techniques known in the art such as conventional to Merrifield solid phase f-Moc or t-Boc chemistry.

In one embodiment, immunogenic components are identified by the ability of the peptide to stimulate T cells. Peptides which stimulate T cells, as determined by, for example, T cell proliferation or cytokine secretion are defined herein as comprising at least one T cell epitope. T cell epitopes are believed to be involved in initiation and perpetuation of the immune response to the protein allergen which is responsible for the clinical symptoms of allergy. These T cell epitopes are thought to trigger early events at the level of the T helper cell by binding to an appropriate HLA molecule on the surface of an antigen presenting cell, thereby stimulating the T cell subpopulation with the relevant T cell receptor for the epitope. These events lead to T cell proliferation, lymphokine secretion, local inflammatory reactions, recruitment of additional immune cells to the site of antigen/T cell interaction, and activation of the B cell cascade, leading to the production of antibodies. A T cell epitope is the basic element, or smallest unit of recognition by a T cell receptor, where the epitope comprises amino acids essential to receptor recognition (e.g., approximately 6 or 7 amino acid residues). Amino acid sequences which mimic those of the T cell epitopes are within the scope of this invention.

Screening immunogenic components can be accomplished using one or more of several different assays. For example, in vitro, peptide T cell stimulatory activity is assayed by contacting a peptide known or suspected of being immunogenic with an antigen presenting cell which presents appropriate MHC molecules in a T cell culture. Presentation of an immunogenic P. mirabilis peptide in association with appropriate MHC molecules to T cells in conjunction with the necessary co-stimulation has the effect of transmitting a signal to the T cell that induces the production of increased levels of cytokines, particularly of interleukin-2 and interleukin-4. The culture supernatant can be obtained and assayed for interleukin-2 or other known cytokines. For example, any one of several conventional assays for interleukin-2 can be employed, such as the assay described in *Proc. Natl. Acad. Sci USA*, 86: 1333 (1989) the pertinent portions of which are incorporated herein by reference. A kit for an assay for the production of interferon is also available from Genzyme Corporation (Cambridge, Mass.).

Alternatively, a common assay for T cell proliferation entails measuring tritiated thymidine incorporation. The proliferation of T cells can be measured in vitro by determining the amount of $^3$H-labeled thymidine incorporated into the replicating DNA of cultured cells. Therefore, the rate of DNA synthesis and, in turn, the rate of cell division can be quantified.

Vaccine compositions of the invention containing immunogenic components (e.g., P. mirabilis polypeptide or fragment thereof or nucleic acid encoding an P. mirabilis polypeptide or fragment thereof) preferably include a pharmaceutically acceptable carrier. The term "pharmaceutically acceptable carrier" refers to a carrier that does not cause an allergic reaction or other untoward effect in patients to whom it is administered. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise minor amounts of auxiliary substances such as wetting or emulsifying agents, preservatives or buffers, which enhance the shelf life or effectiveness of the antibody. For vaccines of the invention containing P. mirabilis polypeptides, the polypeptide is co-administered with a suitable adjuvant.

It will be apparent to those of skill in the art that the therapeutically effective amount of DNA or protein of this invention will depend, inter alia, upon the administration schedule, the unit dose of antibody administered, whether the protein or DNA is administered in combination with other therapeutic agents, the immune status and health of the patient, and the therapeutic activity of the particular protein or DNA.

Vaccine compositions are conventionally administered parenterally, e.g., by injection, either subcutaneously or intramuscularly. Methods for intramuscular immunization are described by Wolff et al. (1990) Science 247: 1465–1468 and by Sedegah et al. (1994) Immunology 91: 9866–9870. Other modes of administration include oral and pulmonary formulations, suppositories, and transdermal applications. Oral immunization is preferred over parenteral methods for inducing protection against infection by P. mirabilis. Cain et. al. (1993) Vaccine 11: 637–642. Oral formulations include such normally employed excipients as, for example, pharmaceutical grades of mannitol, lactose, starch, magnesium stearate, sodium saccharine, cellulose, magnesium carbonate, and the like.

The vaccine compositions of the invention can include an adjuvant, including, but not limited to aluminum hydroxide; N-acetyl-muramyl-L-threonyl-D-isoglutamine (thr-MDP); N-acetyl-nor-muramyl-L-alanyl-D-isoglutamine (CGP 11637, referred to as nor-MDP); N-acetylmuramyl-L-alanyl-D-isoglutaminyl-L-alanine-2-(1'-2'-dipalmitoyl-sn-glycero-3-hydroxyphos-phoryloxy)-ethylamine (CGP 19835A, referred to a MTP-PE); RIBI, which contains three components from bacteria; monophosphoryl lipid A; trehalose dimycoloate; cell wall skeleton (MPL+TDM+CWS) in a 2% squalene/Tween 80 emulsion; and cholera toxin. Others which may be used are non-toxic derivatives of cholera toxin, including its B subunit, and/or conjugates or genetically engineered fusions of the P. mirabilis polypeptide with cholera toxin or its B subunit, procholeragenoid, fungal polysaccharides, including schizophyllan, muramyl dipeptide, muramyl dipeptide derivatives, phorbol esters, labile toxin of E. coli, non-P. mirabilisbacterial lysates, block polymers or saponins.

Other suitable delivery methods include biodegradable microcapsules or immuno-stimulating complexes (ISCOMs), cochleates, or liposomes, genetically engineered attenuated live vectors such as viruses or bacteria, and recombinant (chimeric) virus-like particles, e.g., bluetongue. The amount of adjuvant employed will depend on the type of adjuvant used. For example, when the mucosal adjuvant is cholera toxin, it is suitably used in an amount of 5 mg to 50 mg, for example 10 mg to 35 mg. When used in the form of microcapsules, the amount used will depend on the amount employed in the matrix of the microcapsule to achieve the desired dosage. The determination of this amount is within the skill of a person of ordinary skill in the art.

Carrier systems in humans may include enteric release capsules protecting the antigen from the acidic environment of the stomach, and including P. mirabilis polypeptide in an insoluble form as fusion proteins. Suitable carriers for the vaccines of the invention are enteric coated capsules and polylactide-glycolide microspheres. Suitable diluents are 0.2 N $NaHCO_3$ and/or saline.

Vaccines of the invention can be administered as a primary prophylactic agent in adults or in children, as a secondary prevention, after successful eradication of P. mirabilis in an infected host, or as a therapeutic agent in the aim to induce an immune response in a susceptible host to prevent infection by P. mirabilis. The vaccines of the invention are administered in amounts readily determined by persons of ordinary skill in the art. Thus, for adults a suitable dosage will be in the range of 10 mg to 10 g, preferably 10 mg to 100 mg. A suitable dosage for adults will also be in the range of 5 mg to 500 mg. Similar dosage ranges will be applicable for children. Those skilled in the art will recognize that the optimal dose may be more or less depending upon the patient's body weight, disease, the route of administration, and other factors. Those skilled in the art will also recognize that appropriate dosage levels can be obtained based on results with known oral vaccines such as, for example, a vaccine based on an E. coli lysate (6 mg dose daily up to total of 540 mg) and with an enterotoxigenic E. coli purified antigen (4 doses of 1 mg) (Schulman et al., J. Urol. 150:917–921 (1993); Boedecker et al., American Gastroenterological Assoc. 999:A-222 (1993)). The number of doses will depend upon the disease, the formulation, and efficacy data from clinical trials. Without intending any limitation as to the course of treatment, the treatment can be administered over 3 to 8 doses for a primary immunization schedule over 1 month (Boedeker, American Gastroenterological Assoc. 888:A-222 (1993)).

In a preferred embodiment, a vaccine composition of the invention can be based on a killed whole E. coli preparation with an immunogenic fragment of an P. mirabilis protein of the invention expressed on its surface or it can be based on an E. coli lysate, wherein the killed E. coli acts as a carrier or an adjuvant.

It will be apparent to those skilled in the art that some of the vaccine compositions of the invention are useful only for preventing P. mirabilis infection, some are useful only for treating P. mirabilis infection, and some are useful for both preventing and treating P. mirabilis infection. In a preferred embodiment, the vaccine composition of the invention provides protection against P. mirabilis infection by stimulating humoral and/or cell-mediated immunity against P. mirabilis. It should be understood that amelioration of any of the symptoms of P. mirabilis infection is a desirable clinical goal, including a lessening of the dosage of medication used to treat P. mirabilis-caused disease, or an increase in the production of antibodies in the serum or mucous of patients.

ANTIBODIES REACTIVE WITH P. mirabilis POLYPEPTIDES

The invention also includes antibodies specifically reactive with the subject P. mirabilis polypeptide. Anti-protein/ anti-peptide antisera or monoclonal antibodies can be made by standard protocols (See, for example, *Antibodies: A Laboratory Manual* ed. by Harlow and Lane (Cold Spring Harbor Press: 1988)). A mammal such as a mouse, a hamster or rabbit can be immunized with an immunogenic form of the peptide. Techniques for conferring immunogenicity on a protein or peptide include conjugation to carriers or other techniques well known in the art. An immunogenic portion of the subject *P. mirabilis* polypeptide can be administered in the presence of adjuvant. The progress of immunization can be monitored by detection of antibody titers in plasma or serum. Standard ELISA or other immunoassays can be used with the immunogen as antigen to assess the levels of antibodies.

In a preferred embodiment, the subject antibodies are immunospecific for antigenic determinants of the *P. mirabilis* polypeptides of the invention, e.g. antigenic determinants of a polypeptide of the invention contained in the Sequence Listing, or a closely related human or non-human mammalian homolog (e.g., 90% homologous, more preferably at least about 95% homologous). In yet a further preferred embodiment of the invention, the anti-*P. mirabilis* antibodies do not substantially cross react (i.e., react specifically) with a protein which is for example, less than 80% percent homologous to a sequence of the invention contained in the Sequence Listing. By "not substantially cross react", it is meant that the antibody has a binding affinity for a non-homologous protein which is less than 10 percent, more preferably less than 5 percent, and even more preferably less than 1 percent, of the binding affinity for a protein of the invention contained in the Sequence Listing. In a most preferred embodiment, there is no cross-reactivity between bacterial and mammalian antigens.

The term antibody as used herein is intended to include fragments thereof which are also specifically reactive with *P. mirabilis* polypeptides. Antibodies can be fragmented using conventional techniques and the fragments screened for utility in the same manner as described above for whole antibodies. For example, F(ab')$_2$ fragments can be generated by treating antibody with pepsin. The resulting F(ab')$_2$ fragment can be treated to reduce disulfide bridges to produce Fab' fragments. The antibody of the invention is further intended to include bispecific and chimeric molecules having an anti-*P. mirabilis* portion.

Both monoclonal and polyclonal antibodies (Ab) directed against *P. mirabilis* polypeptides or *P. mirabilis* polypeptide variants, and antibody fragments such as Fab' and F(ab')$_2$, can be used to block the action of *P. mirabilis* polypeptide and allow the study of the role of a particular *P. mirabilis* polypeptide of the invention in aberrant or unwanted intracellular signaling, as well as the normal cellular function of the *P. mirabilis* and by microinjection of anti-*P. mirabilis* polypeptide antibodies of the present invention.

Antibodies which specifically bind *P. mirabilis* epitopes can also be used in immunohistochemical staining of tissue samples in order to evaluate the abundance and pattern of expression of *P. mirabilis* antigens. Anti-*P. mirabilis* polypeptide antibodies can be used diagnostically in immuno-precipitation and immuno-blotting to detect and evaluate *P. mirabilis* levels in tissue or bodily fluid as part of a clinical testing procedure. Likewise, the ability to monitor *P. mirabilis* polypeptide levels in an individual can allow determination of the efficacy of a given treatment regimen for an individual afflicted with such a disorder. The level of an *P. mirabilis* polypeptide can be measured in cells found in bodily fluid, such as in urine samples or can be measured in tissue, such as produced by gastric biopsy. Diagnostic assays using anti-*P. mirabilis* antibodies can include, for example, immunoassays designed to aid in early diagnosis of *P. mirabilis* infections. The present invention can also be used as a method of detecting antibodies contained in samples from individuals infected by this bacterium using specific *P. mirabilis* antigens.

Another application of anti-*P. mirabilis* polypeptide antibodies of the invention is in the immunological screening of cDNA libraries constructed in expression vectors such as λgt11, λgt18–23, λZAP, and λORF8. Messenger libraries of this type, having coding sequences inserted in the correct reading frame and orientation, can produce fusion proteins. For instance, λgt11 will produce fusion proteins whose amino termini consist of β-galactosidase amino acid sequences and whose carboxy termini consist of a foreign polypeptide. Antigenic epitopes of a subject *P. mirabilis* polypeptide can then be detected with antibodies, as, for example, reacting nitrocellulose filters lifted from infected plates with anti-*P. mirabilis* polypeptide antibodies. Phage, scored by this assay, can then be isolated from the infected plate. Thus, the presence of *P. mirabilis* gene homologs can be detected and cloned from other species, and alternate isoforms (including splicing variants) can be detected and cloned.

KITS CONTAINING NUCLEIC ACIDS, POLYPEPTIDES OR ANTIBODIES OF THE INVENTION

The nucleic acid, polypeptides and antibodies of the invention can be combined with other reagents and articles to form kits. Kits for diagnostic purposes typically comprise the nucleic acid, polypeptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose. Kits further can include instructions for use.

BIO CHIP TECHNOLOGY

The nucleic acid sequence of the present invention may be used to detect *P. mirabilis* or other species of Proteus acid sequence using bio chip technology. Bio chips containing arrays of nucleic acid sequence can also be used to measure expression of genes of *P. mirabilis* or other species of Proteus. For example, to diagnose a patient with a *P. mirabilis* or other Proteus infection, a sample from a human or animal can be used as a probe on a bio chip containing an array of nucleic acid sequence from the present invention. In addition, a sample from a disease state can be compared to a sample from a non-disease state which would help identify a gene that is up-regulated or expressed in the disease state. This would provide valuable insight as to the mechanism by which the disease manifests. Changes in gene expression can also be used to identify critical pathways involved in drug transport or metabolism, and may enable the identification of novel targets involved in virulence or host cell interactions involved in maintenance of an infection. Procedures using such techniques have been described by Brown et al., 1995, *Science* 270: 467–470.

Bio chips can also be used to monitor the genetic changes of potential therapeutic compounds including, deletions, insertions or mismatches. Once the therapeutic is added to the patient, changes to the genetic sequence can be evaluated for its efficacy. In addition, the nucleic acid sequence of the present invention can be used to determine essential genes in cell cycling. As described in Iyer et al., 1999 (*Science*, 283:83–87) genes essential in the cell cycle can be identified using bio chips. Furthermore, the present invention provides nucleic acid sequence which can be used with bio chip technology to understand regulatory networks in bacteria, measure the response to environmental signals or drugs as in drug screening, and study virulence induction. (Mons et al., 1998, *Nature Biotechnology*, 16: 45–48. Patents teaching this technology include U.S. Pat. Nos. 5445934, 5744305, and 5800992.

DRUG SCREENING ASSAYS USING *P. mirabilis* POLYPEPTIDES

By making available purified and recombinant *P. mirabilis* polypeptides, the present invention provides assays which can be used to screen for drugs which are either agonists or antagonists of the normal cellular function, in this case, of the subject *P. mirabilis* polypeptides, or of their role in intracellular signaling. Such inhibitors or potentiators may be useful as new therapeutic agents to combat *P. mirabilis* infections in humans. A variety of assay formats will suffice and, in light of the present inventions, will be comprehended by the person skilled in the art.

In many drug screening programs which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or change in enzymatic properties of the molecular target. Accordingly, in an exemplary screening assay of the present invention, the compound of interest is contacted with an isolated and purified *P. mirabilis* polypeptide.

Screening assays can be constructed in vitro with a purified *P. mirabilis* polypeptide or fragment thereof, such as an *P. mirabilis* polypeptide having enzymatic activity, such that the activity of the polypeptide produces a detectable reaction product. The efficacy of the compound can be assessed by generating dose response curves from data obtained using various concentrations of the test compound. Moreover, a control assay can also be performed to provide a baseline for comparison. Suitable products include those with distinctive absorption, fluorescence, or chemiluminescence properties, for example, because detection may be easily automated. A variety of synthetic or naturally occurring compounds can be tested in the assay to identify those which inhibit or potentiate the activity of the *P. mirabilis* polypeptide. Some of these active compounds may directly, or with chemical alterations to promote membrane permeability or solubility, also inhibit or potentiate the same activity (e.g., enzymatic activity) in whole, live *P. mirabilis* cells.

OVEREXPRESSION ASSAYS

Overexpression assays are based on the premise that overproduction of a protein would lead to a higher level of resistance to compounds that selectively interfere with the function of that protein. Overexpression assays may be used to identify compounds that interfere with the function of virtually any type of protein, including without limitation enzymes, receptors, DNA- or RNA-binding proteins, or any proteins that are directly or indirectly involved in regulating cell growth.

Typically, two bacterial strains are constructed. One contains a single copy of the gene of interest, and a second contains several copies of the same gene. Identification of useful inhibitory compounds of this type of assay is based on a comparison of the activity of a test compound in inhibiting growth and/or viability of the two strains. The method involves constructing a nucleic acid vector that directs high level expression of a particular target nucleic acid. The vectors are then transformed into host cells in single or multiple copies to produce strains that express low to moderate and high levels of protein encoding by the target sequence (strain A and B, respectively). Nucleic acid comprising sequences encoding the target gene can, of course, be directly integrated into the host cell.

Large numbers of compounds (or crude substances which may contain active compounds) are screened for their effect on the growth of the two strains. Agents which interfere with an unrelated target equally inhibit the growth of both strains. Agents which interfere with the function of the target at high concentration should inhibit the growth of both strains. It should be possible, however, to titrate out the inhibitory effect of the compound in the overexpressing strain. That is, if the compound is affecting the particular target that is being tested, it should be possible to inhibit the growth of strain A at a concentration of the compound that allows strain B to grow.

Alternatively, a bacterial strain is constructed that contains the gene of interest under the control of an inducible promoter. Identification of useful inhibitory agents using this type of assay is based on a comparison of the activity of a test compound in inhibiting growth and/or viability of this strain under both inducing and non-inducing conditions. The method involves constructing a nucleic acid vector that directs high-level expression of a particular target nucleic acid. The vector is then transformed into host cells that are grown under both non-inducing and inducing conditions (conditions A and B, respectively).

Large numbers of compounds (or crude substances which may contain active compounds) are screened for their effect on growth under these two conditions. Agents that interfere with the function of the target should inhibit growth under both conditions. It should be possible, however, to titrate out the inhibitory effect of the compound in the overexpressing strain. That is, if the compound is affecting the particular target that is being tested, it should be possible to inhibit growth under condition A at a concentration that allows the strain to grow under condition B.

LIGAND-BINDING ASSAYS

Many of the targets according to the invention have functions that have not yet been identified. Ligand-binding assays are useful to identify inhibitor compounds that interfere with the function of a particular target, even when that function is unknown. These assays are designed to detect binding of test compounds to particular.targets. The detection may involve direct measurement of binding. Alternatively, indirect indications of binding may involve stabilization of protein structure or disruption of a biological function. Non-limiting examples of useful ligand-binding assays are detailed below.

A useful method for the detection and isolation of binding proteins is the Biomolecular Interaction Assay (BIAcore) system developed by Pharmacia Biosensor and described in the manufacturer's protocol (LKB Pharmacia, Sweden). The BIAcore system uses an affinity purified anti-GST antibody to immobilize GST-fusion proteins onto a sensor chip. The sensor utilizes surface plasmon resonance which is an optical phenomenon that detects changes in refractive indices. In accordance with the practice of the invention, a protein of interest is coated onto a chip and test compounds are passed over the chip. Binding is detected by a change in the refractive index (surface plasmon resonance).

A different type of ligand-binding assay involves scintillation proximity assays (SPA, described in U.S. Pat. No. 4,568,649).

Another type of ligand binding assay, also undergoing development, is based on the fact that proteins containing mitochondrial targeting signals are imported into isolated mitochondria in vitro (Hurt et al., 1985, *Embo J.* 4:2061–2068; Eilers and Schatz, *Nature*, 1986, 322:228–231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

Another ligand-binding assay is the yeast two-hybrid system (Fields and Song, 1989, *Nature* 340:245–246). The yeast two-hybrid system takes advantage of the properties of the GAL4 protein of the yeast *Saccharomyces cerevisiae*. The GAL4 protein is a transcriptional activator required for the expression of genes encoding enzymes of galactose utilization. This protein consists of two separable and functionally essential domains: an N-terminal domain which binds to specific DNA sequences (UAS$_G$); and a C-terminal domain containing acidic regions, which is necessary to activate transcription. The native GAL4 protein, containing both domains, is a potent activator of transcription when yeast are grown on galactose media. The N-terminal domain binds to DNA in a sequence-specific manner but is unable to activate transcription. The C-terminal domain contains the activating regions but cannot activate transcription because it fails to be localized to UAS$_G$. In the two-hybrid system, a system of two hybrid proteins containing parts of GAL4: (1) a GAL4 DNA-binding domain fused to a protein 'X' and (2) a GAL4 activation region fused to a protein 'Y'. If X and Y can form a protein-protein complex and reconstitute proximity of the GAL4 domains, transcription of a gene regulated by UAS$_G$ occurs. Creation of two hybrid proteins, each containing one of the interacting proteins X and Y, allows the activation region of UAS$_G$ to be brought to its normal site of action.

The binding assay described in Fodor et al., 1991, *Science* 251:767–773, which involves testing the binding affinity of test compounds for a plurality of defined polymers synthesized on a solid substrate, may also be useful.

Compounds which bind to the polypeptides of the invention are potentially useful as antibacterial agents for use in therapeutic compositions.

Pharmaceutical formulations suitable for antibacterial therapy comprise the antibacterial agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The antibacterial compositions include an antibacterial effective amount of active agent. Antibacterial effective amounts are those quantities of the antibacterial agents of the present invention that afford prophylactic protection against bacterial infections or which result in amelioration or cure of an existing bacterial infection. This antibacterial effective amount will depend upon the agent, the location and nature of the infection, and the particular host. The amount can be determined by experimentation known in the art, such as by establishing a matrix of dosages and frequencies and comparing a group of experimental units or subjects to each point in the matrix.

The antibacterial active agents or compositions can be formed into dosage unit forms, such as for example, creams, ointments, lotions, powders, liquids, tablets, capsules, suppositories, sprays, aerosols or the like. If the antibacterial composition is formulated into a dosage unit form, the dosage unit form may contain an antibacterial effective amount of active agent. Alternatively, the dosage unit form may include less than such an amount if multiple dosage unit forms or multiple dosages are to be used to administer a total dosage of the active agent. Dosage unit forms can include, in addition, one or more excipient(s), diluent(s), disintegrant(s), lubricant(s), plasticizer(s), colorant(s), dosage vehicle(s), absorption enhancer(s), stabilizer(s), bactericide(s), or the like.

For general information concerning formulations, see, e.g., Gilman et al. (eds.), 1990, *Goodman and Gilman's: The Pharmacological Basis of Therapeutics*, 8th ed., Pergamon Press; and *Remington's Pharmaceutical Sciences*, 17th ed., 1990, Mack Publishing Co., Easton, Pa.; Avis et al. (eds.), 1993, *Pharmaceutical Dosage Forms: Parenteral Medications*, Dekker, New York; Lieberman et al (eds.), 1990, *Pharmaceutical Dosage Forms: Disperse Systems*, Dekker, New York.

The antibacterial agents and compositions of the present invention are useful for preventing or treating *P. mirabilis* infections. Infection prevention methods incorporate a prophylactically effective amount of an antibacterial agent or composition. A prophylactically effective amount is an amount effective to prevent *P. mirabilis* infection and will depend upon the specific bacterial strain, the agent, and the host. These amounts can be determined experimentally by methods known in the art and as described above.

*P. mirabilis* infection treatment methods incorporate a therapeutically effective amount of an antibacterial agent or composition. A therapeutically effective amount is an amount sufficient to ameliorate or eliminate the infection. The prophylactically and/or therapeutically effective amounts can be administered in one administration or over repeated administrations. Therapeutic administration can be followed by prophylactic administration, once the initial bacterial infection has been resolved.

The antibacterial agents and compositions can be administered topically or systemically. Topical application is typically achieved by administration of creams, ointments, lotions, or sprays as described above. Systemic administration includes both oral and parental routes. Parental routes include, without limitation, subcutaneous, intramuscular, intraperitoneal, intravenous, transdermal, inhalation and intranasal administration.

EXEMPLIFICATION

CLONING AND SEQUENCING P. mirabilis GENOMIC SEQUENCE

This invention provides nucleotide sequences of the genome of P. mirabilis which thus comprises a DNA sequence library of P. mirabilis genomic DNA. The detailed description that follows provides nucleotide sequences of P. mirabilis, and also describes how the sequences were obtained and how ORFs (Open Reading Frames) and protein-coding sequences can be identified. Also described are methods of using the disclosed P. mirabilis sequences in methods including diagnostic and therapeutic applications. Furthermore, the library can be used as a database for identification and comparison of medically important sequences in this and other strains of P. mirabilis as well as other species of Proteus.

Chromosomal DNA from strain 16525 of P. mirabilis was isolated after Zymolyase digestion, sodium dodecyl sulfate lysis, potassium acetate precipitation, phenol:chloroform extraction and ethanol precipitation (Soll, D. R., T. Srikantha and S. R. Lockhart: Characterizing Developmentally Regulated Genes in P. mirabilis. In Microbial Genome Methods. K. W. Adolph, editor. CRC Press. New York. p 17–37.). Genomic P. mirabilis DNA was hydrodynamically sheared in an HPLC and then separated on a standard 1% agarose gel. Fractions corresponding to 2500–3000 bp in length were excised from the gel and purifed by the GeneClean procedure (Bio101, Inc.).

The purified DNA fragments were then blunt-ended using T4 DNA polymerase.

The healed DNA was then ligated to unique BstXI-linker adapters (5'-GTCTTCACCACGGGG-3' and 5'-GTGGTGAAGAC-3' in 100–1000 fold molar excess). These linkers are complimentary to the BstXI-cut pGTC vector, while the overhang is not self-complimentary. Therefore, the linkers will not concatermerize nor will the cut-vector religate itself easily. The linker-adapted inserts were separated from the unincorporated linkers on a 1% agarose gel and purified using GeneClean. The linker-adapted inserts were then ligated to BstXI-cut vector to construct a "shotgun" sublclone libraries.

Only major modifications to the protocols are highlighted. Briefly, the library was then transformed into DH5a competent cells (Gibco/BRL, DH5á transformation protocol). It was assessed by plating onto antibiotic plates containing ampicillin and IPTG/Xgal. The plates were incubated overnight at 37° C. Transformants were then used for plating of clones and picking for sequencing. The cultures were grown overnight at 37° C. DNA was purified using a silica bead DNA preparation (Engelstein, 1996) method. In this manner, 25 μg of DNA was obtained per clone.

These purified DNA samples were then sequenced using primarily ABI dye-terminator chemistry. All subsequent steps were based on sequencing by ABI377 automated DNA sequencing methods. The ABI dye terminator sequence reads were run on ABI377 machines and the data was transferred to UNIX machines following lane tracking of the gels. Base calls and quality scores were determined using the program PHRED (Ewing et al., 1998, Genome Res. 8: 175–185; Ewing and Green, 1998, Genome Res. 8: 685–734). Reads were assembled using PHRAP (P. Green, Abstracts of DOE Human Genome Program Contractor-Grantee Workshop V, January 1996, p. 157) with default program parameters and quality scores. The initial assembly was done at 10.4 fold coverage and yielded 306 contigs.

Finishing can follow the initial assembly. Missing mates (sequences from clones that only gave reads from one end of the Proteus DNA inserted in the plasmid) can be identified and sequenced with ABI technology to allow the identification of additional overlapping contigs.

End-sequencing of randomly picked genomic lambda was also performed. Sequencing on a both sides was done for all lambda sequences. The lambda library backbone helped to verify the integrity of the assembly and allowed closure of some of the physical gaps. Primers for walking off the ends of contigs would be selected using pick_primer (a GTC program) near the ends of the clones to facilitate gap closure. These walks can be sequenced using the selected clones and primers. These data are then reassembled with PHRAP. Additional sequencing using PCR-generated templates and screened and/or unscreened lambda templates can be done in addition.

To identify P. mirabilis polypeptides the complete genomic sequence of P. mirabilis were analyzed essentially as follows: First, all possible stop-to-stop open reading frames (ORFs) greater than 180 nucleotides in all six reading frames were translated into amino acid sequences. Second, the identified ORFs were analyzed for homology to known (archeabacter, prokaryotic and eukaryotic) protein sequences. Third, the coding potential of non-homologous sequences were evaluated with the program GEN-EMARK™ (Borodovsky and Mclninch, 1993, Comp. Chem. 17:123).

IDENTIFICATION, CLONING AND EXPRESSION OF P. mirabilis NUCLEIC ACIDS

Expression and purification of the P. mirabilis polypeptides of the invention can be performed essentially as outlined below.

To facilitate the cloning, expression and purification of membrane and secreted proteins from P. mirabilis, a gene expression system, such as the pET System (Novagen), for cloning and expression of recombinant proteins in E. coli, is selected. Also, a DNA sequence encoding a peptide tag, the His-Tag, is fused to the 3' end of DNA sequences of interest in order to facilitate purification of the recombinant protein products. The 3' end is selected for fusion in order to avoid alteration of any 5' terminal signal sequence.

PCR AMPLIFICATION AND CLONING OF NUCLEIC ACIDS CONTAINING ORF'S ENCODING ENZYMES

Nucleic acids chosen (for example., from the nucleic acids set forth in SEQ ID NO: 1–SEQ ID NO: 4172 for cloning from the 16525 strain of P. mirabilis are prepared for amplification cloning by polymerase chain reaction (PCR). Synthetic oligonucleotide primers specific for the 5' and 3' ends of open reading frames (ORFs) are designed and purchased from GibcoBRL Life Technologies (Gaithersburg, Md., USA). All forward primers (specific for the 5' end of the sequence) are designed to include an NcoI cloning site at the extreme 5' terminus. These primers are designed to permit initiation of protein translation at a methionine residue followed by a valine residue and the coding sequence for the remainder of the native *P. mirabilis* DNA sequence. All reverse primers (specific for the 3' end of any *P. mirabilis* ORF) include a EcoRi site at the extreme 5' terminus to permit cloning of each *P. mirabilis* sequence into the reading frame of the pET-28b. The pET-28b vector provides sequence encoding an additional 20 carboxy-terminal amino acids including six histidine residues (at the extreme C-terminus); which comprise the His-Tag.

Genomic DNA prepared from the 16525 strain of *P. mirabilis* is used as the source of template DNA for PCR amplification reactions (Current Protocols in Molecular Biology, John Wiley and Sons, Inc., F. Ausubel et al., eds., 1994). To amplify a DNA sequence containing an *P. mirabilis* ORF, genomic DNA (50 nanograms) is introduced into a reaction vial containing 2 mM $MgCl_2$, 1 micromolar synthetic oligonucleotide primers (forward and reverse primers) complementary to and flanking a defined *P. mirabilis* ORF, 0.2 mM of each deoxynucleotide triphosphate; dATP, dGTP, dCTP, dTTP and 2.5 units of heat stable DNA polymerase (Amplitaq, Roche Molecular Systems, Inc., Branchburg, N.J., USA) in a final volume of 100 microliters.

Upon completion of thermal cycling reactions, each sample of amplified DNA is washed and purified using the Qiaquick Spin PCR purification kit (Qiagen, Gaithersburg, Md., USA). All amplified DNA samples are subjected to digestion with the restriction endonucleases, e.g., NcoI and EcoRI (New England BioLabs, Beverly, Mass., USA) (Current Protocols in Molecular Biology, John Wiley and Sons, Inc., F. Ausubel et al., eds., 1994). DNA samples are then subjected to electrophoresis on 1.0% NuSeive (FMC BioProducts, Rockland, Me.; USA) agarose gels. DNA is visualized by exposure to ethidium bromide and long wave uv irradiation. DNA contained in slices isolated from the agarose gel is purified using the Bio 101 GeneClean Kit protocol (Bio 101 Vista, Calif., USA).

CLONING OF *P. mirabilis* NUCLEIC ACIDS INTO AN EXPRESSION VECTOR

The pET-28b vector is prepared for cloning by digestion with restriction endonucleases, e.g., NcoI and EcoRI (Current Protocols in Molecular Biology, John Wiley and Sons, Inc., F. Ausubel et al., eds., 1994). The pET-28a vector, which encodes a His-Tag that can be fused to the 5' end of an inserted gene, is prepared by digestion with appropriate restriction endonucleases.

Following digestion, DNA inserts are cloned (Current Protocols in Molecular Biology, John Wiley and Sons, Inc., F. Ausubel et al., eds., 1994) into the previously digested pET-28b expression vector. Products of the ligation reaction are then used to transform the BL21 strain of *E. coli* (Current Protocols in Molecular Biology, John Wiley and Sons, Inc., F. Ausubel et al., eds., 1994) as described below.

TRANSFORMATION OF COMPETENT BACTERIA WITH RECOMBINANT PLASMIDS

Competent bacteria, *E coli* strain BL21 or *E. coli* strain BL21 (DE3), are transformed with recombinant pET expression plasmids carrying the cloned *P. mirabilis* sequences according to standard methods (Current Protocols in Molecular, John Wiley and Sons, Inc., F. Ausubel et al., eds., 1994). Briefly, 1 microliter of ligation reaction is mixed with 50 microliters of electrocompetent cells and subjected to a high voltage pulse, after which, samples are incubated in 0.45 milliliters SOC medium (0.5% yeast extract, 2.0% tryptone, 10 mM NaCl, 2.5 mM KCl, 10 mM MgCl2, 10 mM MgSO4 and 20, mM glucose) at 37° C. with shaking for 1 hour. Samples are then spread on LB agar plates containing 25 microgram/ml kanamycin sulfate for growth overnight. Transformed colonies of BL21 are then picked and analyzed to evaluate cloned inserts as described below.

IDENTIFICATION OF RECOMBINANT EXPRESSION VECTORS WITH *P. mirabilis* NUCLEIC ACIDS Individual BL2 1 clones transformed with recombinant pET-28b *P. mirabilis* ORFs are analyzed by PCR amplification of the cloned inserts using the same forward and reverse primers, specific for each *P. mirabilis* sequence, that were used in the original PCR amplification cloning reactions. Successful amplification verifies the integration of the *P. mirabilis* sequences in the expression vector (Current Protocols in Molecular Biology, John Wiley and Sons, Inc., F. Ausubel et al., eds., 1994).

ISOLATION AND PREPARATION OF NUCLEIC ACIDS FROM TRANSFORMANTS

Individual clones of recombinant pET-28b vectors carrying properly cloned *P. mirabilis* ORFs are picked and incubated in 5 mls of LB broth plus 25 microgram/ml kanamycin sulfate overnight. The following day plasmid DNA is isolated and purified using the Qiagen plasmid purification protocol (Qiagen Inc., Chatsworth, Calif., USA).

EXPRESSION OF RECOMBINANT *P. mirabilis* SEQUENCES IN *E. coli*

The pET vector can be propagated in any *E. coli* K-12 strain e.g. HMS174, HB101, JM109, DH5, etc. for the purpose of cloning or plasmid preparation. Hosts for expression include *E. coli* strains containing a chromosomal copy of the gene for T7 RNA polymerase. These hosts are lysogens of bacteriophage DE3, a lambda derivative that carries the lad gene, the lacUV5 promoter and the gene for T7 RNA polymerase. T7 RNA polymerase is induced by addition of isopropyl-B-D-thiogalactoside (IPTG), and the T7 RNA polymerase transcribes any target plasmid, such as pET-28b, carrying its gene of interest. Strains used include: BL21 (DE3) (Studier, F. W., Rosenberg, A. H., Dunn, J. J., and Dubendorff, J. W. (1990) Meth. Enzymol. 185, 60–89).

To express recombinant *P. mirabilis* sequences, 50 nanograms of plasmid DNA isolated as described above is used to transform competent BL21 (DE3) bacteria as described above (provided by Novagen as part of the pET expression system kit). The lacZ gene (beta-galactosidase) is expressed in the pET-System as described for the *P. mirabilis* recombinant constructions. Transformed cells are cultured in SOC medium for 1 hour, and the culture is then plated on LB plates containing 25 micrograms/ml kanamycin sulfate. The following day, bacterial colonies are pooled and grown in LB medium containing kanamycin sulfate (25 micrograms/ml) to an optical density at 600 nM of 0.5 to 1.0 O.D. units, at which point, 1 millimolar IPTG was added to the culture for 3 hours to induce gene expression of the *P. mirabilis* recombinant DNA constructions.

After induction of gene expression with IPTG, bacteria are pelleted by centrifugation in a Sorvall RC-3B centrifuge at 3500×g for 15 minutes at 4° C. Pellets are resuspended in 50 milliliters of cold 10 mM Tris-HCl, pH 8.0, 0.1 M NaCl and 0.1 mM EDTA (STE buffer). Cells are then centrifuged at 2000×g for 20 min at 4° C. Wet pellets are weighed and frozen at −80° C. until ready for protein purification.

A variety of methodologies known in the art can be utilized to purify the isolated proteins. (Current Protocols in Protein Science, John Wiley and Sons, Inc., J. E. Coligan et al., eds., 1995). For example, the frozen cells may be thawed, resupended in buffer and ruptured by several passages through a small volume microfluidizer (Model M-110S, Microfluidics International Corporation, Newton, Mass.). The resultant homogenate may be centrifuged to yield a clear supernatant (crude extract) and following filtration the crude extract may be fractionated over columns. Fractions may be monitored by absorbance at $OD_{280}$ nm. and peak fractions may analyzed by SDS-PAGE.

The concentrations of purified protein preparations may be quantified spectrophotometrically using absorbance coefficients calculated from amino acid content (Perkins, S. J. 1986 Eur. J. Biochem. 157, 169–180). Protein concentrations are also measured by the method of Bradford, M. M. (1976) Anal. Biochem. 72, 248–254, and Lowry, O. H., Rosebrough, N., Farr, A. L. & Randall, R. J. (1951) J. Biol. Chem. 193, pages 265–275, using bovine serum albumin as a standard.

SDS-polyacrylamide gels of various concentrations may be purchased from BioRad (Hercules, Calif., USA), and stained with Coomassie blue. Molecular weight markers may include rabbit skeletal muscle myosin (200 kDa), *E. coli* (-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

EQUIVALENTS

Those skilled in the art will recognize, or be able to ascertain using no more than routine experimentation, many equivalents to the specific embodiments and methods described herein. The specific embodiments described herein are offered by way of example only, and the invention is to limited only by the terms of the appended claims, along with the full scope of equivalents to which such claims are entitled.

TABLE 2

| ORF_Name | NTID | AAID | NT Length | AA Length | Score | Probability |
|---|---|---|---|---|---|---|
| 10017182_f3_202 | 1 | 4173 | 230 | 693 | 277 | 3.9e-24 |
| Protein name | | | | | Locus_Name | Acc# |
| hypothetical protein SC4H8.02 SC4H8.02 | | | | pir:T35133 | | T35133 |

Description
hypothetical protein SC4H8.02 SC4H8.02

| ORF_Name | NTID | AAID | NT Length | AA Length | Score | Probability |
|---|---|---|---|---|---|---|
| 10546938_f3_215 | 2 | 4174 | 71 | 216 | 186 | 1.7e-14 |
| Protein name | | | | | Locus_Name | Acc# |
| | | | | | sp:DSRB_ECOLI | P40678 |

Description
DSRB PROTEIN

| ORF_Name | NTID | AAID | NT Length | AA Length | Score | Probability |
|---|---|---|---|---|---|---|
| 10598840_c3_401 | 3 | 4175 | 272 | 819 | 700 | 5.8e-69 |
| Protein name | | | | | Locus_Name | Acc# |
| | | | | | sp:DMSA_HAEIN | P45004:Q48 |

Description
(DMSO REDUCTASE)

| ORF_Name | NTID | AAID | NT Length | AA Length | Score | Probability |
|---|---|---|---|---|---|---|
| 10943800_f1_1 | 4 | 4176 | 63 | 192 | | |
| Protein name | | | | | Locus_Name | Acc# |

Description
NO-HIT

| ORF_Name | NTID | AAID | NT Length | AA Length | Score | Probability |
|---|---|---|---|---|---|---|
| 11129575_c1_280 | 5 | 4177 | 67 | 204 | | |
| Protein name | | | | | Locus_Name | Acc# |

Description
NO-HIT

| ORF Name | NTID | AAID | NT Length | AA Length | Score | Probability |
|---|---|---|---|---|---|---|
| 11152161_f2_120 | 6 | 4178 | 119 | 360 | | |
| Protein name | | | | | Locus Name | Acc# |

Description
NO-HIT

| ORF Name | NTID | AAID | NT Length | AA Length | Score | Probability |
|---|---|---|---|---|---|---|
| 119032_f3_177 | 7 | 4179 | 181 | 546 | 902 | 2.3e-90 |
| Protein name | | | | | Locus Name | Acc# |
| NADH DEHYDROGENASE I CHAIN I (EC 1.6.5.3) | | | | gp:D90859 | | D90859:AB0 |

Description
E.coli genomic DNA, Kohara clone #403(51.5-51.9 min.).

| ORF Name | NTID | AAID | NT Length | AA Length | Score | Probability |
|---|---|---|---|---|---|---|
| 12695305_c2_305 | 8 | 4180 | 69 | 210 | 65 | 0.019 |
| Protein name | | | | | Locus Name | Acc# |
| hypothetical protein Y102A5C.26 | | | | pir:T26365 | | T26365 |

Description

| ORF Name | NTID | AAID | NT Length | AA Length | Score | Probability |
|---|---|---|---|---|---|---|
| 13007882_f3_146 | 9 | 4181 | 751 | 2256 | 2159 | 1.4e-223 |
| Protein name | | | | | Locus Name | Acc# |
| | | | | | sp:YFCX_ECOLI | P77399 |

Description

| ORF Name | NTID | AAID | NT Length | AA Length | Score | Probability |
|---|---|---|---|---|---|---|
| 1361062_c2_298 | 10 | 4182 | 60 | 183 | | |
| Protein name | | | | | Locus Name | Acc# |

Description
NO-HIT

| ORF Name | NTID | AAID | NT Length | AA Length | Score | Probability |
|---|---|---|---|---|---|---|
| 13682055_c3_432 | 11 | 4183 | 215 | 648 | 762 | 1.6e-75 |
| Protein name | | | | | Locus Name | Acc# |
| hypothetical protein b2291 | | | | pir:A65001 | | A65001 |

Description

| ORF Name | NTID | AAID | NT Length | AA Length | Score | Probability |
|---|---|---|---|---|---|---|
| 13692002_f1_33 | 12 | 4184 | 367 | 1104 | 1542 | 3.5e-158 |
| Protein name | | | | | Locus Name | Acc# |
| | | | | sp:NUOH_ECOLI | | P33603:P78 |

Description

OXIDOREDUCTASE CHAIN 8) (NUO8)

| ORF Name | NTID | AAID | NT Length | AA Length | Score | Probability |
|---|---|---|---|---|---|---|
| 13711636_f2_91 | 13 | 4185 | 74 | 225 | | |
| Protein name | | | | | Locus Name | Acc# |

Description

NO-HIT

| ORF Name | NTID | AAID | NT Length | AA Length | Score | Probability |
|---|---|---|---|---|---|---|
| 1379713_f3_163 | 14 | 4186 | 903 | 2712 | 717 | 9.2e-71 |
| Protein name | | | | | Locus Name | Acc# |
| | | | | sp:YGCB_ECOLI | | P38036:Q46 |

Description

HYPOTHETICAL 100.5 KD PROTEIN IN IAP-CYSH INTERGENIC REGION

| ORF Name | NTID | AAID | NT Length | AA Length | Score | Probability |
|---|---|---|---|---|---|---|
| 13836511_c1_229 | 15 | 4187 | 586 | 1761 | 1436 | 5.9e-147 |
| Protein name | | | | | Locus Name | Acc# |
| dimethylsulfoxide reductase, chain A1 precursor, anaerobic | | | | pir:E64914 | | E64914 |

Description

| ORF Name | NTID | AAID | NT Length | AA Length | Score | Probability |
|---|---|---|---|---|---|---|
| 13875051_c2_336 | 16 | 4188 | 85 | 258 | 75 | 0.0090 |
| Protein name | | | | | Locus Name | Acc# |
| alpha II spectrin | | | | | gp:HSU26396 | U26396 |

Description

Human fetal alpha II spectrin mRNA, partial cds.

| ORF Name | NTID | AAID | NT Length | AA Length | Score | Probability |
|---|---|---|---|---|---|---|
| 13880467_f2_121 | 17 | 4189 | 226 | 681 | | |
| Protein name | | | | | Locus Name | Acc# |

Description

NO-HIT

| ORF Name | NTID | AAID | NT Length | AA Length | Score | Probability |
|---|---|---|---|---|---|---|
| 14542082_f2_83 | 18 | 4190 | 346 | 1041 | 1255 | 9.0e-128 |
| Protein name | | | | | Locus Name | Acc# |
| | | | | | sp:ACCD_ECOLI | P08193:P78 |

Description (EC 6.4.1.2) (ACCASE BETA CHAIN)

| ORF Name | NTID | AAID | NT Length | AA Length | Score | Probability |
|---|---|---|---|---|---|---|
| 14589551_c2_337 | 19 | 4191 | 78 | 237 | 126 | 3.9e-08 |
| Protein name | | | | | Locus Name | Acc# |
| hypothetical protein APE1413 | | | | | pir:D72619 | D72619 |

Description

| ORF Name | NTID | AAID | NT Length | AA Length | Score | Probability |
|---|---|---|---|---|---|---|
| 14720267_c3_460 | 20 | 4192 | 68 | 207 | 80 | 0.0029 |
| Protein name | | | | | Locus Name | Acc# |
| hypothetical protein 105 | | | | | pir:S72306 | S72306 |

Description

| ORF Name | NTID | AAID | NT Length | AA Length | Score | Probability |
|---|---|---|---|---|---|---|
| 14875206_f2_107 | 21 | 4193 | 257 | 774 | 588 | 4.3e-57 |
| Protein name | | | | | Locus Name | Acc# |
| | | | | | gp:D90857 | D90857:AB0 |

Description

E.coli genomic DNA, Kohara clone #380(51.1-51.4 min.).

| ORF Name | NTID | AAID | NT Length | AA Length | Score | Probability |
|---|---|---|---|---|---|---|
| 14875427_c1_220 | 22 | 4194 | 589 | 1770 | 1478 | 2.1e-151 |
| Protein name | | | | | Locus Name | Acc# |
| TtrS | | | | | gp:STY224978 | AJ224978 |

Description

Salmonella typhimurium, Salmonella Pathogenicity Island 2 (SPI2) genes, ttr gene cluster.

| ORF Name | NTID | AAID | NT Length | AA Length | Score | Probability |
|---|---|---|---|---|---|---|
| 14879150_f2_103 | 23 | 4195 | 491 | 1476 | 1407 | 7.0e-144 |
| Protein name | | | | | Locus Name | Acc# |
| | | | | | sp:NUON_ECOLI | P33608:P78 |

Description

OXIDOREDUCTASE CHAIN 14) (NUO14)

| ORF Name | NTID | AAID | NT Length | AA Length | Score | Probability |
|---|---|---|---|---|---|---|
| 14882927_f2_96 | 24 | 4196 | 600 | 1803 | 2787 | 4.1e-290 |
| Protein name | | | | | Locus Name | Acc# |
| NADH dehydrogenase (ubiquinone), I, chain C-D | | | | | pir:D65000 | D65000:S38 |

Description

| ORF Name | NTID | AAID | NT Length | AA Length | Score | Probability |
|---|---|---|---|---|---|---|
| 14884580_f3_154 | 25 | 4197 | 454 | 1365 | 1300 | 1.5e-132 |
| Protein name | | | | | Locus Name | Acc# |
| | | | | | sp:FOLC_ECOLI | P08192:P78 |

Description

| ORF Name | NTID | AAID | NT Length | AA Length | Score | Probability |
|---|---|---|---|---|---|---|
| 1501_f2_133 | 26 | 4198 | 116 | 351 | 71 | 0.026 |
| Protein name | | | | | Locus Name | Acc# |
| | | | | | sp:ATP8_PETMA | Q35537 |

Description: ATP SYNTHASE PROTEIN 8, (A6L)

| ORF Name | NTID | AAID | NT Length | AA Length | Score | Probability |
|---|---|---|---|---|---|---|
| 15626876_c3_436 | 27 | 4199 | 66 | 201 | | |
| Protein name | | | | | Locus Name | Acc# |

Description: NO-HIT

| ORF Name | NTID | AAID | NT Length | AA Length | Score | Probability |
|---|---|---|---|---|---|---|
| 158518_f1_41 | 28 | 4200 | 945 | 2838 | 2582 | 2.2e-268 |
| Protein name | | | | | Locus Name | Acc# |
| RcsC | | | | | gp:AF071215 | AF071215 |

Description: Proteus mirabilis regulator of swarming behavior precursor (rsbA) and RcsB (rcsB) genes, complete cds; and RcsC (rcsC) gene, partial cds.

| ORF Name | NTID | AAID | NT Length | AA Length | Score | Probability |
|---|---|---|---|---|---|---|
| 15859665_f1_68 | 29 | 4201 | 362 | 1089 | 877 | 1.0e-87 |
| Protein name | | | | | Locus Name | Acc# |
| tetrathionate reductase subunit C (TtrC) | | | | | gp:STY224978 | AJ224978 |

Description: Salmonella typhimurium, Salmonella Pathogenicity Island 2 (SPI2) genes, ttr gene cluster.

| ORF Name | NTID | AAID | NT Length | AA Length | Score | Probability |
|---|---|---|---|---|---|---|
| 15890937_f3_152 | 30 | 4202 | 298 | 897 | 1187 | 1.4e-120 |
| Protein name | | | | | Locus Name | Acc# |
| | | | | | sp:TRUA_ECOLI | P07649 |

Description: I) (PSEUDOURIDINE SYNTHASE I) (URACIL HYDROLYASE) (PSU-I)

| ORF Name | NTID | AAID | NT Length | AA Length | Score | Probability |
|---|---|---|---|---|---|---|
| 16176526_c3_395 | 31 | 4203 | 63 | 192 | | |
| Protein name | | | | | Locus Name | Acc# |

Description
NO-HIT

| ORF Name | NTID | AAID | NT Length | AA Length | Score | Probability |
|---|---|---|---|---|---|---|
| 16276577_f2_81 | 32 | 4204 | 403 | 1212 | 1689 | 9.2e-174 |
| Protein name | | | | | Locus Name | Acc# |
| | | | | | sp:FABB_ECOLI | P14926 |

Description
KETOACYL-ACP SYNTHASE I) (KAS I)

| ORF Name | NTID | AAID | NT Length | AA Length | Score | Probability |
|---|---|---|---|---|---|---|
| 165927_f2_88 | 33 | 4205 | 226 | 681 | 119 | 1.5e-05 |
| Protein name | | | | | Locus Name | Acc# |
| | | | | | sp:YGCH_ECOLI | Q46897 |

Description
HYPOTHETICAL 22.3 KD PROTEIN IN IAP-CYSH INTERGENIC REGION

| ORF Name | NTID | AAID | NT Length | AA Length | Score | Probability |
|---|---|---|---|---|---|---|
| 16830288_f3_183 | 34 | 4206 | 476 | 1431 | 1226 | 1.1e-124 |
| Protein name | | | | | Locus Name | Acc# |
| | | | | | sp:MENE_ECOLI | P37353:P78 |

Description
(O-SUCCINYLBENZOATE-COA SYNTHASE)

| ORF Name | NTID | AAID | NT Length | AA Length | Score | Probability |
|---|---|---|---|---|---|---|
| 17510_f1_7 | 35 | 4207 | 342 | 1029 | 1138 | 2.3e-115 |
| Protein name | | | | | Locus Name | Acc# |
| | | | | | sp:YFCB_ECOLI | P39199:P78 |

Description
(EC 2.1.1.72)

| ORF_Name | NTID | AAID | NT Length | AA Length | Score | Probability |
|---|---|---|---|---|---|---|
| 188155_c1_292 | 36 | 4208 | 247 | 744 | 93 | 0.018 |
| Protein name | | | | | Locus Name | Acc# |
| | | | | | sp:PAPF_ECOLI | P08408 |

Description
MINOR FIMBRIAL PROTEIN PAPF PRECURSOR

| ORF_Name | NTID | AAID | NT Length | AA Length | Score | Probability |
|---|---|---|---|---|---|---|
| 194688_c1_216 | 37 | 4209 | 181 | 546 | 266 | 5.7e-23 |
| Protein name | | | | | Locus Name | Acc# |
| | | | | | sp:YLAC_ECOLI | P77523 |

Description
HYPOTHETICAL 19.8 KD PROTEIN IN TESB-HHA INTERGENIC REGION

| ORF_Name | NTID | AAID | NT Length | AA Length | Score | Probability |
|---|---|---|---|---|---|---|
| 20041052_f2_72 | 38 | 4210 | 263 | 792 | 894 | 1.6e-89 |
| Protein name | | | | | Locus Name | Acc# |
| | | | | | sp:VACJ_SHIFL | P43262 |

Description
VACJ LIPOPROTEIN PRECURSOR

| ORF_Name | NTID | AAID | NT Length | AA Length | Score | Probability |
|---|---|---|---|---|---|---|
| 20784630_f2_118 | 39 | 4211 | 503 | 1512 | | |
| Protein name | | | | | Locus Name | Acc# |

Description
NO-HIT

| ORF_Name | NTID | AAID | NT Length | AA Length | Score | Probability |
|---|---|---|---|---|---|---|
| 2079540_f2_92 | 40 | 4212 | 177 | 534 | 700 | 5.8e-69 |
| Protein name | | | | | Locus Name | Acc# |
| hypothetical protein b2294 | | | | | pir:D65001 | D65001 |

Description

| ORF_Name | NTID | AAID | NT Length | AA Length | Score | Probability |
|---|---|---|---|---|---|---|
| 21571875_f3_205 | 41 | 4213 | 375 | 1128 | 853 | 3.6e-85 |
| Protein name | | | | | Locus Name | Acc# |
| probable NADH-dependent flavin oxidoreductase | | | | | pir:H75303 | H75303 |

Description
NO-HIT... (see below)

| ORF_Name | NTID | AAID | NT Length | AA Length | Score | Probability |
|---|---|---|---|---|---|---|
| 21679628_f2_125 | 42 | 4214 | 201 | 606 | | |
| Protein name | | | | | Locus Name | Acc# |

Description
NO-HIT

| ORF_Name | NTID | AAID | NT Length | AA Length | Score | Probability |
|---|---|---|---|---|---|---|
| 21725837_f1_31 | 43 | 4215 | 244 | 735 | 1126 | 4.2e-114 |
| Protein name | | | | | Locus Name | Acc# |
| NADH dehydrogenase chain B | | | | | gp:AF057063 | AF057063 |

Description
Erwinia carotovora subsp. carotovora aspartate aminotransferase(aat) gene, partial cds; HexA (hexA), NADH dehydrogenase chain A(nuoA), and NADH dehydrogenase chain B (nuoB) genes, complete cds;and NADH dehydrogenase chain C (nuoC) gene, partial cds.

| ORF_Name | NTID | AAID | NT Length | AA Length | Score | Probability |
|---|---|---|---|---|---|---|
| 21759687_f3_165 | 44 | 4216 | 345 | 1038 | 350 | 7.2e-32 |
| Protein name | | | | | Locus Name | Acc# |
| | | | | | sp:YGCJ_ECOLI | Q46899 |

Description
HYPOTHETICAL 40.0 KD PROTEIN IN IAP-CYSH INTERGENIC REGION

| ORF_Name | NTID | AAID | NT Length | AA Length | Score | Probability |
|---|---|---|---|---|---|---|
| 2189126_f1_32 | 45 | 4217 | 200 | 603 | 691 | 5.2e-68 |
| Protein name | | | | | Locus Name | Acc# |
| | | | | | sp:NUOE_SALTY | P33903 |

Description
OXIDOREDUCTASE CHAIN 5) (NUO5)

| ORF Name | NTID | AAID | NT Length | AA Length | Score | Probability |
|---|---|---|---|---|---|---|
| 2206381_f3_156 | 46 | 4218 | 515 | 1548 | 2198 | 1.1e-227 |
| Protein name | | | | | Locus Name | Acc# |
| amidophosphoribosyltransferase, | | | | pir:XQEC | | F65003:A92 |

Description

| ORF Name | NTID | AAID | NT Length | AA Length | Score | Probability |
|---|---|---|---|---|---|---|
| 22397577_f1_8 | 47 | 4219 | 184 | 555 | 706 | 1.4e-69 |
| Protein name | | | | | Locus Name | Acc# |
| | | | | sp:YFCM_ECOLI | | P76938:P76 |

Description

HYPOTHETICAL 21.1 KD PROTEIN IN FABB-MEPA INTERGENIC REGION

| ORF Name | NTID | AAID | NT Length | AA Length | Score | Probability |
|---|---|---|---|---|---|---|
| 22479625_f3_191 | 48 | 4220 | 155 | 468 | 72 | 0.035 |
| Protein name | | | | | Locus Name | Acc# |
| fibronectin | | | | gp:RATFNT3A | | M11750 |

Description

Rat fibronectin gene, exon X, with a type III repeat.

| ORF Name | NTID | AAID | NT Length | AA Length | Score | Probability |
|---|---|---|---|---|---|---|
| 22837750_c3_400 | 49 | 4221 | 419 | 1260 | 1271 | 1.8e-129 |
| Protein name | | | | | Locus Name | Acc# |
| | | | | sp:YBDG_ECOLI | | P39455:P77 |

Description

HYPOTHETICAL 46.6 KD PROTEIN IN PHEP-NFNB INTERGENIC REGION

| ORF Name | NTID | AAID | NT Length | AA Length | Score | Probability |
|---|---|---|---|---|---|---|
| 22853401_c2_312 | 50 | 4222 | 206 | 621 | 742 | 2.1e-73 |
| Protein name | | | | | Locus Name | Acc# |
| | | | | sp:DMSB_ECOLI | | P18776:P77 |

Description

REDUCTASE IRON-SULFUR SUBUNIT)

| ORF Name | NTID | AAID | NT Length | AA Length | Score | Probability |
|---|---|---|---|---|---|---|
| 23478432_f2_94 | 51 | 4223 | 306 | 921 | 943 | 1.0e-94 |
| Protein name | | | | | Locus Name | Acc# |
| HexA | | | | | gp:AF057063 | AF057063 |

Description

Erwinia carotovora subsp. carotovora aspartate aminotransferase(aat) gene, partial cds; HexA (hexA), NADH dehydrogenase chain A(nuoA), and NADH dehydrogenase chain B (nuoB) genes, complete cds;and NADH dehydrogenase chain C (nuoC) gene, partial cds.

| ORF Name | NTID | AAID | NT Length | AA Length | Score | Probability |
|---|---|---|---|---|---|---|
| 23521015_c2_311 | 52 | 4224 | 73 | 222 | | |
| Protein name | | | | | Locus Name | Acc# |

Description

NO-HIT

| ORF Name | NTID | AAID | NT Length | AA Length | Score | Probability |
|---|---|---|---|---|---|---|
| 23525305_f1_36 | 53 | 4225 | 562 | 1689 | 1954 | 7.6e-202 |
| Protein name | | | | | Locus Name | Acc# |
| | | | | | sp:MEND_ECOLI | P17109:P76 |

Description

| ORF Name | NTID | AAID | NT Length | AA Length | Score | Probability |
|---|---|---|---|---|---|---|
| 23598958_f1_20 | 54 | 4226 | 425 | 1278 | 807 | 9.9e-83 |
| Protein name | | | | | Locus Name | Acc# |
| probable integral membrane protein | | | | | pir:T37066 | T37066 |

Description

| ORF Name | NTID | AAID | NT Length | AA Length | Score | Probability |
|---|---|---|---|---|---|---|
| 23610036_c2_387 | 55 | 4227 | 63 | 192 | | |
| Protein name | | | | | Locus Name | Acc# |

Description

NO-HIT

| ORF Name | NTID | AAID | NT Length | AA Length | Score | Probability |
|---|---|---|---|---|---|---|
| 23676683_c2_362 | 56 | 4228 | 221 | 666 | 706 | 1.4e-69 |
| Protein name | | | | | Locus Name | Acc# |
| | | | | | sp:YFCG_ECOLI | P77526 |

Description
HYPOTHETICAL 24.5 KD PROTEIN IN PTA-FOLX INTERGENIC REGION

| ORF Name | NTID | AAID | NT Length | AA Length | Score | Probability |
|---|---|---|---|---|---|---|
| 23859812_f1_57 | 57 | 4229 | 298 | 897 | 491 | 8.2e-47 |
| Protein name | | | | | Locus Name | Acc# |
| | | | | | sp:DAAA_BACSP | P19938 |

Description
TRANSAMINASE)

| ORF Name | NTID | AAID | NT Length | AA Length | Score | Probability |
|---|---|---|---|---|---|---|
| 24229676_c3_412 | 58 | 4230 | 90 | 273 | 142 | 7.9e-10 |
| Protein name | | | | | Locus Name | Acc# |
| | | | | | sp:YGDI_ECOLI | Q46924 |

Description
HYPOTHETICAL LIPOPROTEIN YGDI PRECURSOR

| ORF Name | NTID | AAID | NT Length | AA Length | Score | Probability |
|---|---|---|---|---|---|---|
| 24244692_c1_288 | 59 | 4231 | 184 | 555 | 648 | 1.9e-63 |
| Protein name | | | | | Locus Name | Acc# |
| | | | | | sp:YFCN_ECOLI | P77458 |

Description
HYPOTHETICAL 21.0 KD PROTEIN IN AROC-SIXA INTERGENIC REGION

| ORF Name | NTID | AAID | NT Length | AA Length | Score | Probability |
|---|---|---|---|---|---|---|
| 24250625_c1_283 | 60 | 4232 | 106 | 321 | | |
| Protein name | | | | | Locus Name | Acc# |

Description
NO-HIT

| ORF Name | NTID | AAID | NT Length | AA Length | Score | Probability |
|---|---|---|---|---|---|---|
| 24258292_c2_360 | 61 | 4233 | 355 | 1068 | 396 | 9.6e-37 |
| Protein name | | | | | Locus Name | Acc# |
| | | | | | sp:GNTR_ECOLI | P46860:Q47 |

Description: GLUCONATE UTILIZATION SYSTEM GNT-I TRANSCRIPTIONAL REPRESSOR

| ORF Name | NTID | AAID | NT Length | AA Length | Score | Probability |
|---|---|---|---|---|---|---|
| 24258561_c1_238 | 62 | 4234 | 207 | 624 | 350 | 7.2e-32 |
| Protein name | | | | | Locus Name | Acc# |
| | | | | | sp:RPC1_BPPH8 | P14819 |

Description: REPRESSOR PROTEIN CI

| ORF Name | NTID | AAID | NT Length | AA Length | Score | Probability |
|---|---|---|---|---|---|---|
| 24423376_f1_10 | 63 | 4235 | 63 | 192 | | |
| Protein name | | | | | Locus Name | Acc# |

Description: NO-HIT

| ORF Name | NTID | AAID | NT Length | AA Length | Score | Probability |
|---|---|---|---|---|---|---|
| 24428588_f3_194 | 64 | 4236 | 110 | 333 | 80 | 0.0058 |
| Protein name | | | | | Locus Name | Acc# |
| hypothetical protein PAB0982 | | | | | pir:E75061 | E75061 |

Description

| ORF Name | NTID | AAID | NT Length | AA Length | Score | Probability |
|---|---|---|---|---|---|---|
| 24647188_f2_117 | 65 | 4237 | 101 | 306 | 228 | 6.1e-19 |
| Protein name | | | | | Locus Name | Acc# |
| | | | | | sp:VLY1_BPP22 | P09962 |

Description: LYSIS PROTEIN 13

| ORF Name | NTID | AAID | NT Length | AA Length | Score | Probability |
|---|---|---|---|---|---|---|
| 24805318_f1_23 | 66 | 4238 | 411 | 1236 | 374 | 2.1e-34 |
| Protein name | | | | | Locus Name | Acc# |
| | | | | | sp:ALR2_BACSU | P94494 |

Description: PUTATIVE ALANINE RACEMASE,

| ORF Name | NTID | AAID | NT Length | AA Length | Score | Probability |
|---|---|---|---|---|---|---|
| 25428137_c1_244 | 67 | 4239 | 382 | 1149 | 1756 | 7.3e-181 |
| Protein name | | | | | Locus Name | Acc# |
| ribonucleoside-diphosphate reductase, 1 beta chain:ribonucleotide reductase B2 protein | | | | | pir:RDEC2R | A00527:A64 |

Description:

| ORF Name | NTID | AAID | NT Length | AA Length | Score | Probability |
|---|---|---|---|---|---|---|
| 25546885_f1_60 | 68 | 4240 | 111 | 336 | | |
| Protein name | | | | | Locus Name | Acc# |

Description: NO-HIT

| ORF Name | NTID | AAID | NT Length | AA Length | Score | Probability |
|---|---|---|---|---|---|---|
| 25547137_f2_79 | 69 | 4241 | 307 | 924 | | |
| Protein name | | | | | Locus Name | Acc# |

Description: NO-HIT

| ORF Name | NTID | AAID | NT Length | AA Length | Score | Probability |
|---|---|---|---|---|---|---|
| 25572157_c2_313 | 70 | 4242 | 259 | 780 | 261 | 1.9e-22 |
| Protein name | | | | | Locus Name | Acc# |
| probable dimethylsulfoxide reductase, chain C1, anaerobic | | | | | pir:H64914 | H64914 |

Description:

| ORF Name | NTID | AAID | NT Length | AA Length | Score | Probability |
|---|---|---|---|---|---|---|
| 2579765_f2_130 | 71 | 4243 | 139 | 420 | 137 | 2.7e-09 |
| Protein name | | | | | Locus Name | Acc# |
| hypothetical protein SC4H8.03 SC4H8.03 | | | | | pir:T35134 | T35134 |

Description hypothetical protein SC4H8.03 SC4H8.03

| ORF Name | NTID | AAID | NT Length | AA Length | Score | Probability |
|---|---|---|---|---|---|---|
| 26460887_f3_190 | 72 | 4244 | 175 | 528 | | |
| Protein name | | | | | Locus Name | Acc# |

Description

NO-HIT

| ORF Name | NTID | AAID | NT Length | AA Length | Score | Probability |
|---|---|---|---|---|---|---|
| 26584703_f2_139 | 73 | 4245 | 252 | 759 | 1093 | 1.3e-110 |
| Protein name | | | | | Locus Name | Acc# |
| tetrathionate reductase subunit B (TtrB) | | | | | gp:STY224978 | AJ224978 |

Description

Salmonella typhimurium, Salmonella Pathogenicity Island 2 (SPI2) genes, ttr gene cluster.

| ORF Name | NTID | AAID | NT Length | AA Length | Score | Probability |
|---|---|---|---|---|---|---|
| 26593818_f3_153 | 74 | 4246 | 235 | 708 | 962 | 1.0e-96 |
| Protein name | | | | | Locus Name | Acc# |
| | | | | | sp:DEDA_ECOLI | P09548 |

Description

DEDA PROTEIN (DSG-1 PROTEIN)

| ORF Name | NTID | AAID | NT Length | AA Length | Score | Probability |
|---|---|---|---|---|---|---|
| 26759375_c2_310 | 75 | 4247 | 192 | 579 | 347 | 1.5e-31 |
| Protein name | | | | | Locus Name | Acc# |
| | | | | | gp:AB016260 | AB016260:A |

Description

Agrobacterium tumefaciens plasmid pTi-SAKURA, complete sequence.

| ORF Name | NTID | AAID | NT Length | AA Length | Score | Probability |
|---|---|---|---|---|---|---|
| 281931_c2_373 | 76 | 4248 | 316 | 951 | 347 | 1.5e-31 |
| Protein name | | | | | Locus Name | Acc# |
| unknown | | | | | gp:AF079317 | AF079317 |

Description: Sphingomonas aromaticivorans plasmid pNL1, complete plasmidsequence.

| ORF Name | NTID | AAID | NT Length | AA Length | Score | Probability |
|---|---|---|---|---|---|---|
| 2845827_c3_411 | 77 | 4249 | 897 | 2694 | 4589 | 0.0 |
| Protein name | | | | | Locus Name | Acc# |
| regulator of swarming behavior precursor | | | | | gp:AF071215 | AF071215 |

Description: Proteus mirabilis regulator of swarming behavior precursor (rsbA)and RcsB (rcsB) genes, complete cds; and RcsC (rcsC) gene, partialcds.

| ORF Name | NTID | AAID | NT Length | AA Length | Score | Probability |
|---|---|---|---|---|---|---|
| 2847175_c1_225 | 78 | 4250 | 251 | 756 | 416 | 7.3e-39 |
| Protein name | | | | | Locus Name | Acc# |
| | | | | | sp:YGIX_ECOLI | P52076 |

Description: PROBABLE TRANSCRIPTIONAL REGULATORY PROTEIN YGIX

| ORF Name | NTID | AAID | NT Length | AA Length | Score | Probability |
|---|---|---|---|---|---|---|
| 29300036_f2_74 | 79 | 4251 | 106 | 321 | 300 | 1.4e-26 |
| Protein name | | | | | Locus Name | Acc# |
| | | | | | sp:YFCZ_ECOLI | P76504:P77 |

Description: HYPOTHETICAL 10.3 KD PROTEIN IN SIXA-FADL INTERGENIC REGION

| ORF Name | NTID | AAID | NT Length | AA Length | Score | Probability |
|---|---|---|---|---|---|---|
| 29319077_c3_456 | 80 | 4252 | 267 | 804 | 203 | 2.7e-16 |
| Protein name | | | | | Locus Name | Acc# |
| | | | | | sp:Y441_METJA | Q57883 |

Description: HYPOTHETICAL PROTEIN MJ0441

| ORF Name | NTID | AAID | NT Length | AA Length | Score | Probability |
|---|---|---|---|---|---|---|
| 29457840_f1_14 | 81 | 4253 | 221 | 666 | 450 | 1.8e-42 |
| Protein name | | | | | Locus Name | Acc# |
| | | | | | sp:DEDD_ECOLI | P09549 |

Description: DEDD PROTEIN

| ORF Name | NTID | AAID | NT Length | AA Length | Score | Probability |
|---|---|---|---|---|---|---|
| 2945912_c1_245 | 82 | 4254 | 100 | 303 | 246 | 7.5e-21 |
| Protein name | | | | | Locus Name | Acc# |
| | | | | | sp:YFAE_HAEIN | P45154 |

Description: HYPOTHETICAL PROTEIN HI1309

| ORF Name | NTID | AAID | NT Length | AA Length | Score | Probability |
|---|---|---|---|---|---|---|
| 29475968_f2_102 | 83 | 4255 | 514 | 1545 | 1837 | 1.9e-189 |
| Protein name | | | | | Locus Name | Acc# |
| | | | | | sp:NUOM_ECOLI | P31978:P78 |

Description: OXIDOREDUCTASE CHAIN 13) (NUO13)

| ORF Name | NTID | AAID | NT Length | AA Length | Score | Probability |
|---|---|---|---|---|---|---|
| 29843807_f1_13 | 84 | 4256 | 345 | 1038 | 1055 | 1.4e-106 |
| Protein name | | | | | Locus Name | Acc# |
| | | | | | sp:USG_ECOLI | P08390 |

Description: USG-1 PROTEIN

| ORF Name | NTID | AAID | NT Length | AA Length | Score | Probability |
|---|---|---|---|---|---|---|
| 30080015_f1_44 | 85 | 4257 | 356 | 1071 | 999 | 1.2e-100 |
| Protein name | | | | | Locus Name | Acc# |
| | | | | | sp:SYW_CLOLO | Q46127 |

Description: (TRPRS)

| ORF Name | NTID | AAID | NT Length | AA Length | Score | Probability |
|---|---|---|---|---|---|---|
| 30259541_f2_98 | 86 | 4258 | 919 | 2760 | 3587 | 0.0 |
| Protein name | | | | | Locus Name | Acc# |
| | | | | | sp:NUOG_SALTY | P33900 |

Description: OXIDOREDUCTASE CHAIN 7) (NUO7)

| ORF Name | NTID | AAID | NT Length | AA Length | Score | Probability |
|---|---|---|---|---|---|---|
| 30745456_c2_363 | 87 | 4259 | 63 | 192 | 73 | 0.038 |
| Protein name | | | | | Locus Name | Acc# |
| | | | | | gp:CEY59A8B | AL132898 |

Description: Caenorhabditis elegans cosmid Y59A8B, complete sequence.

| ORF Name | NTID | AAID | NT Length | AA Length | Score | Probability |
|---|---|---|---|---|---|---|
| 3127192_f3_164 | 88 | 4260 | 211 | 636 | | |
| Protein name | | | | | Locus Name | Acc# |

Description: NO-HIT

| ORF Name | NTID | AAID | NT Length | AA Length | Score | Probability |
|---|---|---|---|---|---|---|
| 31500691_f2_100 | 89 | 4261 | 112 | 339 | 475 | 4.1e-45 |
| Protein name | | | | | Locus Name | Acc# |
| NADH DEHYDROGENASE I CHAIN K (EC 1.6.5.3) | | | | | gp:D90859 | D90859:AB0 |

Description: E.coli genomic DNA, Kohara clone #403(51.5-51.9 min.).

| ORF Name | NTID | AAID | NT Length | AA Length | Score | Probability |
|---|---|---|---|---|---|---|
| 31682827_c1_226 | 90 | 4262 | 467 | 1404 | 450 | 1.8e-42 |
| Protein name | | | | | Locus Name | Acc# |
| | | | | | sp:YGIY_ECOLI | P40719 |

Description: PROBABLE SENSOR PROTEIN YGIY,

| ORF Name | NTID | AAID | NT Length | AA Length | Score | Probability |
|---|---|---|---|---|---|---|
| 31751392_c2_344 | 91 | 4263 | 413 | 1242 | 1884 | 2.0e-194 |
| Protein name | | | | | Locus Name | Acc# |
| | | | | | sp:YFBQ_ECOLI | P77727 |

Description: PROBABLE AMINOTRANSFERASE YFBQ,

| ORF Name | NTID | AAID | NT Length | AA Length | Score | Probability |
|---|---|---|---|---|---|---|
| 31756510_c3_391 | 92 | 4264 | 226 | 681 | 159 | 1.2e-11 |
| Protein name | | | | | Locus Name | Acc# |
| | | | | | sp:ECNR_CITFR | O69280 |

Description: TRANSCRIPTIONAL REGULATORY PROTEIN ENTR (ENTERICIDIN R)

| ORF Name | NTID | AAID | NT Length | AA Length | Score | Probability |
|---|---|---|---|---|---|---|
| 31837778_c3_455 | 93 | 4265 | 454 | 1365 | 1390 | 4.5e-142 |
| Protein name | | | | | Locus Name | Acc# |
| | | | | | sp:FADL_ECOLI | P10384:P77 |

Description: FADL PROTEIN) (OUTER MEMBRANE FLP PROTEIN)

| ORF Name | NTID | AAID | NT Length | AA Length | Score | Probability |
|---|---|---|---|---|---|---|
| 31837906_f3_176 | 94 | 4266 | 82 | 249 | 118 | 2.8e-07 |
| Protein name | | | | | Locus Name | Acc# |
| NADH DEHYDROGENASE I CHAIN G (EC 1.6.5.3) | | | | | gp:D90859 | D90859:AB0 |

Description: E.coli genomic DNA, Kohara clone #403(51.5-51.9 min.).

| ORF Name | NTID | AAID | NT Length | AA Length | Score | Probability |
|---|---|---|---|---|---|---|
| 31844581_c2_350 | 95 | 4267 | 745 | 2238 | 3040 | 0.0 |
| Protein name | | | | | Locus Name | Acc# |
| phosphate acetyltransferase, | | | | | pir:JX0357 | JX0357 |

Description

| ORF Name | NTID | AAID | NT Length | AA Length | Score | Probability |
|---|---|---|---|---|---|---|
| 3205043_c3_414 | 96 | 4268 | 406 | 1221 | 2073 | 1.9e-214 |

| Protein name | Locus Name | Acc# |
|---|---|---|
| | sp:CATA_PROMI | P42321 |

Description
CATALASE,

| ORF Name | NTID | AAID | NT Length | AA Length | Score | Probability |
|---|---|---|---|---|---|---|
| 32459656_f1_37 | 97 | 4269 | 325 | 978 | 1103 | 1.2e-111 |

| Protein name | Locus Name | Acc# |
|---|---|---|
| O-SUCCINYLBENZOATE-COA SYNTHASE (OSB SYNTHASE) | gp:D90857 | D90857:AB0 |

Description
E.coli genomic DNA, Kohara clone #380(51.1-51.4 min.).

| ORF Name | NTID | AAID | NT Length | AA Length | Score | Probability |
|---|---|---|---|---|---|---|
| 32510_f3_141 | 98 | 4270 | 128 | 387 | 148 | 1.8e-10 |

| Protein name | Locus Name | Acc# |
|---|---|---|
| | gp:PMFIMOPR | Z32686 |

Description
Proteus mirabilis fimbrial operon, strain HI4320.

| ORF Name | NTID | AAID | NT Length | AA Length | Score | Probability |
|---|---|---|---|---|---|---|
| 32690887_f3_197 | 99 | 4271 | 410 | 1233 | | |

| Protein name | Locus Name | Acc# |
|---|---|---|
| | | |

Description
NO-HIT

| ORF Name | NTID | AAID | NT Length | AA Length | Score | Probability |
|---|---|---|---|---|---|---|
| 33333566_f2_119 | 100 | 4272 | 777 | 2334 | 174 | 4.6e-09 |

| Protein name | Locus Name | Acc# |
|---|---|---|
| ORF MSV156 hypothetical protein | gp:AF063866 | AF063866 |

Description
Melanoplus sanguinipes entomopoxvirus, complete genome.

106

| ORF_Name | NTID | AAID | NT Length | AA Length | Score | Probability |
|---|---|---|---|---|---|---|
| 33360677_c1_227 | 101 | 4273 | 110 | 333 | | |
| Protein name | | | | | Locus Name | Acc# |

Description
NO-HIT

| ORF_Name | NTID | AAID | NT Length | AA Length | Score | Probability |
|---|---|---|---|---|---|---|
| 33398311_f1_5 | 102 | 4274 | 169 | 510 | 393 | 2.0e-36 |
| Protein name | | | | | Locus Name | Acc# |
| | | | | | sp:SIXA_ECOLI | P76502:P77 |

Description
PHOSPHOHISTIDINE PHOSPHATASE SIXA, (RX6)

| ORF_Name | NTID | AAID | NT Length | AA Length | Score | Probability |
|---|---|---|---|---|---|---|
| 33491512_c3_449 | 103 | 4275 | 684 | 2055 | 1874 | 2.3e-193 |
| Protein name | | | | | Locus Name | Acc# |
| hypothetical protein b2324 | | | | | pir:B65005 | B65005 |

Description

| ORF_Name | NTID | AAID | NT Length | AA Length | Score | Probability |
|---|---|---|---|---|---|---|
| 3361077_f3_150 | 104 | 4276 | 266 | 801 | 842 | 5.2e-84 |
| Protein name | | | | | Locus Name | Acc# |
| | | | | | sp:YFCA_ECOLI | P14008 |

Description
HYPOTHETICAL 28.6 KD PROTEIN IN FABB-MEPA INTERGENIC REGION

| ORF_Name | NTID | AAID | NT Length | AA Length | Score | Probability |
|---|---|---|---|---|---|---|
| 33829687_f2_124 | 105 | 4277 | 78 | 237 | | |
| Protein name | | | | | Locus Name | Acc# |

Description
NO-HIT

| ORF Name | NTID | AAID | NT Length | AA Length | Score | Probability |
|---|---|---|---|---|---|---|
| 3392302_c1_221 | 106 | 4278 | 317 | 954 | 1106 | 5.5e-112 |
| Protein name | | | | | Locus Name | Acc# |
| | | | | | sp:HTRB_ECOLI | P24187 |

Description: PROTEIN B)

| ORF Name | NTID | AAID | NT Length | AA Length | Score | Probability |
|---|---|---|---|---|---|---|
| 33989755_c1_293 | 107 | 4279 | 200 | 603 | 758 | 4.2e-75 |
| Protein name | | | | | Locus Name | Acc# |
| | | | | | sp:PHSB_SALTY | P37601 |

Description: THIOSULFATE REDUCTASE ELECTRON TRANSPORT PROTEIN PHSB

| ORF Name | NTID | AAID | NT Length | AA Length | Score | Probability |
|---|---|---|---|---|---|---|
| 34010751_c2_381 | 108 | 4280 | 64 | 195 | | |
| Protein name | | | | | Locus Name | Acc# |

Description: NO-HIT

| ORF Name | NTID | AAID | NT Length | AA Length | Score | Probability |
|---|---|---|---|---|---|---|
| 34087931_f1_47 | 109 | 4281 | 68 | 207 | 146 | 3.0e-10 |
| Protein name | | | | | Locus Name | Acc# |
| lipoprotein Rz1 precursor | | | | | pir:JN0750 | JN0750 |

Description:

| ORF Name | NTID | AAID | NT Length | AA Length | Score | Probability |
|---|---|---|---|---|---|---|
| 34103417_c3_459 | 110 | 4282 | 256 | 771 | 888 | 7.0e-89 |
| Protein name | | | | | Locus Name | Acc# |
| | | | | | sp:PHSC_SALTY | P37602:P37 |

Description: THIOSULFATE REDUCTASE CYTOCHROME B SUBUNIT

| ORF Name | NTID | AAID | NT Length | AA Length | Score | Probability |
|---|---|---|---|---|---|---|
| 34438_f1_3 | 111 | 4283 | 442 | 1329 | 1652 | 7.7e-170 |
| Protein name | | | | | Locus Name | Acc# |
| | | | | | sp:YFCY_ECOLI | P76503 |

Description
ACYLTRANSFERASE) (BETA-KETOTHIOLASE)

| ORF Name | NTID | AAID | NT Length | AA Length | Score | Probability |
|---|---|---|---|---|---|---|
| 34506500_f1_59 | 112 | 4284 | 218 | 657 | 491 | 8.2e-47 |
| Protein name | | | | | Locus Name | Acc# |
| acetyltransferase-like protein | | | | | gp:LSAJ6274 | AJ006274 |

Description
Lactobacillus sakei orfy, hrcA, grpE, dnaK, dnaJ genes.

| ORF Name | NTID | AAID | NT Length | AA Length | Score | Probability |
|---|---|---|---|---|---|---|
| 34632163_c3_389 | 113 | 4285 | 356 | 1071 | 1312 | 8.2e-134 |
| Protein name | | | | | Locus Name | Acc# |
| | | | | | sp:PYRC_ECOLI | P05020 |

Description
DIHYDROOROTASE, (DHOASE)

| ORF Name | NTID | AAID | NT Length | AA Length | Score | Probability |
|---|---|---|---|---|---|---|
| 35266037_f3_175 | 114 | 4286 | 461 | 1386 | 2030 | 6.7e-210 |
| Protein name | | | | | Locus Name | Acc# |
| | | | | | sp:NUOF_ECOLI | P31979:P78 |

Description
OXIDOREDUCTASE CHAIN 6) (NUO6)

| ORF Name | NTID | AAID | NT Length | AA Length | Score | Probability |
|---|---|---|---|---|---|---|
| 35273563_c2_384 | 115 | 4287 | 765 | 2298 | 2910 | 0.0 |
| Protein name | | | | | Locus Name | Acc# |
| | | | | | sp:PHSA_SALTY | P37600 |

Description
THIOSULFATE REDUCTASE PRECURSOR,

109

| ORF Name | NTID | AAID | NT Length | AA Length | Score | Probability |
|---|---|---|---|---|---|---|
| 35350256_f1_40 | 116 | 4288 | 63 | 192 | | |
| Protein name | | | | | Locus Name | Acc# |

Description
NO-HIT

| ORF Name | NTID | AAID | NT Length | AA Length | Score | Probability |
|---|---|---|---|---|---|---|
| 35423431_c3_415 | 117 | 4289 | 101 | 306 | 533 | 2.9e-51 |
| Protein name | | | | | Locus Name | Acc# |
| | | | | | sp:CATA_PROMI | P42321 |

Description
CATALASE,

| ORF Name | NTID | AAID | NT Length | AA Length | Score | Probability |
|---|---|---|---|---|---|---|
| 36132177_c3_416 | 118 | 4290 | 263 | 792 | 129 | 2.0e-05 |
| Protein name | | | | | Locus Name | Acc# |
| | | | | | sp:BPS2_ACIAM | P32985 |

Description
BPS2 PROTEIN

| ORF Name | NTID | AAID | NT Length | AA Length | Score | Probability |
|---|---|---|---|---|---|---|
| 36135792_c2_326 | 119 | 4291 | 770 | 2313 | 3473 | 0.0 |
| Protein name | | | | | Locus Name | Acc# |
| | | | | | sp:RIR1_ECOLI | P00452:P78 |

Description
(RIBONUCLEOTIDE REDUCTASE 1) (B1 PROTEIN) (R1 PROTEIN)

| ORF Name | NTID | AAID | NT Length | AA Length | Score | Probability |
|---|---|---|---|---|---|---|
| 36462843_f2_76 | 120 | 4292 | 362 | 1089 | 1598 | 4.0e-164 |
| Protein name | | | | | Locus Name | Acc# |
| chorismate synthase,:5-enolpyruvylshikimate-3-phosphate | | | | | pir:SYECKR | G65005:S00 |

Description

| ORF Name | NTID | AAID | NT Length | AA Length | Score | Probability |
|---|---|---|---|---|---|---|
| 36519677_f3_160 | 121 | 4293 | 101 | 306 | 106 | 5.1e-06 |
| Protein name | | | | | Locus Name | Acc# |
| | | | | | sp:PTXB_ECOLI | P39302 |

Description
(EC 2.7.1.69)

| ORF Name | NTID | AAID | NT Length | AA Length | Score | Probability |
|---|---|---|---|---|---|---|
| 36540840_f1_49 | 122 | 4294 | 170 | 513 | | |
| Protein name | | | | | Locus Name | Acc# |

Description
NO-HIT

| ORF Name | NTID | AAID | NT Length | AA Length | Score | Probability |
|---|---|---|---|---|---|---|
| 391965_c2_315 | 123 | 4295 | 80 | 243 | 74 | 0.038 |
| Protein name | | | | | Locus Name | Acc# |
| | | | | | sp:YKI3_YEAST | P36079 |

Description
HYPOTHETICAL 23.7 KD PROTEIN IN MDH1-VMA5 INTERGENIC REGION

| ORF Name | NTID | AAID | NT Length | AA Length | Score | Probability |
|---|---|---|---|---|---|---|
| 3937518_c3_397 | 124 | 4296 | 143 | 432 | 319 | 1.4e-28 |
| Protein name | | | | | Locus Name | Acc# |
| conserved hypothetical protein | | | | | pir:G75629 | G75629 |

Description

| ORF Name | NTID | AAID | NT Length | AA Length | Score | Probability |
|---|---|---|---|---|---|---|
| 3939193_f3_166 | 125 | 4297 | 248 | 747 | 278 | 3.1e-24 |
| Protein name | | | | | Locus Name | Acc# |
| hypothetical protein b2757 | | | | | pir:A65057 | A65057 |

Description

| ORF Name | NTID | AAID | NT Length | AA Length | Score | Probability |
|---|---|---|---|---|---|---|
| 3944061_c1_248 | 126 | 4298 | 412 | 1239 | 137 | 3.6e-05 |
| Protein name | | | | | Locus Name | Acc# |
| hypothetical protein BB0512 | | | | pir:G70163 | | G70163 |

Description

| ORF Name | NTID | AAID | NT Length | AA Length | Score | Probability |
|---|---|---|---|---|---|---|
| 3953588_c1_228 | 127 | 4299 | 195 | 588 | 291 | 1.3e-25 |
| Protein name | | | | | Locus Name | Acc# |
| | | | | sp:HDED_ECOLI | | P26603:P28 |

Description
HDED PROTEIN

| ORF Name | NTID | AAID | NT Length | AA Length | Score | Probability |
|---|---|---|---|---|---|---|
| 4025692_c1_231 | 128 | 4300 | 62 | 189 | 140 | 1.3e-09 |
| Protein name | | | | | Locus Name | Acc# |
| | | | | sp:YDCX_ECOLI | | P76109 |

Description
HYPOTHETICAL 9.6 KD PROTEIN IN TEHB-ANSP INTERGENIC REGION

| ORF Name | NTID | AAID | NT Length | AA Length | Score | Probability |
|---|---|---|---|---|---|---|
| 4073750_f1_17 | 129 | 4301 | 201 | 606 | 735 | 1.1e-72 |
| Protein name | | | | | Locus Name | Acc# |
| hypothetical protein b2299 | | | | pir:A65002 | | A65002 |

Description

| ORF Name | NTID | AAID | NT Length | AA Length | Score | Probability |
|---|---|---|---|---|---|---|
| 4173902_f2_116 | 130 | 4302 | 886 | 2661 | 3790 | 0.0 |
| Protein name | | | | | Locus Name | Acc# |
| DNA gyrase | | | | gp:SMU56906 | | U56906 |

Description
Serratia marcescens DNA gyrase (gyrA) gene, complete cds.

| ORF Name | NTID | AAID | NT Length | AA Length | Score | Probability |
|---|---|---|---|---|---|---|
| 4181558_f2_95 | 131 | 4303 | 151 | 456 | 559 | 5.1e-54 |
| Protein name | | | | | Locus Name | Acc# |
| NADH dehydrogenase chain A | | | | | gp:AF057063 | AF057063 |

Description

Erwinia carotovora subsp. carotovora aspartate aminotransferase(aat) gene, partial cds; HexA (hexA), NADH dehydrogenase chain A(nuoA), and NADH dehydrogenase chain B (nuoB) genes, complete cds;and NADH dehydrogenase chain C (nuoC) gene, partial cds.

| ORF Name | NTID | AAID | NT Length | AA Length | Score | Probability |
|---|---|---|---|---|---|---|
| 4192942_f2_80 | 132 | 4304 | 60 | 183 | 57 | 0.024 |
| Protein name | | | | | Locus Name | Acc# |
| | | | | | sp:MENC_HAEIN | P44961 |

Description

4-OXYBUTYRIC ACID SYNTHASE)

| ORF Name | NTID | AAID | NT Length | AA Length | Score | Probability |
|---|---|---|---|---|---|---|
| 4196050_c2_297 | 133 | 4305 | 88 | 267 | 265 | 7.3e-23 |
| Protein name | | | | | Locus Name | Acc# |
| | | | | | gp:D90742 | D90742:AB0 |

Description

Escherichia coli genomic DNA. (23.8 - 24.2 min).

| ORF Name | NTID | AAID | NT Length | AA Length | Score | Probability |
|---|---|---|---|---|---|---|
| 4301077_f2_89 | 134 | 4306 | 306 | 921 | 1180 | 8.0e-120 |
| Protein name | | | | | Locus Name | Acc# |
| hypothetical protein b2755 | | | | | pir:G65056 | G65056 |

Description

| ORF Name | NTID | AAID | NT Length | AA Length | Score | Probability |
|---|---|---|---|---|---|---|
| 4380_f1_48 | 135 | 4307 | 169 | 510 | | |
| Protein name | | | | | Locus Name | Acc# |

Description

NO-HIT

| ORF Name | NTID | AAID | NT Length | AA Length | Score | Probability |
|---|---|---|---|---|---|---|
| 4470938_f3_214 | 136 | 4308 | 73 | 222 | 321 | 8.5e-29 |
| Protein name | | | | | Locus Name | Acc# |
| | | | | | sp:CSPC_ECOLI | P36996 |

Description: COLD SHOCK-LIKE PROTEIN CSPC (CSP-C)

| ORF Name | NTID | AAID | NT Length | AA Length | Score | Probability |
|---|---|---|---|---|---|---|
| 4489712_f1_12 | 137 | 4309 | 266 | 801 | 291 | 1.3e-25 |
| Protein name | | | | | Locus Name | Acc# |
| | | | | | sp:YEAM_ECOLI | P76241 |

Description: HYPOTHETICAL TRANSCRIPTIONAL REGULATOR IN GAPA-RND INTERGENIC REGION

| ORF Name | NTID | AAID | NT Length | AA Length | Score | Probability |
|---|---|---|---|---|---|---|
| 4490686_c2_321 | 138 | 4310 | 221 | 666 | 1072 | 2.2e-108 |
| Protein name | | | | | Locus Name | Acc# |
| RcsB | | | | | gp:AF071215 | AF071215 |

Description: Proteus mirabilis regulator of swarming behavior precursor (rsbA) and RcsB (rcsB) genes, complete cds; and RcsC (rcsC) gene, partial cds.

| ORF Name | NTID | AAID | NT Length | AA Length | Score | Probability |
|---|---|---|---|---|---|---|
| 4502217_c2_304 | 139 | 4311 | 405 | 1218 | 1491 | 8.8e-153 |
| Protein name | | | | | Locus Name | Acc# |
| | | | | | sp:YCEE_ECOLI | P25744 |

Description: HYPOTHETICAL 43.9 KD PROTEIN IN MSYB-HTRB INTERGENIC REGION (ORF1)

| ORF Name | NTID | AAID | NT Length | AA Length | Score | Probability |
|---|---|---|---|---|---|---|
| 4564163_c2_352 | 140 | 4312 | 803 | 2412 | 2879 | 7.3e-300 |
| Protein name | | | | | Locus Name | Acc# |
| | | | | | sp:DHGA_ACICA | P05465 |

Description: (EC 1.1.99.17) (QUINOPROTEIN GLUCOSE DH) (GDH-A)

| ORF Name | NTID | AAID | NT Length | AA Length | Score | Probability |
|---|---|---|---|---|---|---|
| 4689387_f2_110 | 141 | 4313 | 201 | 606 | 445 | 6.1e-42 |
| Protein name | | | | | Locus Name | Acc# |
| hypothetical protein b2250 | | | | | pir:H64995 | H64995 |

Description

| ORF Name | NTID | AAID | NT Length | AA Length | Score | Probability |
|---|---|---|---|---|---|---|
| 4692832_f3_195 | 142 | 4314 | 234 | 705 | 99 | 0.0064 |
| Protein name | | | | | Locus Name | Acc# |
| | | | | | sp:VPV_BPP2 | P31340 |

Description
BASEPLATE ASSEMBLY PROTEIN V (GPV)

| ORF Name | NTID | AAID | NT Length | AA Length | Score | Probability |
|---|---|---|---|---|---|---|
| 4707842_f2_108 | 143 | 4315 | 289 | 870 | 1409 | 4.3e-144 |
| Protein name | | | | | Locus Name | Acc# |
| | | | | | sp:MENB_ECOLI | P27290 |

Description
(DHNA SYNTHETASE)

| ORF Name | NTID | AAID | NT Length | AA Length | Score | Probability |
|---|---|---|---|---|---|---|
| 4742763_c3_442 | 144 | 4316 | 309 | 930 | 948 | 3.1e-95 |
| Protein name | | | | | Locus Name | Acc# |
| hypothetical protein b2304 | | | | | pir:F65002 | F65002 |

Description

| ORF Name | NTID | AAID | NT Length | AA Length | Score | Probability |
|---|---|---|---|---|---|---|
| 475050_f1_19 | 145 | 4317 | 164 | 495 | 301 | 1.1e-26 |
| Protein name | | | | | Locus Name | Acc# |
| | | | | | sp:PTYA_ECOLI | P32058 |

Description
ENZYME II, A COMPONENT),

| ORF Name | NTID | AAID | NT Length | AA Length | Score | Probability |
|---|---|---|---|---|---|---|
| 4803452_c1_261 | 146 | 4318 | 88 | 267 | | |
| Protein name | | | | | Locus Name | Acc# |

Description
NO-HIT

| ORF Name | NTID | AAID | NT Length | AA Length | Score | Probability |
|---|---|---|---|---|---|---|
| 4806512_f3_171 | 147 | 4319 | 221 | 666 | 631 | 1.2e-61 |
| Protein name | | | | | Locus Name | Acc# |
| | | | | | sp:YFBT_ECOLI | P77625 |

Description
HYPOTHETICAL 23.7 KD PROTEIN IN LRHA-ACKA INTERGENIC REGION

| ORF Name | NTID | AAID | NT Length | AA Length | Score | Probability |
|---|---|---|---|---|---|---|
| 4877301_c1_246 | 148 | 4320 | 414 | 1245 | 1396 | 1.0e-142 |
| Protein name | | | | | Locus Name | Acc# |
| | | | | | sp:TYRP_ECOLI | P18199:P76 |

Description
TYROSINE-SPECIFIC TRANSPORT PROTEIN (TYROSINE PERMEASE)

| ORF Name | NTID | AAID | NT Length | AA Length | Score | Probability |
|---|---|---|---|---|---|---|
| 4881338_f1_46 | 149 | 4321 | 137 | 414 | 222 | 2.6e-18 |
| Protein name | | | | | Locus Name | Acc# |
| structural protein P5 | | | | | gp:AF155037 | AF155037 |

Description
Alteromonas phage, complete genome.

| ORF Name | NTID | AAID | NT Length | AA Length | Score | Probability |
|---|---|---|---|---|---|---|
| 4884713_c2_379 | 150 | 4322 | 187 | 564 | 205 | 1.7e-16 |
| Protein name | | | | | Locus Name | Acc# |
| | | | | | sp:YLT2_ANAVA | P29712 |

Description
HYPOTHETICAL 20.2 KD LOW TEMPERATURE-INDUCED PROTEIN (ORF2)

| ORF Name | NTID | AAID | NT Length | AA Length | Score | Probability |
|---|---|---|---|---|---|---|
| 4892211_c2_306 | 151 | 4323 | 541 | 1626 | 840 | 8.5e-84 |
| Protein name | | | | | Locus Name | Acc# |
| | | | | | sp:YCLF_BACSU | P94408 |

Description

HYPOTHETICAL 53.3 KD PROTEIN IN SFP-GERKA INTERGENIC REGION

| ORF Name | NTID | AAID | NT Length | AA Length | Score | Probability |
|---|---|---|---|---|---|---|
| 491312_c2_303 | 152 | 4324 | 215 | 648 | 526 | 1.6e-50 |
| Protein name | | | | | Locus Name | Acc# |
| TtrR | | | | | gp:STY224978 | AJ224978 |

Description

Salmonella typhimurium, Salmonella Pathogenicity Island 2 (SPI2) genes, ttr gene cluster.

| ORF Name | NTID | AAID | NT Length | AA Length | Score | Probability |
|---|---|---|---|---|---|---|
| 4964500_f1_52 | 153 | 4325 | 425 | 1278 | 150 | 5.0e-08 |
| Protein name | | | | | Locus Name | Acc# |
| vitelline B1 precursor:eggshell protein B1 | | | | | pir:S27819 | A48436:S27 |

Description

| ORF Name | NTID | AAID | NT Length | AA Length | Score | Probability |
|---|---|---|---|---|---|---|
| 4975962_f2_87 | 154 | 4326 | 537 | 1614 | 174 | 7.7e-10 |
| Protein name | | | | | Locus Name | Acc# |
| hypothetical protein b2760 | | | | | pir:D65057 | D65057 |

Description

| ORF Name | NTID | AAID | NT Length | AA Length | Score | Probability |
|---|---|---|---|---|---|---|
| 5085937_f3_169 | 155 | 4327 | 158 | 477 | 540 | 5.3e-52 |
| Protein name | | | | | Locus Name | Acc# |
| hypothetical protein b2295 | | | | | pir:E65001 | E65001 |

Description

| ORF Name | NTID | AAID | NT Length | AA Length | Score | Probability |
|---|---|---|---|---|---|---|
| 5093785_c1_243 | 156 | 4328 | 248 | 747 | 961 | 1.3e-96 |
| Protein name | | | | | Locus Name | Acc# |
| | | | | | sp:UBIG_ECOLI | P17993:P76 |

Description
METHYLTRANSFERASE)

| ORF Name | NTID | AAID | NT Length | AA Length | Score | Probability |
|---|---|---|---|---|---|---|
| 5272800_f1_16 | 157 | 4329 | 203 | 612 | 758 | 4.2e-75 |
| Protein name | | | | | Locus Name | Acc# |
| | | | | | sp:UBIX_ECOLI | P09550:P77 |

Description
P-HYDROXYBENZOATE DECARBOXYLASE)

| ORF Name | NTID | AAID | NT Length | AA Length | Score | Probability |
|---|---|---|---|---|---|---|
| 5338513_f1_35 | 158 | 4330 | 614 | 1845 | 2371 | 4.9e-246 |
| Protein name | | | | | Locus Name | Acc# |
| | | | | | sp:NUOL_ECOLI | P33607:P78 |

Description
OXIDOREDUCTASE CHAIN 12) (NUO12)

| ORF Name | NTID | AAID | NT Length | AA Length | Score | Probability |
|---|---|---|---|---|---|---|
| 6055252_f3_192 | 159 | 4331 | 87 | 264 | 70 | 0.040 |
| Protein name | | | | | Locus Name | Acc# |
| | | | | | sp:ATPE_PROMO | P29709 |

Description
ATP SYNTHASE EPSILON CHAIN, SODIUM ION SPECIFIC,

| ORF Name | NTID | AAID | NT Length | AA Length | Score | Probability |
|---|---|---|---|---|---|---|
| 6250027_f3_198 | 160 | 4332 | 102 | 309 | | |
| Protein name | | | | | Locus Name | Acc# |

Description
NO-HIT

| ORF Name | NTID | AAID | NT Length | AA Length | Score | Probability |
|---|---|---|---|---|---|---|
| 6364013_f2_82 | 161 | 4333 | 378 | 1137 | 1326 | 2.7e-135 |
| Protein name | | | | | Locus Name | Acc# |
| | | | | | sp:PDXB_ECOLI | P05459 |

Description
ERYTHRONATE-4-PHOSPHATE DEHYDROGENASE,

| ORF Name | NTID | AAID | NT Length | AA Length | Score | Probability |
|---|---|---|---|---|---|---|
| 6679692_f1_22 | 162 | 4334 | 102 | 309 | 388 | 6.7e-36 |
| Protein name | | | | | Locus Name | Acc# |
| | | | | | sp:YGBF_ECOLI | P45956 |

Description
HYPOTHETICAL 13.2 KD PROTEIN IN IAP-CYSH INTERGENIC REGION

| ORF Name | NTID | AAID | NT Length | AA Length | Score | Probability |
|---|---|---|---|---|---|---|
| 6720316_c2_372 | 163 | 4335 | 62 | 189 | | |
| Protein name | | | | | Locus Name | Acc# |

Description
NO-HIT

| ORF Name | NTID | AAID | NT Length | AA Length | Score | Probability |
|---|---|---|---|---|---|---|
| 6759778_f3_188 | 164 | 4336 | 281 | 846 | 221 | 1.2e-34 |
| Protein name | | | | | Locus Name | Acc# |
| hypothetical protein b1559 | | | | | pir:B64911 | B64911 |

Description

| ORF Name | NTID | AAID | NT Length | AA Length | Score | Probability |
|---|---|---|---|---|---|---|
| 6906303_f2_106 | 165 | 4337 | 445 | 1338 | 954 | 7.1e-96 |
| Protein name | | | | | Locus Name | Acc# |
| | | | | | sp:MENF_ECOLI | P38051:Q47 |

Description
MENAQUINONE-SPECIFIC ISOCHORISMATE SYNTHASE,

| ORF Name | NTID | AAID | NT Length | AA Length | Score | Probability |
|---|---|---|---|---|---|---|
| 6922140_f1_50 | 166 | 4338 | 276 | 831 | | |
| Protein name | | | | | Locus Name | Acc# |

Description: NO-HIT

| ORF Name | NTID | AAID | NT Length | AA Length | Score | Probability |
|---|---|---|---|---|---|---|
| 7036317_f3_189 | 167 | 4339 | 155 | 468 | 182 | 4.5e-14 |
| Protein name | | | | | Locus Name | Acc# |
| | | | | | sp:ENPP_BPP21 | P27358 |

Description: ENDOPEPTIDASE, (LYSIS PROTEIN RZ)

| ORF Name | NTID | AAID | NT Length | AA Length | Score | Probability |
|---|---|---|---|---|---|---|
| 7062567_f3_155 | 168 | 4340 | 165 | 498 | 631 | 1.2e-61 |
| Protein name | | | | | Locus Name | Acc# |
| | | | | | sp:CVPA_ECOLI | P08550 |

Description: PROTEIN)

| ORF Name | NTID | AAID | NT Length | AA Length | Score | Probability |
|---|---|---|---|---|---|---|
| 789712_f1_9 | 169 | 4341 | 186 | 561 | 95 | 0.0072 |
| Protein name | | | | | Locus Name | Acc# |
| | | | | | sp:AAC6_CITDI | P10051 |

Description: AMINOGLYCOSIDE N6'-ACETYLTRANSFERASE, (AAC(6'))

| ORF Name | NTID | AAID | NT Length | AA Length | Score | Probability |
|---|---|---|---|---|---|---|
| 822943_f3_178 | 170 | 4342 | 181 | 546 | 640 | 1.3e-62 |
| Protein name | | | | | Locus Name | Acc# |
| | | | | | sp:NUOJ_ECOLI | P33605:P78 |

Description: OXIDOREDUCTASE CHAIN 10) (NUO10)

| ORF Name | NTID | AAID | NT Length | AA Length | Score | Probability |
|---|---|---|---|---|---|---|
| 832877_f1_30 | 171 | 4343 | 624 | 1875 | 2252 | 2.0e-233 |
| Protein name | | | | | Locus Name | Acc# |
| | | | | | sp:YFBS_ECOLI | P77741:P76 |

Description
HYPOTHETICAL 65.9 KD PROTEIN IN LRHA-ACKA INTERGENIC REGION

| ORF Name | NTID | AAID | NT Length | AA Length | Score | Probability |
|---|---|---|---|---|---|---|
| 882140_f3_142 | 172 | 4344 | 67 | 204 | | |
| Protein name | | | | | Locus Name | Acc# |

Description
NO-HIT

| ORF Name | NTID | AAID | NT Length | AA Length | Score | Probability |
|---|---|---|---|---|---|---|
| 9790927_f2_78 | 173 | 4345 | 91 | 276 | 236 | 8.6e-20 |
| Protein name | | | | | Locus Name | Acc# |
| | | | | | sp:YFCL_ECOLI | P76496 |

Description
HYPOTHETICAL 10.0 KD PROTEIN IN FABB-MEPA INTERGENIC REGION

| ORF Name | NTID | AAID | NT Length | AA Length | Score | Probability |
|---|---|---|---|---|---|---|
| 9844127_c2_307 | 174 | 4346 | 271 | 816 | 222 | 5.9e-35 |
| Protein name | | | | | Locus Name | Acc# |
| similar to PHZF, catalyzing the hydroxylation of | | | | | gp:AC004044 | AC004044 |

Description
Arabidopsis thaliana BAC T5J8 from chromosome IV, top arm, completesequence.

| ORF Name | NTID | AAID | NT Length | AA Length | Score | Probability |
|---|---|---|---|---|---|---|
| 9928181_f2_140 | 175 | 4347 | 1042 | 3129 | 3795 | 0.0 |
| Protein name | | | | | Locus Name | Acc# |
| tetrathionate reductase subunit A (TtrA) | | | | | gp:STY224978 | AJ224978 |

Description
Salmonella typhimurium, Salmonella Pathogenicity Island 2 (SPI2)genes, ttr gene cluster.

| ORF Name | NTID | AAID | NT Length | AA Length | Score | Probability |
|---|---|---|---|---|---|---|
| 9955427_c3_435 | 176 | 4348 | 404 | 1215 | 1765 | 8.1e-182 |
| Protein name | | | | | Locus Name | Acc# |
| | | | | | sp:ACKA_ECOLI | P15046:Q59 |
| Description | | | | | | |
| ACETATE KINASE, (ACETOKINASE) | | | | | | |

| ORF Name | NTID | AAID | NT Length | AA Length | Score | Probability |
|---|---|---|---|---|---|---|
| 10037937_f1_4 | 177 | 4349 | 185 | 558 | 263 | 1.2e-22 |
| Protein name | | | | | Locus Name | Acc# |
| type 1 fimbrial protein sfaA:S fimbrial adhesin major subunit sfaA:type 1 fimbrial | | | | | pir:D49233 | D49233:S38 |
| Description | | | | | | |

| ORF Name | NTID | AAID | NT Length | AA Length | Score | Probability |
|---|---|---|---|---|---|---|
| 10344003_c3_208 | 178 | 4350 | 316 | 951 | 1555 | 1.5e-159 |
| Protein name | | | | | Locus Name | Acc# |
| site-specific recombinase | | | | | gp:AF033498 | AF033498 |
| Description | | | | | | |
| Proteus mirabilis site-specific recombinase (xerC) gene, completecds. | | | | | | |

| ORF Name | NTID | AAID | NT Length | AA Length | Score | Probability |
|---|---|---|---|---|---|---|
| 109392_f1_26 | 179 | 4351 | 97 | 294 | 87 | 0.00053 |
| Protein name | | | | | Locus Name | Acc# |
| ORF11 | | | | | gp:AF152923 | AF152923 |
| Description | | | | | | |
| Yersinia pestis CH971662 cryptic plasmid pYC, complete sequence. | | | | | | |

| ORF Name | NTID | AAID | NT Length | AA Length | Score | Probability |
|---|---|---|---|---|---|---|
| 10972137_c3_217 | 180 | 4352 | 194 | 585 | 764 | 9.6e-76 |
| Protein name | | | | | Locus Name | Acc# |
| hypothetical 23.5K protein (psd-amiB intergenic region):hypothetical protein o204a | | | | | pir:S56390 | S56390:H65 |
| Description | | | | | | |

| ORF Name | NTID | AAID | NT Length | AA Length | Score | Probability |
|---|---|---|---|---|---|---|
| 12267806_c1_131 | 181 | 4353 | 370 | 1113 | 1557 | 8.9e-160 |
| Protein name | | | | | Locus Name | Acc# |
| | | | | | sp:RFFG_ECOLI | P27830:P76 |

Description: DTDP-GLUCOSE 4,6-DEHYDRATASE,

| ORF Name | NTID | AAID | NT Length | AA Length | Score | Probability |
|---|---|---|---|---|---|---|
| 12507055_f2_38 | 182 | 4354 | 233 | 702 | 417 | 5.7e-39 |
| Protein name | | | | | Locus Name | Acc# |
| type 1 fimbrial chaperone | | | | | gp:PMATFGC | Z78535 |

Description: P.mirabilis atf gene cluster.

| ORF Name | NTID | AAID | NT Length | AA Length | Score | Probability |
|---|---|---|---|---|---|---|
| 12926562_f2_46 | 183 | 4355 | 326 | 981 | 1038 | 8.9e-105 |
| Protein name | | | | | Locus Name | Acc# |
| | | | | | sp:RARD_ECOLI | P27844 |

Description: RARD PROTEIN

| ORF Name | NTID | AAID | NT Length | AA Length | Score | Probability |
|---|---|---|---|---|---|---|
| 13860151_c2_155 | 184 | 4356 | 130 | 393 | 502 | 5.6e-48 |
| Protein name | | | | | Locus Name | Acc# |
| hypothetical 13.1 kD protein in pssR-ilvL intergenic region | | | | | pir:G65179 | G65179:S30 |

Description:

| ORF Name | NTID | AAID | NT Length | AA Length | Score | Probability |
|---|---|---|---|---|---|---|
| 1406885_c2_163 | 185 | 4357 | 683 | 2052 | 2768 | 4.2e-288 |
| Protein name | | | | | Locus Name | Acc# |
| | | | | | sp:REP_ECOLI | P09980 |

Description: ATP-DEPENDENT DNA HELICASE REP,

| ORF Name | NTID | AAID | NT Length | AA Length | Score | Probability |
|---|---|---|---|---|---|---|
| 14459717_c2_174 | 186 | 4358 | 67 | 204 | 122 | 1.0e-07 |➁
| Protein name | | | | | Locus Name | Acc# |
| | | | | | sp:YIFL_ECOLI | P39166 |

Description
HYPOTHETICAL 7.2 KD PROTEIN IN CYAY-DAPF INTERGENIC REGION

| ORF Name | NTID | AAID | NT Length | AA Length | Score | Probability |
|---|---|---|---|---|---|---|
| 14489643_c2_179 | 187 | 4359 | 641 | 1926 | 2336 | 2.5e-242 |
| Protein name | | | | | Locus Name | Acc# |
| DNA helicase recQ:DNA-dependent ATPase recQ, | | | | pir:BVECRQ | G65186:JS0 |

Description

| ORF Name | NTID | AAID | NT Length | AA Length | Score | Probability |
|---|---|---|---|---|---|---|
| 14657681_f2_81 | 188 | 4360 | 74 | 225 | 71 | 0.026 |
| Protein name | | | | | Locus Name | Acc# |
| hypothetical protein 105 | | | | | pir:S72306 | S72306 |

Description

| ORF Name | NTID | AAID | NT Length | AA Length | Score | Probability |
|---|---|---|---|---|---|---|
| 14657786_f2_37 | 189 | 4361 | 100 | 303 | 80 | 0.034 |
| Protein name | | | | | Locus Name | Acc# |
| maturase-like protein | | | | | gp:AF142678 | AF142678 |

Description
Swartzia simplex maturase-like protein (matK) gene, complete cds;chloroplast gene for chloroplast product.

| ORF Name | NTID | AAID | NT Length | AA Length | Score | Probability |
|---|---|---|---|---|---|---|
| 14900693_f3_86 | 190 | 4362 | 354 | 1065 | 1323 | 5.6e-135 |
| Protein name | | | | | Locus Name | Acc# |
| | | | | | sp:YJEQ_ECOLI | P39286 |

Description
HYPOTHETICAL 39.2 KD PROTEIN IN PSD-AMIB INTERGENIC REGION

124

| ORF_Name | NTID | AAID | NT Length | AA Length | Score | Probability |
|---|---|---|---|---|---|---|
| 15814177_f3_84 | 191 | 4363 | 80 | 243 | 71 | 0.026 |
| Protein name | | | | | Locus Name | Acc# |
| hypothetical protein Y1074 | | | | | pir:T14991 | T14991 |

Description

| ORF_Name | NTID | AAID | NT Length | AA Length | Score | Probability |
|---|---|---|---|---|---|---|
| 16540901_c1_126 | 192 | 4364 | 525 | 1578 | 2126 | 4.5e-220 |
| Protein name | | | | | Locus Name | Acc# |
| | | | | | sp:THD1_ECOLI | P04968 |

Description

DEAMINASE)

| ORF_Name | NTID | AAID | NT Length | AA Length | Score | Probability |
|---|---|---|---|---|---|---|
| 16907588_f2_39 | 193 | 4365 | 845 | 2538 | 1525 | 2.2e-156 |
| Protein name | | | | | Locus Name | Acc# |
| | | | | | sp:YRAJ_ECOLI | P42915 |

Description

REGION PRECURSOR

| ORF_Name | NTID | AAID | NT Length | AA Length | Score | Probability |
|---|---|---|---|---|---|---|
| 19788952_f1_29 | 194 | 4366 | 308 | 927 | 1063 | 2.0e-107 |
| Protein name | | | | | Locus Name | Acc# |
| | | | | | sp:ILVY_ECOLI | P05827 |

Description

TRANSCRIPTIONAL ACTIVATOR PROTEIN ILVY

| ORF_Name | NTID | AAID | NT Length | AA Length | Score | Probability |
|---|---|---|---|---|---|---|
| 19928451_f1_23 | 195 | 4367 | 438 | 1317 | 1829 | 1.3e-188 |
| Protein name | | | | | Locus Name | Acc# |
| rhlB protein:probable ATP-dependent RNA helicase | | | | | pir:G65181 | G65181:S30 |

Description

| ORF Name | NTID | AAID | NT Length | AA Length | Score | Probability |
|---|---|---|---|---|---|---|
| 2243806_f1_28 | 196 | 4368 | 160 | 483 | 436 | 5.5e-41 |

Protein name | Locus Name | Acc#
---|---|---
transposase homolog A | gp:HPU95957 | U95957

Description

Helicobacter pylori insertion sequence IS606 transposase homologs A(tnpA) and B (tnpB) genes, complete cds.

| ORF Name | NTID | AAID | NT Length | AA Length | Score | Probability |
|---|---|---|---|---|---|---|
| 22843882_f1_1 | 197 | 4369 | 335 | 1008 | 1018 | 1.2e-102 |

Protein name | Locus Name | Acc#
---|---|---
 | sp:DPSD_ECOLI | P10740

Description

PHOSPHATIDYLSERINE DECARBOXYLASE PROENZYME,

| ORF Name | NTID | AAID | NT Length | AA Length | Score | Probability |
|---|---|---|---|---|---|---|
| 23438762_c1_122 | 198 | 4370 | 72 | 219 | 105 | 6.6e-06 |

Protein name | Locus Name | Acc#
---|---|---
 | gp:SMAILVGE | M11655

Description

S.marcescens ilvGEDA operon leader peptide gene, complete cds.

| ORF Name | NTID | AAID | NT Length | AA Length | Score | Probability |
|---|---|---|---|---|---|---|
| 23470252_c1_123 | 199 | 4371 | 562 | 1689 | 2090 | 3.0e-216 |

Protein name | Locus Name | Acc#
---|---|---
acetolactate synthase, II large chain, ilvO phenotype:acetohydroxy acid synthase II large | pir:YCEC | A26570:S48

Description

| ORF Name | NTID | AAID | NT Length | AA Length | Score | Probability |
|---|---|---|---|---|---|---|
| 23540937_c1_125 | 200 | 4372 | 617 | 1854 | 2833 | 5.5e-295 |

Protein name | Locus Name | Acc#
---|---|---
dihydroxy-acid dehydratase, | pir:DWECDA | A27310:D26

Description

| ORF_Name | NTID | AAID | NT Length | AA Length | Score | Probability |
|---|---|---|---|---|---|---|
| 23626506_f3_94 | 201 | 4373 | 165 | 498 | 525 | 2.0e-50 |
| Protein name | | | | | Locus Name | Acc# |
| | | | | | sp:YIGI_ECOLI | P27845:P76 |

Description: HYPOTHETICAL 17.1 KD PROTEIN IN RARD-PLDA INTERGENIC REGION

| ORF_Name | NTID | AAID | NT Length | AA Length | Score | Probability |
|---|---|---|---|---|---|---|
| 23628286_f1_32 | 202 | 4374 | 527 | 1584 | 1515 | 2.5e-155 |
| Protein name | | | | | Locus Name | Acc# |
| | | | | | sp:YIFB_ECOLI | P22787 |

Description:

| ORF_Name | NTID | AAID | NT Length | AA Length | Score | Probability |
|---|---|---|---|---|---|---|
| 23631308_c3_195 | 203 | 4375 | 362 | 1089 | 1081 | 2.5e-109 |
| Protein name | | | | | Locus Name | Acc# |
| | | | | | sp:WZZE_ECOLI | P25905:P76 |

Description: LIPOPOLYSACCHARIDE BIOSYNTHESIS PROTEIN WZZE

| ORF_Name | NTID | AAID | NT Length | AA Length | Score | Probability |
|---|---|---|---|---|---|---|
| 23846913_c1_140 | 204 | 4376 | 296 | 891 | 1170 | 9.1e-119 |
| Protein name | | | | | Locus Name | Acc# |
| diaminopimelate epimerase, | | | | | pir:S01913 | B65185:S30 |

Description:

| ORF_Name | NTID | AAID | NT Length | AA Length | Score | Probability |
|---|---|---|---|---|---|---|
| 24025951_c2_170 | 205 | 4377 | 262 | 789 | 439 | 2.7e-41 |
| Protein name | | | | | Locus Name | Acc# |
| | | | | | sp:RFFC_ECOLI | P27832 |

Description: LIPOPOLYSACCHARIDE BIOSYNTHESIS PROTEIN RFFC

| ORF Name | NTID | AAID | NT Length | AA Length | Score | Probability |
|---|---|---|---|---|---|---|
| 24074186_f2_50 | 206 | 4378 | 141 | 426 | 404 | 1.4e-37 |
| Protein name | | | | | Locus Name | Acc# |
| | | | | | sp:CYAY_ERWCH | P40128 |

Description
CYAY PROTEIN

| ORF Name | NTID | AAID | NT Length | AA Length | Score | Probability |
|---|---|---|---|---|---|---|
| 24274150_f2_36 | 207 | 4379 | 1116 | 3351 | 3227 | 0.0 |
| Protein name | | | | | Locus Name | Acc# |
| | | | | | sp:YJEP_ECOLI | P39285:P76 |

Description
HYPOTHETICAL 123.8 KD PROTEIN IN GENX-PSD INTERGENIC REGION PRECURSOR

| ORF Name | NTID | AAID | NT Length | AA Length | Score | Probability |
|---|---|---|---|---|---|---|
| 24414686_c3_196 | 208 | 4380 | 383 | 1152 | 1559 | 5.5e-160 |
| Protein name | | | | | Locus Name | Acc# |
| bacteriophage N4 adsorption protein:hypothetical protein o389 | | | | | pir:E65182 | E65182:S30 |

Description

| ORF Name | NTID | AAID | NT Length | AA Length | Score | Probability |
|---|---|---|---|---|---|---|
| 24634627_f1_24 | 209 | 4381 | 503 | 1512 | 1770 | 2.4e-182 |
| Protein name | | | | | Locus Name | Acc# |
| | | | | | sp:GPPA_ECOLI | P25552 |

Description
5'-PHOSPHOHYDROLASE)

| ORF Name | NTID | AAID | NT Length | AA Length | Score | Probability |
|---|---|---|---|---|---|---|
| 2469792_c3_200 | 210 | 4382 | 67 | 204 | | |
| Protein name | | | | | Locus Name | Acc# |

Description
NO-HIT

| ORF Name | NTID | AAID | NT Length | AA Length | Score | Probability |
|---|---|---|---|---|---|---|
| 2522157_f2_51 | 211 | 4383 | 90 | 273 | 79 | 0.044 |
| Protein name | | | | | Locus Name | Acc# |
| | | | | | sp:MTPS_PROST | P00474 |

Description
METHYLTRANSFERASE PSTI) (M.PSTI)

| ORF Name | NTID | AAID | NT Length | AA Length | Score | Probability |
|---|---|---|---|---|---|---|
| 2581413_f3_100 | 212 | 4384 | 72 | 219 | | |
| Protein name | | | | | Locus Name | Acc# |

Description
NO-HIT

| ORF Name | NTID | AAID | NT Length | AA Length | Score | Probability |
|---|---|---|---|---|---|---|
| 26454763_c3_189 | 213 | 4385 | 98 | 297 | 225 | 1.3e-18 |
| Protein name | | | | | Locus Name | Acc# |
| acetolactate synthase, II small chain:acetohydroxy-acid synthase II | | | | | pir:B26570 | B26570:S30 |

Description

| ORF Name | NTID | AAID | NT Length | AA Length | Score | Probability |
|---|---|---|---|---|---|---|
| 26754536_f1_16 | 214 | 4386 | 416 | 1251 | 1254 | 1.1e-127 |
| Protein name | | | | | Locus Name | Acc# |
| | | | | | sp:HEMY_ECOLI | P09128 |

Description
HEMY PROTEIN

| ORF Name | NTID | AAID | NT Length | AA Length | Score | Probability |
|---|---|---|---|---|---|---|
| 2865950_c3_197 | 215 | 4387 | 388 | 1167 | 1528 | 1.1e-156 |
| Protein name | | | | | Locus Name | Acc# |
| | | | | | sp:RFFA_ECOLI | P27833 |

Description
LIPOPOLYSACCHARIDE BIOSYNTHESIS PROTEIN RFFA

| ORF Name | NTID | AAID | NT Length | AA Length | Score | Probability |
|---|---|---|---|---|---|---|
| 30508555_c1_146 | 216 | 4388 | 270 | 813 | 818 | 1.8e-81 |
| Protein name | | | | | Locus Name | Acc# |
| | | | | | sp:YIGL_ECOLI | P27848:P76 |

Description
HYPOTHETICAL 29.8 KD PROTEIN IN PLDB-METR INTERGENIC REGION

| ORF Name | NTID | AAID | NT Length | AA Length | Score | Probability |
|---|---|---|---|---|---|---|
| 31251900_c3_199 | 217 | 4389 | 371 | 1116 | 1041 | 4.3e-105 |
| Protein name | | | | | Locus Name | Acc# |
| | | | | | sp:YIFM_ECOLI | P56258 |

Description
HYPOTHETICAL 40.6 KD PROTEIN IN WZXE-WECF INTERGENIC REGION

| ORF Name | NTID | AAID | NT Length | AA Length | Score | Probability |
|---|---|---|---|---|---|---|
| 32454050_c2_178 | 218 | 4390 | 293 | 882 | 1158 | 1.7e-117 |
| Protein name | | | | | Locus Name | Acc# |
| outer membrane phospholipase A precursor | | | | | gp:AF034414 | AF034414 |

Description
Enterobacter agglomerans outer membrane phospholipase A precursor (pldA) gene, complete cds.

| ORF Name | NTID | AAID | NT Length | AA Length | Score | Probability |
|---|---|---|---|---|---|---|
| 32805_c2_162 | 219 | 4391 | 442 | 1329 | 1760 | 2.8e-181 |
| Protein name | | | | | Locus Name | Acc# |
| hypothetical protein b1432 | | | | | pir:C64895 | C64895 |

Description

| ORF Name | NTID | AAID | NT Length | AA Length | Score | Probability |
|---|---|---|---|---|---|---|
| 33213157_c1_135 | 220 | 4392 | 254 | 765 | 924 | 1.1e-92 |
| Protein name | | | | | Locus Name | Acc# |
| | | | | | sp:WECG_ECOLI | P27836 |

Description
(UDP-MANNACA TRANSFERASE)

| ORF_Name | NTID | AAID | NT Length | AA Length | Score | Probability |
|---|---|---|---|---|---|---|
| 33496052_c2_172 | 221 | 4393 | 111 | 336 | | |
| Protein name | | | | | Locus_Name | Acc# |

Description
NO-HIT

| ORF_Name | NTID | AAID | NT Length | AA Length | Score | Probability |
|---|---|---|---|---|---|---|
| 33776638_c2_171 | 222 | 4394 | 461 | 1386 | 1803 | 7.7e-186 |
| Protein name | | | | | Locus_Name | Acc# |
| | | | | | sp:WECF_ECOLI | P27835 |

Description
TRANSFERASE)

| ORF_Name | NTID | AAID | NT Length | AA Length | Score | Probability |
|---|---|---|---|---|---|---|
| 34573451_c1_133 | 223 | 4395 | 436 | 1311 | 1562 | 2.6e-160 |
| Protein name | | | | | Locus_Name | Acc# |
| | | | | | sp:WZXE_ECOLI | P27834 |

Description
LIPOPOLYSACCHARIDE BIOSYNTHESIS PROTEIN WZXE

| ORF_Name | NTID | AAID | NT Length | AA Length | Score | Probability |
|---|---|---|---|---|---|---|
| 35181713_c1_141 | 224 | 4396 | 240 | 723 | 642 | 8.2e-63 |
| Protein name | | | | | Locus_Name | Acc# |
| | | | | | sp:YIGA_ECOLI | P23305 |

Description
HYPOTHETICAL 26.7 KD PROTEIN IN DAPF-XERC INTERGENIC REGION (ORF 235)

| ORF_Name | NTID | AAID | NT Length | AA Length | Score | Probability |
|---|---|---|---|---|---|---|
| 35270015_c3_193 | 225 | 4397 | 122 | 369 | 482 | 7.4e-46 |
| Protein name | | | | | Locus_Name | Acc# |
| thioredoxin | | | | | pir:TXEC | A91519:H65 |

Description

| ORF Name | NTID | AAID | NT Length | AA Length | Score | Probability |
|---|---|---|---|---|---|---|
| 35819067_c3_187 | 226 | 4398 | 69 | 210 | 82 | 0.0030 |
| Protein name | | | | | Locus Name | Acc# |
| hypothetical protein | | | | | pir:C75542 | C75542 |

Description

| ORF Name | NTID | AAID | NT Length | AA Length | Score | Probability |
|---|---|---|---|---|---|---|
| 36134702_c1_132 | 227 | 4399 | 294 | 885 | 1286 | 4.7e-131 |
| Protein name | | | | | Locus Name | Acc# |
| | | | | | sp:RFFH_ECOLI | P27831:P76 |

Description

SYNTHASE) (DTDP-GLUCOSE PYROPHOSPHORYLASE)

| ORF Name | NTID | AAID | NT Length | AA Length | Score | Probability |
|---|---|---|---|---|---|---|
| 38941_f1_33 | 228 | 4400 | 282 | 849 | 357 | 1.3e-32 |
| Protein name | | | | | Locus Name | Acc# |
| | | | | | sp:PSSR_ECOLI | P27826 |

Description

POSSIBLE REGULATORY PROTEIN PSSR

| ORF Name | NTID | AAID | NT Length | AA Length | Score | Probability |
|---|---|---|---|---|---|---|
| 3944200_c3_209 | 229 | 4401 | 721 | 2166 | 3205 | 0.0 |
| Protein name | | | | | Locus Name | Acc# |
| | | | | | sp:UVRD_ECOLI | P03018:Q47 |

Description

DNA HELICASE II,

| ORF Name | NTID | AAID | NT Length | AA Length | Score | Probability |
|---|---|---|---|---|---|---|
| 4100328_f2_40 | 230 | 4402 | 342 | 1029 | 168 | 4.4e-10 |
| Protein name | | | | | Locus Name | Acc# |
| | | | | | sp:MRKD_KLEPN | P21648 |

Description

FIMBRIA ADHESIN PROTEIN PRECURSOR

| ORF Name | NTID | AAID | NT Length | AA Length | Score | Probability |
|---|---|---|---|---|---|---|
| 4113538_f3_99 | 231 | 4403 | 419 | 1260 | 989 | 1.4e-99 |
| Protein name | | | | | Locus Name | Acc# |
| | | | | | sp:HEMX_ECOLI | P09127 |

Description: III METHYLASE) (ORF X)

| ORF Name | NTID | AAID | NT Length | AA Length | Score | Probability |
|---|---|---|---|---|---|---|
| 4114660_f1_13 | 232 | 4404 | 248 | 747 | 937 | 4.5e-94 |
| Protein name | | | | | Locus Name | Acc# |
| | | | | | sp:HEM4_PROMI | Q59683 |

Description: )

| ORF Name | NTID | AAID | NT Length | AA Length | Score | Probability |
|---|---|---|---|---|---|---|
| 4410188_c3_194 | 233 | 4405 | 423 | 1272 | 2041 | 4.6e-211 |
| Protein name | | | | | Locus Name | Acc# |
| | | | | | sp:RHO_ECOLI | P03002 |

Description: TRANSCRIPTION TERMINATION FACTOR RHO

| ORF Name | NTID | AAID | NT Length | AA Length | Score | Probability |
|---|---|---|---|---|---|---|
| 4502305_c2_169 | 234 | 4406 | 424 | 1275 | 1730 | 4.2e-178 |
| Protein name | | | | | Locus Name | Acc# |
| | | | | | sp:WECC_ECOLI | P27829 |

Description: (UDP-MANNACA DEHYDROGENASE)

| ORF Name | NTID | AAID | NT Length | AA Length | Score | Probability |
|---|---|---|---|---|---|---|
| 4744417_c3_207 | 235 | 4407 | 885 | 2658 | 4594 | 0.0 |
| Protein name | | | | | Locus Name | Acc# |
| | | | | | sp:CYAA_PROMI | Q59685 |

Description: CYCLASE)

| ORF Name | NTID | AAID | NT Length | AA Length | Score | Probability |
|---|---|---|---|---|---|---|
| 4883463_c2_176 | 236 | 4408 | 243 | 732 | 655 | 3.4e-64 |
| Protein name | | | | | Locus Name | Acc# |
| | | | | | gp:AF028736 | AF028736 |

Description

Serratia marcescens site specific recombinase (xerC) and DNAhelicase II (uvrD) genes, complete cds.

| ORF Name | NTID | AAID | NT Length | AA Length | Score | Probability |
|---|---|---|---|---|---|---|
| 4884701_c2_177 | 237 | 4409 | 135 | 408 | | |
| Protein name | | | | | Locus Name | Acc# |

Description

NO-HIT

| ORF Name | NTID | AAID | NT Length | AA Length | Score | Probability |
|---|---|---|---|---|---|---|
| 4937968_c1_145 | 238 | 4410 | 345 | 1038 | 869 | 7.2e-87 |
| Protein name | | | | | Locus Name | Acc# |
| | | | | | gp:ECPLDB | X03155 |

Description

E. coli pldB gene for inner membrane lysophospholipase L2.

| ORF Name | NTID | AAID | NT Length | AA Length | Score | Probability |
|---|---|---|---|---|---|---|
| 523412_f2_52 | 239 | 4411 | 333 | 1002 | 1571 | 2.9e-161 |
| Protein name | | | | | Locus Name | Acc# |
| | | | | | sp:HEM3_PROMI | Q59684 |

Description

SYNTHASE) (HMBS) (PRE-UROPORPHYRINOGEN SYNTHASE)

| ORF Name | NTID | AAID | NT Length | AA Length | Score | Probability |
|---|---|---|---|---|---|---|
| 5866562_f2_61 | 240 | 4412 | 80 | 243 | | |
| Protein name | | | | | Locus Name | Acc# |

Description

NO-HIT

134

| ORF Name | NTID | AAID | NT Length | AA Length | Score | Probability |
|---|---|---|---|---|---|---|
| 5944812_f2_80 | 241 | 4413 | 63 | 192 | 142 | 7.9e-10 |
| Protein name | | | | | Locus Name | Acc# |
| hypothetical protein | | | | | gp:SSU18930 | Y18930 |

Description

Sulfolobus solfataricus 281 kb genomic DNA fragment, strain P2.

| ORF Name | NTID | AAID | NT Length | AA Length | Score | Probability |
|---|---|---|---|---|---|---|
| 6645203_c1_124 | 242 | 4414 | 318 | 957 | 1476 | 3.4e-151 |
| Protein name | | | | | Locus Name | Acc# |
| | | | | | sp:ILVE_SALTY | P15168 |

Description

B) (BCAT)

| ORF Name | NTID | AAID | NT Length | AA Length | Score | Probability |
|---|---|---|---|---|---|---|
| 6836457_f1_27 | 243 | 4415 | 89 | 270 | 273 | 1.0e-23 |
| Protein name | | | | | Locus Name | Acc# |
| | | | | | sp:YAFQ_ECOLI | Q47149 |

Description

HYPOTHETICAL 10.8 KD PROTEIN IN GMHA-DINJ INTERGENIC REGION

| ORF Name | NTID | AAID | NT Length | AA Length | Score | Probability |
|---|---|---|---|---|---|---|
| 788512_f3_87 | 244 | 4416 | 300 | 903 | 159 | 3.1e-09 |
| Protein name | | | | | Locus Name | Acc# |
| | | | | | sp:YEEY_ECOLI | P76369:O07 |

Description

HYPOTHETICAL TRANSCRIPTIONAL REGULATOR IN SBCB-HISL INTERGENIC REGION

| ORF Name | NTID | AAID | NT Length | AA Length | Score | Probability |
|---|---|---|---|---|---|---|
| 813556_c1_129 | 245 | 4417 | 373 | 1122 | 1451 | 1.5e-148 |
| Protein name | | | | | Locus Name | Acc# |
| | | | | | sp:RFE_ECOLI | P24235:P76 |

Description (EC 2.4.1.-)

| ORF Name | NTID | AAID | NT Length | AA Length | Score | Probability |
|---|---|---|---|---|---|---|
| 954427_c2_161 | 246 | 4418 | 528 | 1587 | 2214 | 2.1e-229 |
| Protein name | | | | | Locus Name | Acc# |
| ketol-acid reductoisomerase,:acetohydroxy acid isomeroreductase:dihydroxyisovalerate | | | | pir:ISECKR | | A65181:A26 |

Description

| ORF Name | NTID | AAID | NT Length | AA Length | Score | Probability |
|---|---|---|---|---|---|---|
| 10156343_f3_430 | 247 | 4419 | 196 | 591 | 472 | 8.5e-45 |
| Protein name | | | | | Locus Name | Acc# |
| yecM protein | | | | pir:C64950 | | C64950 |

Description

| ORF Name | NTID | AAID | NT Length | AA Length | Score | Probability |
|---|---|---|---|---|---|---|
| 10183125_c3_1164 | 248 | 4420 | 336 | 1011 | 1224 | 1.7e-124 |
| Protein name | | | | | Locus Name | Acc# |
| | | | | sp:YECP_ECOLI | | P76291:007 |

Description
HYPOTHETICAL 37.0 KD PROTEIN IN ASPS-BISZ INTERGENIC REGION

| ORF Name | NTID | AAID | NT Length | AA Length | Score | Probability |
|---|---|---|---|---|---|---|
| 10187783_c3_1051 | 249 | 4421 | 616 | 1851 | 807 | 2.7e-80 |
| Protein name | | | | | Locus Name | Acc# |
| hypothetical protein Rv1739c | | | | pir:F70688 | | F70688 |

Description

| ORF Name | NTID | AAID | NT Length | AA Length | Score | Probability |
|---|---|---|---|---|---|---|
| 10193882_c2_873 | 250 | 4422 | 243 | 732 | 609 | 2.6e-59 |
| Protein name | | | | | Locus Name | Acc# |
| | | | | sp:BID2_ECOLI | | P77201 |

Description
(DTB SYNTHETASE) (DTBS)

| ORF_Name | NTID | AAID | NT Length | AA Length | Score | Probability |
|---|---|---|---|---|---|---|
| 10313750_c3_1083 | 251 | 4423 | 395 | 1188 | 1217 | 9.6e-124 |

| Protein name | Locus Name | Acc# |
|---|---|---|
| YbbB | gp:AF102556 | AF102556 |

Description

Salmonella enteritidis outer membrane protein (omp), lipoprotein(sfbA), ATP-binding protein (sfbB), integral membrane protein(sfbC), YbbB (ybbB), hypothetical transcriptional regulator(glxA1), and glyoxylate induced protein (glxA2) genes, completecds; glyoxylate regulatory protein (glxA3) gene, partial cds; andunknown gene.

| ORF_Name | NTID | AAID | NT Length | AA Length | Score | Probability |
|---|---|---|---|---|---|---|
| 1035_c2_987 | 252 | 4424 | 84 | 255 | 147 | 2.3e-10 |

| Protein name | Locus Name | Acc# |
|---|---|---|
|  | sp:LOLB_ECOLI | P24208:Q46 |

Description

OUTER MEMBRANE LIPOPROTEIN LOLB PRECURSOR

| ORF_Name | NTID | AAID | NT Length | AA Length | Score | Probability |
|---|---|---|---|---|---|---|
| 10423587_f3_561 | 253 | 4425 | 275 | 828 | 784 | 7.3e-78 |

| Protein name | Locus Name | Acc# |
|---|---|---|
| hemin binding protein | gp:YEHEMSTUV | X77867 |

Description

Y.enterocolitica hemS, hemT, hemU and hemV genes.

| ORF_Name | NTID | AAID | NT Length | AA Length | Score | Probability |
|---|---|---|---|---|---|---|
| 10445302_f2_290 | 254 | 4426 | 308 | 927 | 358 | 1.0e-32 |

| Protein name | Locus Name | Acc# |
|---|---|---|
|  | sp:DAPA_METJA | Q57695 |

Description

DIHYDRODIPICOLINATE SYNTHASE, (DHDPS)

| ORF Name | NTID | AAID | NT Length | AA Length | Score | Probability |
|---|---|---|---|---|---|---|
| 10548386_f3_524 | 255 | 4427 | 143 | 432 | 443 | 1.0e-41 |
| Protein name | | | | | Locus Name | Acc# |
| | | | | | sp:YAER_ECOLI | P52096:P75 |

Description

HYPOTHETICAL 14.7 KD PROTEIN IN LPCC-MESJ INTERGENIC REGION

| ORF Name | NTID | AAID | NT Length | AA Length | Score | Probability |
|---|---|---|---|---|---|---|
| 10553137_c2_941 | 256 | 4428 | 218 | 657 | 332 | 5.8e-30 |
| Protein name | | | | | Locus Name | Acc# |
| type 1 fimbrial chaperone | | | | | gp:PMATFGC | Z78535 |

Description

P.mirabilis atf gene cluster.

| ORF Name | NTID | AAID | NT Length | AA Length | Score | Probability |
|---|---|---|---|---|---|---|
| 10567177_c3_1007 | 257 | 4429 | 238 | 717 | 591 | 2.1e-57 |
| Protein name | | | | | Locus Name | Acc# |
| molecular chaperone fimC:fimbrial protein fimC | | | | | pir:S36632 | S36632 |

Description

| ORF Name | NTID | AAID | NT Length | AA Length | Score | Probability |
|---|---|---|---|---|---|---|
| 10585927_f1_81 | 258 | 4430 | 338 | 1017 | 690 | 6.7e-68 |
| Protein name | | | | | Locus Name | Acc# |
| putative glycerone kinase | | | | | gp:SCF55 | AL132991 |

Description

Streptomyces coelicolor cosmid F55.

| ORF Name | NTID | AAID | NT Length | AA Length | Score | Probability |
|---|---|---|---|---|---|---|
| 10600068_f1_183 | 259 | 4431 | 108 | 327 | | |
| Protein name | | | | | Locus Name | Acc# |

Description

NO-HIT

| ORF Name | NTID | AAID | NT Length | AA Length | Score | Probability |
|---|---|---|---|---|---|---|
| 10664003_c1_628 | 260 | 4432 | 150 | 453 | 512 | 4.9e-49 |
| Protein name | | | | | Locus Name | Acc# |
| conserved hypothetical protein b1686 | | | | pir:F64926 | | F64926 |

Description

| ORF Name | NTID | AAID | NT Length | AA Length | Score | Probability |
|---|---|---|---|---|---|---|
| 10680250_c1_738 | 261 | 4433 | 279 | 840 | 1231 | 3.1e-125 |
| Protein name | | | | | Locus Name | Acc# |
| cell division inhibitor minD:septum site-determining protein minD | | | | pir:CCECID | | B31877:D64 |

Description

| ORF Name | NTID | AAID | NT Length | AA Length | Score | Probability |
|---|---|---|---|---|---|---|
| 10723151_f3_546 | 262 | 4434 | 407 | 1224 | 1531 | 5.1e-157 |
| Protein name | | | | | Locus Name | Acc# |
| cyclopropane-fatty-acyl-phospholipid synthase, | | | | pir:A44292 | | A44292:G64 |

Description

| ORF Name | NTID | AAID | NT Length | AA Length | Score | Probability |
|---|---|---|---|---|---|---|
| 10736077_c1_718 | 263 | 4435 | 327 | 984 | 1187 | 1.4e-120 |
| Protein name | | | | | Locus Name | Acc# |
| membrane protein ydaA | | | | pir:QQECX | | H64882:A04 |

Description

| ORF Name | NTID | AAID | NT Length | AA Length | Score | Probability |
|---|---|---|---|---|---|---|
| 10838411_c2_815 | 264 | 4436 | 310 | 933 | 828 | 1.6e-82 |
| Protein name | | | | | Locus Name | Acc# |
| | | | | | sp:YCFS_ECOLI | P75954 |

Description

HYPOTHETICAL 34.6 KD PROTEIN IN NDH-MFD INTERGENIC REGION PRECURSOR

| ORF Name | NTID | AAID | NT Length | AA Length | Score | Probability |
|---|---|---|---|---|---|---|
| 10978130_c3_1020 | 265 | 4437 | 157 | 474 | 317 | 2.2e-28 |
| Protein name | | | | | Locus Name | Acc# |
| | | | | | gp:PMLRPFTSK | Y10417 |

Description: P.mirabilis lrp and ftsK genes.

| ORF Name | NTID | AAID | NT Length | AA Length | Score | Probability |
|---|---|---|---|---|---|---|
| 10989000_f2_273 | 266 | 4438 | 72 | 219 | 176 | 2.0e-13 |
| Protein name | | | | | Locus Name | Acc# |
| | | | | | sp:VOGR_BPP2 | P08762 |

Description: LATE CONTROL OGR PROTEIN

| ORF Name | NTID | AAID | NT Length | AA Length | Score | Probability |
|---|---|---|---|---|---|---|
| 11035675_f3_500 | 267 | 4439 | 222 | 669 | 673 | 4.2e-66 |
| Protein name | | | | | Locus Name | Acc# |
| | | | | | sp:YDGP_ECOLI | P77285 |

Description: HYPOTHETICAL 21.9 KD PROTEIN IN ADD-NTH INTERGENIC REGION

| ORF Name | NTID | AAID | NT Length | AA Length | Score | Probability |
|---|---|---|---|---|---|---|
| 11132962_c2_788 | 268 | 4440 | 190 | 573 | 435 | 7.0e-41 |
| Protein name | | | | | Locus Name | Acc# |
| | | | | | sp:FM1A_SALTY | P37921 |

Description: TYPE-1 FIMBRIAL PROTEIN, A CHAIN PRECURSOR (TYPE-1A PILIN)

| ORF Name | NTID | AAID | NT Length | AA Length | Score | Probability |
|---|---|---|---|---|---|---|
| 11141887_f2_342 | 269 | 4441 | 205 | 618 | 879 | 6.3e-88 |
| Protein name | | | | | Locus Name | Acc# |
| | | | | | sp:GCH2_ECOLI | P25523:P78 |

Description: GTP CYCLOHYDROLASE II,

| ORF Name | NTID | AAID | NT Length | AA Length | Score | Probability |
|---|---|---|---|---|---|---|
| 117037_f3_425 | 270 | 4442 | 194 | 585 | 463 | 7.6e-44 |
| Protein name | | | | | Locus Name | Acc# |
| | | | | | sp:YCDY_ECOLI | P75915 |

Description
HYPOTHETICAL 20.7 KD PROTEIN IN PHOH-CSGG INTERGENIC REGION

| ORF Name | NTID | AAID | NT Length | AA Length | Score | Probability |
|---|---|---|---|---|---|---|
| 1178177_f1_46 | 271 | 4443 | 71 | 216 | 80 | 0.013 |
| Protein name | | | | | Locus Name | Acc# |
| hypothetical protein aq_453 | | | | | pir:D70341 | D70341 |

Description

| ORF Name | NTID | AAID | NT Length | AA Length | Score | Probability |
|---|---|---|---|---|---|---|
| 11875342_f3_594 | 272 | 4444 | 287 | 864 | 1228 | 6.5e-125 |
| Protein name | | | | | Locus Name | Acc# |
| | | | | | sp:PURU_ECOLI | P37051 |

Description
HYDROLASE)

| ORF Name | NTID | AAID | NT Length | AA Length | Score | Probability |
|---|---|---|---|---|---|---|
| 11901562_f3_469 | 273 | 4445 | 409 | 1230 | 1489 | 1.4e-152 |
| Protein name | | | | | Locus Name | Acc# |
| | | | | | sp:YHIH_ECOLI | P37624:P37 |

Description
HYPOTHETICAL ABC TRANSPORTER ATP-BINDING PROTEIN YHIH

| ORF Name | NTID | AAID | NT Length | AA Length | Score | Probability |
|---|---|---|---|---|---|---|
| 12146887_f3_422 | 274 | 4446 | 303 | 912 | 1321 | 9.1e-135 |
| Protein name | | | | | Locus Name | Acc# |
| | | | | | sp:KDSA_ECOLI | P17579 |

Description
8-PHOSPHATE SYNTHETASE) (KDO 8-P SYNTHASE)

141

| ORF Name | NTID | AAID | NT Length | AA Length | Score | Probability |
|---|---|---|---|---|---|---|
| 12150311_c2_810 | 275 | 4447 | 1019 | 3060 | 3954 | 0.0 |
| Protein name | | | | | Locus Name | Acc# |
| | | | | | sp:YDIJ_ECOLI | P77748 |

Description

HYPOTHETICAL 113.2 KD PROTEIN IN LPP-AROD INTERGENIC REGION

| ORF Name | NTID | AAID | NT Length | AA Length | Score | Probability |
|---|---|---|---|---|---|---|
| 12187750_c1_724 | 276 | 4448 | 109 | 330 | 91 | 0.0027 |
| Protein name | | | | | Locus Name | Acc# |
| NADH dehydrogenase (ubiquinone), chain 2 | | | | | pir:S58750 | S58750 |

Description

| ORF Name | NTID | AAID | NT Length | AA Length | Score | Probability |
|---|---|---|---|---|---|---|
| 12299177_f2_361 | 277 | 4449 | 180 | 543 | 152 | 6.9e-11 |
| Protein name | | | | | Locus Name | Acc# |
| hypothetical 14.7K protein, LIM14 | | | | | pir:JC2213 | JC2213 |

Description

| ORF Name | NTID | AAID | NT Length | AA Length | Score | Probability |
|---|---|---|---|---|---|---|
| 12345037_f2_338 | 278 | 4450 | 663 | 1992 | 2368 | 1.0e-245 |
| Protein name | | | | | Locus Name | Acc# |
| | | | | | sp:RNB_ECOLI | P30850:P78 |

Description

EXORIBONUCLEASE II, (RIBONUCLEASE II) (RNASE II)

| ORF Name | NTID | AAID | NT Length | AA Length | Score | Probability |
|---|---|---|---|---|---|---|
| 12361591_c3_1152 | 279 | 4451 | 67 | 204 | | |
| Protein name | | | | | Locus Name | Acc# |

Description

NO-HIT

| ORF Name | NTID | AAID | NT Length | AA Length | Score | Probability |
|---|---|---|---|---|---|---|
| 12533311_c1_600 | 280 | 4452 | 64 | 195 | 78 | 0.012 |
| Protein name | | | | | Locus Name | Acc# |
| | | | | | sp:CIN4_YEAST | P39110 |

Description
GTP-BINDING PROTEIN CIN4

| ORF Name | NTID | AAID | NT Length | AA Length | Score | Probability |
|---|---|---|---|---|---|---|
| 12594012_c2_911 | 281 | 4453 | 641 | 1926 | 1818 | 2.0e-187 |
| Protein name | | | | | Locus Name | Acc# |
| | | | | | sp:ATKA_ECOLI | P03959 |

Description
A CHAIN)

| ORF Name | NTID | AAID | NT Length | AA Length | Score | Probability |
|---|---|---|---|---|---|---|
| 12600953_c2_910 | 282 | 4454 | 300 | 903 | 851 | 5.8e-85 |
| Protein name | | | | | Locus Name | Acc# |
| dimethyl sulfoxide reductase subunit C | | | | | gp:AF135170 | AF135170 |

Description
Yersinia pestis ribose ABC transporter (rbsA) gene, partial cds;D-ribose binding protein (rbsB), catalase/peroxidase (katY),cytochrome c (cybC), cytochrome b (cybB), dimethyl sulfoxidereductase subunit C (dmsC), dimethyl sulfoxide reductase subunit B(dmsB), dimethyl sulfoxide reductase subunit A (dmsA), andL-ribulose-phosphate 4-epimerase (araD) genes, complete cds;

| ORF Name | NTID | AAID | NT Length | AA Length | Score | Probability |
|---|---|---|---|---|---|---|
| 12625682_c3_1111 | 283 | 4455 | 63 | 192 | | |
| Protein name | | | | | Locus Name | Acc# |

Description
NO-HIT

| ORF Name | NTID | AAID | NT Length | AA Length | Score | Probability |
|---|---|---|---|---|---|---|
| 12694668_f3_542 | 284 | 4456 | 205 | 618 | 842 | 5.2e-84 |
| Protein name | | | | | Locus Name | Acc# |
| superoxide dismutase, (Fe) | | | | | pir:DSECF | A29940:S00 |

Description

| ORF_Name | NTID | AAID | NT Length | AA Length | Score | Probability |
|---|---|---|---|---|---|---|
| 1290888_f2_220 | 285 | 4457 | 421 | 1266 | 1581 | 2.6e-162 |
| Protein name | | | | | Locus Name | Acc# |
| glutamyl-tRNA reductase,:hemA protein | | | | | pir:BVEBHA | A32661 |

Description

| ORF_Name | NTID | AAID | NT Length | AA Length | Score | Probability |
|---|---|---|---|---|---|---|
| 1291011_f2_380 | 286 | 4458 | 475 | 1428 | 1593 | 1.4e-163 |
| Protein name | | | | | Locus Name | Acc# |
| | | | | | sp:YDHE_ECOLI | P37340:P77 |

Description
HYPOTHETICAL 49.4 KD PROTEIN IN RIBC-PYRF INTERGENIC REGION

| ORF_Name | NTID | AAID | NT Length | AA Length | Score | Probability |
|---|---|---|---|---|---|---|
| 134712_c1_739 | 287 | 4459 | 90 | 273 | 347 | 1.5e-31 |
| Protein name | | | | | Locus Name | Acc# |
| | | | | | sp:MINE_ECOLI | P18198 |

Description
CELL DIVISION TOPOLOGICAL SPECIFICITY FACTOR

| ORF_Name | NTID | AAID | NT Length | AA Length | Score | Probability |
|---|---|---|---|---|---|---|
| 13729780_f2_412 | 288 | 4460 | 281 | 846 | 599 | 2.9e-58 |
| Protein name | | | | | Locus Name | Acc# |
| | | | | | sp:YDDQ_ECOLI | P77463 |

Description
HYPOTHETICAL ABC TRANSPORTER PERMEASE PROTEIN YDDQ

| ORF_Name | NTID | AAID | NT Length | AA Length | Score | Probability |
|---|---|---|---|---|---|---|
| 1375202_c1_663 | 289 | 4461 | 389 | 1170 | 1428 | 4.2e-146 |
| Protein name | | | | | Locus Name | Acc# |
| | | | | | sp:YCIM_ECOLI | P45576:P76 |

Description
HYPOTHETICAL 44.5 KD PROTEIN IN PGPB-PYRF INTERGENIC REGION PRECURSOR

144

| ORF Name | NTID | AAID | NT Length | AA Length | Score | Probability |
|---|---|---|---|---|---|---|
| 13775787_f3_514 | 290 | 4462 | 551 | 1656 | 1507 | 1.8e-154 |
| Protein name | | | | | Locus Name | Acc# |
| | | | | | sp:TRPE_ECOLI | P00895:P78 |

Description

ANTHRANILATE SYNTHASE COMPONENT I,

| ORF Name | NTID | AAID | NT Length | AA Length | Score | Probability |
|---|---|---|---|---|---|---|
| 13807762_f1_147 | 291 | 4463 | 115 | 348 | | |
| Protein name | | | | | Locus Name | Acc# |

Description

NO-HIT

| ORF Name | NTID | AAID | NT Length | AA Length | Score | Probability |
|---|---|---|---|---|---|---|
| 13836701_c3_1180 | 292 | 4464 | 296 | 891 | 1039 | 7.0e-105 |
| Protein name | | | | | Locus Name | Acc# |
| | | | | | sp:YCHB_SALTY | P30753 |

Description

HYPOTHETICAL 30.9 KD PROTEIN IN HEMM-PRS INTERGENIC REGION

| ORF Name | NTID | AAID | NT Length | AA Length | Score | Probability |
|---|---|---|---|---|---|---|
| 13855077_f3_470 | 293 | 4465 | 375 | 1128 | 1426 | 6.8e-146 |
| Protein name | | | | | Locus Name | Acc# |
| hypothetical 41.1K protein (rhsB-pit intergenic region):yhhJ protein | | | | | pir:S47704 | S47704:H65 |

Description

| ORF Name | NTID | AAID | NT Length | AA Length | Score | Probability |
|---|---|---|---|---|---|---|
| 13882963_c1_657 | 294 | 4466 | 178 | 537 | 578 | 4.9e-56 |
| Protein name | | | | | Locus Name | Acc# |
| | | | | | sp:SODC_SALTY | P53636:O33 |

Description

PRECURSOR,

| ORF Name | NTID | AAID | NT Length | AA Length | Score | Probability |
|---|---|---|---|---|---|---|
| 13910287_f2_325 | 295 | 4467 | 171 | 516 | | |
| Protein name | | | | | Locus Name | Acc# |

Description
NO-HIT

| ORF Name | NTID | AAID | NT Length | AA Length | Score | Probability |
|---|---|---|---|---|---|---|
| 13910936_c3_1149 | 296 | 4468 | 71 | 216 | | |
| Protein name | | | | | Locus Name | Acc# |

Description
NO-HIT

| ORF Name | NTID | AAID | NT Length | AA Length | Score | Probability |
|---|---|---|---|---|---|---|
| 14094040_c3_1087 | 297 | 4469 | 133 | 402 | | |
| Protein name | | | | | Locus Name | Acc# |

Description
NO-HIT

| ORF Name | NTID | AAID | NT Length | AA Length | Score | Probability |
|---|---|---|---|---|---|---|
| 14226512_f2_256 | 298 | 4470 | 245 | 738 | 820 | 1.1e-81 |
| Protein name | | | | | Locus Name | Acc# |
| probable 2-hydroxyhepta-2,4-diene-1,7-dioate isomerase b1180 | | | | | pir:A64864 | A64864 |

Description

| ORF Name | NTID | AAID | NT Length | AA Length | Score | Probability |
|---|---|---|---|---|---|---|
| 14256952_c3_1134 | 299 | 4471 | 233 | 702 | 711 | 4.0e-70 |
| Protein name | | | | | Locus Name | Acc# |
| | | | | | sp:MINC_ECOLI | P18196 |

Description
CELL DIVISION INHIBITOR MINC

146

| ORF Name | NTID | AAID | NT Length | AA Length | Score | Probability |
|---|---|---|---|---|---|---|
| 14337758_c3_1090 | 300 | 4472 | 581 | 1746 | 559 | 1.9e-65 |
| Protein name | | | | | Locus Name | Acc# |
| ABC transporter, ATP-binding protein, EF-3 family | | | | | pir:B75371 | B75371 |

Description

ABC transporter, ATP-binding protein, EF-3 family

| ORF Name | NTID | AAID | NT Length | AA Length | Score | Probability |
|---|---|---|---|---|---|---|
| 14461702_c3_1058 | 301 | 4473 | 253 | 762 | | |
| Protein name | | | | | Locus Name | Acc# |

Description

NO-HIT

| ORF Name | NTID | AAID | NT Length | AA Length | Score | Probability |
|---|---|---|---|---|---|---|
| 14464391_c1_630 | 302 | 4474 | 266 | 801 | 1061 | 3.2e-107 |
| Protein name | | | | | Locus Name | Acc# |
| | | | | | sp:YNHD_ECOLI | P77499 |

Description

PROBABLE ATP-DEPENDENT TRANSPORTER YNHD

| ORF Name | NTID | AAID | NT Length | AA Length | Score | Probability |
|---|---|---|---|---|---|---|
| 14479760_c2_850 | 303 | 4475 | 75 | 228 | | |
| Protein name | | | | | Locus Name | Acc# |

Description

NO-HIT

| ORF Name | NTID | AAID | NT Length | AA Length | Score | Probability |
|---|---|---|---|---|---|---|
| 1453208_f3_441 | 304 | 4476 | 1665 | 4998 | 404 | 4.2e-57 |
| Protein name | | | | | Locus Name | Acc# |
| | | | | | sp:RHSD_ECOLI | P16919:P77 |

Description

RHSD PROTEIN PRECURSOR

| ORF Name | NTID | AAID | NT Length | AA Length | Score | Probability |
|---|---|---|---|---|---|---|
| 14533375_f1_214 | 305 | 4477 | 185 | 558 | 448 | 3.0e-42 |
| Protein name | | | | | Locus Name | Acc# |
| | | | | | sp:YCHJ_ECOLI | P37052 |

Description
HYPOTHETICAL 17.0 KD PROTEIN IN HNR-PURU INTERGENIC REGION

| ORF Name | NTID | AAID | NT Length | AA Length | Score | Probability |
|---|---|---|---|---|---|---|
| 14539203_c2_824 | 306 | 4478 | 142 | 429 | 539 | 6.7e-52 |
| Protein name | | | | | Locus Name | Acc# |
| | | | | | sp:SLYA_ECOLI | P55740 |

Description
TRANSCRIPTIONAL REGULATOR SLYA

| ORF Name | NTID | AAID | NT Length | AA Length | Score | Probability |
|---|---|---|---|---|---|---|
| 14657761_c2_891 | 307 | 4479 | 193 | 582 | 160 | 9.7e-12 |
| Protein name | | | | | Locus Name | Acc# |
| putative alanine acetyl transferase | | | | | gp:ATAC006223 | AC006223 |

Description
Arabidopsis thaliana chromosome II BAC F22D22 genomic sequence, complete sequence.

| ORF Name | NTID | AAID | NT Length | AA Length | Score | Probability |
|---|---|---|---|---|---|---|
| 14876553_c1_622 | 308 | 4480 | 473 | 1422 | 1668 | 1.5e-171 |
| Protein name | | | | | Locus Name | Acc# |
| | | | | | gp:YP102KB | AL031866 |

Description
Yersinia pestis 102 kbases unstable region: from 1 to 119443.

| ORF Name | NTID | AAID | NT Length | AA Length | Score | Probability |
|---|---|---|---|---|---|---|
| 14882813_c1_629 | 309 | 4481 | 205 | 618 | | |
| Protein name | | | | | Locus Name | Acc# |

Description
NO-HIT

| ORF Name | NTID | AAID | NT Length | AA Length | Score | Probability |
|---|---|---|---|---|---|---|
| 14930341_f1_179 | 310 | 4482 | 685 | 2058 | 1959 | 2.3e-202 |
| Protein name | | | | | Locus Name | Acc# |
| | | | | | sp:HMUR_YERPE | Q56989 |

Description
HEMIN RECEPTOR PRECURSOR

| ORF Name | NTID | AAID | NT Length | AA Length | Score | Probability |
|---|---|---|---|---|---|---|
| 14931577_f2_347 | 311 | 4483 | 83 | 252 | 297 | 3.0e-26 |
| Protein name | | | | | Locus Name | Acc# |
| | | | | | sp:YCIN_ECOLI | P46132:P77 |

Description
HYPOTHETICAL 9.4 KD PROTEIN IN SOHB-TOPA INTERGENIC REGION

| ORF Name | NTID | AAID | NT Length | AA Length | Score | Probability |
|---|---|---|---|---|---|---|
| 15665678_c3_1050 | 312 | 4484 | 63 | 192 | 69 | 0.042 |
| Protein name | | | | | Locus Name | Acc# |
| arginine-rich protein a209R | | | | | pir:T17699 | T17699 |

Description

| ORF Name | NTID | AAID | NT Length | AA Length | Score | Probability |
|---|---|---|---|---|---|---|
| 15666000_c3_1059 | 313 | 4485 | 904 | 2715 | 3483 | 0.0 |
| Protein name | | | | | Locus Name | Acc# |
| aconitate hydratase, | | | | | pir:G64875 | G64875:S22 |

Description

| ORF Name | NTID | AAID | NT Length | AA Length | Score | Probability |
|---|---|---|---|---|---|---|
| 15676262_f2_404 | 314 | 4486 | 65 | 198 | 68 | 0.0013 |
| Protein name | | | | | Locus Name | Acc# |
| hypothetical protein C18A3.6 | | | | | pir:T15546 | T15546 |

Description

| ORF Name | NTID | AAID | NT Length | AA Length | Score | Probability |
|---|---|---|---|---|---|---|
| 157125_f2_293 | 315 | 4487 | 250 | 753 | 538 | 8.6e-52 |
| Protein name | | | | | Locus Name | Acc# |
| | | | | | sp:YEAS_ECOLI | P76249:O07 |
| Description | | | | | | |
| HYPOTHETICAL 23.2 KD PROTEIN IN GAPA-RND INTERGENIC REGION | | | | | | |

| ORF Name | NTID | AAID | NT Length | AA Length | Score | Probability |
|---|---|---|---|---|---|---|
| 15803787_f2_353 | 316 | 4488 | 205 | 618 | 691 | 5.2e-68 |
| Protein name | | | | | Locus Name | Acc# |
| anthranilate synthase, component II | | | | | pir:NNEC2 | B64874:A93 |
| Description | | | | | | |

| ORF Name | NTID | AAID | NT Length | AA Length | Score | Probability |
|---|---|---|---|---|---|---|
| 158158_c1_688 | 317 | 4489 | 326 | 981 | 593 | 1.3e-57 |
| Protein name | | | | | Locus Name | Acc# |
| | | | | | sp:YIDY_ECOLI | P31462:P76 |
| Description | | | | | | |
| HYPOTHETICAL 41.5 KD PROTEIN IN TNAB-BGLB INTERGENIC REGION | | | | | | |

| ORF Name | NTID | AAID | NT Length | AA Length | Score | Probability |
|---|---|---|---|---|---|---|
| 158391_f1_58 | 318 | 4490 | 538 | 1617 | 2186 | 2.0e-226 |
| Protein name | | | | | Locus Name | Acc# |
| | | | | | sp:AHPF_ECOLI | P35340:P77 |
| Description | | | | | | |
| (HYDROPEROXIDE REDUCTASE F52A PROTEIN) | | | | | | |

| ORF Name | NTID | AAID | NT Length | AA Length | Score | Probability |
|---|---|---|---|---|---|---|
| 15876717_c2_851 | 319 | 4491 | 329 | 990 | 1286 | 4.7e-131 |
| Protein name | | | | | Locus Name | Acc# |
| | | | | | sp:CYSB_ECOLI | P06613:P76 |
| Description | | | | | | |
| CYS REGULON TRANSCRIPTIONAL ACTIVATOR | | | | | | |

150

| ORF Name | NTID | AAID | NT Length | AA Length | Score | Probability |
|---|---|---|---|---|---|---|
| 159828_f3_588 | 320 | 4492 | 358 | 1077 | 648 | 1.9e-63 |
| Protein name | | | | | Locus Name | Acc# |
| | | | | | sp:YDDR_ECOLI | P77308 |

Description: HYPOTHETICAL ABC TRANSPORTER PERMEASE PROTEIN YDDR

| ORF Name | NTID | AAID | NT Length | AA Length | Score | Probability |
|---|---|---|---|---|---|---|
| 16100037_f3_565 | 321 | 4493 | 346 | 1041 | 1245 | 1.0e-126 |
| Protein name | | | | | Locus Name | Acc# |
| cyanide insensitive terminal oxidase | | | | | gp:PACIOAB | Y10528 |

Description: P.aeruginosa cioA and cioB genes.

| ORF Name | NTID | AAID | NT Length | AA Length | Score | Probability |
|---|---|---|---|---|---|---|
| 161017_c2_962 | 322 | 4494 | 77 | 234 | | |
| Protein name | | | | | Locus Name | Acc# |

Description: NO-HIT

| ORF Name | NTID | AAID | NT Length | AA Length | Score | Probability |
|---|---|---|---|---|---|---|
| 16407906_f2_300 | 323 | 4495 | 328 | 987 | 1177 | 1.7e-119 |
| Protein name | | | | | Locus Name | Acc# |
| acetyl-CoA carboxylase,, carboxyltransferase alpha chain | | | | | pir:A43452 | A43452:D28 |

Description:

| ORF Name | NTID | AAID | NT Length | AA Length | Score | Probability |
|---|---|---|---|---|---|---|
| 16495628_c3_1098 | 324 | 4496 | 64 | 195 | | |
| Protein name | | | | | Locus Name | Acc# |

Description: NO-HIT

| ORF_Name | NTID | AAID | NT Length | AA Length | Score | Probability |
|---|---|---|---|---|---|---|
| 165752_f2_382 | 325 | 4497 | 111 | 336 | 364 | 2.4e-33 |
| Protein name | | | | | Locus Name | Acc# |
| | | | | | sp:MULI_PROMI | P09461 |

Description
MAJOR OUTER MEMBRANE LIPOPROTEIN PRECURSOR (MUREIN-LIPOPROTEIN)

| ORF_Name | NTID | AAID | NT Length | AA Length | Score | Probability |
|---|---|---|---|---|---|---|
| 16673128_f3_433 | 326 | 4498 | 69 | 210 | | |
| Protein name | | | | | Locus Name | Acc# |

Description
NO-HIT

| ORF_Name | NTID | AAID | NT Length | AA Length | Score | Probability |
|---|---|---|---|---|---|---|
| 167131_f1_211 | 327 | 4499 | 141 | 426 | 119 | 2.2e-07 |
| Protein name | | | | | Locus Name | Acc# |
| hypothetical protein PH0761 | | | | | pir:B71124 | B71124 |

Description

| ORF_Name | NTID | AAID | NT Length | AA Length | Score | Probability |
|---|---|---|---|---|---|---|
| 16835887_f1_85 | 328 | 4500 | 111 | 336 | 216 | 1.1e-17 |
| Protein name | | | | | Locus Name | Acc# |
| | | | | | sp:YQFB_ECOLI | Q46828 |

Description
HYPOTHETICAL 11.9 KD PROTEIN IN FLDB-BGLA INTERGENIC REGION

| ORF_Name | NTID | AAID | NT Length | AA Length | Score | Probability |
|---|---|---|---|---|---|---|
| 16854686_f3_458 | 329 | 4501 | 1300 | 3903 | 5131 | 0.0 |
| Protein name | | | | | Locus Name | Acc# |
| | | | | | sp:HRPA_ECOLI | P43329:P77 |

Description
ATP-DEPENDENT HELICASE HRPA

| ORF Name | NTID | AAID | NT Length | AA Length | Score | Probability |
|---|---|---|---|---|---|---|
| 16942_f1_187 | 330 | 4502 | 107 | 324 | | |
| Protein name | | | | | Locus Name | Acc# |

Description
NO-HIT

| ORF Name | NTID | AAID | NT Length | AA Length | Score | Probability |
|---|---|---|---|---|---|---|
| 16989575_c1_720 | 331 | 4503 | 325 | 978 | 955 | 5.6e-96 |
| Protein name | | | | | Locus Name | Acc# |
| | | | | | sp:YDGH_ECOLI | P76177 |

Description
HYPOTHETICAL 33.9 KD PROTEIN IN PNTA-RSTA INTERGENIC REGION PRECURSOR

| ORF Name | NTID | AAID | NT Length | AA Length | Score | Probability |
|---|---|---|---|---|---|---|
| 16990806_f3_516 | 332 | 4504 | 355 | 1068 | 1233 | 1.9e-125 |
| Protein name | | | | | Locus Name | Acc# |
| anthranilate synthase component II | | | | | gp:ECOTGP | J01714:M12 |

Description
Escherichia coli tryptophan operon (trpABCDE) genes, complete.

| ORF Name | NTID | AAID | NT Length | AA Length | Score | Probability |
|---|---|---|---|---|---|---|
| 19532510_c1_708 | 333 | 4505 | 98 | 297 | | |
| Protein name | | | | | Locus Name | Acc# |

Description
NO-HIT

| ORF Name | NTID | AAID | NT Length | AA Length | Score | Probability |
|---|---|---|---|---|---|---|
| 19572187_f2_250 | 334 | 4506 | 147 | 444 | 356 | 1.7e-32 |
| Protein name | | | | | Locus Name | Acc# |
| probable membrane protein b1600 | | | | | pir:B64916 | B64916 |

Description

| ORF_Name | NTID | AAID | NT Length | AA Length | Score | Probability |
|---|---|---|---|---|---|---|
| 19589088_c1_704 | 335 | 4507 | 349 | 1050 | 739 | 4.3e-73 |
| Protein name | | | | | Locus Name | Acc# |
| | | | | | sp:YBIK_ECOLI | P37595:P75 |

Description
HYPOTHETICAL 33.4 KD PROTEIN IN MOEA-GRXA INTERGENIC REGION PRECURSOR

| ORF_Name | NTID | AAID | NT Length | AA Length | Score | Probability |
|---|---|---|---|---|---|---|
| 19609377_c2_847 | 336 | 4508 | 668 | 2007 | 924 | 1.1e-92 |
| Protein name | | | | | Locus Name | Acc# |
| VgrG protein | | | | | gp:AF044503 | AF044503 |

Description
Escherichia coli strain ec11 unknown (498), hcp gene, complete cds;and RhsG accessory genetic element VgrG protein, core component anddsORF-g1 genes, complete cds.

| ORF_Name | NTID | AAID | NT Length | AA Length | Score | Probability |
|---|---|---|---|---|---|---|
| 19691910_c1_693 | 337 | 4509 | 180 | 543 | 394 | 1.6e-36 |
| Protein name | | | | | Locus Name | Acc# |
| putative transmembrane efflux protein | | | | | gp:SC5G9 | AL117385 |

Description
Streptomyces coelicolor cosmid 5G9.

| ORF_Name | NTID | AAID | NT Length | AA Length | Score | Probability |
|---|---|---|---|---|---|---|
| 197132_f3_428 | 338 | 4510 | 512 | 1539 | 2041 | 4.6e-211 |
| Protein name | | | | | Locus Name | Acc# |
| | | | | | sp:MVIN_ECOLI | P75932 |

Description
VIRULENCE FACTOR MVIN HOMOLOG

| ORF_Name | NTID | AAID | NT Length | AA Length | Score | Probability |
|---|---|---|---|---|---|---|
| 19725052_f1_1 | 339 | 4511 | 62 | 189 | | |
| Protein name | | | | | Locus Name | Acc# |

Description
NO-HIT

| ORF Name | NTID | AAID | NT Length | AA Length | Score | Probability |
|---|---|---|---|---|---|---|
| 19728427_f1_43 | 340 | 4512 | 111 | 336 | 285 | 5.5e-25 |
| Protein name | | | | | Locus Name | Acc# |
| ydbL protein precursor | | | | | pir:B64889 | B64889 |

Description

| ORF Name | NTID | AAID | NT Length | AA Length | Score | Probability |
|---|---|---|---|---|---|---|
| 19743780_f1_29 | 341 | 4513 | 86 | 261 | | |
| Protein name | | | | | Locus Name | Acc# |

Description
NO-HIT

| ORF Name | NTID | AAID | NT Length | AA Length | Score | Probability |
|---|---|---|---|---|---|---|
| 19968762_c1_727 | 342 | 4514 | 221 | 666 | 562 | 2.5e-54 |
| Protein name | | | | | Locus Name | Acc# |
| phosphodiesterase, acpD | | | | | pir:G64892 | G64892:S55 |

Description

| ORF Name | NTID | AAID | NT Length | AA Length | Score | Probability |
|---|---|---|---|---|---|---|
| 20094625_c2_792 | 343 | 4515 | 499 | 1500 | 1867 | 1.3e-192 |
| Protein name | | | | | Locus Name | Acc# |
| | | | | | sp:DHAB_ECOLI | P17445 |

Description
BETAINE ALDEHYDE DEHYDROGENASE, (BADH)

| ORF Name | NTID | AAID | NT Length | AA Length | Score | Probability |
|---|---|---|---|---|---|---|
| 203380_f1_202 | 344 | 4516 | 69 | 210 | | |
| Protein name | | | | | Locus Name | Acc# |

Description
NO-HIT

| ORF_Name | NTID | AAID | NT Length | AA Length | Score | Probability |
|---|---|---|---|---|---|---|
| 20348760_c1_675 | 345 | 4517 | 327 | 984 | | |
| Protein name | | | | | Locus Name | Acc# |

Description

NO-HIT

| ORF_Name | NTID | AAID | NT Length | AA Length | Score | Probability |
|---|---|---|---|---|---|---|
| 20407150_f3_559 | 346 | 4518 | 752 | 2259 | 551 | 5.2e-103 |
| Protein name | | | | | Locus Name | Acc# |
| outer membrane heme receptor ShuA | | | | | gp:SDU64516 | U64516 |

Description

Shigella dysenteriae shuV, shuU, shuY, shuX, shuW pseudogene, shuT, outer membrane heme receptor ShuA (shuA), and shuS genes, complete cds.

| ORF_Name | NTID | AAID | NT Length | AA Length | Score | Probability |
|---|---|---|---|---|---|---|
| 20425257_c3_1135 | 347 | 4519 | 61 | 186 | | |
| Protein name | | | | | Locus Name | Acc# |

Description

NO-HIT

| ORF_Name | NTID | AAID | NT Length | AA Length | Score | Probability |
|---|---|---|---|---|---|---|
| 20503202_f3_452 | 348 | 4520 | 375 | 1128 | 658 | 1.6e-64 |
| Protein name | | | | | Locus Name | Acc# |
| putative transglycosylase | | | | | gp:AB030032 | AB030032 |

Description

Actinobacillus actinomycetemcomitans serotype e-specific polysaccharide antigen gene cluster (ORF1, ORF2, ORF3, ORF4, ORF5, rmlB, rmlA, rmlD, rmlC, ORF10, ORF11, ORF12, ORF13, ORF14, ORF15, ORF16, ORF17, ORF18), complete cds.

| ORF_Name | NTID | AAID | NT Length | AA Length | Score | Probability |
|---|---|---|---|---|---|---|
| 20504635_c3_1073 | 349 | 4521 | 82 | 249 | 93 | 0.00017 |
| Protein name | | | | | Locus Name | Acc# |
| hemolysin-coregulated protein | | | | | pir:T10891 | T10891 |

Description

| ORF_Name | NTID | AAID | NT Length | AA Length | Score | Probability |
|---|---|---|---|---|---|---|
| 20509660_f2_240 | 350 | 4522 | 123 | 372 | | |
| Protein name | | | | | Locus Name | Acc# |

Description
NO-HIT

| ORF_Name | NTID | AAID | NT Length | AA Length | Score | Probability |
|---|---|---|---|---|---|---|
| 20509702_f3_436 | 351 | 4523 | 145 | 438 | 527 | 1.3e-50 |
| Protein name | | | | | Locus Name | Acc# |
| | | | | | sp:NTPA_ECOLI | P24236 |

Description
DATP PYROPHOSPHOHYDROLASE,

| ORF_Name | NTID | AAID | NT Length | AA Length | Score | Probability |
|---|---|---|---|---|---|---|
| 20601553_f3_435 | 352 | 4524 | 599 | 1800 | 2413 | 1.8e-250 |
| Protein name | | | | | Locus Name | Acc# |
| | | | | | sp:SYD_ECOLI | P21889 |

Description
(ASPRS)

| ORF_Name | NTID | AAID | NT Length | AA Length | Score | Probability |
|---|---|---|---|---|---|---|
| 20737912_c2_881 | 353 | 4525 | 486 | 1461 | 1603 | 1.2e-164 |
| Protein name | | | | | Locus Name | Acc# |
| | | | | | sp:XYLB_ECOLI | P09099 |

Description
XYLULOSE KINASE, (XYLULOKINASE)

| ORF_Name | NTID | AAID | NT Length | AA Length | Score | Probability |
|---|---|---|---|---|---|---|
| 20740967_f1_126 | 354 | 4526 | 281 | 846 | | |
| Protein name | | | | | Locus Name | Acc# |

Description
NO-HIT

| ORF Name | NTID | AAID | NT Length | AA Length | Score | Probability |
|---|---|---|---|---|---|---|
| 20907507_f1_161 | 355 | 4527 | 277 | 834 | 422 | 1.7e-39 |
| Protein name | | | | | Locus Name | Acc# |
| | | | | | sp:Y902_HAEIN | P44070 |

Description: HYPOTHETICAL PROTEIN HI0902

| ORF Name | NTID | AAID | NT Length | AA Length | Score | Probability |
|---|---|---|---|---|---|---|
| 21488302_f1_116 | 356 | 4528 | 244 | 735 | 872 | 3.5e-87 |
| Protein name | | | | | Locus Name | Acc# |
| | | | | | sp:YDGQ_ECOLI | P77179 |

Description: HYPOTHETICAL 24.5 KD PROTEIN IN ADD-NTH INTERGENIC REGION

| ORF Name | NTID | AAID | NT Length | AA Length | Score | Probability |
|---|---|---|---|---|---|---|
| 21492802_c3_1179 | 357 | 4529 | 68 | 207 | 168 | 1.4e-12 |
| Protein name | | | | | Locus Name | Acc# |
| | | | | | sp:LOLB_ECOLI | P24208:Q46 |

Description: OUTER MEMBRANE LIPOPROTEIN LOLB PRECURSOR

| ORF Name | NTID | AAID | NT Length | AA Length | Score | Probability |
|---|---|---|---|---|---|---|
| 21516406_f1_191 | 358 | 4530 | 61 | 186 | | |
| Protein name | | | | | Locus Name | Acc# |

Description: NO-HIT

| ORF Name | NTID | AAID | NT Length | AA Length | Score | Probability |
|---|---|---|---|---|---|---|
| 21680291_c1_598 | 359 | 4531 | 347 | 1044 | 1230 | 4.0e-125 |

| Protein name | | | | | Locus Name | Acc# |
|---|---|---|---|---|---|---|
| WbnF | | | | | gp:AF172324 | AF172324 |

Description

Escherichia coli GalF (galF) gene, partial cds; O-antigen repeatunit transporter Wzx (wzx), WbnA (wbnA), O-antigen polymerase Wzy(wzy), WbnB (wbnB), WbnC (wbnC), WbnD (wbnD), WbnE (wbnE),UDP-Glc-4-epimerase GalE (galE), 6-phosphogluconate dehydrogenaseGnd (gnd), UDP-Glc-6-dehydrogenase Ugd (ugd), and WbnF (wbnF)genes, complete cds; and chain length determinant

| ORF Name | NTID | AAID | NT Length | AA Length | Score | Probability |
|---|---|---|---|---|---|---|
| 21720007_f2_395 | 360 | 4532 | 480 | 1443 | 1792 | 1.1e-184 |

| Protein name | | | | | Locus Name | Acc# |
|---|---|---|---|---|---|---|
| cyanide insensitive terminal oxidase | | | | | gp:PACIOAB | Y10528 |

Description

P.aeruginosa cioA and cioB genes.

| ORF Name | NTID | AAID | NT Length | AA Length | Score | Probability |
|---|---|---|---|---|---|---|
| 21745627_f2_233 | 361 | 4533 | 218 | 657 | 759 | 3.3e-75 |

| Protein name | | | | | Locus Name | Acc# |
|---|---|---|---|---|---|---|
| | | | | | sp:RUVA_ECOLI | P08576 |

Description

HOLLIDAY JUNCTION DNA HELICASE RUVA

| ORF Name | NTID | AAID | NT Length | AA Length | Score | Probability |
|---|---|---|---|---|---|---|
| 21912812_f3_462 | 362 | 4534 | 67 | 204 | | |

| Protein name | | | | | Locus Name | Acc# |
|---|---|---|---|---|---|---|

Description

NO-HIT

| ORF Name | NTID | AAID | NT Length | AA Length | Score | Probability |
|---|---|---|---|---|---|---|
| 22031641_c2_979 | 363 | 4535 | 192 | 579 | 395 | 1.2e-36 |

| Protein name | | | | | Locus Name | Acc# |
|---|---|---|---|---|---|---|
| | | | | | sp:YCEB_ECOLI | P09995 |

Description 20.5 KD PROTEIN IN PYRC-GRXB INTERGENIC REGION

| ORF Name | NTID | AAID | NT Length | AA Length | Score | Probability |
|---|---|---|---|---|---|---|
| 22037717_f1_74 | 364 | 4536 | 169 | 510 | 319 | 1.4e-28 |
| Protein name | | | | | Locus Name | Acc# |
| conserved hypothetical protein yknA | | | | | pir:F69857 | F69857 |

Description

| ORF Name | NTID | AAID | NT Length | AA Length | Score | Probability |
|---|---|---|---|---|---|---|
| 22048255_c2_875 | 365 | 4537 | 148 | 447 | 84 | 0.043 |
| Protein name | | | | | Locus Name | Acc# |
| NADH dehydrogenase subunit 4 | | | | | gp:AF070738 | AF070738 |

Description

Haemonchus contortus isolate Hcoh04 NADH dehydrogenase subunit 4(ND4) gene, mitochondrial gene encoding mitochondrial protein, partial cds.

| ORF Name | NTID | AAID | NT Length | AA Length | Score | Probability |
|---|---|---|---|---|---|---|
| 22116312_f3_463 | 366 | 4538 | 293 | 882 | 654 | 4.4e-64 |
| Protein name | | | | | Locus Name | Acc# |
| transposase OrfB | | | | | gp:AF034211 | AF034211 |

Description

Desulfovibrio vulgaris vulgaris insertion sequence ISD1 transposase gene, complete cds.

| ORF Name | NTID | AAID | NT Length | AA Length | Score | Probability |
|---|---|---|---|---|---|---|
| 22126312_f2_365 | 367 | 4539 | 198 | 597 | 169 | 1.1e-12 |
| Protein name | | | | | Locus Name | Acc# |
| putative outer membrane protein | | | | | gp:AF114793 | AF114793 |

Description

Vitreoscilla sp. YciB homolog, putative transcriptional activator, putative outer membrane protein, BioA homolog, and glutamine synthetase homolog genes, complete cds; and unknown genes.

| ORF Name | NTID | AAID | NT Length | AA Length | Score | Probability |
|---|---|---|---|---|---|---|
| 22321052_f2_313 | 368 | 4540 | 345 | 1038 | 770 | 2.2e-76 |
| Protein name | | | | | Locus Name | Acc# |
| hypothetical protein L4171.5 | | | | | pir:T02833 | T02833 |

Description

| ORF Name | NTID | AAID | NT Length | AA Length | Score | Probability |
|---|---|---|---|---|---|---|
| 22370213_f1_130 | 369 | 4541 | 88 | 267 | 73 | 0.021 |
| Protein name | | | | | Locus Name | Acc# |
| AF-6 | | | | | gp:AF063023 | AF063023 |

Description

Caenorhabditis elegans AF-6 mRNA, complete cds.

| ORF Name | NTID | AAID | NT Length | AA Length | Score | Probability |
|---|---|---|---|---|---|---|
| 22459567_f2_249 | 370 | 4542 | 525 | 1578 | 2134 | 6.4e-221 |
| Protein name | | | | | Locus Name | Acc# |
| | | | | | sp:G6PD_ECOLI | P22992:P78 |

Description

GLUCOSE-6-PHOSPHATE 1-DEHYDROGENASE, (G6PD)

| ORF Name | NTID | AAID | NT Length | AA Length | Score | Probability |
|---|---|---|---|---|---|---|
| 22714063_f1_78 | 371 | 4543 | 319 | 960 | 369 | 6.9e-34 |
| Protein name | | | | | Locus Name | Acc# |
| | | | | | gp:AB029044 | AB029044 |

Description

Comamonas testosteroni orfX, orfY, aphT, aphC, aphE, aphF, aphG, aphH, orfJ, aphI gene cluster for meta-pathway enzymes required for degradation of phenol, complete cds.

| ORF Name | NTID | AAID | NT Length | AA Length | Score | Probability |
|---|---|---|---|---|---|---|
| 22773452_c1_771 | 372 | 4544 | 566 | 1701 | 2017 | 1.6e-208 |
| Protein name | | | | | Locus Name | Acc# |
| | | | | | sp:YCHM_ECOLI | P40877:P76 |

Description

HYPOTHETICAL 58.4 KD PROTEIN IN PTH-PRSA INTERGENIC REGION

| ORF Name | NTID | AAID | NT Length | AA Length | Score | Probability |
|---|---|---|---|---|---|---|
| 22835377_f3_563 | 373 | 4545 | 220 | 663 | 213 | 2.4e-17 |
| Protein name | | | | | Locus Name | Acc# |
| conserved hypothetical protein | | | | | pir:C75329 | C75329 |

Description

| ORF Name | NTID | AAID | NT Length | AA Length | Score | Probability |
|---|---|---|---|---|---|---|
| 22852160_c1_764 | 374 | 4546 | 66 | 201 | | |
| Protein name | | | | | Locus Name | Acc# |

Description
NO-HIT

| ORF Name | NTID | AAID | NT Length | AA Length | Score | Probability |
|---|---|---|---|---|---|---|
| 22868942_c3_1003 | 375 | 4547 | 307 | 924 | 1334 | 3.8e-136 |
| Protein name | | | | | Locus Name | Acc# |
| | | | | | sp:OPPC_ECOLI | P77664 |

Description
OLIGOPEPTIDE TRANSPORT SYSTEM PERMEASE PROTEIN OPPC

| ORF Name | NTID | AAID | NT Length | AA Length | Score | Probability |
|---|---|---|---|---|---|---|
| 23437802_f3_502 | 376 | 4548 | 279 | 840 | 1019 | 9.2e-103 |
| Protein name | | | | | Locus Name | Acc# |
| | | | | | sp:NLPA_ECOLI | P04846 |

Description
LIPOPROTEIN-28 PRECURSOR

| ORF Name | NTID | AAID | NT Length | AA Length | Score | Probability |
|---|---|---|---|---|---|---|
| 23442327_c2_943 | 377 | 4549 | 184 | 555 | 89 | 0.037 |
| Protein name | | | | | Locus Name | Acc# |
| | | | | | sp:FM12_KLEPN | P12903 |

Description
FIMBRIAL SUBUNIT TYPE 1 PRECURSOR

| ORF Name | NTID | AAID | NT Length | AA Length | Score | Probability |
|---|---|---|---|---|---|---|
| 23442327_c3_1126 | 378 | 4550 | 185 | 558 | 97 | 0.0036 |
| Protein name | | | | | Locus Name | Acc# |
| | | | | | gp:ECFIMA01 | X00981 |

Description
E. coli fimA gene for type 1 fimbrial subunit.

| ORF Name | NTID | AAID | NT Length | AA Length | Score | Probability |
|---|---|---|---|---|---|---|
| 23445301_f2_378 | 379 | 4551 | 93 | 282 | | |
| Protein name | | | | | Locus Name | Acc# |
| | | | | | | |

Description: NO-HIT

| ORF Name | NTID | AAID | NT Length | AA Length | Score | Probability |
|---|---|---|---|---|---|---|
| 23470015_f3_489 | 380 | 4552 | 101 | 306 | 146 | 3.0e-10 |
| Protein name | | | | | Locus Name | Acc# |
| | | | | | sp:YJBD_ECOLI | P32685 |

Description: HYPOTHETICAL 10.5 KD PROTEIN IN PEPE-LYSC INTERGENIC REGION

| ORF Name | NTID | AAID | NT Length | AA Length | Score | Probability |
|---|---|---|---|---|---|---|
| 23470461_f3_420 | 381 | 4553 | 366 | 1101 | 1578 | 5.3e-162 |
| Protein name | | | | | Locus Name | Acc# |
| peptide chain release factor 1 | | | | | gp:ECU18555 | U18555 |

Description: Escherichia coli kdsA operon genes, complete cds.

| ORF Name | NTID | AAID | NT Length | AA Length | Score | Probability |
|---|---|---|---|---|---|---|
| 23475090_c2_944 | 382 | 4554 | 110 | 333 | 143 | 6.8e-10 |
| Protein name | | | | | Locus Name | Acc# |
| | | | | | sp:YRAI_ECOLI | P42914 |

Description: PRECURSOR

| ORF Name | NTID | AAID | NT Length | AA Length | Score | Probability |
|---|---|---|---|---|---|---|
| 23476588_f2_396 | 383 | 4555 | 227 | 684 | 357 | 1.3e-32 |
| Protein name | | | | | Locus Name | Acc# |
| | | | | | sp:YIDX_ECOLI | P31461:P76 |

Description: HYPOTHETICAL 24.8 KD PROTEIN IN IBPA-GYRB INTERGENIC REGION

| ORF Name | NTID | AAID | NT Length | AA Length | Score | Probability |
|---|---|---|---|---|---|---|
| 23484410_f1_39 | 384 | 4556 | 582 | 1749 | 2274 | 9.4e-236 |
| Protein name | | | | | Locus Name | Acc# |
| | | | | | sp:LCFA_ECOLI | P29212 |

Description
SYNTHETASE)

| ORF Name | NTID | AAID | NT Length | AA Length | Score | Probability |
|---|---|---|---|---|---|---|
| 23555400_c2_869 | 385 | 4557 | 479 | 1440 | 2022 | 4.8e-209 |
| Protein name | | | | | Locus Name | Acc# |
| | | | | | sp:FUMC_ECOLI | P05042:P76 |

Description
FUMARATE HYDRATASE CLASS II, (FUMARASE)

| ORF Name | NTID | AAID | NT Length | AA Length | Score | Probability |
|---|---|---|---|---|---|---|
| 23557937_f1_55 | 386 | 4558 | 636 | 1911 | 112 | 4.9e-06 |
| Protein name | | | | | Locus Name | Acc# |
| glutamate decarboxylase | | | | | pir:E69015 | E69015 |

Description

| ORF Name | NTID | AAID | NT Length | AA Length | Score | Probability |
|---|---|---|---|---|---|---|
| 23594431_c1_643 | 387 | 4559 | 83 | 252 | 258 | 4.0e-22 |
| Protein name | | | | | Locus Name | Acc# |
| | | | | | sp:PSPB_ECOLI | P23854 |

Description
PHAGE SHOCK PROTEIN B

| ORF Name | NTID | AAID | NT Length | AA Length | Score | Probability |
|---|---|---|---|---|---|---|
| 23594555_f2_312 | 388 | 4560 | 149 | 450 | 73 | 0.024 |
| Protein name | | | | | Locus Name | Acc# |
| | | | | | sp:VATM_HUMAN | O15342 |

Description
ATPASE M9.2 SUBUNIT) (9.2 KD MEMBRANE ACCESSORY PROTEIN)

| ORF_Name | NTID | AAID | NT Length | AA Length | Score | Probability |
|---|---|---|---|---|---|---|
| 23595792_f1_102 | 389 | 4561 | 237 | 714 | 738 | 5.5e-73 |
| Protein name | | | | | Locus Name | Acc# |
| | | | | | gp:AP000342 | AP000342 |

Description

Plasmid R100 genomic DNA.

| ORF_Name | NTID | AAID | NT Length | AA Length | Score | Probability |
|---|---|---|---|---|---|---|
| 236250_f1_27 | 390 | 4562 | 68 | 207 | | |
| Protein name | | | | | Locus Name | Acc# |

Description

NO-HIT

| ORF_Name | NTID | AAID | NT Length | AA Length | Score | Probability |
|---|---|---|---|---|---|---|
| 23626928_c1_734 | 391 | 4563 | 326 | 981 | 482 | 7.4e-46 |
| Protein name | | | | | Locus Name | Acc# |
| | | | | | sp:ROB_ECOLI | P27292 |

Description

RIGHT ORIGIN-BINDING PROTEIN

| ORF_Name | NTID | AAID | NT Length | AA Length | Score | Probability |
|---|---|---|---|---|---|---|
| 23627333_c3_1099 | 392 | 4564 | 904 | 2715 | 2675 | 3.0e-278 |
| Protein name | | | | | Locus Name | Acc# |
| | | | | | sp:KDPD_ECOLI | P21865 |

Description

SENSOR PROTEIN KDPD,

| ORF_Name | NTID | AAID | NT Length | AA Length | Score | Probability |
|---|---|---|---|---|---|---|
| 23633562_c1_662 | 393 | 4565 | 109 | 330 | 289 | 2.1e-25 |
| Protein name | | | | | Locus Name | Acc# |
| | | | | | sp:YCIS_ECOLI | P77614 |

Description

HYPOTHETICAL 11.4 KD PROTEIN IN PGPB-PYRF INTERGENIC REGION

| ORF Name | NTID | AAID | NT Length | AA Length | Score | Probability |
|---|---|---|---|---|---|---|
| 23636552_c3_1088 | 394 | 4566 | 62 | 189 | | |
| Protein name | | | | | Locus Name | Acc# |

Description
NO-HIT

| ORF Name | NTID | AAID | NT Length | AA Length | Score | Probability |
|---|---|---|---|---|---|---|
| 23649076_c1_618 | 395 | 4567 | 139 | 420 | | |
| Protein name | | | | | Locus Name | Acc# |

Description
NO-HIT

| ORF Name | NTID | AAID | NT Length | AA Length | Score | Probability |
|---|---|---|---|---|---|---|
| 23650257_f2_310 | 396 | 4568 | 347 | 1044 | 505 | 2.7e-48 |
| Protein name | | | | | Locus Name | Acc# |
| | | | | | sp:YJCR_ECOLI | P32716 |

Description
HYPOTHETICAL 36.9 KD PROTEIN IN FDHF-ALSK INTERGENIC REGION

| ORF Name | NTID | AAID | NT Length | AA Length | Score | Probability |
|---|---|---|---|---|---|---|
| 23678375_c3_1000 | 397 | 4569 | 565 | 1698 | 1629 | 2.1e-167 |
| Protein name | | | | | Locus Name | Acc# |
| | | | | | sp:OPPA_SALTY | P06202 |

Description
PERIPLASMIC OLIGOPEPTIDE-BINDING PROTEIN PRECURSOR

| ORF Name | NTID | AAID | NT Length | AA Length | Score | Probability |
|---|---|---|---|---|---|---|
| 23687762_c1_768 | 398 | 4570 | 68 | 207 | | |
| Protein name | | | | | Locus Name | Acc# |

Description
NO-HIT

| ORF Name | NTID | AAID | NT Length | AA Length | Score | Probability |
|---|---|---|---|---|---|---|
| 23712812_f3_482 | 399 | 4571 | 367 | 1104 | 1178 | 1.3e-119 |
| Protein name | | | | | Locus Name | Acc# |
| D-alanine--D-alanine ligase, A:D-alanylalanine synthetase | | | | | pir:CEEBDT | A28642;B28 |

Description

| ORF Name | NTID | AAID | NT Length | AA Length | Score | Probability |
|---|---|---|---|---|---|---|
| 23835937_c3_1037 | 400 | 4572 | 308 | 927 | 1135 | 4.7e-115 |
| Protein name | | | | | Locus Name | Acc# |
| | | | | | sp:YDHB_ECOLI | P37598 |

Description
HYPOTHETICAL TRANSCRIPTIONAL REGULATOR IN PURR-CFA INTERGENIC REGION

| ORF Name | NTID | AAID | NT Length | AA Length | Score | Probability |
|---|---|---|---|---|---|---|
| 23862938_c2_789 | 401 | 4573 | 358 | 1077 | 402 | 2.2e-37 |
| Protein name | | | | | Locus Name | Acc# |
| mannose binding protein FimH precursor | | | | | gp:AF104348 | AF104348 |

Description
Enterobacter cloacae mannose binding protein FimH precursor (fimH)gene, complete cds.

| ORF Name | NTID | AAID | NT Length | AA Length | Score | Probability |
|---|---|---|---|---|---|---|
| 23865716_f1_16 | 402 | 4574 | 60 | 183 | | |
| Protein name | | | | | Locus Name | Acc# |

Description
NO-HIT

| ORF Name | NTID | AAID | NT Length | AA Length | Score | Probability |
|---|---|---|---|---|---|---|
| 23866285_f2_356 | 403 | 4575 | 116 | 351 | 164 | 3.7e-12 |
| Protein name | | | | | Locus Name | Acc# |
| | | | | | sp:OSMY_ECOLI | P27291 |

Description
OSMOTICALLY INDUCIBLE PROTEIN Y PRECURSOR

| ORF Name | NTID | AAID | NT Length | AA Length | Score | Probability |
|---|---|---|---|---|---|---|
| 23953206_c3_1040 | 404 | 4576 | 295 | 888 | 989 | 1.4e-99 |
| Protein name | | | | | Locus Name | Acc# |
| | | | | | sp:YDHH_ECOLI | P77570 |

Description: HYPOTHETICAL 39.5 KD PROTEIN IN PDXH-SLYB INTERGENIC REGION

| ORF Name | NTID | AAID | NT Length | AA Length | Score | Probability |
|---|---|---|---|---|---|---|
| 24023432_c2_827 | 405 | 4577 | 434 | 1305 | 1866 | 1.6e-192 |
| Protein name | | | | | Locus Name | Acc# |
| tyrosine--tRNA ligase,:tyrosyl-tRNA synthetase | | | | | pir:SYECYT | A01178:C43 |

Description

| ORF Name | NTID | AAID | NT Length | AA Length | Score | Probability |
|---|---|---|---|---|---|---|
| 24100687_f2_327 | 406 | 4578 | 86 | 261 | 192 | 4.0e-15 |
| Protein name | | | | | Locus Name | Acc# |
| | | | | | sp:YNFD_ECOLI | P76172 |

Description: HYPOTHETICAL 12.1 KD PROTEIN IN SPEG-DGSA INTERGENIC REGION PRECURSOR

| ORF Name | NTID | AAID | NT Length | AA Length | Score | Probability |
|---|---|---|---|---|---|---|
| 241650_c2_781 | 407 | 4579 | 225 | 678 | 755 | 8.7e-75 |
| Protein name | | | | | Locus Name | Acc# |
| | | | | | sp:YCHE_ECOLI | P25743:P76 |

Description: HYPOTHETICAL 23.5 KD PROTEIN IN ADHE-OPPA INTERGENIC REGION

| ORF Name | NTID | AAID | NT Length | AA Length | Score | Probability |
|---|---|---|---|---|---|---|
| 24228377_f3_558 | 408 | 4580 | 350 | 1053 | 1347 | 1.6e-137 |
| Protein name | | | | | Locus Name | Acc# |
| 2-dehydro-3-deoxyphosphoheptonate aldolase, (Trp-sensitive):3-deoxy-D-arabino-heptulosonat | | | | | pir:ADECH | H64928:JQ1 |

Description

| ORF Name | NTID | AAID | NT Length | AA Length | Score | Probability |
|---|---|---|---|---|---|---|
| 24235267_f1_88 | 409 | 4581 | 188 | 567 | 126 | 1.2e-07 |
| Protein name | | | | | Locus Name | Acc# |
| CarG | | | | | gp:ECU17224 | U17224 |

Description

Erwinia carotovora CarR (carR), CarA (carA), CarB (carB), CarC(carC), CarD (carD), CarE (carE), CarF (carF), CarG (carG), CarH(carH), KduI (kduI), KdgT (kdgT), and RexZ (rexZ) genes, completecds.

| ORF Name | NTID | AAID | NT Length | AA Length | Score | Probability |
|---|---|---|---|---|---|---|
| 24245181_c2_816 | 410 | 4582 | 555 | 1668 | 2037 | 1.2e-210 |
| Protein name | | | | | Locus Name | Acc# |
| | | | | | sp:XASA_ECOLI | P39183:P76 |

Description

AMINO ACID ANTIPORTER (EXTREME ACID SENSITIVITY PROTEIN)

| ORF Name | NTID | AAID | NT Length | AA Length | Score | Probability |
|---|---|---|---|---|---|---|
| 24250267_c3_1015 | 411 | 4583 | 69 | 210 | 58 | 0.030 |
| Protein name | | | | | Locus Name | Acc# |
| | | | | | gp:PFMAL3P8 | AL034560:A |

Description

Plasmodium falciparum MAL3P8, complete sequence.

| ORF Name | NTID | AAID | NT Length | AA Length | Score | Probability |
|---|---|---|---|---|---|---|
| 24252260_c1_617 | 412 | 4584 | 70 | 213 | | |
| Protein name | | | | | Locus Name | Acc# |

Description

NO-HIT

| ORF Name | NTID | AAID | NT Length | AA Length | Score | Probability |
|---|---|---|---|---|---|---|
| 24257708_c3_1017 | 413 | 4585 | 354 | 1065 | 677 | 1.6e-66 |
| Protein name | | | | | Locus Name | Acc# |
| | | | | | sp:NUCM_ERWCH | P37994 |

Description

NUCLEASE NUCM PRECURSOR,

| ORF_Name | NTID | AAID | NT Length | AA Length | Score | Probability |
|---|---|---|---|---|---|---|
| 24257952_c1_679 | 414 | 4586 | 95 | 288 | | |
| Protein name | | | | | Locus Name | Acc# |
| | | | | | | |

Description
NO-HIT

| ORF_Name | NTID | AAID | NT Length | AA Length | Score | Probability |
|---|---|---|---|---|---|---|
| 24259381_f1_40 | 415 | 4587 | 400 | 1203 | 1196 | 1.6e-121 |
| Protein name | | | | | Locus Name | Acc# |
| | | | | | sp:RND_ECOLI | P09155 |

Description
RIBONUCLEASE D, (RNASE D)

| ORF_Name | NTID | AAID | NT Length | AA Length | Score | Probability |
|---|---|---|---|---|---|---|
| 24259702_f2_311 | 416 | 4588 | 491 | 1476 | 257 | 2.8e-19 |
| Protein name | | | | | Locus Name | Acc# |
| | | | | | sp:OPRJ_PSEAE | Q51397 |

Description
OUTER MEMBRANE PROTEIN OPRJ PRECURSOR

| ORF_Name | NTID | AAID | NT Length | AA Length | Score | Probability |
|---|---|---|---|---|---|---|
| 24266042_c1_636 | 417 | 4589 | 69 | 210 | | |
| Protein name | | | | | Locus Name | Acc# |

Description
NO-HIT

| ORF_Name | NTID | AAID | NT Length | AA Length | Score | Probability |
|---|---|---|---|---|---|---|
| 24272677_f1_8 | 418 | 4590 | 316 | 951 | 1170 | 9.1e-119 |
| Protein name | | | | | Locus Name | Acc# |
| | | | | | sp:YHCC_ECOLI | P45476 |

Description
HYPOTHETICAL 34.6 KD PROTEIN IN ARCB-GLTB INTERGENIC REGION

| ORF Name | NTID | AAID | NT Length | AA Length | Score | Probability |
|---|---|---|---|---|---|---|
| 24275260_f1_57 | 419 | 4591 | 236 | 711 | | |
| Protein name | | | | | Locus Name | Acc# |

Description

NO-HIT

| ORF Name | NTID | AAID | NT Length | AA Length | Score | Probability |
|---|---|---|---|---|---|---|
| 24299187_c2_848 | 420 | 4592 | 253 | 762 | | |
| Protein name | | | | | Locus Name | Acc# |

Description

NO-HIT

| ORF Name | NTID | AAID | NT Length | AA Length | Score | Probability |
|---|---|---|---|---|---|---|
| 24328260_f3_453 | 421 | 4593 | 535 | 1608 | 898 | 6.1e-90 |
| Protein name | | | | | Locus Name | Acc# |
| serine chemoreceptor | | | | | gp:ECTSRX | V00373:J01 |

Description

E. coli gene tsr coding for the serine chemoreceptor protein.

| ORF Name | NTID | AAID | NT Length | AA Length | Score | Probability |
|---|---|---|---|---|---|---|
| 24330027_f3_423 | 422 | 4594 | 99 | 300 | 128 | 2.4e-08 |
| Protein name | | | | | Locus Name | Acc# |
| | | | | | gp:AB024946 | AB024946 |

Description

Escherichia coli plasmid pB171 DNA, complete sequence.

| ORF Name | NTID | AAID | NT Length | AA Length | Score | Probability |
|---|---|---|---|---|---|---|
| 24339677_c2_853 | 423 | 4595 | 244 | 735 | 443 | 1.0e-41 |
| Protein name | | | | | Locus Name | Acc# |
| | | | | | sp:PGPB_ECOLI | P18201 |

Description

PHOSPHATIDYLGLYCEROPHOSPHATASE B,

| ORF Name | NTID | AAID | NT Length | AA Length | Score | Probability |
|---|---|---|---|---|---|---|
| 24392265_f3_454 | 424 | 4596 | 885 | 2658 | 1708 | 8.9e-176 |
| Protein name | | | | | Locus Name | Acc# |
| | | | | | sp:YDBH_ECOLI | P52645:P77 |

Description

HYPOTHETICAL 96.8 KD PROTEIN IN LDHA-TYNA INTERGENIC REGION

| ORF Name | NTID | AAID | NT Length | AA Length | Score | Probability |
|---|---|---|---|---|---|---|
| 24406550_c1_728 | 425 | 4597 | 156 | 471 | 276 | 3.5e-31 |
| Protein name | | | | | Locus Name | Acc# |
| | | | | | sp:ACPD_ECOLI | P41407:P77 |

Description

ACYL CARRIER PROTEIN PHOSPHODIESTERASE (ACP PHOSPHODIESTERASE)

| ORF Name | NTID | AAID | NT Length | AA Length | Score | Probability |
|---|---|---|---|---|---|---|
| 24412561_c2_814 | 426 | 4598 | 149 | 450 | 362 | 3.8e-33 |
| Protein name | | | | | Locus Name | Acc# |
| | | | | | sp:YNHA_ECOLI | P76194 |

Description

HYPOTHETICAL 15.8 KD PROTEIN IN LPP-AROD INTERGENIC REGION

| ORF Name | NTID | AAID | NT Length | AA Length | Score | Probability |
|---|---|---|---|---|---|---|
| 24415890_c2_908 | 427 | 4599 | 816 | 2451 | 3513 | 0.0 |
| Protein name | | | | | Locus Name | Acc# |
| dimethyl sulfoxide reductase subunit A | | | | | gp:AF135170 | AF135170 |

Description

Yersinia pestis ribose ABC transporter (rbsA) gene, partial cds;D-ribose binding protein (rbsB), catalase/peroxidase (katY),cytochrome c (cybC), cytochrome b (cybB), dimethyl sulfoxidereductase subunit C (dmsC), dimethyl sulfoxide reductase subunit B(dmsB), dimethyl sulfoxide reductase subunit A (dmsA), andL-ribulose-phosphate 4-epimerase (araD) genes, complete cds; andunknown genes.

| ORF Name | NTID | AAID | NT Length | AA Length | Score | Probability |
|---|---|---|---|---|---|---|
| 24415927_c2_838 | 428 | 4600 | 214 | 645 | 641 | 1.0e-62 |
| Protein name | | | | | Locus Name | Acc# |
| | | | | | sp:OMPW_ECOLI | P21364:P97 |

Description: OUTER MEMBRANE PROTEIN W PRECURSOR

| ORF Name | NTID | AAID | NT Length | AA Length | Score | Probability |
|---|---|---|---|---|---|---|
| 24417302_f1_80 | 429 | 4601 | 500 | 1503 | 715 | 1.5e-70 |
| Protein name | | | | | Locus Name | Acc# |
| | | | | | sp:YZ2R_AGRVI | P70795 |

Description: HYPOTHETICAL 52.8 KD PROTEIN IN TAR-I TTUC' 3'REGION (ORFZ2)

| ORF Name | NTID | AAID | NT Length | AA Length | Score | Probability |
|---|---|---|---|---|---|---|
| 24429828_f2_296 | 430 | 4602 | 366 | 1101 | 607 | 4.2e-59 |
| Protein name | | | | | Locus Name | Acc# |
| | | | | | gp:A69679 | A69679 |

Description: Sequence 9 from Patent WO9807872.

| ORF Name | NTID | AAID | NT Length | AA Length | Score | Probability |
|---|---|---|---|---|---|---|
| 24469562_f1_154 | 431 | 4603 | 63 | 192 | | |
| Protein name | | | | | Locus Name | Acc# |

Description: NO-HIT

| ORF Name | NTID | AAID | NT Length | AA Length | Score | Probability |
|---|---|---|---|---|---|---|
| 2447800_c1_775 | 432 | 4604 | 378 | 1137 | 1497 | 2.0e-153 |
| Protein name | | | | | Locus Name | Acc# |
| ribose-phosphate pyrophosphokinase,:phosphoribosylpyrophosphate | | | | | pir:KIEBRT | A30408:A37 |

Description

| ORF Name | NTID | AAID | NT Length | AA Length | Score | Probability |
|---|---|---|---|---|---|---|
| 24492135_c1_729 | 433 | 4605 | 139 | 420 | 127 | 4.8e-08 |„
| Protein name | | | | | Locus Name | Acc# |
| type 1 fimbrial chaperone | | | | | gp:PMATFGC | Z78535 |
| Description | | | | | | |
| P.mirabilis atf gene cluster. | | | | | | |

| ORF Name | NTID | AAID | NT Length | AA Length | Score | Probability |
|---|---|---|---|---|---|---|
| 24492936_c1_659 | 434 | 4606 | 642 | 1929 | 131 | 2.1e-05 |
| Protein name | | | | | Locus Name | Acc# |
| diacylglycerol lipase | | | | | gp:D85895 | D85895 |
| Description | | | | | | |
| Aspergillus oryzae DNA for diacylglycerol lipase, complete cds. | | | | | | |

| ORF Name | NTID | AAID | NT Length | AA Length | Score | Probability |
|---|---|---|---|---|---|---|
| 24495266_c3_1074 | 435 | 4607 | 360 | 1083 | 124 | 5.4e-05 |
| Protein name | | | | | Locus Name | Acc# |
| hypothetical protein SC66T3.10c | | | | | pir:T35367 | T35367 |
| Description | | | | | | |

| ORF Name | NTID | AAID | NT Length | AA Length | Score | Probability |
|---|---|---|---|---|---|---|
| 24495936_f3_529 | 436 | 4608 | 172 | 519 | 621 | 1.4e-60 |
| Protein name | | | | | Locus Name | Acc# |
| thioredoxin peroxidase,:scavengase:scavengase p20:thiol peroxidase p20 | | | | | pir:JC5504 | JC5504:G64 |
| Description | | | | | | |

| ORF Name | NTID | AAID | NT Length | AA Length | Score | Probability |
|---|---|---|---|---|---|---|
| 24505287_f2_237 | 437 | 4609 | 108 | 327 | 77 | 0.026 |
| Protein name | | | | | Locus Name | Acc# |
| | | | | | sp:Y18K_MSVN | P14978 |
| Description | | | | | | |
| HYPOTHETICAL 17.7 KD PROTEIN | | | | | | |

| ORF Name | NTID | AAID | NT Length | AA Length | Score | Probability |
|---|---|---|---|---|---|---|
| 24609628_c1_642 | 438 | 4610 | 262 | 789 | 789 | 2.2e-78 |
| Protein name | | | | | Locus Name | Acc# |
| phage shock protein A | | | | pir:C64879 | | C64879:S17 |

Description

| ORF Name | NTID | AAID | NT Length | AA Length | Score | Probability |
|---|---|---|---|---|---|---|
| 24616067_c3_990 | 439 | 4611 | 79 | 240 | | |
| Protein name | | | | | Locus Name | Acc# |

Description
NO-HIT

| ORF Name | NTID | AAID | NT Length | AA Length | Score | Probability |
|---|---|---|---|---|---|---|
| 24617937_f2_275 | 440 | 4612 | 164 | 495 | 93 | 0.025 |
| Protein name | | | | | Locus Name | Acc# |
| hypothetical protein C32F10.4 | | | | pir:T34023 | | T34023 |

Description

| ORF Name | NTID | AAID | NT Length | AA Length | Score | Probability |
|---|---|---|---|---|---|---|
| 24640877_c1_735 | 441 | 4613 | 258 | 777 | 929 | 3.2e-93 |
| Protein name | | | | | Locus Name | Acc# |
| | | | | | sp:YBBM_ECOLI | P77307 |

Description
HYPOTHETICAL 28.2 KD PROTEIN IN USHA-TESA INTERGENIC REGION

| ORF Name | NTID | AAID | NT Length | AA Length | Score | Probability |
|---|---|---|---|---|---|---|
| 24642130_f3_491 | 442 | 4614 | 391 | 1176 | 1416 | 7.8e-145 |
| Protein name | | | | | Locus Name | Acc# |
| | | | | | sp:XYLR_ECOLI | P37390 |

Description
XYLOSE OPERON REGULATORY PROTEIN

| ORF Name | NTID | AAID | NT Length | AA Length | Score | Probability |
|---|---|---|---|---|---|---|
| 24644757_f3_551 | 443 | 4615 | 472 | 1419 | 1988 | 1.9e-205 |
| Protein name | | | | | Locus Name | Acc# |
| | | | | | sp:KPY1_ECOLI | P14178:P78 |

Description: PYRUVATE KINASE I, (PK-1)

| ORF Name | NTID | AAID | NT Length | AA Length | Score | Probability |
|---|---|---|---|---|---|---|
| 24646892_f3_451 | 444 | 4616 | 99 | 300 | 331 | 7.4e-30 |
| Protein name | | | | | Locus Name | Acc# |
| | | | | | sp:YCGL_ECOLI | P76003 |

Description: HYPOTHETICAL 12.4 KD PROTEIN IN MINC-SHEA INTERGENIC REGION

| ORF Name | NTID | AAID | NT Length | AA Length | Score | Probability |
|---|---|---|---|---|---|---|
| 24647752_c1_683 | 445 | 4617 | 493 | 1482 | 1706 | 1.5e-175 |
| Protein name | | | | | Locus Name | Acc# |
| | | | | | sp:YB07_HAEIN | Q57007:P96 |

Description: HYPOTHETICAL NA+/H+ ANTIPORTER HI1107

| ORF Name | NTID | AAID | NT Length | AA Length | Score | Probability |
|---|---|---|---|---|---|---|
| 24648382_c3_1046 | 446 | 4618 | 350 | 1053 | 1178 | 1.3e-119 |
| Protein name | | | | | Locus Name | Acc# |
| | | | | | sp:YCJF_ECOLI | P45525:P77 |

Description: HYPOTHETICAL 39.4 KD PROTEIN IN PSPE-TYRR INTERGENIC REGION

| ORF Name | NTID | AAID | NT Length | AA Length | Score | Probability |
|---|---|---|---|---|---|---|
| 24728568_c1_673 | 447 | 4619 | 333 | 1002 | 1072 | 2.2e-108 |
| Protein name | | | | | Locus Name | Acc# |
| | | | | | sp:YFEH_ECOLI | P39836:P76 |

Description: HYPOTHETICAL 36.4 KD PROTEIN IN XAPB-LIG INTERGENIC REGION

| ORF Name | NTID | AAID | NT Length | AA Length | Score | Probability |
|---|---|---|---|---|---|---|
| 24797193_f3_447 | 448 | 4620 | 446 | 1341 | 1371 | 4.6e-140 |
| Protein name | | | | | Locus Name | Acc# |
| | | | | | sp:YEBA_ECOLI | P24204:P76 |

Description: HYPOTHETICAL 46.7 KD PROTEIN IN MSBB-RUVB INTERGENIC REGION (ORFU)

| ORF Name | NTID | AAID | NT Length | AA Length | Score | Probability |
|---|---|---|---|---|---|---|
| 24798567_f1_47 | 449 | 4621 | 67 | 204 | | |
| Protein name | | | | | Locus Name | Acc# |

Description: NO-HIT

| ORF Name | NTID | AAID | NT Length | AA Length | Score | Probability |
|---|---|---|---|---|---|---|
| 24804675_f2_251 | 450 | 4622 | 294 | 885 | 197 | 4.7e-14 |
| Protein name | | | | | Locus Name | Acc# |
| | | | | | sp:YC39_ODOSI | P49534 |

Description: HYPOTHETICAL 36.3 KD PROTEIN YCF39 (ORF319)

| ORF Name | NTID | AAID | NT Length | AA Length | Score | Probability |
|---|---|---|---|---|---|---|
| 24814425_f3_460 | 451 | 4623 | 803 | 2412 | 1467 | 3.1e-150 |
| Protein name | | | | | Locus Name | Acc# |
| dimethylsulfoxide reductase, chain A2 precursor, anaerobic | | | | | pir:F64914 | F64914 |

Description:

| ORF Name | NTID | AAID | NT Length | AA Length | Score | Probability |
|---|---|---|---|---|---|---|
| 24865880_f3_465 | 452 | 4624 | 104 | 315 | | |
| Protein name | | | | | Locus Name | Acc# |

Description: NO-HIT

| ORF Name | NTID | AAID | NT Length | AA Length | Score | Probability |
|---|---|---|---|---|---|---|
| 24880055_c2_940 | 453 | 4625 | 470 | 1413 | 1687 | 1.5e-173 |
| Protein name | | | | | Locus Name | Acc# |
| | | | | | sp:ARCD_ECOLI | P77429 |

Description
PUTATIVE ARGININE/ORNITHINE ANTIPORTER

| ORF Name | NTID | AAID | NT Length | AA Length | Score | Probability |
|---|---|---|---|---|---|---|
| 24897075_f2_263 | 454 | 4626 | 66 | 201 | | |
| Protein name | | | | | Locus Name | Acc# |

Description
NO-HIT

| ORF Name | NTID | AAID | NT Length | AA Length | Score | Probability |
|---|---|---|---|---|---|---|
| 2509427_f3_486 | 455 | 4627 | 623 | 1872 | 385 | 1.1e-39 |
| Protein name | | | | | Locus Name | Acc# |
| | | | | | sp:YJCQ_ECOLI | P32715 |

Description
HYPOTHETICAL 76.1 KD PROTEIN IN FDHF-ALSK INTERGENIC REGION

| ORF Name | NTID | AAID | NT Length | AA Length | Score | Probability |
|---|---|---|---|---|---|---|
| 2521061_f1_83 | 456 | 4628 | 209 | 630 | 522 | 4.3e-50 |
| Protein name | | | | | Locus Name | Acc# |
| conserved hypothetical protein | | | | | pir:C75279 | C75279 |

Description

| ORF Name | NTID | AAID | NT Length | AA Length | Score | Probability |
|---|---|---|---|---|---|---|
| 25392013_f3_457 | 457 | 4629 | 63 | 192 | | |
| Protein name | | | | | Locus Name | Acc# |

Description
NO-HIT

| ORF Name | NTID | AAID | NT Length | AA Length | Score | Probability |
|---|---|---|---|---|---|---|
| 25421917_f3_478 | 458 | 4630 | 218 | 657 | 136 | 8.4e-08 |
| Protein name | | | | | Locus Name | Acc# |
| hypothetical protein b1199 | | | | | pir:D64866 | D64866 |

Description

| ORF Name | NTID | AAID | NT Length | AA Length | Score | Probability |
|---|---|---|---|---|---|---|
| 25421962_f2_294 | 459 | 4631 | 304 | 915 | 671 | 6.9e-66 |
| Protein name | | | | | Locus Name | Acc# |
| | | | | | gp:ECOADAA | M10315 |

Description

E.coli (strain B) ada gene coding for Ada polyprotein, regulatoryprotein of adaptive response.

| ORF Name | NTID | AAID | NT Length | AA Length | Score | Probability |
|---|---|---|---|---|---|---|
| 25431661_f2_332 | 460 | 4632 | 334 | 1005 | 1270 | 2.3e-129 |
| Protein name | | | | | Locus Name | Acc# |
| | | | | | sp:ADD_ECOLI | P22333:P78 |

Description

ADENOSINE DEAMINASE, (ADENOSINE AMINOHYDROLASE)

| ORF Name | NTID | AAID | NT Length | AA Length | Score | Probability |
|---|---|---|---|---|---|---|
| 25436_f1_101 | 461 | 4633 | 111 | 336 | 235 | 1.1e-19 |
| Protein name | | | | | Locus Name | Acc# |
| | | | | | gp:AP000342 | AP000342 |

Description

Plasmid R100 genomic DNA.

| ORF Name | NTID | AAID | NT Length | AA Length | Score | Probability |
|---|---|---|---|---|---|---|
| 25505456_f2_231 | 462 | 4634 | 124 | 375 | | |
| Protein name | | | | | Locus Name | Acc# |

Description

NO-HIT

| ORF Name | NTID | AAID | NT Length | AA Length | Score | Probability |
|---|---|---|---|---|---|---|
| 255127_c3_1163 | 463 | 4635 | 144 | 435 | 487 | 2.2e-46 |
| Protein name | | | | | Locus Name | Acc# |
| probable membrane protein yecN | | | | | pir:E64949 | E64949 |

Description

HYPOTHETICAL 11.4 KD PROTEIN IN PYRF-OSMB INTERGENIC REGION (shown below second entry)

| ORF Name | NTID | AAID | NT Length | AA Length | Score | Probability |
|---|---|---|---|---|---|---|
| 2554205_c3_1062 | 464 | 4636 | 134 | 405 | 454 | 6.8e-43 |
| Protein name | | | | | Locus Name | Acc# |
| | | | | | sp:YCIH_ECOLI | P08245:P76 |

Description

HYPOTHETICAL 11.4 KD PROTEIN IN PYRF-OSMB INTERGENIC REGION

| ORF Name | NTID | AAID | NT Length | AA Length | Score | Probability |
|---|---|---|---|---|---|---|
| 25579637_f1_10 | 465 | 4637 | 817 | 2454 | 168 | 2.2e-08 |
| Protein name | | | | | Locus Name | Acc# |
| ORF MSV156 hypothetical protein | | | | | gp:AF063866 | AF063866 |

Description

Melanoplus sanguinipes entomopoxvirus, complete genome.

| ORF Name | NTID | AAID | NT Length | AA Length | Score | Probability |
|---|---|---|---|---|---|---|
| 25579702_c1_776 | 466 | 4638 | 89 | 270 | | |
| Protein name | | | | | Locus Name | Acc# |

Description

NO-HIT

| ORF Name | NTID | AAID | NT Length | AA Length | Score | Probability |
|---|---|---|---|---|---|---|
| 25581266_c1_748 | 467 | 4639 | 251 | 756 | 936 | 5.7e-94 |
| Protein name | | | | | Locus Name | Acc# |
| | | | | | sp:ZNUC_ECOLI | P52648:P76 |

Description

HIGH-AFFINITY ZINC UPTAKE SYSTEM ATP-BINDING PROTEIN ZNUC

| ORF Name | NTID | AAID | NT Length | AA Length | Score | Probability |
|---|---|---|---|---|---|---|
| 25582805_c2_799 | 468 | 4640 | 279 | 840 | 955 | 5.6e-96 |
| Protein name | | | | | Locus Name | Acc# |
| | | | | | sp:PHOH_ECOLI | P31544 |

Description

PHOH PROTEIN (PHOSPHATE STARVATION-INDUCIBLE PROTEIN PSIH)

| ORF Name | NTID | AAID | NT Length | AA Length | Score | Probability |
|---|---|---|---|---|---|---|
| 25657843_f2_236 | 469 | 4641 | 355 | 1068 | | |
| Protein name | | | | | Locus Name | Acc# |

Description

NO-HIT

| ORF Name | NTID | AAID | NT Length | AA Length | Score | Probability |
|---|---|---|---|---|---|---|
| 25659827_c2_856 | 470 | 4642 | 266 | 801 | 878 | 8.0e-88 |
| Protein name | | | | | Locus Name | Acc# |
| | | | | | sp:DCOP_ECOLI | P08244 |

Description

DECARBOXYLASE)

| ORF Name | NTID | AAID | NT Length | AA Length | Score | Probability |
|---|---|---|---|---|---|---|
| 25664692_f1_115 | 471 | 4643 | 367 | 1104 | 1178 | 1.3e-119 |
| Protein name | | | | | Locus Name | Acc# |
| | | | | | sp:YDGO_ECOLI | P76182 |

Description

HYPOTHETICAL 38.1 KD PROTEIN IN ADD-NTH INTERGENIC REGION

| ORF Name | NTID | AAID | NT Length | AA Length | Score | Probability |
|---|---|---|---|---|---|---|
| 25671965_f1_114 | 472 | 4644 | 214 | 645 | 799 | 1.9e-79 |
| Protein name | | | | | Locus Name | Acc# |
| | | | | | sp:YDGM_ECOLI | P77223 |

Description

PUTATIVE FERREDOXIN-LIKE PROTEIN IN ADD-NTH INTERGENIC REGION

| ORF Name | NTID | AAID | NT Length | AA Length | Score | Probability |
|---|---|---|---|---|---|---|
| 25673292_c2_898 | 473 | 4645 | 332 | 999 | 1205 | 1.8e-122 |
| Protein name | | | | | Locus Name | Acc# |
| probable serine-threonine dehydratase | | | | pir:T41325 | | T41325 |

Description

| ORF Name | NTID | AAID | NT Length | AA Length | Score | Probability |
|---|---|---|---|---|---|---|
| 25680250_f2_280 | 474 | 4646 | 532 | 1599 | 2030 | 6.7e-210 |
| Protein name | | | | | Locus Name | Acc# |
| | | | | | sp:YHIH_ECOLI | P37624:P37 |

Description
HYPOTHETICAL ABC TRANSPORTER ATP-BINDING PROTEIN YHIH

| ORF Name | NTID | AAID | NT Length | AA Length | Score | Probability |
|---|---|---|---|---|---|---|
| 25782005_c3_1028 | 475 | 4647 | 130 | 393 | 402 | 2.2e-37 |
| Protein name | | | | | Locus Name | Acc# |
| | | | | | sp:YDIC_ECOLI | P77667 |

Description
HYPOTHETICAL 13.3 KD PROTEIN IN LPP-AROD INTERGENIC REGION

| ORF Name | NTID | AAID | NT Length | AA Length | Score | Probability |
|---|---|---|---|---|---|---|
| 25948290_f2_326 | 476 | 4648 | 93 | 282 | 234 | 1.4e-19 |
| Protein name | | | | | Locus Name | Acc# |
| | | | | | sp:OSMB_ECOLI | P17873 |

Description
OSMOTICALLY INDUCIBLE LIPOPROTEIN B PRECURSOR

| ORF Name | NTID | AAID | NT Length | AA Length | Score | Probability |
|---|---|---|---|---|---|---|
| 2600000_f1_32 | 477 | 4649 | 338 | 1017 | 1110 | 2.1e-112 |
| Protein name | | | | | Locus Name | Acc# |
| lipid A acyltransferase | | | | gp:AF039020 | | AF039020 |

Description
Salmonella typhimurium lipid A acyltransferase (msbB) gene, complete cds.

| ORF_Name | NTID | AAID | NT Length | AA Length | Score | Probability |
|---|---|---|---|---|---|---|
| 26016893_c1_615 | 478 | 4650 | 158 | 477 | 313 | 6.0e-28 |
| Protein name | | | | | Locus Name | Acc# |
| | | | | | sp:UP12_ECOLI | P39177:P77 |

Description: UNKNOWN PROTEIN FROM 2D-PAGE (SPOTS PR25/LM16/2D_000LR3)

| ORF_Name | NTID | AAID | NT Length | AA Length | Score | Probability |
|---|---|---|---|---|---|---|
| 26037768_c1_654 | 479 | 4651 | 320 | 963 | | |
| Protein name | | | | | Locus Name | Acc# |

Description: NO-HIT

| ORF_Name | NTID | AAID | NT Length | AA Length | Score | Probability |
|---|---|---|---|---|---|---|
| 26064006_c2_923 | 480 | 4652 | 71 | 216 | 124 | 2.7e-07 |
| Protein name | | | | | Locus Name | Acc# |
| | | | | | sp:PENA_BURCE | Q02940 |

Description: BETA-LACTAMASE PRECURSOR, (PENICILLINASE)

| ORF_Name | NTID | AAID | NT Length | AA Length | Score | Probability |
|---|---|---|---|---|---|---|
| 26071076_f3_488 | 481 | 4653 | 454 | 1365 | 1294 | 6.6e-132 |
| Protein name | | | | | Locus Name | Acc# |
| | | | | | sp:YEGD_ECOLI | P36928:P76 |

Description: HYPOTHETICAL 49.4 KD PROTEIN IN ALKA-BAES INTERGENIC REGION

| ORF_Name | NTID | AAID | NT Length | AA Length | Score | Probability |
|---|---|---|---|---|---|---|
| 26203376_f1_14 | 482 | 4654 | 224 | 675 | 698 | 9.5e-69 |
| Protein name | | | | | Locus Name | Acc# |
| | | | | | sp:RIMJ_ECOLI | P09454 |

Description: (ACETYLATING ENZYME FOR N-TERMINAL OF RIBOSOMAL PROTEIN S5)

| ORF Name | NTID | AAID | NT Length | AA Length | Score | Probability |
|---|---|---|---|---|---|---|
| 26257751_f2_331 | 483 | 4655 | 73 | 222 | | |
| Protein name | | | | | Locus Name | Acc# |

Description
NO-HIT

| ORF Name | NTID | AAID | NT Length | AA Length | Score | Probability |
|---|---|---|---|---|---|---|
| 26282591_c1_710 | 484 | 4656 | 62 | 189 | | |
| Protein name | | | | | Locus Name | Acc# |

Description
NO-HIT

| ORF Name | NTID | AAID | NT Length | AA Length | Score | Probability |
|---|---|---|---|---|---|---|
| 26290907_c2_878 | 485 | 4657 | 95 | 288 | 221 | 3.3e-18 |
| Protein name | | | | | Locus Name | Acc# |
| | | | | | gp:AB025342 | AB025342 |

Description
Moritella marina genes, complete cds, similar to eicosapentaenoicacid synthesis gene cluster.

| ORF Name | NTID | AAID | NT Length | AA Length | Score | Probability |
|---|---|---|---|---|---|---|
| 26290937_c1_637 | 486 | 4658 | 218 | 657 | 868 | 9.2e-87 |
| Protein name | | | | | Locus Name | Acc# |
| pyridoxamine-phosphate oxidase, pdxH | | | | | pir:B43261 | B43261:H64 |

Description

| ORF Name | NTID | AAID | NT Length | AA Length | Score | Probability |
|---|---|---|---|---|---|---|
| 26347160_c3_1169 | 487 | 4659 | 62 | 189 | | |
| Protein name | | | | | Locus Name | Acc# |

Description
NO-HIT

| ORF Name | NTID | AAID | NT Length | AA Length | Score | Probability |
|---|---|---|---|---|---|---|
| 26353430_c2_823 | 488 | 4660 | 80 | 243 | 219 | 5.5e-18 |
| Protein name | | | | | Locus Name | Acc# |
| | | | | | sp:YDHL_ECOLI | P76188 |

Description
HYPOTHETICAL 14.4 KD PROTEIN IN SODC-NEMA INTERGENIC REGION PRECURSOR

| ORF Name | NTID | AAID | NT Length | AA Length | Score | Probability |
|---|---|---|---|---|---|---|
| 26353431_f1_151 | 489 | 4661 | 335 | 1008 | 1176 | 2.1e-119 |
| Protein name | | | | | Locus Name | Acc# |
| | | | | | sp:PSPF_ECOLI | P37344:P76 |

Description
PSP OPERON TRANSCRIPTIONAL ACTIVATOR

| ORF Name | NTID | AAID | NT Length | AA Length | Score | Probability |
|---|---|---|---|---|---|---|
| 26369053_f2_242 | 490 | 4662 | 97 | 294 | 75 | 0.0099 |
| Protein name | | | | | Locus Name | Acc# |
| ribonuclease inhibitor homolog yrdF | | | | | pir:C69973 | C69973 |

Description

| ORF Name | NTID | AAID | NT Length | AA Length | Score | Probability |
|---|---|---|---|---|---|---|
| 26429061_f3_540 | 491 | 4663 | 141 | 426 | 578 | 4.9e-56 |
| Protein name | | | | | Locus Name | Acc# |
| | | | | | sp:LGUL_ECOLI | Q59384:P77 |

Description
(S-D-LACTOYLGLUTATHIONE METHYLGLYOXAL LYASE)

| ORF Name | NTID | AAID | NT Length | AA Length | Score | Probability |
|---|---|---|---|---|---|---|
| 26432816_f1_207 | 492 | 4664 | 533 | 1602 | 418 | 4.5e-39 |
| Protein name | | | | | Locus Name | Acc# |
| | | | | | sp:YDDS_ECOLI | P76128:P77 |

Description
PUTATIVE BINDING PROTEIN YDDS PRECURSOR

| ORF Name | NTID | AAID | NT Length | AA Length | Score | Probability |
|---|---|---|---|---|---|---|
| 26442202_c2_794 | 493 | 4665 | 296 | 891 | 374 | 2.1e-34 |
| Protein name | | | | | Locus Name | Acc# |
| | | | | | sp:YJEF_ECOLI | P31806 |
| Description | | | | | | |
| HYPOTHETICAL 54.7 KD PROTEIN IN PSD-AMIB INTERGENIC REGION (URF1) | | | | | | |

| ORF Name | NTID | AAID | NT Length | AA Length | Score | Probability |
|---|---|---|---|---|---|---|
| 26454676_c3_1166 | 494 | 4666 | 535 | 1608 | 413 | 1.5e-38 |
| Protein name | | | | | Locus Name | Acc# |
| probable lipoprotein | | | | | pir:F70905 | F70905 |
| Description | | | | | | |

| ORF Name | NTID | AAID | NT Length | AA Length | Score | Probability |
|---|---|---|---|---|---|---|
| 26460910_c1_743 | 495 | 4667 | 120 | 363 | 423 | 1.3e-39 |
| Protein name | | | | | Locus Name | Acc# |
| hypothetical protein b1809 | | | | | pir:A64942 | A64942 |
| Description | | | | | | |

| ORF Name | NTID | AAID | NT Length | AA Length | Score | Probability |
|---|---|---|---|---|---|---|
| 26464010_f2_244 | 496 | 4668 | 110 | 333 | 81 | 0.010 |
| Protein name | | | | | Locus Name | Acc# |
| probable membrane protein YLR414c:hypothetical protein L9931.8 | | | | | pir:S59380 | S59380 |
| Description | | | | | | |

| ORF Name | NTID | AAID | NT Length | AA Length | Score | Probability |
|---|---|---|---|---|---|---|
| 26751500_c2_918 | 497 | 4669 | 336 | 1011 | 231 | 2.9e-19 |
| Protein name | | | | | Locus Name | Acc# |
| site-specific recombinase | | | | | gp:AF033498 | AF033498 |
| Description | | | | | | |
| Proteus mirabilis site-specific recombinase (xerC) gene, completecds. | | | | | | |

| ORF Name | NTID | AAID | NT Length | AA Length | Score | Probability |
|---|---|---|---|---|---|---|
| 26751500_f3_553 | 498 | 4670 | 357 | 1074 | 271 | 1.7e-23 |
| Protein name | | | | | Locus Name | Acc# |
| | | | | | sp:YXEI_BACSU | P54948 |

Description
HYPOTHETICAL 37.2 KD PROTEIN IN IDH-DEOR INTERGENIC REGION

| ORF Name | NTID | AAID | NT Length | AA Length | Score | Probability |
|---|---|---|---|---|---|---|
| 26834717_f3_459 | 499 | 4671 | 468 | 1407 | 2068 | 6.3e-214 |
| Protein name | | | | | Locus Name | Acc# |
| | | | | | sp:PNTB_ECOLI | P07002:P76 |

Description
TRANSHYDROGENASE SUBUNIT BETA)

| ORF Name | NTID | AAID | NT Length | AA Length | Score | Probability |
|---|---|---|---|---|---|---|
| 26839687_f1_52 | 500 | 4672 | 296 | 891 | 202 | 2.7e-15 |
| Protein name | | | | | Locus Name | Acc# |
| dimethyl sulfoxide reductase subunit C | | | | | gp:AF135170 | AF135170 |

Description
Yersinia pestis ribose ABC transporter (rbsA) gene, partial cds;D-ribose binding protein (rbsB), catalase/peroxidase (katY),cytochrome c (cybC), cytochrome b (cybB), dimethyl sulfoxidereductase subunit C (dmsC), dimethyl sulfoxide reductase subunit B(dmsB), dimethyl sulfoxide reductase subunit A (dmsA), andL-ribulose-phosphate 4-epimerase (araD) genes, complete cds;

| ORF Name | NTID | AAID | NT Length | AA Length | Score | Probability |
|---|---|---|---|---|---|---|
| 2735887_f3_572 | 501 | 4673 | 393 | 1182 | 380 | 4.7e-35 |
| Protein name | | | | | Locus Name | Acc# |
| | | | | | sp:HIS8_BACSU | P17731:O32 |

Description
PHOSPHATE TRANSAMINASE)

| ORF Name | NTID | AAID | NT Length | AA Length | Score | Probability |
|---|---|---|---|---|---|---|
| 2756562_f3_560 | 502 | 4674 | 385 | 1158 | 1130 | 1.6e-114 |
| Protein name | | | | | Locus Name | Acc# |
| | | | | | sp:HMUS_YERPE | Q56990 |

Description
HEMIN TRANSPORT PROTEIN HMUS

| ORF Name | NTID | AAID | NT Length | AA Length | Score | Probability |
|---|---|---|---|---|---|---|
| 2822177_c1_658 | 503 | 4675 | 262 | 789 | | |
| Protein name | | | | | Locus Name | Acc# |

Description
NO-HIT

| ORF Name | NTID | AAID | NT Length | AA Length | Score | Probability |
|---|---|---|---|---|---|---|
| 2844163_f1_135 | 504 | 4676 | 268 | 807 | 792 | 1.0e-78 |
| Protein name | | | | | Locus Name | Acc# |
| | | | | | sp:YCIK_ECOLI | P31808:P77 |

Description
(EC 1.-.-.-)

| ORF Name | NTID | AAID | NT Length | AA Length | Score | Probability |
|---|---|---|---|---|---|---|
| 2855302_c1_702 | 505 | 4677 | 690 | 2073 | 2556 | 1.2e-265 |
| Protein name | | | | | Locus Name | Acc# |
| | | | | | gp:ECOKDPABC | K02670 |

Description
Escherichia coli kdpABC operon coding for Kdp-ATPase proteinsKdpA,-B,-C.

| ORF Name | NTID | AAID | NT Length | AA Length | Score | Probability |
|---|---|---|---|---|---|---|
| 2869052_c3_1171 | 506 | 4678 | 401 | 1206 | 1562 | 2.6e-160 |
| Protein name | | | | | Locus Name | Acc# |
| probable permease b1065 | | | | | pir:F64849 | F64849 |

Description

| ORF_Name | NTID | AAID | NT Length | AA Length | Score | Probability |
|---|---|---|---|---|---|---|
| 292177_c1_677 | 507 | 4679 | 179 | 540 | 126 | 6.6e-08 |
| Protein name | | | | | Locus Name | Acc# |
| | | | | | sp:AAC2_PROST | Q52424 |

Description
AMINOGLYCOSIDE 2'-N-ACETYLTRANSFERASE, (AAC(2')-IA)

| ORF_Name | NTID | AAID | NT Length | AA Length | Score | Probability |
|---|---|---|---|---|---|---|
| 2923387_f2_306 | 508 | 4680 | 480 | 1443 | 715 | 1.5e-70 |
| Protein name | | | | | Locus Name | Acc# |
| N-ethylammeline chlorohydrolase | | | | | pir:G70352 | G70352 |

Description

| ORF_Name | NTID | AAID | NT Length | AA Length | Score | Probability |
|---|---|---|---|---|---|---|
| 2923437_f2_274 | 509 | 4681 | 239 | 720 | 116 | 0.00011 |
| Protein name | | | | | Locus Name | Acc# |
| hypothetical protein ytmA | | | | | pir:A69996 | A69996 |

Description

| ORF_Name | NTID | AAID | NT Length | AA Length | Score | Probability |
|---|---|---|---|---|---|---|
| 29351017_f1_33 | 510 | 4682 | 134 | 405 | 131 | 1.2e-08 |
| Protein name | | | | | Locus Name | Acc# |
| hypothetical protein PH0571 | | | | | pir:G71171 | G71171 |

Description

| ORF_Name | NTID | AAID | NT Length | AA Length | Score | Probability |
|---|---|---|---|---|---|---|
| 29427066_f1_3 | 511 | 4683 | 99 | 300 | 253 | 1.4e-21 |
| Protein name | | | | | Locus Name | Acc# |
| | | | | | sp:YCHH_ECOLI | P31807 |

Description
HYPOTHETICAL 10.5 KD PROTEIN IN PTH-PRS INTERGENIC REGION (ORF-2)

| ORF Name | NTID | AAID | NT Length | AA Length | Score | Probability |
|---|---|---|---|---|---|---|
| 29487767_c2_871 | 512 | 4684 | 317 | 954 | 785 | 5.7e-78 |
| Protein name | | | | | Locus Name | Acc# |
| | | | | | sp:YNFL_ECOLI | P77559 |

Description
HYPOTHETICAL TRANSCRIPTIONAL REGULATOR IN MLC-ASR INTERGENIC REGION

| ORF Name | NTID | AAID | NT Length | AA Length | Score | Probability |
|---|---|---|---|---|---|---|
| 29492161_c2_812 | 513 | 4685 | 443 | 1332 | 1086 | 7.3e-110 |
| Protein name | | | | | Locus Name | Acc# |
| | | | | | sp:YNHC_ECOLI | P77689 |

Description
HYPOTHETICAL 46.8 KD PROTEIN IN LPP-AROD INTERGENIC REGION

| ORF Name | NTID | AAID | NT Length | AA Length | Score | Probability |
|---|---|---|---|---|---|---|
| 29494062_f1_184 | 514 | 4686 | 128 | 387 | 299 | 1.8e-26 |
| Protein name | | | | | Locus Name | Acc# |
| | | | | | sp:YHAH_ECOLI | P42621 |

Description
HYPOTHETICAL 14.3 KD PROTEIN IN EXUR-TDCC INTERGENIC REGION

| ORF Name | NTID | AAID | NT Length | AA Length | Score | Probability |
|---|---|---|---|---|---|---|
| 29500303_c3_1141 | 515 | 4687 | 62 | 189 | | |
| Protein name | | | | | Locus Name | Acc# |

Description
NO-HIT

| ORF Name | NTID | AAID | NT Length | AA Length | Score | Probability |
|---|---|---|---|---|---|---|
| 30078188_c1_678 | 516 | 4688 | 61 | 186 | | |
| Protein name | | | | | Locus Name | Acc# |

Description
NO-HIT

| ORF Name | NTID | AAID | NT Length | AA Length | Score | Probability |
|---|---|---|---|---|---|---|
| 30079416_f2_241 | 517 | 4689 | 305 | 918 | 280 | 1.7e-23 |
| Protein name | | | | | Locus Name | Acc# |
| | | | | | gp:ECORHSEX | L19083 |

Description

Escherichia coli RhsE genetic element; defective RhsE core protein, complete cds; complete ORF-E2; H-rpt subelement; complete ORF-H.

| ORF Name | NTID | AAID | NT Length | AA Length | Score | Probability |
|---|---|---|---|---|---|---|
| 30082635_c3_1035 | 518 | 4690 | 242 | 729 | 790 | 1.7e-78 |
| Protein name | | | | | Locus Name | Acc# |
| | | | | | sp:RISA_ECOLI | P29015 |

Description

RIBOFLAVIN SYNTHASE ALPHA CHAIN,

| ORF Name | NTID | AAID | NT Length | AA Length | Score | Probability |
|---|---|---|---|---|---|---|
| 30110751_c2_846 | 519 | 4691 | 98 | 297 | | |
| Protein name | | | | | Locus Name | Acc# |

Description

NO-HIT

| ORF Name | NTID | AAID | NT Length | AA Length | Score | Probability |
|---|---|---|---|---|---|---|
| 30662812_f1_15 | 520 | 4692 | 99 | 300 | | |
| Protein name | | | | | Locus Name | Acc# |

Description

NO-HIT

| ORF Name | NTID | AAID | NT Length | AA Length | Score | Probability |
|---|---|---|---|---|---|---|
| 30673191_f3_485 | 521 | 4693 | 174 | 525 | 558 | 6.5e-54 |
| Protein name | | | | | Locus Name | Acc# |
| | | | | | sp:YAII_ECOLI | P52088:P75 |

Description

HYPOTHETICAL 17.0 KD PROTEIN IN PROC-AROL INTERGENIC REGION

| ORF Name | NTID | AAID | NT Length | AA Length | Score | Probability |
|---|---|---|---|---|---|---|
| 30736012_f2_309 | 522 | 4694 | 99 | 300 | | |
| Protein name | | | | | Locus Name | Acc# |

Description
NO-HIT

| ORF Name | NTID | AAID | NT Length | AA Length | Score | Probability |
|---|---|---|---|---|---|---|
| 30741537_f3_535 | 523 | 4695 | 302 | 909 | 1050 | 4.8e-106 |
| Protein name | | | | | Locus Name | Acc# |
| | | | | | sp:SAPC_ECOLI | Q47624 |

Description
PEPTIDE TRANSPORT SYSTEM PERMEASE PROTEIN SAPC

| ORF Name | NTID | AAID | NT Length | AA Length | Score | Probability |
|---|---|---|---|---|---|---|
| 31370910_c2_798 | 524 | 4696 | 188 | 567 | 445 | 6.1e-42 |
| Protein name | | | | | Locus Name | Acc# |
| | | | | | sp:YJJP_HAEIN | P44520 |

Description
HYPOTHETICAL PROTEIN HI0108

| ORF Name | NTID | AAID | NT Length | AA Length | Score | Probability |
|---|---|---|---|---|---|---|
| 31407515_f1_153 | 525 | 4697 | 275 | 828 | 1181 | 6.2e-120 |
| Protein name | | | | | Locus Name | Acc# |
| reductase (NADH),:enoyl-ACP reductase:short-chain alcohol dehydrogenase | | | | | pir:S48029 | S48029:A47 |

Description

| ORF Name | NTID | AAID | NT Length | AA Length | Score | Probability |
|---|---|---|---|---|---|---|
| 31408427_c1_644 | 526 | 4698 | 475 | 1428 | 1720 | 4.8e-177 |
| Protein name | | | | | Locus Name | Acc# |
| | | | | | sp:YCJX_ECOLI | P76046:P77 |

Description
HYPOTHETICAL 52.6 KD PROTEIN IN OMPG-TYRR INTERGENIC REGION

| ORF Name | NTID | AAID | NT Length | AA Length | Score | Probability |
|---|---|---|---|---|---|---|
| 31523267_c3_999 | 527 | 4699 | 484 | 1455 | 1440 | 2.2e-147 |
| Protein name | | | | | Locus Name | Acc# |
| | | | | | sp:CYSG_SALTY | P25924 |

Description

| ORF Name | NTID | AAID | NT Length | AA Length | Score | Probability |
|---|---|---|---|---|---|---|
| 3158313_f1_110 | 528 | 4700 | 571 | 1716 | 477 | 2.5e-45 |
| Protein name | | | | | Locus Name | Acc# |
| | | | | | sp:YDGA_ECOLI | P77804;Q47 |

Description

HYPOTHETICAL 54.7 KD PROTEIN IM MANA-GUSC INTERGENIC REGION

| ORF Name | NTID | AAID | NT Length | AA Length | Score | Probability |
|---|---|---|---|---|---|---|
| 3162812_f2_323 | 529 | 4701 | 199 | 600 | | |
| Protein name | | | | | Locus Name | Acc# |

Description

NO-HIT

| ORF Name | NTID | AAID | NT Length | AA Length | Score | Probability |
|---|---|---|---|---|---|---|
| 31719757_c1_599 | 530 | 4702 | 212 | 639 | 697 | 1.2e-68 |
| Protein name | | | | | Locus Name | Acc# |
| thymidine kinase | | | | | gp:AB008676 | AB008676 |

Description

Escherichia coli 0157 DNA, map position at 46 min., complete cds.

| ORF Name | NTID | AAID | NT Length | AA Length | Score | Probability |
|---|---|---|---|---|---|---|
| 31907290_f2_354 | 531 | 4703 | 466 | 1401 | 1362 | 4.1e-139 |
| Protein name | | | | | Locus Name | Acc# |
| | | | | | sp:TRPC_SALTY | P00910 |

Description

| ORF Name | NTID | AAID | NT Length | AA Length | Score | Probability |
|---|---|---|---|---|---|---|
| 3213433_c1_763 | 532 | 4704 | 268 | 807 | 1031 | 4.9e-104 |
| Protein name | | | | | Locus Name | Acc# |
| | | | | | sp:YECO_ECOLI | P76290:007 |

Description
HYPOTHETICAL 27.8 KD PROTEIN IN ASPS-BISZ INTERGENIC REGION

| ORF Name | NTID | AAID | NT Length | AA Length | Score | Probability |
|---|---|---|---|---|---|---|
| 32219413_c3_1031 | 533 | 4705 | 139 | 420 | 248 | 4.6e-21 |
| Protein name | | | | | Locus Name | Acc# |
| hypothetical protein PH0571 | | | | | pir:G71171 | G71171 |

Description

| ORF Name | NTID | AAID | NT Length | AA Length | Score | Probability |
|---|---|---|---|---|---|---|
| 32230326_f1_79 | 534 | 4706 | 154 | 465 | 78 | 0.0068 |
| Protein name | | | | | Locus Name | Acc# |
| hypothetical protein AF0585 | | | | | pir:A69323 | A69323 |

Description

| ORF Name | NTID | AAID | NT Length | AA Length | Score | Probability |
|---|---|---|---|---|---|---|
| 3225686_c2_939 | 535 | 4707 | 67 | 204 | | |
| Protein name | | | | | Locus Name | Acc# |

Description
NO-HIT

| ORF Name | NTID | AAID | NT Length | AA Length | Score | Probability |
|---|---|---|---|---|---|---|
| 32308202_f3_537 | 536 | 4708 | 274 | 825 | 1007 | 1.7e-101 |
| Protein name | | | | | Locus Name | Acc# |
| | | | | | sp:SAPF_SALTY | P36638 |

Description
PEPTIDE TRANSPORT SYSTEM ATP-BINDING PROTEIN SAPF

| ORF Name | NTID | AAID | NT Length | AA Length | Score | Probability |
|---|---|---|---|---|---|---|
| 32617631_c1_635 | 537 | 4709 | 74 | 225 | | |
| Protein name | | | | | Locus Name | Acc# |
| | | | | | | |

Description: NO-HIT

| ORF Name | NTID | AAID | NT Length | AA Length | Score | Probability |
|---|---|---|---|---|---|---|
| 32693927_c3_1016 | 538 | 4710 | 272 | 819 | 898 | 6.1e-90 |
| Protein name | | | | | Locus Name | Acc# |
| | | | | | sp:YJJP_ECOLI | P39402 |

Description: HYPOTHETICAL 30.5 KD PROTEIN IN DNAT-BGLJ INTERGENIC REGION (F277)

| ORF Name | NTID | AAID | NT Length | AA Length | Score | Probability |
|---|---|---|---|---|---|---|
| 32697142_f3_461 | 539 | 4711 | 295 | 888 | 140 | 4.2e-12 |
| Protein name | | | | | Locus Name | Acc# |
| polyferredoxin 2 | | | | | pir:H69032 | H69032 |

Description:

| ORF Name | NTID | AAID | NT Length | AA Length | Score | Probability |
|---|---|---|---|---|---|---|
| 32937_f2_260 | 540 | 4712 | 234 | 705 | 347 | 1.5e-31 |
| Protein name | | | | | Locus Name | Acc# |
| | | | | | gp:AP000342 | AP000342 |

Description: Plasmid R100 genomic DNA.

| ORF Name | NTID | AAID | NT Length | AA Length | Score | Probability |
|---|---|---|---|---|---|---|
| 3303_c2_887 | 541 | 4713 | 341 | 1026 | 858 | 1.1e-85 |
| Protein name | | | | | Locus Name | Acc# |
| | | | | | sp:YIDZ_ECOLI | P31463 |

Description: HYPOTHETICAL TRANSCRIPTIONAL REGULATOR IN TNAB-BGLB INTERGENIC REGION

| ORF Name | NTID | AAID | NT Length | AA Length | Score | Probability |
|---|---|---|---|---|---|---|
| 33204441_f2_355 | 542 | 4714 | 279 | 840 | 926 | 6.6e-93 |

| Protein name | Locus Name | Acc# |
|---|---|---|
| tryptophan synthase alpha subunit | gp:ECU23495 | U23495 |

Description

Escherichia coli ECOR 46 anthranilate isomerase (trpC), tryptophansynthase beta subunit (trpB), tryptophan synthase alpha subunit(trpA), (yciG), and (yciE) genes, complete cds.

| ORF Name | NTID | AAID | NT Length | AA Length | Score | Probability |
|---|---|---|---|---|---|---|
| 33212750_f1_91 | 543 | 4715 | 282 | 849 | 170 | 7.0e-11 |

| Protein name | Locus Name | Acc# |
|---|---|---|
| regulatory protein hpaA | pir:A55349 | A55349:S41 |

Description

| ORF Name | NTID | AAID | NT Length | AA Length | Score | Probability |
|---|---|---|---|---|---|---|
| 3324068_f3_492 | 544 | 4716 | 399 | 1200 | 112 | 0.0050 |

| Protein name | Locus Name | Acc# |
|---|---|---|
| hypothetical protein, MAL4P2.47 | gp:PFMAL4P2 | AL035475 |

Description

Plasmodium falciparum MAL4P2, complete sequence.

| ORF Name | NTID | AAID | NT Length | AA Length | Score | Probability |
|---|---|---|---|---|---|---|
| 33250257_f3_522 | 545 | 4717 | 508 | 1527 | 1822 | 7.4e-188 |

| Protein name | Locus Name | Acc# |
|---|---|---|
| cardiolipin synthase | gp:ECU24197 | U24197 |

Description

Escherichia coli ECOR 16 (yciD) gene, partial cds, and (yciC),(yciB), (yciA), membrane protein (tonB), (yciI), putative potassiumchannel (kch), and cardiolipin synthase (cls) genes, complete cds.

| ORF Name | NTID | AAID | NT Length | AA Length | Score | Probability |
|---|---|---|---|---|---|---|
| 33256_c2_785 | 546 | 4718 | 862 | 2589 | 3593 | 0.0 |
| Protein name | | | | | Locus Name | Acc# |
| | | | | | sp:NIRB_ECOLI | P08201 |

Description
LARGE SUBUNIT,

| ORF Name | NTID | AAID | NT Length | AA Length | Score | Probability |
|---|---|---|---|---|---|---|
| 33290937_f1_90 | 547 | 4719 | 81 | 246 | 83 | 0.012 |
| Protein name | | | | | Locus Name | Acc# |
| L-methionine-alpha-deamino-gamma- | | | | | gp:PSEMEGL | L43133 |

Description
Pseudomonas putida methionine gamma-lyase (MEGL-PSEPU) gene, methionine gamma-lyase gene, complete cds.

| ORF Name | NTID | AAID | NT Length | AA Length | Score | Probability |
|---|---|---|---|---|---|---|
| 33360401_c2_832 | 548 | 4720 | 549 | 1650 | 1959 | 2.3e-202 |
| Protein name | | | | | Locus Name | Acc# |
| | | | | | sp:MPPA_ECOLI | P77348 |

Description
PERIPLASMIC MUREIN PEPTIDE-BINDING PROTEIN PRECURSOR

| ORF Name | NTID | AAID | NT Length | AA Length | Score | Probability |
|---|---|---|---|---|---|---|
| 33392010_c2_951 | 549 | 4721 | 66 | 201 | | |
| Protein name | | | | | Locus Name | Acc# |

Description
NO-HIT

| ORF Name | NTID | AAID | NT Length | AA Length | Score | Probability |
|---|---|---|---|---|---|---|
| 33408136_c1_627 | 550 | 4722 | 821 | 2466 | 3392 | 0.0 |
| Protein name | | | | | Locus Name | Acc# |
| pyruvate,water dikinase, ppsA:phosphoenolpyruvate | | | | | pir:S20554 | S20554:F64 |

Description

| ORF Name | NTID | AAID | NT Length | AA Length | Score | Probability |
|---|---|---|---|---|---|---|
| 33417712_c3_1066 | 551 | 4723 | 352 | 1059 | 1020 | 7.2e-103 |
| Protein name | | | | | Locus Name | Acc# |
| conserved hypothetical protein b1624 | | | | pir:B64919 | | B64919 |

Description

| ORF Name | NTID | AAID | NT Length | AA Length | Score | Probability |
|---|---|---|---|---|---|---|
| 33625011_f1_212 | 552 | 4724 | 894 | 2685 | 4006 | 0.0 |
| Protein name | | | | | Locus Name | Acc# |
| acetaldehyde dehydrogenase (acetylating), / alcohol dehydrogenase,:acetaldehyde/alcohol | | | | pir:DEEC | | JS0406:S14 |

Description

| ORF Name | NTID | AAID | NT Length | AA Length | Score | Probability |
|---|---|---|---|---|---|---|
| 33629385_f3_590 | 553 | 4725 | 147 | 444 | 649 | 1.5e-63 |
| Protein name | | | | | Locus Name | Acc# |
| DNA-binding protein H-NS | | | | pir:S02776 | | S02776 |

Description

| ORF Name | NTID | AAID | NT Length | AA Length | Score | Probability |
|---|---|---|---|---|---|---|
| 33681540_c2_957 | 554 | 4726 | 481 | 1446 | 2059 | 5.7e-213 |
| Protein name | | | | | Locus Name | Acc# |
| pyruvate kinase, A:pyruvate kinase II | | | | pir:S29790 | | S29790:F64 |

Description

| ORF Name | NTID | AAID | NT Length | AA Length | Score | Probability |
|---|---|---|---|---|---|---|
| 3370317_f2_239 | 555 | 4727 | 174 | 525 | 123 | 5.9e-06 |
| Protein name | | | | | Locus Name | Acc# |
| | | | | | sp:RHSB_ECOLI | P16917 |

Description
RHSB PROTEIN PRECURSOR

| ORF Name | NTID | AAID | NT Length | AA Length | Score | Probability |
|---|---|---|---|---|---|---|
| 33991301_f1_92 | 556 | 4728 | 342 | 1029 | 127 | 1.4e-05 |
| Protein name | | | | | Locus Name | Acc# |
| RepH16 | | | | | gp:AF143472 | AF143472 |

Description
Borrelia hermsii plasmid-encoded RepH16 (repH16) and RepH16- (repH16-) genes, complete cds.

| ORF Name | NTID | AAID | NT Length | AA Length | Score | Probability |
|---|---|---|---|---|---|---|
| 33992007_c3_1165 | 557 | 4729 | 537 | 1614 | 569 | 4.4e-55 |
| Protein name | | | | | Locus Name | Acc# |
| putative ABC transporter ATP-binding protein | | | | | gp:SCF56 | AL133424 |

Description
Streptomyces coelicolor cosmid F56.

| ORF Name | NTID | AAID | NT Length | AA Length | Score | Probability |
|---|---|---|---|---|---|---|
| 3400282_f3_567 | 558 | 4730 | 125 | 378 | | |
| Protein name | | | | | Locus Name | Acc# |

Description
NO-HIT

| ORF Name | NTID | AAID | NT Length | AA Length | Score | Probability |
|---|---|---|---|---|---|---|
| 34022205_c1_733 | 559 | 4731 | 339 | 1020 | 1260 | 2.7e-128 |
| Protein name | | | | | Locus Name | Acc# |
| | | | | | sp:LDHD_ECOLI | P52643 |

Description
D-LACTATE DEHYDROGENASE, (D-LDH)

| ORF Name | NTID | AAID | NT Length | AA Length | Score | Probability |
|---|---|---|---|---|---|---|
| 34039681_c1_682 | 560 | 4732 | 408 | 1227 | 585 | 9.0e-57 |
| Protein name | | | | | Locus Name | Acc# |
| | | | | | sp:PATB_BACSU | Q08432 |

Description
PUTATIVE AMINOTRANSFERASE B,

| ORF_Name | NTID | AAID | NT Length | AA Length | Score | Probability |
|---|---|---|---|---|---|---|
| 34040952_f1_104 | 561 | 4733 | 67 | 204 | 52 | 0.012 |
| Protein name | | | | | Locus_Name | Acc# |
| conserved hypothetical protein MTH384 | | | | | pir:G69149 | G69149 |

Description

| ORF_Name | NTID | AAID | NT Length | AA Length | Score | Probability |
|---|---|---|---|---|---|---|
| 34062525_f2_301 | 562 | 4734 | 319 | 960 | 338 | 1.3e-30 |
| Protein name | | | | | Locus_Name | Acc# |
| hypothetical transcriptional activator | | | | | gp:AF139107 | AF139107 |

Description

Pseudomonas aeruginosa hypothetical multidrug resistance protein(mdr) gene, partial cds; hypothetical transcriptional activator(act) and glutamyl-tRNA synthetase (gltX) genes, complete cds; andtRNA-Ala and tRNA-Glu genes, complete sequence.

| ORF_Name | NTID | AAID | NT Length | AA Length | Score | Probability |
|---|---|---|---|---|---|---|
| 34085805_f2_368 | 563 | 4735 | 330 | 993 | 1217 | 9.6e-124 |
| Protein name | | | | | Locus_Name | Acc# |
| | | | | | sp:SAPB_SALTY | P36668 |

Description

PEPTIDE TRANSPORT SYSTEM PERMEASE PROTEIN SAPB

| ORF_Name | NTID | AAID | NT Length | AA Length | Score | Probability |
|---|---|---|---|---|---|---|
| 34160893_f2_270 | 564 | 4736 | 213 | 642 | 586 | 7.0e-57 |
| Protein name | | | | | Locus_Name | Acc# |
| dimethylsulfoxide reductase, chain B1, anaerobic | | | | | pir:G64914 | G64914 |

Description

| ORF_Name | NTID | AAID | NT Length | AA Length | Score | Probability |
|---|---|---|---|---|---|---|
| 34167512_c3_1142 | 565 | 4737 | 290 | 873 | 1087 | 5.7e-110 |
| Protein name | | | | | Locus_Name | Acc# |
| | | | | | sp:YEBK_ECOLI | P46118:P76 |

Description

HYPOTHETICAL 32.0 KD PROTEIN IN PYKA-ZWF INTERGENIC REGION

200

| ORF_Name | NTID | AAID | NT Length | AA Length | Score | Probability |
|---|---|---|---|---|---|---|
| 34244177_f2_232 | 566 | 4738 | 199 | 600 | 708 | 8.3e-70 |

| Protein name | | Locus Name | Acc# |
|---|---|---|---|
| crossover junction endodeoxyribonuclease, ruvC:DNA repair protein ruvC:Holliday junction | pir:D38113 | | D38113:S19 |

Description

| ORF_Name | NTID | AAID | NT Length | AA Length | Score | Probability |
|---|---|---|---|---|---|---|
| 34376_c3_1026 | 567 | 4739 | 80 | 243 | | |

Protein name — Locus Name — Acc#

Description
NO-HIT

| ORF_Name | NTID | AAID | NT Length | AA Length | Score | Probability |
|---|---|---|---|---|---|---|
| 34487516_f3_446 | 568 | 4740 | 321 | 966 | 963 | 7.9e-97 |

| Protein name | Locus Name | Acc# |
|---|---|---|
| | sp:ZNUA_ECOLI | P39172:P76 |

Description
HIGH-AFFINITY ZINC UPTAKE SYSTEM PROTEIN ZNUA PRECURSOR

| ORF_Name | NTID | AAID | NT Length | AA Length | Score | Probability |
|---|---|---|---|---|---|---|
| 34569641_f2_254 | 569 | 4741 | 203 | 612 | 461 | 1.2e-43 |

| Protein name | Locus Name | Acc# |
|---|---|---|
| rnd protein | pir:F64941 | F64941:S41 |

Description

| ORF_Name | NTID | AAID | NT Length | AA Length | Score | Probability |
|---|---|---|---|---|---|---|
| 34614437_f2_225 | 570 | 4742 | 161 | 486 | 452 | 1.1e-42 |

| Protein name | Locus Name | Acc# |
|---|---|---|
| | sp:YCDW_ECOLI | P75913 |

Description
PUTATIVE 2-HYDROXYACID DEHYDROGENASE IN PHOH-CSGG INTERGENIC REGION

| ORF Name | NTID | AAID | NT Length | AA Length | Score | Probability |
|---|---|---|---|---|---|---|
| 34630027_f2_253 | 571 | 4743 | 239 | 720 | 763 | 1.2e-75 |
| Protein name | | | | | Locus Name | Acc# |
| | | | | | sp:YEAZ_ECOLI | P76256:008 |

Description

HYPOTHETICAL 25.2 KD PROTEIN IN FADD-PABB INTERGENIC REGION

| ORF Name | NTID | AAID | NT Length | AA Length | Score | Probability |
|---|---|---|---|---|---|---|
| 35166532_f1_21 | 572 | 4744 | 258 | 777 | 1059 | 5.3e-107 |
| Protein name | | | | | Locus Name | Acc# |
| | | | | | sp:YEBC_ECOLI | P24237 |

Description

HYPOTHETICAL 26.4 KD PROTEIN IN RUVC-ASPS INTERGENIC REGION

| ORF Name | NTID | AAID | NT Length | AA Length | Score | Probability |
|---|---|---|---|---|---|---|
| 35175441_f2_235 | 573 | 4745 | 724 | 2175 | 981 | 6.0e-106 |
| Protein name | | | | | Locus Name | Acc# |
| vgrE protein | | | | | gp:AF044499 | AF044499 |

Description

Escherichia coli strain ec50 RhsE accessory genetic element vgrEprotein, core protein, and dsORF-e5 genes, complete cds.

| ORF Name | NTID | AAID | NT Length | AA Length | Score | Probability |
|---|---|---|---|---|---|---|
| 35211686_c3_1158 | 574 | 4746 | 60 | 183 | | |
| Protein name | | | | | Locus Name | Acc# |

Description

NO-HIT

| ORF Name | NTID | AAID | NT Length | AA Length | Score | Probability |
|---|---|---|---|---|---|---|
| 35265937_f1_28 | 575 | 4747 | 67 | 204 | 76 | 0.036 |
| Protein name | | | | | Locus Name | Acc# |
| | | | | | sp:KKA9_STRRI | P13250 |

Description (RIBOSTAMYCIN PHOSPHOTRANSFERASE) (APH(3'))

| ORF_Name | NTID | AAID | NT Length | AA Length | Score | Probability |
|---|---|---|---|---|---|---|
| 35269426_f2_252 | 576 | 4748 | 659 | 1980 | 2311 | 1.1e-239 |

| Protein name | | | | | Locus Name | Acc# |
|---|---|---|---|---|---|---|
| | | | | | sp:YOAA_ECOLI | P76257:007 |

Description: PROBABLE ATP-DEPENDENT HELICASE YOAA

| ORF_Name | NTID | AAID | NT Length | AA Length | Score | Probability |
|---|---|---|---|---|---|---|
| 35287552_c1_597 | 577 | 4749 | 331 | 996 | 1183 | 3.8e-120 |

| Protein name | | | | | Locus Name | Acc# |
|---|---|---|---|---|---|---|
| UTP--glucose-1-phosphate uridylyltransferase, galU:UDP-glucose pyrophosphorylase | | | | | pir:JC2265 | G64870:JC2 |

Description

| ORF_Name | NTID | AAID | NT Length | AA Length | Score | Probability |
|---|---|---|---|---|---|---|
| 35351385_c1_605 | 578 | 4750 | 120 | 363 | 366 | 1.4e-33 |

| Protein name | | | | | Locus Name | Acc# |
|---|---|---|---|---|---|---|
| | | | | | sp:NIRD_ECOLI | P23675 |

Description: SMALL SUBUNIT,

| ORF_Name | NTID | AAID | NT Length | AA Length | Score | Probability |
|---|---|---|---|---|---|---|
| 35360887_c2_849 | 579 | 4751 | 214 | 645 | | |

| Protein name | | | | | Locus Name | Acc# |
|---|---|---|---|---|---|---|

Description: NO-HIT

| ORF_Name | NTID | AAID | NT Length | AA Length | Score | Probability |
|---|---|---|---|---|---|---|
| 35878_f1_186 | 580 | 4752 | 161 | 486 | 140 | 1.3e-09 |

| Protein name | | | | | Locus Name | Acc# |
|---|---|---|---|---|---|---|
| | | | | | sp:YCB7_PSEDE | P29940 |

Description: HYPOTHETICAL 21.2 KD PROTEIN IN COBO 3'REGION (ORF7)

| ORF Name | NTID | AAID | NT Length | AA Length | Score | Probability |
|---|---|---|---|---|---|---|
| 36110715_c2_833 | 581 | 4753 | 334 | 1005 | 927 | 5.1e-93 |
| Protein name | | | | | Locus Name | Acc# |
| probable transport protein b1342 | | | | | pir:A64884 | A64884 |

Description

| ORF Name | NTID | AAID | NT Length | AA Length | Score | Probability |
|---|---|---|---|---|---|---|
| 36111392_c1_700 | 582 | 4754 | 214 | 645 | 1001 | 7.4e-101 |
| Protein name | | | | | Locus Name | Acc# |
| dimethyl sulfoxide reductase subunit B | | | | | gp:AF135170 | AF135170 |

Description

Yersinia pestis ribose ABC transporter (rbsA) gene, partial cds;D-ribose binding protein (rbsB), catalase/peroxidase (katY),cytochrome c (cybC), cytochrome b (cybB), dimethyl sulfoxidereductase subunit C (dmsC), dimethyl sulfoxide reductase subunit B(dmsB), dimethyl sulfoxide reductase subunit A (dmsA), andL-ribulose-phosphate 4-epimerase (araD) genes, complete cds;

| ORF Name | NTID | AAID | NT Length | AA Length | Score | Probability |
|---|---|---|---|---|---|---|
| 36224167_c3_1004 | 583 | 4755 | 341 | 1026 | 1493 | 5.4e-153 |
| Protein name | | | | | Locus Name | Acc# |
| | | | | | sp:OPPF_ECOLI | P77737 |

Description

OLIGOPEPTIDE TRANSPORT ATP-BINDING PROTEIN OPPF

| ORF Name | NTID | AAID | NT Length | AA Length | Score | Probability |
|---|---|---|---|---|---|---|
| 36334426_c2_912 | 584 | 4756 | 206 | 621 | 441 | 1.6e-41 |
| Protein name | | | | | Locus Name | Acc# |
| | | | | | sp:ATKC_ECOLI | P03961 |

Description

C CHAIN)

| ORF Name | NTID | AAID | NT Length | AA Length | Score | Probability |
|---|---|---|---|---|---|---|
| 36353403_c1_612 | 585 | 4757 | 426 | 1281 | 1855 | 9.3e-194 |
| Protein name | | | | | Locus Name | Acc# |
| cytosine deaminase | | | | | gp:ECU73857 | U73857 |

Description

Escherichia coli chromosome minutes 6-8.

| ORF Name | NTID | AAID | NT Length | AA Length | Score | Probability |
|---|---|---|---|---|---|---|
| 36359457_c2_989 | 586 | 4758 | 365 | 1098 | 1725 | 1.4e-177 |
| Protein name | | | | | Locus Name | Acc# |
| probable GTP-binding protein ychF | | | | | pir:H64866 | H64866 |

Description

| ORF Name | NTID | AAID | NT Length | AA Length | Score | Probability |
|---|---|---|---|---|---|---|
| 36367263_c2_872 | 587 | 4759 | 405 | 1218 | 1040 | 5.5e-105 |
| Protein name | | | | | Locus Name | Acc# |
| | | | | | gp:ECOMLC | D32222 |

Description

Escherichia coli mlc gene.

| ORF Name | NTID | AAID | NT Length | AA Length | Score | Probability |
|---|---|---|---|---|---|---|
| 36412893_f3_442 | 588 | 4760 | 143 | 432 | 126 | 2.1e-07 |
| Protein name | | | | | Locus Name | Acc# |
| core protein | | | | | gp:ECRHSEH2 | AF044501 |

Description

Escherichia coli strain ec45 RhsE accessory genetic element coreprotein gene, partial cds, and dsORF-e4, complete cds; and RhsHaccessory genetic element unknown (450), core protein, and dsORF-h1genes, complete cds.

| ORF Name | NTID | AAID | NT Length | AA Length | Score | Probability |
|---|---|---|---|---|---|---|
| 37813_f2_324 | 589 | 4761 | 386 | 1161 | | |
| Protein name | | | | | Locus Name | Acc# |

Description

NO-HIT

| ORF Name | NTID | AAID | NT Length | AA Length | Score | Probability |
|---|---|---|---|---|---|---|
| 3906431_f3_495 | 590 | 4762 | 424 | 1275 | 1324 | 4.4e-135 |
| Protein name | | | | | Locus Name | Acc# |
| | | | | | sp:YNFM_ECOLI | P43531:P77 |

Description

HYPOTHETICAL 45.3 KD PROTEIN IN MLC-ASR INTERGENIC REGION

205

| ORF_Name | NTID | AAID | NT Length | AA Length | Score | Probability |
|---|---|---|---|---|---|---|
| 3907891_f1_84 | 591 | 4763 | 206 | 621 | 276 | 5.0e-24 |
| Protein name | | | | | Locus_Name | Acc# |
| probable DNA-3-methyladenine glycosidase II | | | | | pir:A75257 | A75257 |

Description

| ORF_Name | NTID | AAID | NT Length | AA Length | Score | Probability |
|---|---|---|---|---|---|---|
| 3912843_c1_647 | 592 | 4764 | 103 | 312 | 122 | 1.0e-07 |
| Protein name | | | | | Locus_Name | Acc# |
| | | | | | sp:YH83_SYNY3 | P73602 |

Description

HYPOTHETICAL 16.8 KD PROTEIN sll1783

| ORF_Name | NTID | AAID | NT Length | AA Length | Score | Probability |
|---|---|---|---|---|---|---|
| 3917885_f2_393 | 593 | 4765 | 358 | 1077 | 1108 | 1.7e-114 |
| Protein name | | | | | Locus_Name | Acc# |
| ABC-type permease | | | | | pir:T12072 | T12072 |

Description

| ORF_Name | NTID | AAID | NT Length | AA Length | Score | Probability |
|---|---|---|---|---|---|---|
| 391943_f3_538 | 594 | 4766 | 221 | 666 | 1057 | 8.6e-107 |
| Protein name | | | | | Locus_Name | Acc# |
| | | | | | sp:GT_PROMI | P15214 |

Description

GLUTATHIONE S-TRANSFERASE GST-6.0, (GST B1-1)

| ORF_Name | NTID | AAID | NT Length | AA Length | Score | Probability |
|---|---|---|---|---|---|---|
| 3925135_f2_314 | 595 | 4767 | 212 | 639 | 274 | 8.1e-24 |
| Protein name | | | | | Locus_Name | Acc# |
| | | | | | gp:AB015670 | AB015670 |

Description

Bacillus sp. genes for CDase, CGTase, MBP and 15 ORFs, partial andcomplete cds.

| ORF Name | NTID | AAID | NT Length | AA Length | Score | Probability |
|---|---|---|---|---|---|---|
| 3937543_c3_1008 | 596 | 4768 | 870 | 2613 | 2002 | 6.3e-207 |
| Protein name | | | | | Locus Name | Acc# |
| | | | | | sp:SFMD_ECOLI | P77468 |

Description

OUTER MEMBRANE USHER PROTEIN SFMD PRECURSOR

| ORF Name | NTID | AAID | NT Length | AA Length | Score | Probability |
|---|---|---|---|---|---|---|
| 3937812_f1_160 | 597 | 4769 | 166 | 501 | 535 | 1.8e-51 |
| Protein name | | | | | Locus Name | Acc# |
| outer membrane lipoprotein Pcp | | | | | gp:AF168687 | AF168687 |

Description

Erwinia carotovora subsp. carotovora Hor (hor) and outer membrane lipoprotein Pcp (pcp) genes, complete cds; and unknown gene.

| ORF Name | NTID | AAID | NT Length | AA Length | Score | Probability |
|---|---|---|---|---|---|---|
| 3939093_f1_56 | 598 | 4770 | 275 | 828 | 332 | 5.8e-30 |
| Protein name | | | | | Locus Name | Acc# |
| | | | | | sp:YQJI_ECOLI | Q46872 |

Description

HYPOTHETICAL 23.4 KD PROTEIN IN RPOD-AER INTERGENIC REGION

| ORF Name | NTID | AAID | NT Length | AA Length | Score | Probability |
|---|---|---|---|---|---|---|
| 3941567_c2_897 | 599 | 4771 | 255 | 768 | 83 | 0.0060 |
| Protein name | | | | | Locus Name | Acc# |
| hypothetical protein b4256:hypothetical protein f97 | | | | | pir:S56481 | S56481:C65 |

Description

| ORF Name | NTID | AAID | NT Length | AA Length | Score | Probability |
|---|---|---|---|---|---|---|
| 3948267_c2_811 | 600 | 4772 | 501 | 1506 | 2095 | 8.7e-217 |
| Protein name | | | | | Locus Name | Acc# |
| | | | | | sp:YNHE_ECOLI | P77522 |

Description

HYPOTHETICAL 56.3 KD PROTEIN IN LPP-AROD INTERGENIC REGION

| ORF Name | NTID | AAID | NT Length | AA Length | Score | Probability |
|---|---|---|---|---|---|---|
| 3955461_c2_852 | 601 | 4773 | 494 | 1485 | 237 | 3.5e-19 |
| Protein name | | | | | Locus Name | Acc# |
| orf229 gp | | | | gp:AF115102 | | AF115102:A |

Description

Streptococcus thermophilus bacteriophage Sfi19, complete genome.

| ORF Name | NTID | AAID | NT Length | AA Length | Score | Probability |
|---|---|---|---|---|---|---|
| 3961713_f1_89 | 602 | 4774 | 269 | 810 | 571 | 2.7e-55 |
| Protein name | | | | | Locus Name | Acc# |
| | | | | | sp:YAEC_ECOLI | P28635 |

Description

PRECURSOR

| ORF Name | NTID | AAID | NT Length | AA Length | Score | Probability |
|---|---|---|---|---|---|---|
| 3984768_c1_730 | 603 | 4775 | 197 | 594 | | |
| Protein name | | | | | Locus Name | Acc# |

Description

NO-HIT

| ORF Name | NTID | AAID | NT Length | AA Length | Score | Probability |
|---|---|---|---|---|---|---|
| 3986268_c2_947 | 604 | 4776 | 310 | 933 | | |
| Protein name | | | | | Locus Name | Acc# |

Description

NO-HIT

| ORF Name | NTID | AAID | NT Length | AA Length | Score | Probability |
|---|---|---|---|---|---|---|
| 4017188_c3_1092 | 605 | 4777 | 135 | 408 | 202 | 3.5e-16 |
| Protein name | | | | | Locus Name | Acc# |
| | | | | | sp:Y854_PYRHO | O58584 |

Description

HYPOTHETICAL PROTEIN PH0854

| ORF Name | NTID | AAID | NT Length | AA Length | Score | Probability |
|---|---|---|---|---|---|---|
| 4022202_f3_464 | 606 | 4778 | 657 | 1974 | 122 | 0.00032 |
| Protein name | | | | | Locus Name | Acc# |
| | | | | | sp:YG09_METJA | Q59004 |

Description
HYPOTHETICAL ATP-BINDING PROTEIN MJ1609

| ORF Name | NTID | AAID | NT Length | AA Length | Score | Probability |
|---|---|---|---|---|---|---|
| 4025952_c2_822 | 607 | 4779 | 112 | 339 | 531 | 4.7e-51 |
| Protein name | | | | | Locus Name | Acc# |
| | | | | | sp:YDHD_ECOLI | P37010:P77 |

Description
12.9 KD PROTEIN IN LHR-SODB INTERGENIC REGION

| ORF Name | NTID | AAID | NT Length | AA Length | Score | Probability |
|---|---|---|---|---|---|---|
| 4031693_c2_796 | 608 | 4780 | 148 | 447 | 304 | 5.4e-27 |
| Protein name | | | | | Locus Name | Acc# |
| | | | | | sp:UP12_ECOLI | P39177:P77 |

Description
UNKNOWN PROTEIN FROM 2D-PAGE (SPOTS PR25/LM16/2D_000LR3)

| ORF Name | NTID | AAID | NT Length | AA Length | Score | Probability |
|---|---|---|---|---|---|---|
| 4032827_f2_287 | 609 | 4781 | 228 | 687 | 329 | 1.2e-29 |
| Protein name | | | | | Locus Name | Acc# |
| | | | | | sp:YAHD_ECOLI | P77736 |

Description
HYPOTHETICAL 21.7 KD PROTEIN IN BETT-PRPR INTERGENIC REGION

| ORF Name | NTID | AAID | NT Length | AA Length | Score | Probability |
|---|---|---|---|---|---|---|
| 4062515_c1_645 | 610 | 4782 | 154 | 465 | | |
| Protein name | | | | | Locus Name | Acc# |

Description
NO-HIT

| ORF Name | NTID | AAID | NT Length | AA Length | Score | Probability |
|---|---|---|---|---|---|---|
| 4062802_f3_468 | 611 | 4783 | 360 | 1083 | 1125 | 5.4e-114 |
| Protein name | | | | | Locus Name | Acc# |
| | | | | | sp:YHII_ECOLI | P37626 |

Description: (F355)

| ORF Name | NTID | AAID | NT Length | AA Length | Score | Probability |
|---|---|---|---|---|---|---|
| 4065930_c2_932 | 612 | 4784 | 66 | 201 | | |
| Protein name | | | | | Locus Name | Acc# |

Description: NO-HIT

| ORF Name | NTID | AAID | NT Length | AA Length | Score | Probability |
|---|---|---|---|---|---|---|
| 40663_f3_517 | 613 | 4785 | 438 | 1317 | 1776 | 5.6e-183 |
| Protein name | | | | | Locus Name | Acc# |
| | | | | | sp:TRPB_ECOLI | P00932:P78 |

Description: TRYPTOPHAN SYNTHASE BETA CHAIN,

| ORF Name | NTID | AAID | NT Length | AA Length | Score | Probability |
|---|---|---|---|---|---|---|
| 4095387_c1_696 | 614 | 4786 | 397 | 1194 | 1219 | 5.9e-124 |
| Protein name | | | | | Locus Name | Acc# |
| | | | | | sp:YDEE_ECOLI | P31126:P31 |

Description: HYPOTHETICAL 42.7 KD PROTEIN IN MARB-DCP INTERGENIC REGION

| ORF Name | NTID | AAID | NT Length | AA Length | Score | Probability |
|---|---|---|---|---|---|---|
| 4101713_f3_466 | 615 | 4787 | 524 | 1575 | 354 | 2.5e-29 |
| Protein name | | | | | Locus Name | Acc# |
| protein with 5'-3' exonuclease domain (Kem-1 family) PFB0205c | | | | | pir:A71621 | A71621 |

Description

| ORF Name | NTID | AAID | NT Length | AA Length | Score | Probability |
|---|---|---|---|---|---|---|
| 4103426_f2_227 | 616 | 4788 | 203 | 612 | 150 | 1.7e-09 |
| Protein name | | | | | Locus Name | Acc# |
| EGL-9 | | | | | gp:AF178536 | AF178536 |

Description: Caenorhabditis elegans EGL-9 (egl-9) mRNA, complete cds.

| ORF Name | NTID | AAID | NT Length | AA Length | Score | Probability |
|---|---|---|---|---|---|---|
| 4113765_f1_62 | 617 | 4789 | 317 | 954 | 392 | 2.5e-36 |
| Protein name | | | | | Locus Name | Acc# |
| hypothetical protein RP372 | | | | | pir:E71694 | E71694 |

Description:

| ORF Name | NTID | AAID | NT Length | AA Length | Score | Probability |
|---|---|---|---|---|---|---|
| 4117936_f2_398 | 618 | 4790 | 329 | 990 | 1284 | 7.6e-131 |
| Protein name | | | | | Locus Name | Acc# |
| | | | | | sp:HEM2_ECOLI | P15002:P78 |

Description: SYNTHASE) (ALAD) (ALADH)

| ORF Name | NTID | AAID | NT Length | AA Length | Score | Probability |
|---|---|---|---|---|---|---|
| 4179677_f3_528 | 619 | 4791 | 100 | 303 | 78 | 0.0048 |
| Protein name | | | | | Locus Name | Acc# |
| hypothetical protein BB0708 | | | | | pir:C70188 | C70188 |

Description:

| ORF Name | NTID | AAID | NT Length | AA Length | Score | Probability |
|---|---|---|---|---|---|---|
| 4297127_c2_795 | 620 | 4792 | 125 | 378 | | |
| Protein name | | | | | Locus Name | Acc# |

Description: NO-HIT

| ORF Name | NTID | AAID | NT Length | AA Length | Score | Probability |
|---|---|---|---|---|---|---|
| 4298768_c2_842 | 621 | 4793 | 311 | 936 | 1157 | 2.2e-117 |

| Protein name | | | | | Locus Name | Acc# |
|---|---|---|---|---|---|---|
| | | | | | sp:YCIL_ECOLI | P37765 |

Description

HYPOTHETICAL 32.7 KD PROTEIN IN TRPL-BTUR INTERGENIC REGION (ORF4)

| ORF Name | NTID | AAID | NT Length | AA Length | Score | Probability |
|---|---|---|---|---|---|---|
| 4329633_c2_790 | 622 | 4794 | 188 | 567 | 219 | 5.5e-18 |

| Protein name | | | | | Locus Name | Acc# |
|---|---|---|---|---|---|---|
| | | | | | sp:FIMF_SALTY | P37926 |

Description

FIMBRIAL-LIKE PROTEIN FIMF PRECURSOR

| ORF Name | NTID | AAID | NT Length | AA Length | Score | Probability |
|---|---|---|---|---|---|---|
| 4332893_f1_54 | 623 | 4795 | 344 | 1035 | 833 | 4.7e-83 |

| Protein name | | | | | Locus Name | Acc# |
|---|---|---|---|---|---|---|
| unknown | | | | | gp:AF102543 | AF102543 |

Description

Zymomonas mobilis ZM4 fosmid clone 43A9, complete sequence.

| ORF Name | NTID | AAID | NT Length | AA Length | Score | Probability |
|---|---|---|---|---|---|---|
| 4393760_f2_360 | 624 | 4796 | 146 | 441 | 523 | 3.3e-50 |

| Protein name | | | | | Locus Name | Acc# |
|---|---|---|---|---|---|---|
| | | | | | sp:YCIA_ECOLI | P04379 |

Description (P14 PROTEIN)

| ORF Name | NTID | AAID | NT Length | AA Length | Score | Probability |
|---|---|---|---|---|---|---|
| 4394050_c3_1130 | 625 | 4797 | 97 | 294 | 109 | 2.5e-06 |

| Protein name | | | | | Locus Name | Acc# |
|---|---|---|---|---|---|---|
| hypothetical protein PH0444 | | | | | pir:E71155 | E71155 |

Description

212

| ORF Name | NTID | AAID | NT Length | AA Length | Score | Probability |
|---|---|---|---|---|---|---|
| 440678_c1_691 | 626 | 4798 | 535 | 1608 | 2353 | 4.0e-244 |
| Protein name | | | | | Locus Name | Acc# |
| | | | | | sp:YBIT_ECOLI | P75790 |

Description
HYPOTHETICAL ABC TRANSPORTER ATP-BINDING PROTEIN YBIT

| ORF Name | NTID | AAID | NT Length | AA Length | Score | Probability |
|---|---|---|---|---|---|---|
| 4428187_f1_193 | 627 | 4799 | 79 | 240 | 103 | 1.1e-05 |
| Protein name | | | | | Locus Name | Acc# |
| | | | | | gp:ABCARRA | X70360 |

Description
A.brasilense carR gene.

| ORF Name | NTID | AAID | NT Length | AA Length | Score | Probability |
|---|---|---|---|---|---|---|
| 4428467_f1_105 | 628 | 4800 | 122 | 369 | 231 | 2.9e-19 |
| Protein name | | | | | Locus Name | Acc# |
| | | | | | sp:YNFB_ECOLI | P76170 |

Description
HYPOTHETICAL 12.9 KD PROTEIN IN RSPA-SPEG INTERGENIC REGION PRECURSOR

| ORF Name | NTID | AAID | NT Length | AA Length | Score | Probability |
|---|---|---|---|---|---|---|
| 4429713_f3_589 | 629 | 4801 | 281 | 846 | 495 | 3.1e-47 |
| Protein name | | | | | Locus Name | Acc# |
| oligopeptide ABC transporter, ATP-binding protein | | | | | pir:D72371 | D72371 |

Description

| ORF Name | NTID | AAID | NT Length | AA Length | Score | Probability |
|---|---|---|---|---|---|---|
| 4459677_c3_1097 | 630 | 4802 | 214 | 645 | 560 | 4.0e-54 |

| Protein name | | | | | Locus Name | Acc# |
|---|---|---|---|---|---|---|
| unknown | | | | | gp:AF135170 | AF135170 |

Description

Yersinia pestis ribose ABC transporter (rbsA) gene, partial cds;D-ribose binding protein (rbsB), catalase/peroxidase (katY), cytochrome c (cybC), cytochrome b (cybB), dimethyl sulfoxidereductase subunit C (dmsC), dimethyl sulfoxide reductase subunit B(dmsB), dimethyl sulfoxide reductase subunit A (dmsA), andL-ribulose-phosphate 4-epimerase (araD) genes, complete cds;

| ORF Name | NTID | AAID | NT Length | AA Length | Score | Probability |
|---|---|---|---|---|---|---|
| 4532532_c1_721 | 631 | 4803 | 213 | 642 | 140 | 1.3e-09 |

| Protein name | | | | | Locus Name | Acc# |
|---|---|---|---|---|---|---|
| type 1 fimbrial protein sfaA:S fimbrial adhesin major subunit sfaA:type 1 fimbrial | | | | | pir:D49233 | D49233:S38 |

Description

| ORF Name | NTID | AAID | NT Length | AA Length | Score | Probability |
|---|---|---|---|---|---|---|
| 4539550_f1_2 | 632 | 4804 | 153 | 462 | 114 | 7.3e-07 |

| Protein name | | | | | Locus Name | Acc# |
|---|---|---|---|---|---|---|
| hypothetical protein APE1165 | | | | | pir:H72586 | H72586 |

Description

| ORF Name | NTID | AAID | NT Length | AA Length | Score | Probability |
|---|---|---|---|---|---|---|
| 4572187_f1_145 | 633 | 4805 | 307 | 924 | 1342 | 5.4e-137 |

| Protein name | | | | | Locus Name | Acc# |
|---|---|---|---|---|---|---|
| | | | | | sp:YDAO_ECOLI | P76055:Q47 |

Description

HYPOTHETICAL 35.6 KD PROTEIN IN DBPA-INTR INTERGENIC REGION

| ORF Name | NTID | AAID | NT Length | AA Length | Score | Probability |
|---|---|---|---|---|---|---|
| 4572250_f1_117 | 634 | 4806 | 216 | 651 | 1001 | 7.4e-101 |

| Protein name | | | | | Locus Name | Acc# |
|---|---|---|---|---|---|---|
| | | | | | sp:END3_ECOLI | P20625 |

Description

LYASE)

214

| ORF Name | NTID | AAID | NT Length | AA Length | Score | Probability |
|---|---|---|---|---|---|---|
| 4584625_f2_363 | 635 | 4807 | 112 | 339 | 278 | 3.1e-24 |
| Protein name | | | | | Locus Name | Acc# |
| hypothetical protein b1248 | | | | | pir:C64872 | C64872 |

Description

| ORF Name | NTID | AAID | NT Length | AA Length | Score | Probability |
|---|---|---|---|---|---|---|
| 4586507_c1_649 | 636 | 4808 | 255 | 768 | 458 | 2.6e-43 |
| Protein name | | | | | Locus Name | Acc# |
| tonB protein | | | | | pir:A36928 | A36928 |

Description

| ORF Name | NTID | AAID | NT Length | AA Length | Score | Probability |
|---|---|---|---|---|---|---|
| 4693750_f2_276 | 637 | 4809 | 510 | 1533 | 1799 | 2.0e-185 |
| Protein name | | | | | Locus Name | Acc# |
| | | | | | sp:AMN_ECOLI | P15272:P78 |

Description

AMP NUCLEOSIDASE,

| ORF Name | NTID | AAID | NT Length | AA Length | Score | Probability |
|---|---|---|---|---|---|---|
| 4693800_f2_376 | 638 | 4810 | 228 | 687 | 880 | 4.9e-88 |
| Protein name | | | | | Locus Name | Acc# |
| | | | | | sp:RNT_ECOLI | P30014:P76 |

Description

RIBONUCLEASE T, (EXORIBONUCLEASE T) (RNASE T)

| ORF Name | NTID | AAID | NT Length | AA Length | Score | Probability |
|---|---|---|---|---|---|---|
| 4695933_f2_221 | 639 | 4811 | 285 | 858 | 920 | 2.8e-92 |
| Protein name | | | | | Locus Name | Acc# |
| | | | | | sp:HEMK_ECOLI | P37186:Q46 |

Description

HEMK PROTEIN

| ORF Name | NTID | AAID | NT Length | AA Length | Score | Probability |
|---|---|---|---|---|---|---|
| 4698592_f3_449 | 640 | 4812 | 125 | 378 | 398 | 5.9e-37 |
| Protein name | | | | | Locus Name | Acc# |
| probable membrane protein b1599 | | | | | pir:A64916 | A64916 |

Description

| ORF Name | NTID | AAID | NT Length | AA Length | Score | Probability |
|---|---|---|---|---|---|---|
| 4712506_c3_1148 | 641 | 4813 | 100 | 303 | | |
| Protein name | | | | | Locus Name | Acc# |

Description

NO-HIT

| ORF Name | NTID | AAID | NT Length | AA Length | Score | Probability |
|---|---|---|---|---|---|---|
| 4745303_c2_845 | 642 | 4814 | 869 | 2610 | 3746 | 0.0 |
| Protein name | | | | | Locus Name | Acc# |
| | | | | | sp:TOP1_ECOLI | P06612 |

Description (UNTWISTING ENZYME) (SWIVELASE)

| ORF Name | NTID | AAID | NT Length | AA Length | Score | Probability |
|---|---|---|---|---|---|---|
| 4766886_f1_87 | 643 | 4815 | 138 | 417 | 148 | 1.8e-10 |
| Protein name | | | | | Locus Name | Acc# |
| | | | | | sp:YUR5_RHIME | P42879 |

Description

HYPOTHETICAL 15.0 KD PROTEIN IN UREB-UREC INTERGENIC REGION (ORF5)

| ORF Name | NTID | AAID | NT Length | AA Length | Score | Probability |
|---|---|---|---|---|---|---|
| 4767587_c2_791 | 644 | 4816 | 211 | 636 | 588 | 4.3e-57 |
| Protein name | | | | | Locus Name | Acc# |
| regulatory protein | | | | | gp:ECU73857 | U73857 |

Description

Escherichia coli chromosome minutes 6-8.

| ORF Name | NTID | AAID | NT Length | AA Length | Score | Probability |
|---|---|---|---|---|---|---|
| 4768802_f2_272 | 645 | 4817 | 205 | 618 | 903 | 1.8e-90 |――
| Protein name | | | | | Locus Name | Acc# |
| alkyl hydroperoxide reductase | | | | gp:STYAHPCFA | | J05478 |

Description

Salmonella typhimurium alkyl hydroperoxide reductase (ahpC) and (ahpF) genes, complete cds.

| ORF Name | NTID | AAID | NT Length | AA Length | Score | Probability |
|---|---|---|---|---|---|---|
| 4772161_c3_1121 | 646 | 4818 | 264 | 795 | 1182 | 4.9e-120 |
| Protein name | | | | | Locus Name | Acc# |
| | | | | | sp:FNR_ECOLI | P03019 |

Description

FUMARATE AND NITRATE REDUCTION REGULATORY PROTEIN

| ORF Name | NTID | AAID | NT Length | AA Length | Score | Probability |
|---|---|---|---|---|---|---|
| 4823576_c3_1044 | 647 | 4819 | 123 | 372 | 300 | 1.4e-26 |
| Protein name | | | | | Locus Name | Acc# |
| | | | | | sp:PSPC_ECOLI | P23855 |

Description

PHAGE SHOCK PROTEIN C

| ORF Name | NTID | AAID | NT Length | AA Length | Score | Probability |
|---|---|---|---|---|---|---|
| 4823938_c3_1002 | 648 | 4820 | 309 | 930 | 1349 | 9.8e-138 |
| Protein name | | | | | Locus Name | Acc# |
| | | | | | sp:OPPB_ECOLI | P31132:P76 |

Description

OLIGOPEPTIDE TRANSPORT SYSTEM PERMEASE PROTEIN OPPB

| ORF Name | NTID | AAID | NT Length | AA Length | Score | Probability |
|---|---|---|---|---|---|---|
| 4875068_f1_176 | 649 | 4821 | 374 | 1125 | 1117 | 3.8e-113 |
| Protein name | | | | | Locus Name | Acc# |
| probable membrane protein b1688 | | | | pir:H64926 | | H64926 |

Description

| ORF Name | NTID | AAID | NT Length | AA Length | Score | Probability |
|---|---|---|---|---|---|---|
| 4875312_f1_163 | 650 | 4822 | 408 | 1227 | 1126 | 4.2e-114 |
| Protein name | | | | | Locus Name | Acc# |
| Bicyclomycin resistance protein (Sulfonamide | | | | | gp:D90809 | D90809:AB0 |

Description

E.coli genomic DNA, Kohara clone #318(37.2-37.6 min.).

| ORF Name | NTID | AAID | NT Length | AA Length | Score | Probability |
|---|---|---|---|---|---|---|
| 4879637_f1_37 | 651 | 4823 | 60 | 183 | | |
| Protein name | | | | | Locus Name | Acc# |

Description

NO-HIT

| ORF Name | NTID | AAID | NT Length | AA Length | Score | Probability |
|---|---|---|---|---|---|---|
| 4881510_c1_723 | 652 | 4824 | 337 | 1014 | | |
| Protein name | | | | | Locus Name | Acc# |

Description

NO-HIT

| ORF Name | NTID | AAID | NT Length | AA Length | Score | Probability |
|---|---|---|---|---|---|---|
| 4881567_c3_1049 | 653 | 4825 | 181 | 546 | 403 | 1.7e-37 |
| Protein name | | | | | Locus Name | Acc# |
| | | | | | sp:AIL_YEREN | P16454 |

Description

ATTACHMENT INVASION LOCUS PROTEIN PRECURSOR

| ORF Name | NTID | AAID | NT Length | AA Length | Score | Probability |
|---|---|---|---|---|---|---|
| 4886688_f1_49 | 654 | 4826 | 513 | 1542 | 2188 | 1.2e-226 |
| Protein name | | | | | Locus Name | Acc# |
| | | | | | sp:PNTA_ECOLI | P07001:P76 |

Description

TRANSHYDROGENASE SUBUNIT ALPHA)

218

| ORF Name | NTID | AAID | NT Length | AA Length | Score | Probability |
|---|---|---|---|---|---|---|
| 4900002_c2_787 | 655 | 4827 | 112 | 339 | 107 | 4.0e-06 |
| Protein name | | | | | Locus Name | Acc# |
| | | | | | gp:PMFIMOPR | Z32686 |

Description

Proteus mirabilis fimbrial operon, strain HI4320.

| ORF Name | NTID | AAID | NT Length | AA Length | Score | Probability |
|---|---|---|---|---|---|---|
| 4969153_f3_421 | 656 | 4828 | 274 | 825 | 818 | 1.8e-81 |
| Protein name | | | | | Locus Name | Acc# |
| ychA protein | | | | | pir:I83572 | I83572:C64 |

Description

| ORF Name | NTID | AAID | NT Length | AA Length | Score | Probability |
|---|---|---|---|---|---|---|
| 4971093_f2_370 | 657 | 4829 | 337 | 1014 | 1400 | 3.9e-143 |
| Protein name | | | | | Locus Name | Acc# |
| | | | | | gp:ECAJ649 | AJ222649 |

Description

Erwinia chrysanthemi DNA sequence of antimicrobialpeptides-resistance locus.

| ORF Name | NTID | AAID | NT Length | AA Length | Score | Probability |
|---|---|---|---|---|---|---|
| 5081388_f2_246 | 658 | 4830 | 75 | 228 | | |
| Protein name | | | | | Locus Name | Acc# |

Description

NO-HIT

| ORF Name | NTID | AAID | NT Length | AA Length | Score | Probability |
|---|---|---|---|---|---|---|
| 5094012_f1_178 | 659 | 4831 | 80 | 243 | 134 | 5.5e-09 |
| Protein name | | | | | Locus Name | Acc# |
| | | | | | sp:HEMP_YEREN | P31516 |

Description

HEMIN UPTAKE PROTEIN HEMP

219

| ORF Name | NTID | AAID | NT Length | AA Length | Score | Probability |
|---|---|---|---|---|---|---|
| 5114812_c2_813 | 660 | 4832 | 415 | 1248 | 1339 | 1.1e-136 |
| Protein name | | | | | Locus Name | Acc# |
| aminotransferase nifS homolog b1680, pyridoxal phosphate-dependent | | | | | pir:H64925 | H64925 |

Description

| ORF Name | NTID | AAID | NT Length | AA Length | Score | Probability |
|---|---|---|---|---|---|---|
| 5117778_f2_262 | 661 | 4833 | 70 | 213 | 147 | 2.3e-10 |
| Protein name | | | | | Locus Name | Acc# |
| | | | | | sp:YNBE_ECOLI | P76075 |

Description
HYPOTHETICAL 6.8 KD PROTEIN IN LDHA-FEAR INTERGENIC REGION

| ORF Name | NTID | AAID | NT Length | AA Length | Score | Probability |
|---|---|---|---|---|---|---|
| 5117943_c3_1045 | 662 | 4834 | 87 | 264 | 85 | 0.00086 |
| Protein name | | | | | Locus Name | Acc# |
| | | | | | sp:PSPD_ECOLI | P23856 |

Description
PHAGE SHOCK PROTEIN D

| ORF Name | NTID | AAID | NT Length | AA Length | Score | Probability |
|---|---|---|---|---|---|---|
| 5125325_f2_234 | 663 | 4835 | 338 | 1017 | 1422 | 1.8e-145 |
| Protein name | | | | | Locus Name | Acc# |
| | | | | | sp:RUVB_ECOLI | P08577 |

Description
HOLLIDAY JUNCTION DNA HELICASE RUVB

| ORF Name | NTID | AAID | NT Length | AA Length | Score | Probability |
|---|---|---|---|---|---|---|
| 5128550_f3_523 | 664 | 4836 | 66 | 201 | | |
| Protein name | | | | | Locus Name | Acc# |

Description
NO-HIT

| ORF Name | NTID | AAID | NT Length | AA Length | Score | Probability |
|---|---|---|---|---|---|---|
| 5192660_f1_41 | 665 | 4837 | 117 | 354 | | |
| Protein name | | | | | Locus Name | Acc# |

Description: NO-HIT

| ORF Name | NTID | AAID | NT Length | AA Length | Score | Probability |
|---|---|---|---|---|---|---|
| 5272507_c2_877 | 666 | 4838 | 61 | 186 | | |
| Protein name | | | | | Locus Name | Acc# |

Description: NO-HIT

| ORF Name | NTID | AAID | NT Length | AA Length | Score | Probability |
|---|---|---|---|---|---|---|
| 5273902_c1_606 | 667 | 4839 | 337 | 1014 | 1358 | 1.1e-138 |
| Protein name | | | | | Locus Name | Acc# |
| | | | | | sp:OPPD_ECOLI | P76027:P77 |

Description: OLIGOPEPTIDE TRANSPORT ATP-BINDING PROTEIN OPPD

| ORF Name | NTID | AAID | NT Length | AA Length | Score | Probability |
|---|---|---|---|---|---|---|
| 5314827_f3_566 | 668 | 4840 | 286 | 861 | 469 | 1.8e-44 |
| Protein name | | | | | Locus Name | Acc# |
| | | | | | sp:VIUB_VIBCH | Q56646 |

Description: VIBRIOBACTIN UTILIZATION PROTEIN VIUB

| ORF Name | NTID | AAID | NT Length | AA Length | Score | Probability |
|---|---|---|---|---|---|---|
| 5328503_f2_289 | 669 | 4841 | 451 | 1356 | 726 | 1.0e-71 |
| Protein name | | | | | Locus Name | Acc# |
| | | | | | gp:STY224978 | AJ224978 |

Description: Salmonella typhimurium, Salmonella Pathogenicity Island 2 (SPI2) genes, ttr gene cluster.

| ORF Name | NTID | AAID | NT Length | AA Length | Score | Probability |
|---|---|---|---|---|---|---|
| 5345077_c2_948 | 670 | 4842 | 221 | 666 | 706 | 1.4e-69 |
| Protein name | | | | | Locus Name | Acc# |
| | | | | | sp:YBBL_ECOLI | P77279 |

Description

HYPOTHETICAL ABC TRANSPORTER ATP-BINDING PROTEIN YBBL

| ORF Name | NTID | AAID | NT Length | AA Length | Score | Probability |
|---|---|---|---|---|---|---|
| 5355217_f2_336 | 671 | 4843 | 679 | 2040 | 1974 | 5.8e-204 |
| Protein name | | | | | Locus Name | Acc# |
| probable iron-sulfur protein b1629:rnfC protein homolog b1629 | | | | | pir:G64919 | G64919 |

Description

| ORF Name | NTID | AAID | NT Length | AA Length | Score | Probability |
|---|---|---|---|---|---|---|
| 553842_c3_1006 | 672 | 4844 | 189 | 570 | 249 | 3.6e-21 |
| Protein name | | | | | Locus Name | Acc# |
| FimI precursor | | | | | gp:ECFIMCLUS | Z37500 |

Description

E.coli type 1 fimbriae, genes fimB, fimE, fimA, fimI, fimC.

| ORF Name | NTID | AAID | NT Length | AA Length | Score | Probability |
|---|---|---|---|---|---|---|
| 5859530_f2_358 | 673 | 4845 | 276 | 831 | 268 | 3.5e-23 |
| Protein name | | | | | Locus Name | Acc# |
| probable membrane protein yciC | | | | | pir:B64873 | B64873:S07 |

Description

| ORF Name | NTID | AAID | NT Length | AA Length | Score | Probability |
|---|---|---|---|---|---|---|
| 5892337_f3_437 | 674 | 4846 | 176 | 531 | 782 | 1.2e-77 |
| Protein name | | | | | Locus Name | Acc# |
| hcp | | | | | gp:AF044503 | AF044503 |

Description

Escherichia coli strain ec11 unknown (498), hcp gene, complete cds;and RhsG accessory genetic element VgrG protein, core component anddsORF-g1 genes, complete cds.

222

| ORF Name | NTID | AAID | NT Length | AA Length | Score | Probability |
|---|---|---|---|---|---|---|
| 5897962_c3_1181 | 675 | 4847 | 197 | 594 | 808 | 2.1e-80 |
| Protein name | | | | | Locus Name | Acc# |
| | | | | | sp:PTH_ECOLI | P23932 |

Description: PEPTIDYL-TRNA HYDROLASE, (PTH)

| ORF Name | NTID | AAID | NT Length | AA Length | Score | Probability |
|---|---|---|---|---|---|---|
| 5913443_c2_921 | 676 | 4848 | 212 | 639 | 114 | 1.2e-06 |
| Protein name | | | | | Locus Name | Acc# |
| hypothetical protein APE1062 | | | | | pir:G72705 | G72705 |

Description:

| ORF Name | NTID | AAID | NT Length | AA Length | Score | Probability |
|---|---|---|---|---|---|---|
| 5937700_f1_17 | 677 | 4849 | 261 | 786 | 732 | 2.4e-72 |
| Protein name | | | | | Locus Name | Acc# |
| Copper homeostasis protein CutC. | | | | | gp:D90829 | D90829:AB0 |

Description: E.coli genomic DNA, Kohara clone #337(41.9-42.3 min.).

| ORF Name | NTID | AAID | NT Length | AA Length | Score | Probability |
|---|---|---|---|---|---|---|
| 6016080_c2_828 | 678 | 4850 | 293 | 882 | 1062 | 2.5e-107 |
| Protein name | | | | | Locus Name | Acc# |
| | | | | | sp:PDXY_ECOLI | P77150 |

Description: PYRIDOXAMINE KINASE, (PM KINASE)

| ORF Name | NTID | AAID | NT Length | AA Length | Score | Probability |
|---|---|---|---|---|---|---|
| 6098250_c1_655 | 679 | 4851 | 360 | 1083 | 1093 | 1.3e-110 |
| Protein name | | | | | Locus Name | Acc# |
| | | | | | sp:SOHB_ECOLI | P24213:P77 |

Description: POSSIBLE PROTEASE SOHB,

| ORF_Name | NTID | AAID | NT Length | AA Length | Score | Probability |
|---|---|---|---|---|---|---|
| 6253_c2_886 | 680 | 4852 | 96 | 291 | 228 | 1.5e-18 |
| Protein name | | | | | Locus Name | Acc# |
| | | | | | sp:YIDY_ECOLI | P31462:P76 |

Description: HYPOTHETICAL 41.5 KD PROTEIN IN TNAB-BGLB INTERGENIC REGION

| ORF_Name | NTID | AAID | NT Length | AA Length | Score | Probability |
|---|---|---|---|---|---|---|
| 6439018_f2_257 | 681 | 4853 | 152 | 459 | 648 | 1.9e-63 |
| Protein name | | | | | Locus Name | Acc# |
| | | | | | sp:YCGN_ECOLI | P76005 |

Description: HYPOTHETICAL 17.9 KD PROTEIN IN MINC-SHEA INTERGENIC REGION

| ORF_Name | NTID | AAID | NT Length | AA Length | Score | Probability |
|---|---|---|---|---|---|---|
| 6441086_f3_525 | 682 | 4854 | 228 | 687 | 637 | 2.8e-62 |
| Protein name | | | | | Locus Name | Acc# |
| | | | | | sp:YEAS_ECOLI | P76249:O07 |

Description: HYPOTHETICAL 23.2 KD PROTEIN IN GAPA-RND INTERGENIC REGION

| ORF_Name | NTID | AAID | NT Length | AA Length | Score | Probability |
|---|---|---|---|---|---|---|
| 650883_c3_1034 | 683 | 4855 | 62 | 189 | | |
| Protein name | | | | | Locus Name | Acc# |

Description: NO-HIT

| ORF_Name | NTID | AAID | NT Length | AA Length | Score | Probability |
|---|---|---|---|---|---|---|
| 6642012_c3_1030 | 684 | 4856 | 479 | 1440 | 1466 | 3.9e-150 |
| Protein name | | | | | Locus Name | Acc# |
| | | | | | sp:DCEB_ECOLI | P28302:P76 |

Description: GLUTAMATE DECARBOXYLASE BETA, (GAD-BETA)

| ORF Name | NTID | AAID | NT Length | AA Length | Score | Probability |
|---|---|---|---|---|---|---|
| 665826_c2_880 | 685 | 4857 | 457 | 1374 | 1965 | 5.2e-203 |
| Protein name | | | | | Locus Name | Acc# |
| | | | | | sp:XYLA_ECOLI | P00944:P00 |

Description: XYLOSE ISOMERASE,

| ORF Name | NTID | AAID | NT Length | AA Length | Score | Probability |
|---|---|---|---|---|---|---|
| 6660887_f1_139 | 686 | 4858 | 232 | 699 | 532 | 3.7e-51 |
| Protein name | | | | | Locus Name | Acc# |
| | | | | | gp:ECU24203 | U24203 |

Description: Escherichia coli ECOR 52 (yciD) gene, partial cds, and (yciC),(yciB), (yciA), membrane protein (tonB), (yciI), putative potassiumchannel (kch), and cardiolipin synthase (cls) genes, complete cds.

| ORF Name | NTID | AAID | NT Length | AA Length | Score | Probability |
|---|---|---|---|---|---|---|
| 6757762_c2_913 | 687 | 4859 | 230 | 693 | 751 | 2.3e-74 |
| Protein name | | | | | Locus Name | Acc# |
| | | | | | sp:KDPE_ECOLI | P21866:P75 |

Description: KDP OPERON TRANSCRIPTIONAL REGULATORY PROTEIN KDPE

| ORF Name | NTID | AAID | NT Length | AA Length | Score | Probability |
|---|---|---|---|---|---|---|
| 6814503_c2_840 | 688 | 4860 | 309 | 930 | 943 | 1.0e-94 |
| Protein name | | | | | Locus Name | Acc# |
| | | | | | sp:YCIV_ECOLI | P77766 |

Description: HYPOTHETICAL 32.6 KD PROTEIN IN TRPL-BTUR INTERGENIC REGION

| ORF Name | NTID | AAID | NT Length | AA Length | Score | Probability |
|---|---|---|---|---|---|---|
| 6822942_c2_826 | 689 | 4861 | 91 | 276 | 186 | 1.7e-14 |
| Protein name | | | | | Locus Name | Acc# |
| unknown | | | | | gp:AF168597 | AF168597 |

Description

Serratia sp. ATCC39006 Rap (rap) and outer membrane lipoprotein Pcp(pcp) genes, complete cds; and unknown gene.

| ORF Name | NTID | AAID | NT Length | AA Length | Score | Probability |
|---|---|---|---|---|---|---|
| 6828593_c3_1014 | 690 | 4862 | 419 | 1260 | 1816 | 3.2e-187 |
| Protein name | | | | | Locus Name | Acc# |
| | | | | | sp:CODB_ECOLI | P25525 |

Description

CYTOSINE PERMEASE

| ORF Name | NTID | AAID | NT Length | AA Length | Score | Probability |
|---|---|---|---|---|---|---|
| 6835761_c2_841 | 691 | 4863 | 214 | 645 | 869 | 7.2e-87 |
| Protein name | | | | | Locus Name | Acc# |
| probable translation factor yciO | | | | | pir:F64874 | F64874 |

Description

| ORF Name | NTID | AAID | NT Length | AA Length | Score | Probability |
|---|---|---|---|---|---|---|
| 6836706_c1_596 | 692 | 4864 | 237 | 714 | | |
| Protein name | | | | | Locus Name | Acc# |

Description

NO-HIT

| ORF Name | NTID | AAID | NT Length | AA Length | Score | Probability |
|---|---|---|---|---|---|---|
| 6928842_f2_379 | 693 | 4865 | 348 | 1047 | 1493 | 5.4e-153 |
| Protein name | | | | | Locus Name | Acc# |
| purine nucleotide synthesis repressor | | | | | gp:AF040636 | AF040636 |

Description

Salmonella typhimurium purine nucleotide synthesis repressor (purR)gene, complete cds.

| ORF Name | NTID | AAID | NT Length | AA Length | Score | Probability |
|---|---|---|---|---|---|---|
| 7032556_f1_180 | 694 | 4866 | 323 | 972 | 808 | 2.1e-80 |
| Protein name | | | | | Locus Name | Acc# |
| hemV protein | | | | | pir:S54440 | S54440 |

Description: hemV protein

| ORF Name | NTID | AAID | NT Length | AA Length | Score | Probability |
|---|---|---|---|---|---|---|
| 7033176_c2_959 | 695 | 4867 | 286 | 861 | 1005 | 2.8e-101 |
| Protein name | | | | | Locus Name | Acc# |
| | | | | | sp:ZNUB_ECOLI | P39832:P76 |

Description: HIGH-AFFINITY ZINC UPTAKE SYSTEM MEMBRANE PROTEIN ZNUB

| ORF Name | NTID | AAID | NT Length | AA Length | Score | Probability |
|---|---|---|---|---|---|---|
| 7069076_c1_774 | 696 | 4868 | 103 | 312 | 253 | 1.4e-21 |
| Protein name | | | | | Locus Name | Acc# |
| | | | | | sp:LOLB_ECOLI | P24208:Q46 |

Description: OUTER MEMBRANE LIPOPROTEIN LOLB PRECURSOR

| ORF Name | NTID | AAID | NT Length | AA Length | Score | Probability |
|---|---|---|---|---|---|---|
| 7129643_c3_1168 | 697 | 4869 | 579 | 1740 | 2350 | 8.3e-244 |
| Protein name | | | | | Locus Name | Acc# |
| | | | | | sp:SYR_ECOLI | P11875 |

Description: ARGINYL-TRNA SYNTHETASE, (ARGININE--TRNA LIGASE) (ARGRS)

| ORF Name | NTID | AAID | NT Length | AA Length | Score | Probability |
|---|---|---|---|---|---|---|
| 7220063_f3_513 | 698 | 4870 | 202 | 609 | 745 | 9.9e-74 |
| Protein name | | | | | Locus Name | Acc# |
| | | | | | sp:BTUR_SALTY | P31570 |

Description: ADENOSYLTRANSFERASE) (CORRINOID ADOTRANSFERASE ACTIVITY)

| ORF Name | NTID | AAID | NT Length | AA Length | Score | Probability |
|---|---|---|---|---|---|---|
| 7220301_f1_107 | 699 | 4871 | 315 | 948 | 798 | 2.4e-79 |
| Protein name | | | | | Locus Name | Acc# |
| | | | | | sp:TUS_ECOLI | P16525 |

Description: BINDING PROTEIN)

| ORF Name | NTID | AAID | NT Length | AA Length | Score | Probability |
|---|---|---|---|---|---|---|
| 7225002_f1_209 | 700 | 4872 | 243 | 732 | 481 | 9.4e-46 |
| Protein name | | | | | Locus Name | Acc# |
| oligopeptide transport ATP-binding protein homolog ykfD | | | | | pir:B69856 | B69856 |

Description

| ORF Name | NTID | AAID | NT Length | AA Length | Score | Probability |
|---|---|---|---|---|---|---|
| 7234762_f1_9 | 701 | 4873 | 140 | 423 | | |
| Protein name | | | | | Locus Name | Acc# |

Description: NO-HIT

| ORF Name | NTID | AAID | NT Length | AA Length | Score | Probability |
|---|---|---|---|---|---|---|
| 7236566_f2_295 | 702 | 4874 | 132 | 399 | 165 | 3.1e-11 |
| Protein name | | | | | Locus Name | Acc# |
| | | | | | gp:NGOSUCAB | L36381 |

Description: Neisseria gonorrhoeae sucAB-lpd operon, sucB and lpd genes, complete cds, sucA gene partial cds and IS-150-like element 3' end.

| ORF Name | NTID | AAID | NT Length | AA Length | Score | Probability |
|---|---|---|---|---|---|---|
| 7241000_f1_59 | 703 | 4875 | 94 | 285 | 324 | 4.1e-29 |
| Protein name | | | | | Locus Name | Acc# |
| transposase OrfA | | | | | gp:AF034211 | AF034211 |

Description: Desulfovibrio vulgaris vulgaris insertion sequence ISD1 transposase gene, complete cds.

| ORF_Name | NTID | AAID | NT Length | AA Length | Score | Probability |
|---|---|---|---|---|---|---|
| 781301_c2_961 | 704 | 4876 | 65 | 198 | 171 | 1.0e-12 |
| Protein name | | | | | Locus Name | Acc# |
| | | | | | sp:T150_ECOLI | P19769 |

Description
PUTATIVE TRANSPOSASE FOR INSERTION SEQUENCE IS150

| ORF_Name | NTID | AAID | NT Length | AA Length | Score | Probability |
|---|---|---|---|---|---|---|
| 782812_c2_890 | 705 | 4877 | 63 | 192 | | |
| Protein name | | | | | Locus Name | Acc# |

Description
NO-HIT

| ORF_Name | NTID | AAID | NT Length | AA Length | Score | Probability |
|---|---|---|---|---|---|---|
| 790687_f2_279 | 706 | 4878 | 63 | 192 | 73 | 0.042 |
| Protein name | | | | | Locus Name | Acc# |
| hypothetical protein F23F1.16 | | | | | pir:T02493 | T02493 |

Description

| ORF_Name | NTID | AAID | NT Length | AA Length | Score | Probability |
|---|---|---|---|---|---|---|
| 796928_c3_1105 | 707 | 4879 | 142 | 429 | 143 | 6.2e-10 |
| Protein name | | | | | Locus Name | Acc# |
| | | | | | gp:BBU45425 | U45425 |

Description
Borrelia burgdorferi 2.9-5 locus, ORF-A-D, REP+, REP-, and lipoprotein (LP) genes, complete cds.

| ORF_Name | NTID | AAID | NT Length | AA Length | Score | Probability |
|---|---|---|---|---|---|---|
| 797155_c2_793 | 708 | 4880 | 570 | 1713 | 2391 | 3.8e-248 |
| Protein name | | | | | Locus Name | Acc# |
| | | | | | sp:BETA_ECOLI | P17444:P77 |

Description
CHOLINE DEHYDROGENASE, (CHD)

229

| ORF Name | NTID | AAID | NT Length | AA Length | Score | Probability |
|---|---|---|---|---|---|---|
| 807813_f2_397 | 709 | 4881 | 104 | 315 | 184 | 2.8e-14 |
| Protein name | | | | | Locus Name | Acc# |
| | | | | | sp:YECF_ECOLI | P46120:P76 |

Description
HYPOTHETICAL 8.2 KD PROTEIN IN UVRY-SDIA INTERGENIC REGION

| ORF Name | NTID | AAID | NT Length | AA Length | Score | Probability |
|---|---|---|---|---|---|---|
| 812827_f3_493 | 710 | 4882 | 249 | 750 | 910 | 3.3e-91 |
| Protein name | | | | | Locus Name | Acc# |
| | | | | | sp:YDFG_ECOLI | P39831:P77 |

Description
PROBABLE OXIDOREDUCTASE IN DCP-NOHA INTERGENIC REGION,

| ORF Name | NTID | AAID | NT Length | AA Length | Score | Probability |
|---|---|---|---|---|---|---|
| 818805_f2_266 | 711 | 4883 | 70 | 213 | 73 | 0.016 |
| Protein name | | | | | Locus Name | Acc# |
| hypothetical protein 126 (rps12 3' region) | | | | | pir:S49604 | S49604 |

Description

| ORF Name | NTID | AAID | NT Length | AA Length | Score | Probability |
|---|---|---|---|---|---|---|
| 820301_c2_945 | 712 | 4884 | 833 | 2502 | 750 | 2.9e-74 |
| Protein name | | | | | Locus Name | Acc# |
| | | | | | sp:YRAJ_ECOLI | P42915 |

Description
REGION PRECURSOR

| ORF Name | NTID | AAID | NT Length | AA Length | Score | Probability |
|---|---|---|---|---|---|---|
| 834378_f1_45 | 713 | 4885 | 68 | 207 | | |
| Protein name | | | | | Locus Name | Acc# |

Description
NO-HIT

| ORF_Name | NTID | AAID | NT Length | AA Length | Score | Probability |
|---|---|---|---|---|---|---|
| 834691_c1_722 | 714 | 4886 | 803 | 2412 | 749 | 3.7e-74 |
| Protein name | | | | | Locus Name | Acc# |
| | | | | | sp:YRAJ_ECOLI | P42915 |

Description: REGION PRECURSOR

| ORF_Name | NTID | AAID | NT Length | AA Length | Score | Probability |
|---|---|---|---|---|---|---|
| 836000_f3_568 | 715 | 4887 | 166 | 501 | 202 | 3.5e-16 |
| Protein name | | | | | Locus Name | Acc# |
| | | | | | sp:Y866_METJA | Q58276 |

Description: HYPOTHETICAL HIT-LIKE PROTEIN MJ0866

| ORF_Name | NTID | AAID | NT Length | AA Length | Score | Probability |
|---|---|---|---|---|---|---|
| 836687_c3_1039 | 716 | 4888 | 115 | 348 | | |
| Protein name | | | | | Locus Name | Acc# |

Description: NO-HIT

| ORF_Name | NTID | AAID | NT Length | AA Length | Score | Probability |
|---|---|---|---|---|---|---|
| 836701_c3_1001 | 717 | 4889 | 551 | 1656 | 2091 | 2.3e-216 |
| Protein name | | | | | Locus Name | Acc# |
| | | | | | sp:OPPA_SALTY | P06202 |

Description: PERIPLASMIC OLIGOPEPTIDE-BINDING PROTEIN PRECURSOR

| ORF_Name | NTID | AAID | NT Length | AA Length | Score | Probability |
|---|---|---|---|---|---|---|
| 839425_c3_992 | 718 | 4890 | 344 | 1035 | 670 | 8.8e-66 |
| Protein name | | | | | Locus Name | Acc# |
| ExpM protein | | | | | gp:ECJ224437 | AJ224437 |

Description: Erwinia carotovora subsp. carotovora expL, expM, and galU genes.

| ORF_Name | NTID | AAID | NT Length | AA Length | Score | Probability |
|---|---|---|---|---|---|---|
| 865630_f3_533 | 719 | 4891 | 605 | 1818 | 1999 | 1.3e-206 |
| Protein name | | | | | Locus Name | Acc# |
| | | | | | sp:SAPA_ECOLI | O47622;P77 |

Description: PEPTIDE TRANSPORT PERIPLASMIC PROTEIN SAPA PRECURSOR

| ORF_Name | NTID | AAID | NT Length | AA Length | Score | Probability |
|---|---|---|---|---|---|---|
| 869058_f2_303 | 720 | 4892 | 199 | 600 | 153 | 5.4e-11 |
| Protein name | | | | | Locus Name | Acc# |
| hypothetical protein PAB0976 | | | | | pir:D75059 | D75059 |

Description

| ORF_Name | NTID | AAID | NT Length | AA Length | Score | Probability |
|---|---|---|---|---|---|---|
| 878425_f1_127 | 721 | 4893 | 61 | 186 | | |
| Protein name | | | | | Locus Name | Acc# |

Description: NO-HIT

| ORF_Name | NTID | AAID | NT Length | AA Length | Score | Probability |
|---|---|---|---|---|---|---|
| 892001_f2_335 | 722 | 4894 | 224 | 675 | 854 | 2.8e-85 |
| Protein name | | | | | Locus Name | Acc# |
| probable membrane protein b1627 | | | | | pir:E64919 | E64919 |

Description

| ORF_Name | NTID | AAID | NT Length | AA Length | Score | Probability |
|---|---|---|---|---|---|---|
| 963885_c2_831 | 723 | 4895 | 536 | 1611 | 1608 | 3.5e-165 |
| Protein name | | | | | Locus Name | Acc# |
| regulatory protein TyrR | | | | | gp:AF035010 | AF035010 |

Description: Erwinia herbicola regulatory protein TyrR (tyrR) gene, completecds.

| ORF Name | NTID | AAID | NT Length | AA Length | Score | Probability |
|---|---|---|---|---|---|---|
| 970327_f2_403 | 724 | 4896 | 688 | 2067 | 2754 | 1.3e-286 |
| Protein name | | | | | Locus Name | Acc# |
| | | | | | sp:BETT_ECOLI | P17447 |

Description
HIGH-AFFINITY CHOLINE TRANSPORT PROTEIN

| ORF Name | NTID | AAID | NT Length | AA Length | Score | Probability |
|---|---|---|---|---|---|---|
| 978425_f2_334 | 725 | 4897 | 156 | 471 | 256 | 6.5e-22 |
| Protein name | | | | | Locus Name | Acc# |
| probable membrane protein b1626 | | | | | pir:D64919 | D64919 |

Description

| ORF Name | NTID | AAID | NT Length | AA Length | Score | Probability |
|---|---|---|---|---|---|---|
| 979052_c2_821 | 726 | 4898 | 65 | 198 | | |
| Protein name | | | | | Locus Name | Acc# |

Description
NO-HIT

| ORF Name | NTID | AAID | NT Length | AA Length | Score | Probability |
|---|---|---|---|---|---|---|
| 985376_f2_226 | 727 | 4899 | 158 | 477 | 414 | 1.2e-38 |
| Protein name | | | | | Locus Name | Acc# |
| | | | | | sp:YCDW_ECOLI | P75913 |

Description
PUTATIVE 2-HYDROXYACID DEHYDROGENASE IN PHOH-CSGG INTERGENIC REGION

| ORF Name | NTID | AAID | NT Length | AA Length | Score | Probability |
|---|---|---|---|---|---|---|
| 9881552_f1_61 | 728 | 4900 | 176 | 531 | 97 | 0.00049 |
| Protein name | | | | | Locus Name | Acc# |
| conserved hypothetical protein yjcF | | | | | pir:F69846 | F69846 |

Description

| ORF Name | NTID | AAID | NT Length | AA Length | Score | Probability |
|---|---|---|---|---|---|---|
| 9954127_f3_557 | 729 | 4901 | 299 | 900 | 1029 | 8.0e-104 |
| Protein name | | | | | Locus Name | Acc# |
| | | | | | sp:YDIA_ECOLI | P03822:P46 |

Description
HYPOTHETICAL 31.2 KD PROTEIN IN PPSA-AROH INTERGENIC REGION

| ORF Name | NTID | AAID | NT Length | AA Length | Score | Probability |
|---|---|---|---|---|---|---|
| 10345050_c1_251 | 730 | 4902 | 81 | 246 | | |
| Protein name | | | | | Locus Name | Acc# |

Description
NO-HIT

| ORF Name | NTID | AAID | NT Length | AA Length | Score | Probability |
|---|---|---|---|---|---|---|
| 1037_f2_130 | 731 | 4903 | 163 | 492 | 323 | 5.2e-29 |
| Protein name | | | | | Locus Name | Acc# |
| | | | | | sp:PPDD_ECOLI | P36647 |

Description
PREPILIN PEPTIDASE DEPENDENT PROTEIN D PRECURSOR

| ORF Name | NTID | AAID | NT Length | AA Length | Score | Probability |
|---|---|---|---|---|---|---|
| 10398911_f2_73 | 732 | 4904 | 97 | 294 | 72 | 0.020 |
| Protein name | | | | | Locus Name | Acc# |
| hypothetical protein orf 00958 | | | | | pir:S57388 | S57388:S50 |

Description

| ORF Name | NTID | AAID | NT Length | AA Length | Score | Probability |
|---|---|---|---|---|---|---|
| 10440887_c1_209 | 733 | 4905 | 73 | 222 | | |
| Protein name | | | | | Locus Name | Acc# |

Description
NO-HIT

| ORF Name | NTID | AAID | NT Length | AA Length | Score | Probability |
|---|---|---|---|---|---|---|
| 10548125_f3_141 | 734 | 4906 | 80 | 243 | | |
| Protein name | | | | | Locus Name | Acc# |
| | | | | | | |

Description: NO-HIT

| ORF Name | NTID | AAID | NT Length | AA Length | Score | Probability |
|---|---|---|---|---|---|---|
| 10681561_f3_148 | 735 | 4907 | 80 | 243 | 260 | 2.5e-22 |
| Protein name | | | | | Locus Name | Acc# |
| | | | | | sp:YECH_ECOLI | P46887 |

Description: HYPOTHETICAL 8.6 KD PROTEIN IN FTN-TYRP INTERGENIC REGION

| ORF Name | NTID | AAID | NT Length | AA Length | Score | Probability |
|---|---|---|---|---|---|---|
| 1073251_c1_234 | 736 | 4908 | 684 | 2055 | 580 | 1.2e-107 |
| Protein name | | | | | Locus Name | Acc# |
| | | | | | sp:IRGA_VIBCH | P27772 |

Description: IRON-REGULATED OUTER MEMBRANE VIRULENCE PROTEIN PRECURSOR

| ORF Name | NTID | AAID | NT Length | AA Length | Score | Probability |
|---|---|---|---|---|---|---|
| 10758437_c3_377 | 737 | 4909 | 131 | 396 | 466 | 3.7e-44 |
| Protein name | | | | | Locus Name | Acc# |
| Sty SBLI | | | | | gp:SEHSD | X99719 |

Description: S.enterica hsdM, hsdS & hsdR genes.

| ORF Name | NTID | AAID | NT Length | AA Length | Score | Probability |
|---|---|---|---|---|---|---|
| 128562_f1_67 | 738 | 4910 | 63 | 192 | | |
| Protein name | | | | | Locus Name | Acc# |
| | | | | | | |

Description: NO-HIT

| ORF_Name | NTID | AAID | NT Length | AA Length | Score | Probability |
|---|---|---|---|---|---|---|
| 133437_f1_63 | 739 | 4911 | 371 | 1116 | 836 | 2.9e-87 |
| Protein name | | | | | Locus Name | Acc# |
| | | | | | gp:ECOAMPHSM | L28105 |

Description

Escherichia coli ampD gene; quinolinate phosphoribosyltransferase(nadC) gene; prepilin-like peptidase dependent protein (ppdD) gene;hopB, hopC genes; GMP reductase (guaC) gene.

| ORF_Name | NTID | AAID | NT Length | AA Length | Score | Probability |
|---|---|---|---|---|---|---|
| 14079837_f3_163 | 740 | 4912 | 180 | 543 | | |
| Protein name | | | | | Locus Name | Acc# |

Description

NO-HIT

| ORF_Name | NTID | AAID | NT Length | AA Length | Score | Probability |
|---|---|---|---|---|---|---|
| 14226093_c2_269 | 741 | 4913 | 127 | 384 | 346 | 1.9e-31 |
| Protein name | | | | | Locus Name | Acc# |
| yacL protein | | | | | pir:G64734 | G64734 |

Description

| ORF_Name | NTID | AAID | NT Length | AA Length | Score | Probability |
|---|---|---|---|---|---|---|
| 14485927_c1_239 | 742 | 4914 | 66 | 201 | | |
| Protein name | | | | | Locus Name | Acc# |

Description

NO-HIT

| ORF_Name | NTID | AAID | NT Length | AA Length | Score | Probability |
|---|---|---|---|---|---|---|
| 14495187_c3_327 | 743 | 4915 | 897 | 2694 | 4135 | 0.0 |
| Protein name | | | | | Locus Name | Acc# |
| pyruvate dehydrogenase (lipoamide),:pyruvate dehydrogenase complex component E1 | | | | | pir:DEECPV | B64734:A30 |

Description

| ORF Name | NTID | AAID | NT Length | AA Length | Score | Probability |
|---|---|---|---|---|---|---|
| 14642182_f3_185 | 744 | 4916 | 272 | 819 | 709 | 6.5e-70 |
| Protein name | | | | | Locus Name | Acc# |
| | | | | | sp:YACF_ECOLI | P36680:P75 |

Description: HYPOTHETICAL 28.3 KD PROTEIN IN MUTT-GUAC INTERGENIC REGION

| ORF Name | NTID | AAID | NT Length | AA Length | Score | Probability |
|---|---|---|---|---|---|---|
| 14650062_c2_298 | 745 | 4917 | 374 | 1125 | | |
| Protein name | | | | | Locus Name | Acc# |

Description: NO-HIT

| ORF Name | NTID | AAID | NT Length | AA Length | Score | Probability |
|---|---|---|---|---|---|---|
| 14650312_f2_72 | 746 | 4918 | 120 | 363 | | |
| Protein name | | | | | Locus Name | Acc# |

Description: NO-HIT

| ORF Name | NTID | AAID | NT Length | AA Length | Score | Probability |
|---|---|---|---|---|---|---|
| 14651512_f2_99 | 747 | 4919 | 254 | 765 | 133 | 1.5e-06 |
| Protein name | | | | | Locus Name | Acc# |
| ExsD | | | | | gp:PAU56077 | U56077 |

Description: Pseudomonas aeruginosa exoenzyme S secretion (psc) locus, exsD, pscB, pscC, pscD, pscE, pscF, pscG, pscH, pscI, pscJ, pscK and pscLgenes, complete cds.

| ORF Name | NTID | AAID | NT Length | AA Length | Score | Probability |
|---|---|---|---|---|---|---|
| 14878160_c2_284 | 748 | 4920 | 71 | 216 | | |
| Protein name | | | | | Locus Name | Acc# |

Description: NO-HIT

| ORF Name | NTID | AAID | NT Length | AA Length | Score | Probability |
|---|---|---|---|---|---|---|
| 14963437_c2_278 | 749 | 4921 | 155 | 468 | 259 | 3.1e-22 |
| Protein name | | | | | Locus Name | Acc# |
| | | | | | sp:YGFX_ECOLI | Q46824 |

Description
HYPOTHETICAL 16.1 KD PROTEIN IN FLDB-BGLA INTERGENIC REGION

| ORF Name | NTID | AAID | NT Length | AA Length | Score | Probability |
|---|---|---|---|---|---|---|
| 16408390_f1_58 | 750 | 4922 | 67 | 204 | | |
| Protein name | | | | | Locus Name | Acc# |

Description
NO-HIT

| ORF Name | NTID | AAID | NT Length | AA Length | Score | Probability |
|---|---|---|---|---|---|---|
| 16598436_f1_18 | 751 | 4923 | 141 | 426 | 264 | 9.3e-23 |
| Protein name | | | | | Locus Name | Acc# |
| hypothetical protein | | | | | pir:H75473 | H75473 |

Description

| ORF Name | NTID | AAID | NT Length | AA Length | Score | Probability |
|---|---|---|---|---|---|---|
| 16797813_f1_47 | 752 | 4924 | 464 | 1395 | 993 | 5.2e-100 |
| Protein name | | | | | Locus Name | Acc# |
| RtxD protein | | | | | gp:AF119150 | AF119150 |

Description
Vibrio cholerae Rtx toxin gene cluster, complete cds.

| ORF Name | NTID | AAID | NT Length | AA Length | Score | Probability |
|---|---|---|---|---|---|---|
| 16835930_f3_139 | 753 | 4925 | 278 | 837 | 685 | 2.3e-67 |
| Protein name | | | | | Locus Name | Acc# |
| | | | | | sp:YKGG_ECOLI | P77433 |

Description
HYPOTHETICAL 31.1 KD PROTEIN IN EAEH-BETA INTERGENIC REGION

| ORF Name | NTID | AAID | NT Length | AA Length | Score | Probability |
|---|---|---|---|---|---|---|
| 187806_f2_97 | 754 | 4926 | 140 | 423 | 417 | 5.7e-39 |
| Protein name | | | | | Locus Name | Acc# |
| hypothetical protein | | | | | gp:PMAJ84 | AJ000084 |

Description: Proteus mirabilis ccm and pat genes and partial ygbA gene.

| ORF Name | NTID | AAID | NT Length | AA Length | Score | Probability |
|---|---|---|---|---|---|---|
| 194461_c1_240 | 755 | 4927 | 150 | 453 | 668 | 1.4e-65 |
| Protein name | | | | | Locus Name | Acc# |
| UmoC | | | | | gp:PMU66823 | U66823 |

Description: Proteus mirabilis UmoC (umoC) gene, complete cds; and unknown gene.

| ORF Name | NTID | AAID | NT Length | AA Length | Score | Probability |
|---|---|---|---|---|---|---|
| 19562767_f1_11 | 756 | 4928 | 242 | 729 | 107 | 0.00036 |
| Protein name | | | | | Locus Name | Acc# |
| long polar fimbrial major protein precursor | | | | | pir:A56271 | A56271 |

Description:

| ORF Name | NTID | AAID | NT Length | AA Length | Score | Probability |
|---|---|---|---|---|---|---|
| 19564410_c1_225 | 757 | 4929 | 96 | 291 | 173 | 4.1e-13 |
| Protein name | | | | | Locus Name | Acc# |
| | | | | | sp:YR7F_ECOLI | P21320 |

Description: HYPOTHETICAL 11.9 KD PROTEIN (ORFF) (RETRON EC67)

| ORF Name | NTID | AAID | NT Length | AA Length | Score | Probability |
|---|---|---|---|---|---|---|
| 19713591_c1_249 | 758 | 4930 | 418 | 1257 | 1659 | 1.4e-170 |
| Protein name | | | | | Locus Name | Acc# |
| Sty SBLI | | | | | gp:SEHSD | X99719 |

Description: S.enterica hsdM, hsdS & hsdR genes.

| ORF Name | NTID | AAID | NT Length | AA Length | Score | Probability |
|---|---|---|---|---|---|---|
| 2117890_c1_219 | 759 | 4931 | 62 | 189 | | |
| Protein name | | | | | Locus Name | Acc# |
| | | | | | | |

Description
NO-HIT

| ORF Name | NTID | AAID | NT Length | AA Length | Score | Probability |
|---|---|---|---|---|---|---|
| 21524177_c2_280 | 760 | 4932 | 239 | 720 | 542 | 3.2e-52 |
| Protein name | | | | | Locus Name | Acc# |
| | | | | | sp:DSBC_ECOLI | P21892 |

Description
THIOL:DISULFIDE INTERCHANGE PROTEIN DSBC PRECURSOR

| ORF Name | NTID | AAID | NT Length | AA Length | Score | Probability |
|---|---|---|---|---|---|---|
| 22273452_f3_184 | 761 | 4933 | 399 | 1200 | 526 | 1.6e-50 |
| Protein name | | | | | Locus Name | Acc# |
| | | | | | sp:HOFC_ECOLI | P36646:P75 |

Description
PROTEIN TRANSPORT PROTEIN HOFC

| ORF Name | NTID | AAID | NT Length | AA Length | Score | Probability |
|---|---|---|---|---|---|---|
| 22445135_f1_66 | 762 | 4934 | 85 | 258 | 257 | 5.1e-22 |
| Protein name | | | | | Locus Name | Acc# |
| yacG protein | | | | | pir:E64732 | E64732 |

Description

| ORF Name | NTID | AAID | NT Length | AA Length | Score | Probability |
|---|---|---|---|---|---|---|
| 22551026_c3_329 | 763 | 4935 | 485 | 1458 | 2251 | 2.6e-233 |
| Protein name | | | | | Locus Name | Acc# |
| dihydrolipoamide dehydrogenase,:2-oxoglutarate dehydrogenase | | | | | pir:DEECLP | S45195:D64 |

Description

| ORF Name | NTID | AAID | NT Length | AA Length | Score | Probability |
|---|---|---|---|---|---|---|
| 23439135_c3_325 | 764 | 4936 | 191 | 576 | 686 | 1.8e-67 |
| Protein name | | | | | Locus Name | Acc# |
| | | | | | sp:AMPD_ECOLI | P13016 |

Description
AMPD PROTEIN

| ORF Name | NTID | AAID | NT Length | AA Length | Score | Probability |
|---|---|---|---|---|---|---|
| 23492202_f1_16 | 765 | 4937 | 239 | 720 | 924 | 1.1e-92 |
| Protein name | | | | | Locus Name | Acc# |
| | | | | | sp:YKGE_ECOLI | P77252 |

Description
HYPOTHETICAL 26.0 KD PROTEIN IN EAEH-BETA INTERGENIC REGION

| ORF Name | NTID | AAID | NT Length | AA Length | Score | Probability |
|---|---|---|---|---|---|---|
| 23540707_c2_264 | 766 | 4938 | 108 | 327 | 150 | 2.9e-10 |
| Protein name | | | | | Locus Name | Acc# |
| putative auxin down-regulated protein | | | | | gp:ATAC006429 | AC006429 |

Description
Arabidopsis thaliana chromosome II BAC F15K19 genomic sequence, complete sequence.

| ORF Name | NTID | AAID | NT Length | AA Length | Score | Probability |
|---|---|---|---|---|---|---|
| 23595640_c3_343 | 767 | 4939 | 264 | 795 | 618 | 2.9e-60 |
| Protein name | | | | | Locus Name | Acc# |
| putative 26 kDa protein | | | | | gp:AF037440 | AF037440 |

Description
Edwardsiella ictaluri D-3-phosphoglycerate dehydrogenase (serA) gene, partial cds; ribose-5-phosphate isomerase (rpiA), inhibitor of chromosome initiation (iciA), putative 26 kDa protein (yggE), putative 30.6 kDa protein (yggB), and fructose 1,6-bisphosphate aldolase (fda) genes, complete cds; and phosphoglycerate kinase (pgk) gene, partial cds.

| ORF Name | NTID | AAID | NT Length | AA Length | Score | Probability |
|---|---|---|---|---|---|---|
| 23600035_f3_150 | 768 | 4940 | 287 | 864 | 633 | 7.3e-62 |
| Protein name | | | | Locus Name | | Acc# |
| | | | | sp:VIRF_YEREN | | P13225 |

Description: VIRULENCE REGULON TRANSCRIPTIONAL ACTIVATOR

| ORF Name | NTID | AAID | NT Length | AA Length | Score | Probability |
|---|---|---|---|---|---|---|
| 23616316_c3_356 | 769 | 4941 | 436 | 1311 | 243 | 7.0e-17 |
| Protein name | | | | Locus Name | | Acc# |
| interaptin | | | | pir:T14867 | | T14867 |

Description:

| ORF Name | NTID | AAID | NT Length | AA Length | Score | Probability |
|---|---|---|---|---|---|---|
| 23628136_c2_258 | 770 | 4942 | 272 | 819 | 1005 | 2.8e-101 |
| Protein name | | | | Locus Name | | Acc# |
| | | | | sp:PDHR_ECOLI | | P06957 |

Description: PYRUVATE DEHYDROGENASE COMPLEX REPRESSOR

| ORF Name | NTID | AAID | NT Length | AA Length | Score | Probability |
|---|---|---|---|---|---|---|
| 23632838_f2_118 | 771 | 4943 | 715 | 2148 | 1349 | 9.8e-138 |
| Protein name | | | | Locus Name | | Acc# |
| | | | | sp:HLYB_ECOLI | | P08716 |

Description: HEMOLYSIN SECRETION ATP-BINDING PROTEIN, PLASMID

| ORF Name | NTID | AAID | NT Length | AA Length | Score | Probability |
|---|---|---|---|---|---|---|
| 23650277_f2_101 | 772 | 4944 | 70 | 213 | | |
| Protein name | | | | Locus Name | | Acc# |

Description: NO-HIT

242

| ORF Name | NTID | AAID | NT Length | AA Length | Score | Probability |
|---|---|---|---|---|---|---|
| 24005027_c3_341 | 773 | 4945 | 308 | 927 | 959 | 2.1e-96 |

| Protein name | | | | | Locus Name | Acc# |
|---|---|---|---|---|---|---|
| putative 30.6 kDa protein | | | | | gp:AF037440 | AF037440 |

Description

Edwardsiella ictaluri D-3-phosphoglycerate dehydrogenase (serA)gene, partial cds; ribose-5-phosphate isomerase (rpiA), inhibitorof chromosome initiation (iciA), putative 26 kDa protein (yggE),putative 30.6 kDa protein (yggB), and fructose 1,6-bisphosphatealdolase (fda) genes, complete cds; and phosphoglycerate kinase(pgk) gene, partial cds.

| ORF Name | NTID | AAID | NT Length | AA Length | Score | Probability |
|---|---|---|---|---|---|---|
| 24015893_c1_243 | 774 | 4946 | 76 | 231 | | |

| Protein name | | | | | Locus Name | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24259686_c2_287 | 775 | 4947 | 218 | 657 | 494 | 3.9e-47 |

| Protein name | | | | | Locus Name | Acc# |
|---|---|---|---|---|---|---|
| | | | | | sp:YIJF_ECOLI | P32668 |

Description (F205)

| ORF Name | NTID | AAID | NT Length | AA Length | Score | Probability |
|---|---|---|---|---|---|---|
| 24304637_c3_359 | 776 | 4948 | 345 | 1038 | 1141 | 1.1e-115 |

| Protein name | | | | | Locus Name | Acc# |
|---|---|---|---|---|---|---|
| | | | | | sp:GALE_SALTI | Q56093 |

Description

GALACTOSE 4-EPIMERASE)

| ORF Name | NTID | AAID | NT Length | AA Length | Score | Probability |
|---|---|---|---|---|---|---|
| 24344062_f3_138 | 777 | 4949 | 518 | 1557 | 974 | 5.4e-98 |

| Protein name | | | | | Locus Name | Acc# |
|---|---|---|---|---|---|---|
| L-lactate permease (lctP) homolog | | | | | pir:C70175 | C70175 |

Description

| ORF_Name | NTID | AAID | NT Length | AA Length | Score | Probability |
|---|---|---|---|---|---|---|
| 2437757_c1_210 | 778 | 4950 | 204 | 615 | 511 | 6.2e-49 |
| Protein name | | | | | Locus Name | Acc# |
| | | | | | sp:YGFB_ECOLI | P25533 |

Description (F194)

| ORF_Name | NTID | AAID | NT Length | AA Length | Score | Probability |
|---|---|---|---|---|---|---|
| 24412832_f2_83 | 779 | 4951 | 60 | 183 | | |
| Protein name | | | | | Locus Name | Acc# |

Description

NO-HIT

| ORF_Name | NTID | AAID | NT Length | AA Length | Score | Probability |
|---|---|---|---|---|---|---|
| 24432715_c1_212 | 780 | 4952 | 400 | 1203 | 1206 | 1.4e-122 |
| Protein name | | | | | Locus Name | Acc# |
| probable 2-octaprenyl-6-methoxyphenol 4-monoxygenase, ubiH:visB protein | | | | | pir:C65075 | C65075:C47 |

Description

| ORF_Name | NTID | AAID | NT Length | AA Length | Score | Probability |
|---|---|---|---|---|---|---|
| 245878_c1_250 | 781 | 4953 | 141 | 426 | | |
| Protein name | | | | | Locus Name | Acc# |

Description

NO-HIT

| ORF_Name | NTID | AAID | NT Length | AA Length | Score | Probability |
|---|---|---|---|---|---|---|
| 2468750_c2_294 | 782 | 4954 | 220 | 663 | 655 | 3.4e-64 |
| Protein name | | | | | Locus Name | Acc# |
| drug activity modulator B | | | | | pir:C64084 | C64084 |

Description

| ORF Name | NTID | AAID | NT Length | AA Length | Score | Probability |
|---|---|---|---|---|---|---|
| 24798550_c2_293 | 783 | 4955 | 62 | 189 | | |
| Protein name | | | | | Locus Name | Acc# |

Description: NO-HIT

| ORF Name | NTID | AAID | NT Length | AA Length | Score | Probability |
|---|---|---|---|---|---|---|
| 24802327_f1_2 | 784 | 4956 | 391 | 1176 | 240 | 6.2e-30 |
| Protein name | | | | | Locus Name | Acc# |
| | | | | | sp:INTR_ECOLI | P76056 |

Description: PUTATIVE PROPHAGE RAC INTEGRASE

| ORF Name | NTID | AAID | NT Length | AA Length | Score | Probability |
|---|---|---|---|---|---|---|
| 24820927_c3_360 | 785 | 4957 | 357 | 1074 | 1308 | 2.2e-133 |
| Protein name | | | | | Locus Name | Acc# |
| | | | | | sp:GAL7_ECOLI | P09148:P78 |

Description: GALACTOSE-1-PHOSPHATE URIDYLYLTRANSFERASE,

| ORF Name | NTID | AAID | NT Length | AA Length | Score | Probability |
|---|---|---|---|---|---|---|
| 25391063_c2_289 | 786 | 4958 | 63 | 192 | | |
| Protein name | | | | | Locus Name | Acc# |

Description: NO-HIT

| ORF Name | NTID | AAID | NT Length | AA Length | Score | Probability |
|---|---|---|---|---|---|---|
| 25422577_c3_328 | 787 | 4959 | 621 | 1866 | 2484 | 5.2e-258 |
| Protein name | | | | | Locus Name | Acc# |
| dihydrolipoamide S-acetyltransferase,:dihydrolipoyl | | | | | pir:XXECDP | A30278:S45 |

Description

| ORF Name | NTID | AAID | NT Length | AA Length | Score | Probability |
|---|---|---|---|---|---|---|
| 25515775_f3_161 | 788 | 4960 | 212 | 639 | 569 | 4.4e-55 |
| Protein name | | | | | Locus Name | Acc# |
| | | | | | sp:YGFA_HAEIN | P44905 |

Description: HYPOTHETICAL PROTEIN HI0858

| ORF Name | NTID | AAID | NT Length | AA Length | Score | Probability |
|---|---|---|---|---|---|---|
| 25579717_f1_9 | 789 | 4961 | 235 | 708 | | |
| Protein name | | | | | Locus Name | Acc# |

Description: NO-HIT

| ORF Name | NTID | AAID | NT Length | AA Length | Score | Probability |
|---|---|---|---|---|---|---|
| 26055311_c3_340 | 790 | 4962 | 872 | 2619 | 4021 | 0.0 |
| Protein name | | | | | Locus Name | Acc# |
| | | | | | sp:ACO2_ECOLI | P36683:P36 |

Description: (ACONITASE 2)

| ORF Name | NTID | AAID | NT Length | AA Length | Score | Probability |
|---|---|---|---|---|---|---|
| 26225910_f1_51 | 791 | 4963 | 311 | 936 | 1348 | 1.3e-137 |
| Protein name | | | | | Locus Name | Acc# |
| | | | | | sp:ICIA_ECOLI | P24194 |

Description: CHROMOSOME INITIATION INHIBITOR (ORIC REPLICATION INHIBITOR)

| ORF Name | NTID | AAID | NT Length | AA Length | Score | Probability |
|---|---|---|---|---|---|---|
| 26344702_c2_272 | 792 | 4964 | 218 | 657 | 932 | 1.5e-93 |
| Protein name | | | | | Locus Name | Acc# |
| ribose-5-phosphate isomerase | | | | | gp:AF037440 | AF037440 |

Description

Edwardsiella ictaluri D-3-phosphoglycerate dehydrogenase (serA)gene, partial cds; ribose-5-phosphate isomerase (rpiA), inhibitorof chromosome initiation (iciA), putative 26 kDa protein (yggE), putative 30.6 kDa protein (yggB), and fructose 1,6-bisphosphatealdolase (fda) genes, complete cds; and phosphoglycerate kinase(pgk) gene, partial cds.

| ORF Name | NTID | AAID | NT Length | AA Length | Score | Probability |
|---|---|---|---|---|---|---|
| 26460311_c3_374 | 793 | 4965 | 99 | 300 | 76 | 0.0077 |
| Protein name | | | | | Locus Name | Acc# |
| hypothetical protein AF0614 | | | | | pir:F69326 | F69326 |

Description

| ORF Name | NTID | AAID | NT Length | AA Length | Score | Probability |
|---|---|---|---|---|---|---|
| 26594051_c3_357 | 794 | 4966 | 230 | 693 | 1158 | 1.7e-117 |
| Protein name | | | | | Locus Name | Acc# |
| Ccm1 protein | | | | | gp:PMAJ84 | AJ000084 |

Description

Proteus mirabilis ccm and pat genes and partial ygbA gene.

| ORF Name | NTID | AAID | NT Length | AA Length | Score | Probability |
|---|---|---|---|---|---|---|
| 2865953_f2_108 | 795 | 4967 | 210 | 633 | 323 | 5.2e-29 |
| Protein name | | | | | Locus Name | Acc# |
| hypothetical protein | | | | | pir:E75485 | E75485 |

Description

| ORF Name | NTID | AAID | NT Length | AA Length | Score | Probability |
|---|---|---|---|---|---|---|
| 31416057_f3_155 | 796 | 4968 | 340 | 1023 | 956 | 4.3e-96 |
| Protein name | | | | | Locus Name | Acc# |
| | | | | | sp:UP14_ECOLI | P39179:Q46 |

Description

UNKNOWN PROTEIN FROM 2D-PAGE (SPOT PR51)

247

| ORF Name | NTID | AAID | NT Length | AA Length | Score | Probability |
|---|---|---|---|---|---|---|
| 31902_f2_117 | 797 | 4969 | 700 | 2103 | 1687 | 1.5e-173 |

Protein name: RtxB protein
Locus Name: gp:AF119150
Acc#: AF119150

Description: Vibrio cholerae Rtx toxin gene cluster, complete cds.

| ORF Name | NTID | AAID | NT Length | AA Length | Score | Probability |
|---|---|---|---|---|---|---|
| 3214087_c3_353 | 798 | 4970 | 354 | 1065 | 1640 | 1.4e-168 |

Protein name:
Locus Name: sp:RF2_ECOLI
Acc#: P07012:P76

Description: PEPTIDE CHAIN RELEASE FACTOR 2 (RF-2)

| ORF Name | NTID | AAID | NT Length | AA Length | Score | Probability |
|---|---|---|---|---|---|---|
| 32242780_f3_157 | 799 | 4971 | 60 | 183 | | |

Protein name:
Locus Name:
Acc#:

Description: NO-HIT

| ORF Name | NTID | AAID | NT Length | AA Length | Score | Probability |
|---|---|---|---|---|---|---|
| 33234677_c3_342 | 800 | 4972 | 214 | 645 | 704 | 2.2e-69 |

Protein name:
Locus Name: sp:YGGA_ECOLI
Acc#: P11667

Description: HYPOTHETICAL 23.2 KD PROTEIN IN SBM-FBA INTERGENIC REGION (ORF 5)

| ORF Name | NTID | AAID | NT Length | AA Length | Score | Probability |
|---|---|---|---|---|---|---|
| 33365705_f1_26 | 801 | 4973 | 74 | 225 | | |

Protein name:
Locus Name:
Acc#:

Description: NO-HIT

| ORF Name | NTID | AAID | NT Length | AA Length | Score | Probability |
|---|---|---|---|---|---|---|
| 34024040_c3_363 | 802 | 4974 | 346 | 1041 | 942 | 1.3e-94 |
| Protein name | | | | | Locus Name | Acc# |
| | | | | | sp:GALR_ECOLI | P03024 |

Description: GALACTOSE OPERON REPRESSOR

| ORF Name | NTID | AAID | NT Length | AA Length | Score | Probability |
|---|---|---|---|---|---|---|
| 34276687_c3_349 | 803 | 4975 | 368 | 1107 | 1422 | 1.8e-145 |
| Protein name | | | | | Locus Name | Acc# |
| aminomethyltransferase,:glycine cleavage system protein T | | | | | pir:A56689 | A56689:S36 |

Description:

| ORF Name | NTID | AAID | NT Length | AA Length | Score | Probability |
|---|---|---|---|---|---|---|
| 34586567_c2_279 | 804 | 4976 | 319 | 960 | 1602 | 1.5e-164 |
| Protein name | | | | | Locus Name | Acc# |
| site-specific recombinase | | | | | gp:AF033497 | AF033497 |

Description: Proteus mirabilis site-specific recombinase (xerD) gene, completecds.

| ORF Name | NTID | AAID | NT Length | AA Length | Score | Probability |
|---|---|---|---|---|---|---|
| 34642802_f1_1 | 805 | 4977 | 281 | 846 | 772 | 1.4e-76 |
| Protein name | | | | | Locus Name | Acc# |
| hypothetical protein b2360 | | | | | pir:E65009 | E65009 |

Description:

| ORF Name | NTID | AAID | NT Length | AA Length | Score | Probability |
|---|---|---|---|---|---|---|
| 35164586_c1_226 | 806 | 4978 | 170 | 513 | 400 | 3.6e-37 |
| Protein name | | | | | Locus Name | Acc# |
| | | | | | sp:ECOT_ECOLI | P23827 |

Description: ECOTIN PRECURSOR

| ORF Name | NTID | AAID | NT Length | AA Length | Score | Probability |
|---|---|---|---|---|---|---|
| 35318800_c1_204 | 807 | 4979 | 68 | 207 | 71 | 0.026 |
| Protein name | | | | | Locus Name | Acc# |
| ATP synthase subunit i | | | | | gp:AF101055 | AF101055 |

Description

Clostridium acetobutylicum atp operon, complete sequence.

| ORF Name | NTID | AAID | NT Length | AA Length | Score | Probability |
|---|---|---|---|---|---|---|
| 35360937_f3_174 | 808 | 4980 | 2807 | 8424 | 3884 | 0.0 |
| Protein name | | | | | Locus Name | Acc# |
| RtxA protein | | | | | gp:AF119150 | AF119150 |

Description

Vibrio cholerae Rtx toxin gene cluster, complete cds.

| ORF Name | NTID | AAID | NT Length | AA Length | Score | Probability |
|---|---|---|---|---|---|---|
| 35820251_c2_282 | 809 | 4981 | 513 | 1542 | 2204 | 2.5e-228 |
| Protein name | | | | | Locus Name | Acc# |
| lysine--tRNA ligase,:lysyl-tRNA synthetase I | | | | | pir:SYECKT | B65073:JS0 |

Description

| ORF Name | NTID | AAID | NT Length | AA Length | Score | Probability |
|---|---|---|---|---|---|---|
| 36207183_c2_295 | 810 | 4982 | 312 | 939 | 329 | 1.2e-29 |
| Protein name | | | | | Locus Name | Acc# |
| hypothetical protein b2372 | | | | | pir:A65011 | A65011 |

Description

| ORF Name | NTID | AAID | NT Length | AA Length | Score | Probability |
|---|---|---|---|---|---|---|
| 36517153_f2_85 | 811 | 4983 | 479 | 1440 | 1972 | 9.4e-204 |
| Protein name | | | | | Locus Name | Acc# |
| | | | | | sp:YKGF_ECOLI | P77536 |

Description

HYPOTHETICAL 53.1 KD PROTEIN IN EAEH-BETA INTERGENIC REGION

| ORF Name | NTID | AAID | NT Length | AA Length | Score | Probability |
|---|---|---|---|---|---|---|
| 36517202_c1_216 | 812 | 4984 | 64 | 195 | | |
| Protein name | | | | | Locus Name | Acc# |

Description
NO-HIT

| ORF Name | NTID | AAID | NT Length | AA Length | Score | Probability |
|---|---|---|---|---|---|---|
| 38885_f1_12 | 813 | 4985 | 145 | 438 | 97 | 0.00020 |
| Protein name | | | | | Locus Name | Acc# |
| hypothetical protein slr2101 | | | | | pir:S75133 | S75133 |

Description

| ORF Name | NTID | AAID | NT Length | AA Length | Score | Probability |
|---|---|---|---|---|---|---|
| 3907138_c3_348 | 814 | 4986 | 415 | 1248 | 1403 | 1.9e-143 |
| Protein name | | | | | Locus Name | Acc# |
| probable monooxygenase, visC | | | | | pir:B65075 | B65075:D47 |

Description

| ORF Name | NTID | AAID | NT Length | AA Length | Score | Probability |
|---|---|---|---|---|---|---|
| 3907936_c1_244 | 815 | 4987 | 225 | 678 | | |
| Protein name | | | | | Locus Name | Acc# |

Description
NO-HIT

| ORF Name | NTID | AAID | NT Length | AA Length | Score | Probability |
|---|---|---|---|---|---|---|
| 3926910_f3_160 | 816 | 4988 | 130 | 393 | 372 | 3.3e-34 |
| Protein name | | | | | Locus Name | Acc# |
| | | | | | sp:YGFE_ECOLI | P45580 |

Description
HYPOTHETICAL 12.6 KD PROTEIN IN PEPP-SSR INTERGENIC REGION (O109)

| ORF Name | NTID | AAID | NT Length | AA Length | Score | Probability |
|---|---|---|---|---|---|---|
| 3937568_c3_361 | 817 | 4989 | 393 | 1182 | 1242 | 2.1e-126 |
| Protein name | | | | | Locus Name | Acc# |
| | | | | | gp:SYNDSP1 | M12159 |

Description

Synthetic plasmid pDSP1: a cloning vector for eukaryotic genes and gene regulatory elements, segment 1.

| ORF Name | NTID | AAID | NT Length | AA Length | Score | Probability |
|---|---|---|---|---|---|---|
| 3938292_f3_187 | 818 | 4990 | 576 | 1731 | 2903 | 2.1e-302 |
| Protein name | | | | | Locus Name | Acc# |
| | | | | | sp:HLYB_PROMI | P16465 |

Description

HEMOLYSIN ACTIVATOR PROTEIN PRECURSOR

| ORF Name | NTID | AAID | NT Length | AA Length | Score | Probability |
|---|---|---|---|---|---|---|
| 4015927_c1_221 | 819 | 4991 | 443 | 1332 | 175 | 7.7e-10 |
| Protein name | | | | | Locus Name | Acc# |
| | | | | | sp:MYSB_RABIT | P04461 |

Description (FRAGMENT)

| ORF Name | NTID | AAID | NT Length | AA Length | Score | Probability |
|---|---|---|---|---|---|---|
| 4035963_f1_27 | 820 | 4992 | 322 | 969 | 1020 | 7.2e-103 |
| Protein name | | | | | Locus Name | Acc# |
| probable 2-hydroxyacid dehydrogenase in bisC-cspA intergenic region:hypothetical | | | | | pir:C65154 | C65154:S47 |

Description

| ORF Name | NTID | AAID | NT Length | AA Length | Score | Probability |
|---|---|---|---|---|---|---|
| 4086017_c1_215 | 821 | 4993 | 101 | 306 | 361 | 4.9e-33 |
| Protein name | | | | | Locus Name | Acc# |
| | | | | | sp:YGFY_ECOLI | Q46825 |

Description

HYPOTHETICAL 10.5 KD PROTEIN IN FLDB-BGLA INTERGENIC REGION

| ORF Name | NTID | AAID | NT Length | AA Length | Score | Probability |
|---|---|---|---|---|---|---|
| 4101712_c1_233 | 822 | 4994 | 548 | 1647 | 2107 | 4.7e-218 |
| Protein name | | | | | Locus Name | Acc# |
| Na+/glucose symporter | | | | | gp:VIBAQ3334 | D78137 |

Description: Vibrio parahaemolyticus DNA for Na+/glucose symporter, complete cds.

| ORF Name | NTID | AAID | NT Length | AA Length | Score | Probability |
|---|---|---|---|---|---|---|
| 4147068_f1_3 | 823 | 4995 | 808 | 2427 | 251 | 6.0e-24 |
| Protein name | | | | | Locus Name | Acc# |
| hypothetical protein jhp1070 | | | | | pir:D71853 | D71853 |

Description:

| ORF Name | NTID | AAID | NT Length | AA Length | Score | Probability |
|---|---|---|---|---|---|---|
| 4187792_c2_275 | 824 | 4996 | 145 | 438 | 506 | 2.1e-48 |
| Protein name | | | | | Locus Name | Acc# |
| glycine cleavage system protein H:aminomethyl carrier protein:glycine decarboxylase complex | | | | | pir:A56623 | A56623:S36 |

Description:

| ORF Name | NTID | AAID | NT Length | AA Length | Score | Probability |
|---|---|---|---|---|---|---|
| 4303450_f1_31 | 825 | 4997 | 195 | 588 | 223 | 2.1e-18 |
| Protein name | | | | | Locus Name | Acc# |
| | | | | | sp:YIEF_ECOLI | P31465 |

Description: HYPOTHETICAL 20.4 KD PROTEIN IN TNAB-BGLB INTERGENIC REGION

| ORF Name | NTID | AAID | NT Length | AA Length | Score | Probability |
|---|---|---|---|---|---|---|
| 4304005_f3_188 | 826 | 4998 | 1589 | 4770 | 7935 | 0.0 |
| Protein name | | | | | Locus Name | Acc# |
| | | | | | sp:HLYA_PROMI | P16466 |

Description: HEMOLYSIN PRECURSOR

| ORF Name | NTID | AAID | NT Length | AA Length | Score | Probability |
|---|---|---|---|---|---|---|
| 4336562_f1_10 | 827 | 4999 | 78 | 237 | 71 | 0.026 |

Protein name | Locus Name | Acc#
hypothetical protein | gp:SSU18930 | Y18930

Description
Sulfolobus solfataricus 281 kb genomic DNA fragment, strain P2.

| ORF Name | NTID | AAID | NT Length | AA Length | Score | Probability |
|---|---|---|---|---|---|---|
| 4472203_f3_173 | 828 | 5000 | 67 | 204 | | |

Protein name | Locus Name | Acc#

Description
NO-HIT

| ORF Name | NTID | AAID | NT Length | AA Length | Score | Probability |
|---|---|---|---|---|---|---|
| 4580376_f2_70 | 829 | 5001 | 81 | 246 | | |

Protein name | Locus Name | Acc#

Description
NO-HIT

| ORF Name | NTID | AAID | NT Length | AA Length | Score | Probability |
|---|---|---|---|---|---|---|
| 4817207_f1_64 | 830 | 5002 | 207 | 624 | 596 | 6.1e-58 |

Protein name | Locus Name | Acc#
| sp:YACE_ECOLI | P36679:P75

Description
HYPOTHETICAL 22.6 KD PROTEIN IN MUTT-GUAC INTERGENIC REGION

| ORF Name | NTID | AAID | NT Length | AA Length | Score | Probability |
|---|---|---|---|---|---|---|
| 4885937_f3_172 | 831 | 5003 | 67 | 204 | | |

Protein name | Locus Name | Acc#

Description
NO-HIT

| ORF Name | NTID | AAID | NT Length | AA Length | Score | Probability |
|---|---|---|---|---|---|---|
| 4953426_c2_283 | 832 | 5004 | 192 | 579 | 972 | 8.8e-98 |

| Protein name | Locus Name | Acc# |
|---|---|---|
| putative acetyl transferase | gp:PMAJ84 | AJ000084 |

Description

Proteus mirabilis ccm and pat genes and partial ygbA gene.

| ORF Name | NTID | AAID | NT Length | AA Length | Score | Probability |
|---|---|---|---|---|---|---|
| 4962825_c3_365 | 833 | 5005 | 286 | 861 | 297 | 3.0e-26 |

| Protein name | Locus Name | Acc# |
|---|---|---|
| unknown | gp:AF113952 | AF113952 |

Description

Campylobacter jejuni multidrug-efflux transporter gene, completecds; and unknown genes.

| ORF Name | NTID | AAID | NT Length | AA Length | Score | Probability |
|---|---|---|---|---|---|---|
| 4976525_f2_77 | 834 | 5006 | 221 | 666 | 81 | 0.0076 |

| Protein name | Locus Name | Acc# |
|---|---|---|
| flavocetin A | pir:S55679 | S55679 |

Description

| ORF Name | NTID | AAID | NT Length | AA Length | Score | Probability |
|---|---|---|---|---|---|---|
| 50925_c1_237 | 835 | 5007 | 398 | 1197 | 490 | 1.0e-46 |

| Protein name | Locus Name | Acc# |
|---|---|---|
| | sp:YCAD_ECOLI | P21503:P75 |

Description

HYPOTHETICAL 41.4 KD PROTEIN IN DMSC-PFLA INTERGENIC REGION (ORF Y)

| ORF Name | NTID | AAID | NT Length | AA Length | Score | Probability |
|---|---|---|---|---|---|---|
| 5117193_c1_220 | 836 | 5008 | 133 | 402 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 5117218_f1_55 | 837 | 5009 | 1824 | 5475 | 3923 | 0.0 |
| Protein name | | | | | Locus Name | Acc# |
| RtxA protein | | | | | gp:AF119150 | AF119150 |

Description: Vibrio cholerae Rtx toxin gene cluster, complete cds.

| ORF Name | NTID | AAID | NT Length | AA Length | Score | Probability |
|---|---|---|---|---|---|---|
| 5210092_f3_135 | 838 | 5010 | 90 | 273 | 66 | 0.038 |
| Protein name | | | | | Locus Name | Acc# |
| | | | | | sp:UDG_STRPN | Q57346:Q54 |

Description: (UDP-GLCDH) (UDPGDH)

| ORF Name | NTID | AAID | NT Length | AA Length | Score | Probability |
|---|---|---|---|---|---|---|
| 5292188_f2_119 | 839 | 5011 | 78 | 237 | 61 | 0.024 |
| Protein name | | | | | Locus Name | Acc# |
| 33.1 kDa protein | | | | | gp:HUMPSPBQ | L11573:L22 |

Description: Human surfactant protein B mRNA, complete cds.

| ORF Name | NTID | AAID | NT Length | AA Length | Score | Probability |
|---|---|---|---|---|---|---|
| 57752_c3_376 | 840 | 5012 | 192 | 579 | | |
| Protein name | | | | | Locus Name | Acc# |

Description: NO-HIT

| ORF Name | NTID | AAID | NT Length | AA Length | Score | Probability |
|---|---|---|---|---|---|---|
| 5864385_f2_79 | 841 | 5013 | 248 | 747 | 102 | 0.0018 |
| Protein name | | | | | Locus Name | Acc# |
| | | | | | sp:FM1A_SERMA | P22595 |

Description: TYPE-1 FIMBRIAL PROTEIN SUBUNIT PRECURSOR

| ORF Name | NTID | AAID | NT Length | AA Length | Score | Probability |
|---|---|---|---|---|---|---|
| 5870953_f2_96 | 842 | 5014 | 149 | 450 | 304 | 5.4e-27 |
| Protein name | | | | | Locus Name | Acc# |
| | | | | | sp:UP03_ECOLI | P37903:P76 |

Description: UNKNOWN PROTEIN 2D_000B3L FROM 2D-PAGE

| ORF Name | NTID | AAID | NT Length | AA Length | Score | Probability |
|---|---|---|---|---|---|---|
| 656951_f2_80 | 843 | 5015 | 87 | 264 | | |
| Protein name | | | | | Locus Name | Acc# |

Description: NO-HIT

| ORF Name | NTID | AAID | NT Length | AA Length | Score | Probability |
|---|---|---|---|---|---|---|
| 6640675_f2_86 | 844 | 5016 | 74 | 225 | | |
| Protein name | | | | | Locus Name | Acc# |

Description: NO-HIT

| ORF Name | NTID | AAID | NT Length | AA Length | Score | Probability |
|---|---|---|---|---|---|---|
| 6914082_c3_322 | 845 | 5017 | 180 | 543 | 571 | 2.7e-55 |
| Protein name | | | | | Locus Name | Acc# |
| putative 8-oxo-dGTPase | | | | | gp:PMI250100 | AJ250100 |

Description: Proteus mirabilis mutT gene for putative 8-oxo-dGTPase and hpmBAgene promoter region.

| ORF Name | NTID | AAID | NT Length | AA Length | Score | Probability |
|---|---|---|---|---|---|---|
| 6928467_c3_347 | 846 | 5018 | 441 | 1326 | 1793 | 8.8e-185 |
| Protein name | | | | | Locus Name | Acc# |
| | | | | | sp:AMPP_ECOLI | P15034 |

Description: (AMINOPEPTIDASE P II) (APP-II) (AMINOACYLPROLINE AMINOPEPTIDASE)

| ORF_Name | NTID | AAID | NT Length | AA Length | Score | Probability |
|---|---|---|---|---|---|---|
| 7062516_c2_281 | 847 | 5019 | 579 | 1740 | 1926 | 7.1e-199 |
| Protein name | | | | | Locus Name | Acc# |
| | | | | | sp:RECJ_ERWCH | P39693:Q47 |

Description

SINGLE-STRANDED-DNA-SPECIFIC EXONUCLEASE RECJ,

| ORF_Name | NTID | AAID | NT Length | AA Length | Score | Probability |
|---|---|---|---|---|---|---|
| 7222327_c2_274 | 848 | 5020 | 416 | 1251 | 1649 | 1.6e-169 |
| Protein name | | | | | Locus Name | Acc# |
| phosphoglycerate dehydrogenase, | | | | | pir:DEECPG | A25200:B38 |

Description

| ORF_Name | NTID | AAID | NT Length | AA Length | Score | Probability |
|---|---|---|---|---|---|---|
| 7312803_f3_136 | 849 | 5021 | 503 | 1512 | 1327 | 2.1e-135 |
| Protein name | | | | | Locus Name | Acc# |
| | | | | | gp:AB013369 | AB013369 |

Description

Bacillus halodurans C-125 yesT and comEC genes, partial and complete cds.

| ORF_Name | NTID | AAID | NT Length | AA Length | Score | Probability |
|---|---|---|---|---|---|---|
| 803125_c3_373 | 850 | 5022 | 753 | 2262 | 113 | 2.4e-07 |
| Protein name | | | | | Locus Name | Acc# |
| conserved hypothetical secreted protein HP1098 | | | | | pir:B64657 | B64657 |

Description

| ORF_Name | NTID | AAID | NT Length | AA Length | Score | Probability |
|---|---|---|---|---|---|---|
| 808393_c3_358 | 851 | 5023 | 316 | 951 | 434 | 9.0e-41 |
| Protein name | | | | | Locus Name | Acc# |
| cation efflux system protein (zinc/cadmium) PAB0462 | | | | | pir:H75109 | H75109 |

Description

258

| ORF_Name | NTID | AAID | NT Length | AA Length | Score | Probability |
|---|---|---|---|---|---|---|
| 836058_f2_76 | 852 | 5024 | 278 | 837 | | |
| Protein name | | | | | Locus Name | Acc# |

Description
NO-HIT

| ORF_Name | NTID | AAID | NT Length | AA Length | Score | Probability |
|---|---|---|---|---|---|---|
| 89056_c3_370 | 853 | 5025 | 207 | 624 | 330 | 9.4e-30 |
| Protein name | | | | | Locus Name | Acc# |
| hypothetical protein A51L | | | | | pir:T17541 | T17541 |

Description

| ORF_Name | NTID | AAID | NT Length | AA Length | Score | Probability |
|---|---|---|---|---|---|---|
| 915926_c1_232 | 854 | 5026 | 357 | 1074 | 717 | 9.2e-71 |
| Protein name | | | | | Locus Name | Acc# |
| | | | | | sp:GALM_HAEIN | P31765 |

Description
ALDOSE 1-EPIMERASE, (MUTAROTASE)

| ORF_Name | NTID | AAID | NT Length | AA Length | Score | Probability |
|---|---|---|---|---|---|---|
| 963192_f3_147 | 855 | 5027 | 81 | 246 | 165 | 2.9e-12 |
| Protein name | | | | | Locus Name | Acc# |
| | | | | | sp:YDCH_ECOLI | P46135 |

Description
HYPOTHETICAL 6.5 KD PROTEIN IN TRG-RIML INTERGENIC REGION

| ORF_Name | NTID | AAID | NT Length | AA Length | Score | Probability |
|---|---|---|---|---|---|---|
| 976010_f2_102 | 856 | 5028 | 85 | 258 | | |
| Protein name | | | | | Locus Name | Acc# |

Description
NO-HIT

| ORF_Name | NTID | AAID | NT Length | AA Length | Score | Probability |
|---|---|---|---|---|---|---|
| 9771961_c1_245 | 857 | 5029 | 194 | 585 | | |
| Protein name | | | | | Locus Name | Acc# |

Description
NO-HIT

| ORF_Name | NTID | AAID | NT Length | AA Length | Score | Probability |
|---|---|---|---|---|---|---|
| 9773937_f1_19 | 858 | 5030 | 146 | 441 | 356 | 1.7e-32 |
| Protein name | | | | | Locus Name | Acc# |
| | | | | | sp:YKGJ_ECOLI | P71300 |

Description
HYPOTHETICAL 11.8 KD PROTEIN IN INTF-EAEH INTERGENIC REGION

| ORF_Name | NTID | AAID | NT Length | AA Length | Score | Probability |
|---|---|---|---|---|---|---|
| 9775633_f3_180 | 859 | 5031 | 211 | 636 | 168 | 3.7e-12 |
| Protein name | | | | | Locus Name | Acc# |
| mucin (clone PGM-2B) | | | | | pir:S55316 | S55316 |

Description

| ORF_Name | NTID | AAID | NT Length | AA Length | Score | Probability |
|---|---|---|---|---|---|---|
| 9776562_f2_106 | 860 | 5032 | 191 | 576 | 650 | 1.2e-63 |
| Protein name | | | | | Locus Name | Acc# |
| flavodoxin II:flavodoxin B | | | | | pir:G65073 | G65073:S52 |

Description

| ORF_Name | NTID | AAID | NT Length | AA Length | Score | Probability |
|---|---|---|---|---|---|---|
| 9813140_f3_140 | 861 | 5033 | 68 | 207 | | |
| Protein name | | | | | Locus Name | Acc# |

Description
NO-HIT

| ORF Name | NTID | AAID | NT Length | AA Length | Score | Probability |
|---|---|---|---|---|---|---|
| 985250_c2_303 | 862 | 5034 | 490 | 1473 | 1009 | 1.1e-101 |
| Protein name | | | | | Locus Name | Acc# |
| FtsK | | | | | gp:ECFTSKGEN | Z49932 |

Description
E.coli ftsK gene.

| ORF Name | NTID | AAID | NT Length | AA Length | Score | Probability |
|---|---|---|---|---|---|---|
| 995127_c2_276 | 863 | 5035 | 964 | 2895 | 3943 | 0.0 |
| Protein name | | | | | Locus Name | Acc# |
| glycine dehydrogenase (decarboxylating), | | | | | pir:S36834 | S36834:I41 |

Description

| ORF Name | NTID | AAID | NT Length | AA Length | Score | Probability |
|---|---|---|---|---|---|---|
| 10157783_f3_588 | 864 | 5036 | 62 | 189 | 141 | 1.0e-09 |
| Protein name | | | | | Locus Name | Acc# |
| | | | | | gp:D90887 | D90887:AB0 |

Description
E.coli genomic DNA, Kohara clone #437(58.6-59.0 min.).

| ORF Name | NTID | AAID | NT Length | AA Length | Score | Probability |
|---|---|---|---|---|---|---|
| 10193816_c2_1275 | 865 | 5037 | 129 | 390 | 420 | 2.7e-39 |
| Protein name | | | | | Locus Name | Acc# |
| | | | | | sp:CRCB_ECOLI | P37002 |

Description
CRCB PROTEIN

| ORF Name | NTID | AAID | NT Length | AA Length | Score | Probability |
|---|---|---|---|---|---|---|
| 1035885_c2_1293 | 866 | 5038 | 266 | 801 | 939 | 2.8e-94 |
| Protein name | | | | | Locus Name | Acc# |
| | | | | | sp:YFIO_ECOLI | P77146:Q47 |

Description
PRECURSOR

| ORF Name | NTID | AAID | NT Length | AA Length | Score | Probability |
|---|---|---|---|---|---|---|
| 104018_c3_1631 | 867 | 5039 | 123 | 372 | | |
| Protein name | | | | | Locus Name | Acc# |

Description
NO-HIT

| ORF Name | NTID | AAID | NT Length | AA Length | Score | Probability |
|---|---|---|---|---|---|---|
| 1047158_f1_138 | 868 | 5040 | 250 | 753 | 788 | 2.8e-78 |
| Protein name | | | | | Locus Name | Acc# |
| minor tail protein gp19 | | | | | pir:T13105 | T13105 |

Description

| ORF Name | NTID | AAID | NT Length | AA Length | Score | Probability |
|---|---|---|---|---|---|---|
| 10549068_c3_1394 | 869 | 5041 | 349 | 1050 | 78 | 0.034 |
| Protein name | | | | | Locus Name | Acc# |
| MHC class II beta chain | | | | | gp:GMMHCDR01 | Z27130 |

Description
G.moholi MHC class II DRB gene, exon 2 (partial).

| ORF Name | NTID | AAID | NT Length | AA Length | Score | Probability |
|---|---|---|---|---|---|---|
| 10558462_c3_1493 | 870 | 5042 | 181 | 546 | 834 | 3.7e-83 |
| Protein name | | | | | Locus Name | Acc# |
| flavodoxin A:flavodoxin 1 | | | | | pir:A37319 | A37319:C64 |

Description

| ORF Name | NTID | AAID | NT Length | AA Length | Score | Probability |
|---|---|---|---|---|---|---|
| 10570133_c3_1556 | 871 | 5043 | 131 | 396 | 269 | 2.7e-23 |
| Protein name | | | | | Locus Name | Acc# |
| | | | | | sp:YFIM_ECOLI | P46126 |

Description
HYPOTHETICAL 9.9 KD PROTEIN IN PSSA-KGTP INTERGENIC REGION

| ORF Name | NTID | AAID | NT Length | AA Length | Score | Probability |
|---|---|---|---|---|---|---|
| 10588557_c1_872 | 872 | 5044 | 99 | 300 | | |
| Protein name | | | | | Locus Name | Acc# |

Description
NO-HIT

| ORF Name | NTID | AAID | NT Length | AA Length | Score | Probability |
|---|---|---|---|---|---|---|
| 10625013_c2_1259 | 873 | 5045 | 68 | 207 | | |
| Protein name | | | | | Locus Name | Acc# |

Description
NO-HIT

| ORF Name | NTID | AAID | NT Length | AA Length | Score | Probability |
|---|---|---|---|---|---|---|
| 10628175_c1_840 | 874 | 5046 | 260 | 783 | 995 | 3.2e-100 |
| Protein name | | | | | Locus Name | Acc# |
| | | | | | sp:ARTP_ECOLI | P30858;P77 |

Description
ARGININE TRANSPORT ATP-BINDING PROTEIN ARTP

| ORF Name | NTID | AAID | NT Length | AA Length | Score | Probability |
|---|---|---|---|---|---|---|
| 10662891_c1_891 | 875 | 5047 | 289 | 870 | 797 | 3.1e-79 |
| Protein name | | | | | Locus Name | Acc# |
| | | | | | sp:YBHA_ECOLI | P21829 |

Description
HYPOTHETICAL 30.2 KD PROTEIN IN MODC-BIOA INTERGENIC REGION

| ORF Name | NTID | AAID | NT Length | AA Length | Score | Probability |
|---|---|---|---|---|---|---|
| 10675831_c1_867 | 876 | 5048 | 594 | 1785 | 207 | 1.4e-28 |
| Protein name | | | | | Locus Name | Acc# |
| probable regulatory protein | | | | | pir:C70548 | C70548 |

Description

| ORF Name | NTID | AAID | NT Length | AA Length | Score | Probability |
|---|---|---|---|---|---|---|
| 10734665_c1_871 | 877 | 5049 | 472 | 1419 | 955 | 5.6e-96 |
| Protein name | | | | Locus Name | | Acc# |
| | | | | sp:YHCL_ECOLI | | P45428 |

Description
HYPOTHETICAL 48.8 KD PROTEIN IN NANA-SSPB INTERGENIC REGION (O455)

| ORF Name | NTID | AAID | NT Length | AA Length | Score | Probability |
|---|---|---|---|---|---|---|
| 10750380_c1_846 | 878 | 5050 | 579 | 1740 | 1731 | 3.3e-178 |
| Protein name | | | | Locus Name | | Acc# |
| | | | | sp:FTHS_CLOCY | | Q07064 |

Description
SYNTHETASE) (FHS) (FTHFS)

| ORF Name | NTID | AAID | NT Length | AA Length | Score | Probability |
|---|---|---|---|---|---|---|
| 10756258_f2_347 | 879 | 5051 | 85 | 258 | | |
| Protein name | | | | Locus Name | | Acc# |

Description
NO-HIT

| ORF Name | NTID | AAID | NT Length | AA Length | Score | Probability |
|---|---|---|---|---|---|---|
| 10822163_f1_129 | 880 | 5052 | 374 | 1125 | | |
| Protein name | | | | Locus Name | | Acc# |

Description
NO-HIT

| ORF Name | NTID | AAID | NT Length | AA Length | Score | Probability |
|---|---|---|---|---|---|---|
| 10978256_c3_1590 | 881 | 5053 | 826 | 2481 | 3196 | 0.0 |
| Protein name | | | | Locus Name | | Acc# |
| probable membrane protein b0221:hypothetical protein b0221 | | | | pir:F64746 | | F64746 |

Description

| ORF Name | NTID | AAID | NT Length | AA Length | Score | Probability |
|---|---|---|---|---|---|---|
| 110380_c2_1323 | 882 | 5054 | 60 | 183 | | |
| Protein name | | | | | Locus Name | Acc# |

Description
NO-HIT

| ORF Name | NTID | AAID | NT Length | AA Length | Score | Probability |
|---|---|---|---|---|---|---|
| 11038962_c1_927 | 883 | 5055 | 274 | 825 | 790 | 1.7e-78 |
| Protein name | | | | | Locus Name | Acc# |
| chaperone | | | | | gp:ECOF17D | L77091 |

Description
Escherichia coli F17d fimbrial gene cluster encoding the majorfimbrial subunit protein (F17d-A), the chaperone protein (F17d-D),the transmembrane protein (F17d-C), the adhesin (F17d-G), completecds.

| ORF Name | NTID | AAID | NT Length | AA Length | Score | Probability |
|---|---|---|---|---|---|---|
| 11142905_f2_480 | 884 | 5056 | 774 | 2325 | 3066 | 0.0 |
| Protein name | | | | | Locus Name | Acc# |
| | | | | | sp:CLPA_ECOLI | P15716:P77 |

Description
ATP-DEPENDENT CLP PROTEASE ATP-BINDING SUBUNIT CLPA

| ORF Name | NTID | AAID | NT Length | AA Length | Score | Probability |
|---|---|---|---|---|---|---|
| 11385_c3_1530 | 885 | 5057 | 402 | 1209 | 1331 | 8.0e-136 |
| Protein name | | | | | Locus Name | Acc# |
| | | | | | sp:NAGA_ECOLI | P15300 |

Description
DEACETYLASE)

| ORF Name | NTID | AAID | NT Length | AA Length | Score | Probability |
|---|---|---|---|---|---|---|
| 115626_c2_1357 | 886 | 5058 | 98 | 297 | 99 | 0.00033 |
| Protein name | | | | | Locus Name | Acc# |
| | | | | | sp:VE59_LAMBD | P03754 |

Description
EA59 GENE PROTEIN

| ORF Name | NTID | AAID | NT Length | AA Length | Score | Probability |
|---|---|---|---|---|---|---|
| 11728931_c1_998 | 887 | 5059 | 72 | 219 | | |
| Protein name | | | | | Locus Name | Acc# |

Description
NO-HIT

| ORF Name | NTID | AAID | NT Length | AA Length | Score | Probability |
|---|---|---|---|---|---|---|
| 117942_c2_1147 | 888 | 5060 | 588 | 1767 | 1859 | 8.9e-192 |
| Protein name | | | | | Locus Name | Acc# |
| | | | | | sp:CYDC_ECOLI | P23886 |

Description
TRANSPORT ATP-BINDING PROTEIN CYDC

| ORF Name | NTID | AAID | NT Length | AA Length | Score | Probability |
|---|---|---|---|---|---|---|
| 11800041_f3_580 | 889 | 5061 | 387 | 1164 | 1484 | 4.9e-152 |
| Protein name | | | | | Locus Name | Acc# |
| | | | | | sp:PROB_SERMA | P17856 |

Description
GLUTAMATE 5-KINASE, (GAMMA-GLUTAMYL KINASE) (GK)

| ORF Name | NTID | AAID | NT Length | AA Length | Score | Probability |
|---|---|---|---|---|---|---|
| 11907183_c3_1476 | 890 | 5062 | 122 | 369 | 137 | 9.3e-08 |
| Protein name | | | | | Locus Name | Acc# |
| invariant surface glycoprotein 100 | | | | | pir:T30294 | T30294 |

Description

| ORF Name | NTID | AAID | NT Length | AA Length | Score | Probability |
|---|---|---|---|---|---|---|
| 1192537_f2_452 | 891 | 5063 | 204 | 615 | 855 | 2.2e-85 |
| Protein name | | | | | Locus Name | Acc# |
| | | | | | sp:DCD_ECOLI | P28248 |

Description
DEAMINASE)

| ORF Name | NTID | AAID | NT Length | AA Length | Score | Probability |
|---|---|---|---|---|---|---|
| 1195167_c1_956 | 892 | 5064 | 112 | 339 | 82 | 0.0018 |
| Protein name | | | | | Locus Name | Acc# |
| | | | | | gp:AP000363 | AP000363 |

Description
Bacteriophage VT2-Sa, complete genome sequence.

| ORF Name | NTID | AAID | NT Length | AA Length | Score | Probability |
|---|---|---|---|---|---|---|
| 1203177_f3_566 | 893 | 5065 | 212 | 639 | 233 | 1.8e-19 |
| Protein name | | | | | Locus Name | Acc# |
| type 4 prepilin-like protein specific leader | | | | | gp:ECOUW67 | U18997 |

Description
Escherichia coli K-12 chromosomal region from 67.4 to 76.0 minutes.

| ORF Name | NTID | AAID | NT Length | AA Length | Score | Probability |
|---|---|---|---|---|---|---|
| 1209692_f2_417 | 894 | 5066 | 96 | 291 | 272 | 1.3e-23 |
| Protein name | | | | | Locus Name | Acc# |
| | | | | | sp:YBGE_ECOLI | P37343:P75 |

Description
10.9 KD PROTEIN IN CYDB-TOLQ INTERGENIC REGION (ORFD)

| ORF Name | NTID | AAID | NT Length | AA Length | Score | Probability |
|---|---|---|---|---|---|---|
| 12115637_c2_1374 | 895 | 5067 | 362 | 1089 | 1639 | 1.8e-168 |
| Protein name | | | | | Locus Name | Acc# |
| ZapE | | | | | gp:AF064762 | AF064762 |

Description
Proteus mirabilis metalloprotease operon, complete sequence.

| ORF Name | NTID | AAID | NT Length | AA Length | Score | Probability |
|---|---|---|---|---|---|---|
| 12187503_f1_145 | 896 | 5068 | 493 | 1482 | 1663 | 5.2e-171 |
| Protein name | | | | | Locus Name | Acc# |
| | | | | | sp:YBFM_ECOLI | P75733 |

Description
HYPOTHETICAL 52.8 KD PROTEIN IN GLNS-FUR INTERGENIC REGION

| ORF Name | NTID | AAID | NT Length | AA Length | Score | Probability |
|---|---|---|---|---|---|---|
| 1219837_c2_1276 | 897 | 5069 | 339 | 1020 | 1298 | 2.5e-132 |
| Protein name | | | | | Locus Name | Acc# |
| probable nrdG protein | | | | | pir:C70861 | C70861 |

Description

| ORF Name | NTID | AAID | NT Length | AA Length | Score | Probability |
|---|---|---|---|---|---|---|
| 12210827_c2_1158 | 898 | 5070 | 190 | 573 | 532 | 3.7e-51 |
| Protein name | | | | | Locus Name | Acc# |
| putative permease Mig-13 | | | | | gp:AF020809 | AF020809 |

Description

Salmonella typhimurium multidrug pump Cmr (cmr) gene, partial cds;putative permease Mig-13 (mig-13) and transcriptional activatorDeoR (deoR) genes, complete cds; and penicillin-binding protein 6(pbp-6) gene, partial cds.

| ORF Name | NTID | AAID | NT Length | AA Length | Score | Probability |
|---|---|---|---|---|---|---|
| 12398387_c2_1138 | 899 | 5071 | 265 | 798 | 1183 | 3.8e-120 |
| Protein name | | | | | Locus Name | Acc# |
| pyruvate formate-lyase activating enzyme,, lyase 1-specific:formate C-acetyltransferase | | | | | pir:S01789 | S01789:E64 |

Description

| ORF Name | NTID | AAID | NT Length | AA Length | Score | Probability |
|---|---|---|---|---|---|---|
| 1254667_f3_590 | 900 | 5072 | 60 | 183 | | |
| Protein name | | | | | Locus Name | Acc# |

Description

NO-HIT

| ORF Name | NTID | AAID | NT Length | AA Length | Score | Probability |
|---|---|---|---|---|---|---|
| 12597002_c3_1496 | 901 | 5073 | 61 | 186 | 162 | 6.0e-12 |
| Protein name | | | | | Locus Name | Acc# |
| | | | | | sp:HOLE_ECOLI | P28689 |

Description

DNA POLYMERASE III, THETA SUBUNIT,

268

| ORF Name | NTID | AAID | NT Length | AA Length | Score | Probability |
|---|---|---|---|---|---|---|
| 1269135_f2_261 | 902 | 5074 | 87 | 264 | 176 | 2.0e-13 |
| Protein name | | | | | Locus Name | Acc# |
| hypothetical protein L7030 | | | | | pir:T42130 | T42130 |

Description

| ORF Name | NTID | AAID | NT Length | AA Length | Score | Probability |
|---|---|---|---|---|---|---|
| 12697175_c2_1332 | 903 | 5075 | 363 | 1092 | 1915 | 1.0e-197 |
| Protein name | | | | | Locus Name | Acc# |
| NrpU | | | | | gp:PMU46488 | U46488 |

Description

Proteus mirabilis NrpS (nrpS) gene, partial cds, NrpU (nrpU), NrpT(nrpT), NrpA (nrpA), NrpB (nrpB), NrpG (nrpG) and IrpP (irpP) genes, complete cds.

| ORF Name | NTID | AAID | NT Length | AA Length | Score | Probability |
|---|---|---|---|---|---|---|
| 12948567_c3_1630 | 904 | 5076 | 95 | 288 | 376 | 1.3e-34 |
| Protein name | | | | | Locus Name | Acc# |
| hypothetical protein (argF-lacZ region) | | | | | pir:I41306 | I41306 |

Description

| ORF Name | NTID | AAID | NT Length | AA Length | Score | Probability |
|---|---|---|---|---|---|---|
| 13007837_f2_372 | 905 | 5077 | 109 | 330 | | |
| Protein name | | | | | Locus Name | Acc# |

Description

NO-HIT

| ORF Name | NTID | AAID | NT Length | AA Length | Score | Probability |
|---|---|---|---|---|---|---|
| 1300882_f3_646 | 906 | 5078 | 241 | 726 | | |
| Protein name | | | | | Locus Name | Acc# |

Description

NO-HIT

| ORF_Name | NTID | AAID | NT Length | AA Length | Score | Probability |
|---|---|---|---|---|---|---|
| 1303152_c3_1377 | 907 | 5079 | 93 | 282 | | |
| Protein name | | | | | Locus Name | Acc# |

Description
NO-HIT

| ORF_Name | NTID | AAID | NT Length | AA Length | Score | Probability |
|---|---|---|---|---|---|---|
| 1360160_c1_1030 | 908 | 5080 | 64 | 195 | | |
| Protein name | | | | | Locus Name | Acc# |

Description
NO-HIT

| ORF_Name | NTID | AAID | NT Length | AA Length | Score | Probability |
|---|---|---|---|---|---|---|
| 1365942_f3_641 | 909 | 5081 | 107 | 324 | 78 | 0.025 |
| Protein name | | | | | Locus Name | Acc# |
| | | | | | sp:PANC_BACSU | P52998 |

Description
(PANTOATE ACTIVATING ENZYME)

| ORF_Name | NTID | AAID | NT Length | AA Length | Score | Probability |
|---|---|---|---|---|---|---|
| 13694785_c1_967 | 910 | 5082 | 383 | 1152 | 1759 | 3.5e-181 |
| Protein name | | | | | Locus Name | Acc# |
| alcohol dehydrogenase, C:class III alcohol dehydrogenase | | | | | pir:S57525 | S57525 |

Description

| ORF_Name | NTID | AAID | NT Length | AA Length | Score | Probability |
|---|---|---|---|---|---|---|
| 13707627_c3_1446 | 911 | 5083 | 265 | 798 | 1121 | 1.4e-113 |
| Protein name | | | | | Locus Name | Acc# |
| | | | | | sp:HIS6_SALTY | P10374 |

Description
HISF PROTEIN (CYCLASE)

| ORF_Name | NTID | AAID | NT Length | AA Length | Score | Probability |
|---|---|---|---|---|---|---|
| 13714410_c1_879 | 912 | 5084 | 401 | 1206 | 1381 | 4.0e-141 |
| Protein name | | | | | Locus_Name | Acc# |
| | | | | | sp:YBHS_ECOLI | P75775 |

Description

HYPOTHETICAL 42.1 KD PROTEIN IN MOAE-RHLE INTERGENIC REGION

| ORF_Name | NTID | AAID | NT Length | AA Length | Score | Probability |
|---|---|---|---|---|---|---|
| 13806553_f2_381 | 913 | 5085 | 318 | 957 | | |
| Protein name | | | | | Locus_Name | Acc# |

Description

NO-HIT

| ORF_Name | NTID | AAID | NT Length | AA Length | Score | Probability |
|---|---|---|---|---|---|---|
| 13839160_f2_507 | 914 | 5086 | 103 | 312 | 159 | 5.0e-11 |
| Protein name | | | | | Locus_Name | Acc# |
| core protein | | | | | gp:ECRHSEH2 | AF044501 |

Description

Escherichia coli strain ec45 RhsE accessory genetic element coreprotein gene, partial cds, and dsORF-e4, complete cds; and RhsHaccessory genetic element unknown (450), core protein, and dsORF-h1genes, complete cds.

| ORF_Name | NTID | AAID | NT Length | AA Length | Score | Probability |
|---|---|---|---|---|---|---|
| 13839160_f3_769 | 915 | 5087 | 179 | 540 | 151 | 8.8e-11 |
| Protein name | | | | | Locus_Name | Acc# |
| rhsF | | | | | pir:I69804 | I69804 |

Description

| ORF_Name | NTID | AAID | NT Length | AA Length | Score | Probability |
|---|---|---|---|---|---|---|
| 1385750_f1_170 | 916 | 5088 | 164 | 495 | 695 | 2.0e-68 |
| Protein name | | | | | Locus_Name | Acc# |
| molybdenum cofactor biosynthesis protein C:moaC protein | | | | | pir:G64814 | G64814:S35 |

Description

271

| ORF Name | NTID | AAID | NT Length | AA Length | Score | Probability |
|---|---|---|---|---|---|---|
| 13954542_c3_1545 | 917 | 5089 | 179 | 540 | 726 | 1.0e-71 |
| Protein name | | | | | Locus Name | Acc# |
| | | | | | sp:YBEA_ECOLI | P05850 |

Description: HYPOTHETICAL 17.3 KD PROTEIN IN MRDA-PHPB INTERGENIC REGION

| ORF Name | NTID | AAID | NT Length | AA Length | Score | Probability |
|---|---|---|---|---|---|---|
| 13961432_f1_91 | 918 | 5090 | 71 | 216 | 100 | 2.2e-05 |
| Protein name | | | | | Locus Name | Acc# |
| hypothetical protein APE2345 | | | | | pir:F72462 | F72462 |

Description

| ORF Name | NTID | AAID | NT Length | AA Length | Score | Probability |
|---|---|---|---|---|---|---|
| 14109550_c3_1442 | 919 | 5091 | 254 | 765 | 921 | 2.2e-92 |
| Protein name | | | | | Locus Name | Acc# |
| | | | | | sp:ARTI_ECOLI | P30859;P77 |

Description: ARGININE-BINDING PERIPLASMIC PROTEIN 1 PRECURSOR

| ORF Name | NTID | AAID | NT Length | AA Length | Score | Probability |
|---|---|---|---|---|---|---|
| 1415930_f1_195 | 920 | 5092 | 142 | 429 | 446 | 4.8e-42 |
| Protein name | | | | | Locus Name | Acc# |
| | | | | | sp:YJBQ_ECOLI | P32698 |

Description: HYPOTHETICAL 15.7 KD PROTEIN IN APHA-UVRA INTERGENIC REGION (O138)

| ORF Name | NTID | AAID | NT Length | AA Length | Score | Probability |
|---|---|---|---|---|---|---|
| 14235626_c3_1646 | 921 | 5093 | 334 | 1005 | 695 | 2.0e-68 |
| Protein name | | | | | Locus Name | Acc# |
| | | | | | sp:TRER_SALTY | P36674 |

Description: TREHALOSE OPERON REPRESSOR

272

| ORF Name | NTID | AAID | NT Length | AA Length | Score | Probability |
|---|---|---|---|---|---|---|
| 1425127_f2_320 | 922 | 5094 | 263 | 792 | 1141 | 1.1e-115 |
| Protein name | | | | | Locus Name | Acc# |
| | | | | | sp:TRMD_SERMA | P36244 |

Description: (METHYLTRANSFERASE)

| ORF Name | NTID | AAID | NT Length | AA Length | Score | Probability |
|---|---|---|---|---|---|---|
| 1429636_f3_523 | 923 | 5095 | 92 | 279 | 187 | 1.3e-14 |
| Protein name | | | | | Locus Name | Acc# |
| hypothetical protein B | | | | | pir:S21562 | S21562 |

Description:

| ORF Name | NTID | AAID | NT Length | AA Length | Score | Probability |
|---|---|---|---|---|---|---|
| 14298510_c1_922 | 924 | 5096 | 279 | 840 | 774 | 8.4e-77 |
| Protein name | | | | | Locus Name | Acc# |
| | | | | | sp:YBFF_ECOLI | P75736 |

Description: PUTATIVE ESTERASE/LIPASE YBFF,

| ORF Name | NTID | AAID | NT Length | AA Length | Score | Probability |
|---|---|---|---|---|---|---|
| 14299192_c1_873 | 925 | 5097 | 285 | 858 | 628 | 2.5e-61 |
| Protein name | | | | | Locus Name | Acc# |
| probable thiosulfate sulfurtransferase, | | | | | pir:H65028 | H65028 |

Description:

| ORF Name | NTID | AAID | NT Length | AA Length | Score | Probability |
|---|---|---|---|---|---|---|
| 14334385_c1_980 | 926 | 5098 | 95 | 288 | 215 | 1.4e-17 |
| Protein name | | | | | Locus Name | Acc# |
| probable NrdH protein | | | | | pir:F70648 | F70648 |

Description:

| ORF Name | NTID | AAID | NT Length | AA Length | Score | Probability |
|---|---|---|---|---|---|---|
| 14457930_c3_1535 | 927 | 5099 | 361 | 1086 | 1475 | 4.4e-151 |
| Protein name | | | | | Locus Name | Acc# |
| | | | | | sp:PHOL_ECOLI | P77349 |

Description
PHOH-LIKE PROTEIN

| ORF Name | NTID | AAID | NT Length | AA Length | Score | Probability |
|---|---|---|---|---|---|---|
| 1448510_c2_1348 | 928 | 5100 | 106 | 321 | | |
| Protein name | | | | | Locus Name | Acc# |

Description
NO-HIT

| ORF Name | NTID | AAID | NT Length | AA Length | Score | Probability |
|---|---|---|---|---|---|---|
| 1448588_c2_1146 | 929 | 5101 | 71 | 216 | 78 | 0.0061 |
| Protein name | | | | | Locus Name | Acc# |
| BACR42I17.ab | | | | | gp:DMBR42I17 | AL121806 |

Description
Drosophila melanogaster clone BACR42I17.

| ORF Name | NTID | AAID | NT Length | AA Length | Score | Probability |
|---|---|---|---|---|---|---|
| 14494042_f1_182 | 930 | 5102 | 155 | 468 | 138 | 2.4e-09 |
| Protein name | | | | | Locus Name | Acc# |
| | | | | | sp:YC07_METJA | Q58604 |

Description
HYPOTHETICAL PROTEIN MJ1207

| ORF Name | NTID | AAID | NT Length | AA Length | Score | Probability |
|---|---|---|---|---|---|---|
| 14534718_c2_1161 | 931 | 5103 | 359 | 1080 | 1510 | 8.6e-155 |
| Protein name | | | | | Locus Name | Acc# |
| histidinol-phosphatase and | | | | | gp:AB008676 | AB008676 |

Description
Escherichia coli O157 DNA, map position at 46 min., complete cds.

| ORF Name | NTID | AAID | NT Length | AA Length | Score | Probability |
|---|---|---|---|---|---|---|
| 14539078_c1_976 | 932 | 5104 | 637 | 1914 | 2552 | 3.3e-265 |
| Protein name | | | | | Locus Name | Acc# |
| | | | | | sp:PBP2_ECOLI | P08150 |

Description: PENICILLIN-BINDING PROTEIN 2 (PBP-2)

| ORF Name | NTID | AAID | NT Length | AA Length | Score | Probability |
|---|---|---|---|---|---|---|
| 14551061_c1_1071 | 933 | 5105 | 68 | 207 | | |
| Protein name | | | | | Locus Name | Acc# |

Description: NO-HIT

| ORF Name | NTID | AAID | NT Length | AA Length | Score | Probability |
|---|---|---|---|---|---|---|
| 14569032_f2_477 | 934 | 5106 | 569 | 1710 | 1574 | 1.4e-161 |
| Protein name | | | | | Locus Name | Acc# |
| | | | | | sp:YBJD_ECOLI | P75828 |

Description: HYPOTHETICAL 63.6 KD PROTEIN IN AQPZ-CSPD INTERGENIC REGION

| ORF Name | NTID | AAID | NT Length | AA Length | Score | Probability |
|---|---|---|---|---|---|---|
| 1459675_c2_1343 | 935 | 5107 | 79 | 240 | 136 | 3.4e-09 |
| Protein name | | | | | Locus Name | Acc# |
| ORF4 | | | | | gp:AF152923 | AF152923 |

Description: Yersinia pestis CH971662 cryptic plasmid pYC, complete sequence.

| ORF Name | NTID | AAID | NT Length | AA Length | Score | Probability |
|---|---|---|---|---|---|---|
| 1462776_f2_302 | 936 | 5108 | 413 | 1242 | 1753 | 1.5e-180 |
| Protein name | | | | | Locus Name | Acc# |
| NqrB | | | | | gp:AF117331 | AF117331 |

Description: Vibrio cholerae N16961 Na+-translocating NADH-ubiquinoneoxidoreductase enzyme complex, complete sequence.

| ORF_Name | NTID | AAID | NT Length | AA Length | Score | Probability |
|---|---|---|---|---|---|---|
| 14645878_c1_957 | 937 | 5109 | 77 | 234 | | |
| Protein name | | | | | Locus Name | Acc# |

Description
NO-HIT

| ORF_Name | NTID | AAID | NT Length | AA Length | Score | Probability |
|---|---|---|---|---|---|---|
| 14657817_f2_377 | 938 | 5110 | 78 | 237 | | |
| Protein name | | | | | Locus Name | Acc# |

Description
NO-HIT

| ORF_Name | NTID | AAID | NT Length | AA Length | Score | Probability |
|---|---|---|---|---|---|---|
| 14708292_c1_1036 | 939 | 5111 | 159 | 480 | 561 | 3.1e-54 |
| Protein name | | | | | Locus Name | Acc# |
| | | | | | gp:ECU28377 | U28377 |

Description
Escherichia coli K-12 genome; approximately 65 to 68 minutes.

| ORF_Name | NTID | AAID | NT Length | AA Length | Score | Probability |
|---|---|---|---|---|---|---|
| 14735302_c2_1274 | 940 | 5112 | 328 | 987 | 1547 | 1.0e-158 |
| Protein name | | | | | Locus Name | Acc# |
| | | | | | sp:LIPA_ECOLI | P25845:P77 |

Description
LIPOIC ACID SYNTHETASE (LIP-SYN) (LIPOATE SYNTHASE)

| ORF_Name | NTID | AAID | NT Length | AA Length | Score | Probability |
|---|---|---|---|---|---|---|
| 14860417_c3_1614 | 941 | 5113 | 242 | 729 | 458 | 2.6e-43 |
| Protein name | | | | | Locus Name | Acc# |
| ORF6 | | | | | gp:AF152923 | AF152923 |

Description
Yersinia pestis CH971662 cryptic plasmid pYC, complete sequence.

| ORF Name | NTID | AAID | NT Length | AA Length | Score | Probability |
|---|---|---|---|---|---|---|
| 14880152_c1_925 | 942 | 5114 | 150 | 453 | 708 | 8.3e-70 |
| Protein name | | | | | Locus Name | Acc# |
| ferric uptake regulation protein | | | | | gp:AF016035 | AF016035 |

Description: Erwinia chrysanthemi ferric uptake regulation protein (fur) gene, complete cds.

| ORF Name | NTID | AAID | NT Length | AA Length | Score | Probability |
|---|---|---|---|---|---|---|
| 14884687_f1_52 | 943 | 5115 | 415 | 1248 | 1471 | 1.2e-150 |
| Protein name | | | | | Locus Name | Acc# |
| | | | | | sp:DCDA_ECOLI | P00861 |

Description: DIAMINOPIMELATE DECARBOXYLASE, (DAP DECARBOXYLASE)

| ORF Name | NTID | AAID | NT Length | AA Length | Score | Probability |
|---|---|---|---|---|---|---|
| 14886341_f1_207 | 944 | 5116 | 459 | 1380 | 1975 | 4.5e-204 |
| Protein name | | | | | Locus Name | Acc# |
| | | | | | sp:YCAJ_ECOLI | P45526:P75 |

Description: HYPOTHETICAL 49.6 KD PROTEIN IN LOLA-SERS INTERGENIC REGION

| ORF Name | NTID | AAID | NT Length | AA Length | Score | Probability |
|---|---|---|---|---|---|---|
| 14897200_c3_1521 | 945 | 5117 | 110 | 333 | 83 | 0.0016 |
| Protein name | | | | | Locus Name | Acc# |
| natriuretic peptide receptor C | | | | | gp:AF006821 | AF006821 |

Description: Bufo marinus natriuretic peptide receptor C mRNA, partial cds.

| ORF Name | NTID | AAID | NT Length | AA Length | Score | Probability |
|---|---|---|---|---|---|---|
| 14898436_f2_264 | 946 | 5118 | 699 | 2100 | 166 | 7.6e-15 |
| Protein name | | | | | Locus Name | Acc# |
| heme receptor | | | | | gp:AF047484 | AF047484 |

Description: Vibrio vulnificus heme receptor (hupA) gene, complete cds.

| ORF Name | NTID | AAID | NT Length | AA Length | Score | Probability |
|---|---|---|---|---|---|---|
| 14901562_c1_975 | 947 | 5119 | 110 | 333 | 403 | 1.7e-37 |
| Protein name | | | | | Locus Name | Acc# |
| | | | | | sp:YBEB_ECOLI | P05848:P77 |

Description: HYPOTHETICAL 11.6 KD PROTEIN IN MRDA-PHPB INTERGENIC REGION

| ORF Name | NTID | AAID | NT Length | AA Length | Score | Probability |
|---|---|---|---|---|---|---|
| 15625925_c2_1364 | 948 | 5120 | 64 | 195 | | |
| Protein name | | | | | Locus Name | Acc# |

Description: NO-HIT

| ORF Name | NTID | AAID | NT Length | AA Length | Score | Probability |
|---|---|---|---|---|---|---|
| 15658463_c1_990 | 949 | 5121 | 221 | 666 | 197 | 1.2e-15 |
| Protein name | | | | | Locus Name | Acc# |
| | | | | | sp:YDHC_BACSU | O05494 |

Description: HYPOTHETICAL TRANSCRIPTIONAL REGULATOR IN DINB-PHOB INTERGENIC REGION

| ORF Name | NTID | AAID | NT Length | AA Length | Score | Probability |
|---|---|---|---|---|---|---|
| 15660392_f3_556 | 950 | 5122 | 671 | 2016 | 659 | 1.3e-64 |
| Protein name | | | | | Locus Name | Acc# |
| FyuA precursor | | | | | gp:ECFYUAK49 | Z38065 |

Description: E.coli fyuA gene precursor.

| ORF Name | NTID | AAID | NT Length | AA Length | Score | Probability |
|---|---|---|---|---|---|---|
| 15704387_c2_1164 | 951 | 5123 | 561 | 1686 | 1817 | 2.5e-187 |
| Protein name | | | | | Locus Name | Acc# |
| | | | | | sp:YEGH_ECOLI | P76389:P94 |

Description: HYPOTHETICAL 59.5 KD PROTEIN IN WZA-ASMA INTERGENIC REGION

| ORF Name | NTID | AAID | NT Length | AA Length | Score | Probability |
|---|---|---|---|---|---|---|
| 15708385_c1_1080 | 952 | 5124 | 277 | 834 | | |
| Protein name | | | | | Locus Name | Acc# |
| | | | | | | |

Description
NO-HIT

| ORF Name | NTID | AAID | NT Length | AA Length | Score | Probability |
|---|---|---|---|---|---|---|
| 15708508_c1_958 | 953 | 5125 | 164 | 495 | 468 | 2.2e-44 |
| Protein name | | | | | Locus Name | Acc# |
| putative methyltransferase | | | | | gp:BA1242593 | AJ242593 |

Description
Bacteriophage A118 complete genome.

| ORF Name | NTID | AAID | NT Length | AA Length | Score | Probability |
|---|---|---|---|---|---|---|
| 15714000_f3_652 | 954 | 5126 | 576 | 1731 | 2547 | 1.1e-264 |
| Protein name | | | | | Locus Name | Acc# |
| glutamine--tRNA ligase,:glutaminyl-tRNA synthetase | | | | | pir:SYECQT | G64802:A92 |

Description

| ORF Name | NTID | AAID | NT Length | AA Length | Score | Probability |
|---|---|---|---|---|---|---|
| 15741306_c3_1482 | 955 | 5127 | 94 | 285 | 109 | 2.5e-06 |
| Protein name | | | | | Locus Name | Acc# |
| hypothetical protein APE1672 | | | | | pir:D72548 | D72548 |

Description

| ORF Name | NTID | AAID | NT Length | AA Length | Score | Probability |
|---|---|---|---|---|---|---|
| 15828428_c2_1269 | 956 | 5128 | 281 | 846 | 1072 | 2.2e-108 |
| Protein name | | | | | Locus Name | Acc# |
| | | | | | sp:GLTJ_ECOLI | P41074 |

Description
GLUTAMATE/ASPARTATE TRANSPORT SYSTEM PERMEASE PROTEIN GLTJ

| ORF Name | NTID | AAID | NT Length | AA Length | Score | Probability |
|---|---|---|---|---|---|---|
| 16051537_c3_1548 | 957 | 5129 | 99 | 300 | 398 | 5.9e-37 |

| Protein name | Locus Name | Acc# |
|---|---|---|
| | sp:YBED_ECOLI | P30977 |

Description

HYPOTHETICAL 9.8 KD PROTEIN IN LIPB-DACA INTERGENIC REGION (ORF1)

| ORF Name | NTID | AAID | NT Length | AA Length | Score | Probability |
|---|---|---|---|---|---|---|
| 16058456_f3_694 | 958 | 5130 | 79 | 240 | 105 | 6.6e-06 |

| Protein name | Locus Name | Acc# |
|---|---|---|
| hypothetical protein APE0042 | pir:E72756 | E72756 |

Description

| ORF Name | NTID | AAID | NT Length | AA Length | Score | Probability |
|---|---|---|---|---|---|---|
| 16134687_c1_1060 | 959 | 5131 | 342 | 1029 | 563 | 1.9e-54 |

| Protein name | Locus Name | Acc# |
|---|---|---|
| VirB11 | gp:AF141604 | AF141604 |

Description

Brucella suis VirB1 (virB1), VirB2 (virB2), VirB3 (virB3), VirB4(virB4), VirB5 (virB5), VirB6 (virB6), VirB7 (virB7), VirB8(virB8), VirB9 (virB9), VirB10 (virB10), VirB11 (virB11), and ORF12genes, complete cds.

| ORF Name | NTID | AAID | NT Length | AA Length | Score | Probability |
|---|---|---|---|---|---|---|
| 16226688_c1_945 | 960 | 5132 | 65 | 198 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 16228936_f2_318 | 961 | 5133 | 101 | 306 | 361 | 4.9e-33 |

| Protein name | Locus Name | Acc# |
|---|---|---|
| 30S RIBOSOMAL PROTEIN S16. | gp:D90888 | D90888:AB0 |

Description

E.coli genomic DNA, Kohara clone #438(58.9-59.3 min.).

| ORF Name | NTID | AAID | NT Length | AA Length | Score | Probability |
|---|---|---|---|---|---|---|
| 16305163_f2_317 | 962 | 5134 | 194 | 585 | 761 | 2.0e-75 |
| Protein name | | | | | Locus Name | Acc# |
| hypothetical protein in emrB 3' region | | | | | pir:H65048 | H65048 |

Description

| ORF Name | NTID | AAID | NT Length | AA Length | Score | Probability |
|---|---|---|---|---|---|---|
| 16407828_c1_1078 | 963 | 5135 | 106 | 321 | | |
| Protein name | | | | | Locus Name | Acc# |

Description
NO-HIT

| ORF Name | NTID | AAID | NT Length | AA Length | Score | Probability |
|---|---|---|---|---|---|---|
| 16464410_f2_398 | 964 | 5136 | 187 | 564 | 576 | 8.1e-56 |
| Protein name | | | | | Locus Name | Acc# |
| | | | | | sp:SEQA_ECOLI | P36658 |

Description
SEQA PROTEIN

| ORF Name | NTID | AAID | NT Length | AA Length | Score | Probability |
|---|---|---|---|---|---|---|
| 164813_f2_478 | 965 | 5137 | 373 | 1122 | 1008 | 1.3e-101 |
| Protein name | | | | | Locus Name | Acc# |
| probable membrane protein b0878 | | | | | pir:F64826 | F64826 |

Description

| ORF Name | NTID | AAID | NT Length | AA Length | Score | Probability |
|---|---|---|---|---|---|---|
| 16603433_c3_1397 | 966 | 5138 | 263 | 792 | | |
| Protein name | | | | | Locus Name | Acc# |

Description
NO-HIT

| ORF Name | NTID | AAID | NT Length | AA Length | Score | Probability |
|---|---|---|---|---|---|---|
| 16676417_c2_1353 | 967 | 5139 | 119 | 360 | 144 | 3.2e-09 |
| Protein name | | | | | Locus Name | Acc# |
| hypothetical protein | | | | | pir:S50828 | S50828 |

Description

| ORF Name | NTID | AAID | NT Length | AA Length | Score | Probability |
|---|---|---|---|---|---|---|
| 16681630_c3_1621 | 968 | 5140 | 255 | 768 | 237 | 6.8e-20 |
| Protein name | | | | | Locus Name | Acc# |
| | | | | | gp:ECL224861 | AJ224861 |

Description

Enterobacter cloacae plasmid CloDF13 mobilization region.

| ORF Name | NTID | AAID | NT Length | AA Length | Score | Probability |
|---|---|---|---|---|---|---|
| 16829686_f3_514 | 969 | 5141 | 249 | 750 | | |
| Protein name | | | | | Locus Name | Acc# |

Description

NO-HIT

| ORF Name | NTID | AAID | NT Length | AA Length | Score | Probability |
|---|---|---|---|---|---|---|
| 17011502_c1_845 | 970 | 5142 | 460 | 1383 | 1868 | 9.9e-193 |
| Protein name | | | | | Locus Name | Acc# |
| | | | | | sp:SDHM_ECOLI | P30744:Q59 |

Description (L-SD2)

| ORF Name | NTID | AAID | NT Length | AA Length | Score | Probability |
|---|---|---|---|---|---|---|
| 17054155_f3_768 | 971 | 5143 | 76 | 231 | 118 | 1.0e-05 |
| Protein name | | | | | Locus Name | Acc# |
| core protein | | | | | gp:ECRHSEH2 | AF044501 |

Description

Escherichia coli strain ec45 RhsE accessory genetic element coreprotein gene, partial cds, and dsORF-e4, complete cds; and RhsHaccessory genetic element unknown (450), core protein, and dsORF-h1genes, complete cds.

| ORF Name | NTID | AAID | NT Length | AA Length | Score | Probability |
|---|---|---|---|---|---|---|
| 171885_f2_289 | 972 | 5144 | 73 | 222 | | |
| Protein name | | | | | Locus Name | Acc# |

Description
NO-HIT

| ORF Name | NTID | AAID | NT Length | AA Length | Score | Probability |
|---|---|---|---|---|---|---|
| 190678_c2_1252 | 973 | 5145 | 106 | 321 | 158 | 1.6e-11 |
| Protein name | | | | | Locus Name | Acc# |
| | | | | | sp:SSB_ECOLI | P02339 |

Description
SINGLE-STRAND BINDING PROTEIN (SSB) (HELIX-DESTABILIZING PROTEIN)

| ORF Name | NTID | AAID | NT Length | AA Length | Score | Probability |
|---|---|---|---|---|---|---|
| 194025_f2_338 | 974 | 5146 | 65 | 198 | | |
| Protein name | | | | | Locus Name | Acc# |

Description
NO-HIT

| ORF Name | NTID | AAID | NT Length | AA Length | Score | Probability |
|---|---|---|---|---|---|---|
| 19536591_f3_742 | 975 | 5147 | 434 | 1305 | 1722 | 2.9e-177 |
| Protein name | | | | | Locus Name | Acc# |
| | | | | | sp:AROA_ECOLI | P07638:P78 |

Description
(ENOLPYRUVYLSHIKIMATE-3-PHOSPHATE SYNTHASE) (EPSP SYNTHASE)

| ORF Name | NTID | AAID | NT Length | AA Length | Score | Probability |
|---|---|---|---|---|---|---|
| 19539087_f1_232 | 976 | 5148 | 99 | 300 | 90 | 0.0043 |
| Protein name | | | | | Locus Name | Acc# |
| | | | | | gp:ECORHSEX | L19083 |

Description
Escherichia coli RhsE genetic element; defective RhsE core protein, complete cds; complete ORF-E2; H-rpt subelement; complete ORF-H.

| ORF Name | NTID | AAID | NT Length | AA Length | Score | Probability |
|---|---|---|---|---|---|---|
| 19548202_f3_552 | 977 | 5149 | 70 | 213 | | |
| Protein name | | | | | Locus Name | Acc# |

Description: NO-HIT

| ORF Name | NTID | AAID | NT Length | AA Length | Score | Probability |
|---|---|---|---|---|---|---|
| 19578812_c2_1224 | 978 | 5150 | 111 | 336 | 128 | 2.4e-08 |
| Protein name | | | | | Locus Name | Acc# |
| | | | | | gp:PMFIMOPR | Z32686 |

Description: Proteus mirabilis fimbrial operon, strain HI4320.

| ORF Name | NTID | AAID | NT Length | AA Length | Score | Probability |
|---|---|---|---|---|---|---|
| 19581443_f2_422 | 979 | 5151 | 523 | 1572 | 739 | 4.3e-73 |
| Protein name | | | | | Locus Name | Acc# |
| HecB | | | | | gp:ERWHRPN | L39897 |

Description: Erwinia chrysanthemi phospholipase C (plcA) gene, partial cds; HrpF(hrpF), HrpG (hrpG), HrcC (hrcC), HrpT (hrpT), HrpV (hrpV), HrpNharpin (hrpN), ORF1, and HecB (hecB) genes, complete cds; and HecA(hecA) gene, partial cds.

| ORF Name | NTID | AAID | NT Length | AA Length | Score | Probability |
|---|---|---|---|---|---|---|
| 19609385_c3_1547 | 980 | 5152 | 422 | 1269 | 1581 | 2.6e-162 |
| Protein name | | | | | Locus Name | Acc# |
| | | | | | sp:DACA_ECOLI | P04287:P77 |

Description: (DD-CARBOXYPEPTIDASE) (PBP-5)

| ORF Name | NTID | AAID | NT Length | AA Length | Score | Probability |
|---|---|---|---|---|---|---|
| 1961563_f3_686 | 981 | 5153 | 232 | 699 | 721 | 3.5e-71 |
| Protein name | | | | | Locus Name | Acc# |
| DTB SYNTHASE | | | | | gp:A38251 | A38251 |

Description: Sequence 6 from Patent WO9408023.

| ORF Name | NTID | AAID | NT Length | AA Length | Score | Probability |
|---|---|---|---|---|---|---|
| 19665635_c1_987 | 982 | 5154 | 303 | 912 | 866 | 1.5e-86 |
| Protein name | | | | | Locus Name | Acc# |
| hypothetical protein b2681 | | | | | pir:B65048 | B65048 |

Description

| ORF Name | NTID | AAID | NT Length | AA Length | Score | Probability |
|---|---|---|---|---|---|---|
| 19688891_c1_970 | 983 | 5155 | 248 | 747 | 974 | 5.4e-98 |
| Protein name | | | | | Locus Name | Acc# |
| | | | | | sp:GLTK_ECOLI | P41075 |

Description

GLUTAMATE/ASPARTATE TRANSPORT SYSTEM PERMEASE PROTEIN GLTK

| ORF Name | NTID | AAID | NT Length | AA Length | Score | Probability |
|---|---|---|---|---|---|---|
| 19691906_c1_1108 | 984 | 5156 | 481 | 1446 | 1592 | 1.7e-163 |
| Protein name | | | | | Locus Name | Acc# |
| | | | | | sp:PTTB_ECOLI | P36672 |

Description (EC 2.7.1.69) (EII-TRE)

| ORF Name | NTID | AAID | NT Length | AA Length | Score | Probability |
|---|---|---|---|---|---|---|
| 19699012_f1_231 | 985 | 5157 | 207 | 624 | 103 | 0.0042 |
| Protein name | | | | | Locus Name | Acc# |
| ribosomal protein var1 | | | | | pir:S04682 | S04682 |

Description

| ORF Name | NTID | AAID | NT Length | AA Length | Score | Probability |
|---|---|---|---|---|---|---|
| 19711512_c1_908 | 986 | 5158 | 140 | 423 | 184 | 2.8e-14 |
| Protein name | | | | | Locus Name | Acc# |
| hypothetical protein APE1069 | | | | | pir:F72706 | F72706 |

Description

| ORF Name | NTID | AAID | NT Length | AA Length | Score | Probability |
|---|---|---|---|---|---|---|
| 19719003_c2_1175 | 987 | 5159 | 177 | 534 | 641 | 1.0e-62 |
| Protein name | | | | | Locus Name | Acc# |
| DNA-binding protein, starvation-inducible | | | | pir:A46401 | | A46401:S29 |

Description

| ORF Name | NTID | AAID | NT Length | AA Length | Score | Probability |
|---|---|---|---|---|---|---|
| 19719751_f2_310 | 988 | 5160 | 151 | 456 | 343 | 4.0e-31 |
| Protein name | | | | | Locus Name | Acc# |
| | | | | | sp:CRL_ECOLI | P24251:P77 |

Description

CURLIN GENES TRANSCRIPTIONAL ACTIVATORY PROTEIN

| ORF Name | NTID | AAID | NT Length | AA Length | Score | Probability |
|---|---|---|---|---|---|---|
| 19723561_c2_1215 | 989 | 5161 | 396 | 1191 | 405 | 1.1e-37 |
| Protein name | | | | | Locus Name | Acc# |
| bicyclomycin resistance protein (bcr1) RP603 | | | | pir:E71665 | | E71665 |

Description

| ORF Name | NTID | AAID | NT Length | AA Length | Score | Probability |
|---|---|---|---|---|---|---|
| 19770267_f2_316 | 990 | 5162 | 542 | 1629 | 1818 | 2.0e-187 |
| Protein name | | | | | Locus Name | Acc# |
| gamma-glutamylcysteine synthetase | | | | gp:AF055352 | | AF055352 |

Description

Salmonella typhimurium gamma-glutamylcysteine synthetase (gshA)gene, complete cds.

| ORF Name | NTID | AAID | NT Length | AA Length | Score | Probability |
|---|---|---|---|---|---|---|
| 19814702_f3_688 | 991 | 5163 | 320 | 963 | | |
| Protein name | | | | | Locus Name | Acc# |

Description

NO-HIT

| ORF Name | NTID | AAID | NT Length | AA Length | Score | Probability |
|---|---|---|---|---|---|---|
| 1989092_c3_1417 | 992 | 5164 | 209 | 630 | 232 | 1.1e-18 |
| Protein name | | | | | Locus Name | Acc# |
| hypothetical protein Rv1634 | | | | pir:H70559 | | H70559 |

Description

| ORF Name | NTID | AAID | NT Length | AA Length | Score | Probability |
|---|---|---|---|---|---|---|
| 2000717_f1_216 | 993 | 5165 | 196 | 591 | 638 | 2.2e-62 |
| Protein name | | | | | Locus Name | Acc# |
| | | | | sp:YCBK_ECOLI | | P75848 |

Description
HYPOTHETICAL 20.4 KD PROTEIN IN MUKB-ASPC INTERGENIC REGION

| ORF Name | NTID | AAID | NT Length | AA Length | Score | Probability |
|---|---|---|---|---|---|---|
| 20111692_c1_1003 | 994 | 5166 | 115 | 348 | 385 | 1.4e-35 |
| Protein name | | | | | Locus Name | Acc# |
| hypothetical 13K protein (pheA 5' region):yfiA protein | | | | pir:Q5ECPA | | A30275:A36 |

Description

| ORF Name | NTID | AAID | NT Length | AA Length | Score | Probability |
|---|---|---|---|---|---|---|
| 20353402_f1_141 | 995 | 5167 | 87 | 264 | 90 | 0.0064 |
| Protein name | | | | | Locus Name | Acc# |
| putative phage tail protein | | | | gp:YPPMT1 | | AL117211 |

Description
Yersinia pestis plasmid pPMT1.

| ORF Name | NTID | AAID | NT Length | AA Length | Score | Probability |
|---|---|---|---|---|---|---|
| 20408125_c1_1034 | 996 | 5168 | 328 | 987 | 126 | 1.5e-05 |

| Protein name | Locus Name | Acc# |
|---|---|---|
| | sp:BLAB_AERHY | P26918 |

Description

BETA-LACTAMASE PRECURSOR,

| ORF Name | NTID | AAID | NT Length | AA Length | Score | Probability |
|---|---|---|---|---|---|---|
| 20579688_c1_982 | 997 | 5169 | 404 | 1215 | 1506 | 2.3e-154 |
| Protein name | | | | | Locus Name | Acc# |
| | | | | | sp:PROV_ECOLI | P14175 |

Description: GLYCINE BETAINE/L-PROLINE TRANSPORT ATP-BINDING PROTEIN PROV

| ORF Name | NTID | AAID | NT Length | AA Length | Score | Probability |
|---|---|---|---|---|---|---|
| 20586562_f1_202 | 998 | 5170 | 83 | 252 | | |
| Protein name | | | | | Locus Name | Acc# |

Description: NO-HIT

| ORF Name | NTID | AAID | NT Length | AA Length | Score | Probability |
|---|---|---|---|---|---|---|
| 20729636_c3_1452 | 999 | 5171 | 591 | 1776 | 2244 | 1.4e-232 |
| Protein name | | | | | Locus Name | Acc# |
| | | | | | sp:SFCA_ECOLI | P26616:P78 |

Description: , (MALIC ENZYME)

| ORF Name | NTID | AAID | NT Length | AA Length | Score | Probability |
|---|---|---|---|---|---|---|
| 20744008_f2_498 | 1000 | 5172 | 217 | 654 | 739 | 4.3e-73 |
| Protein name | | | | | Locus Name | Acc# |
| | | | | | sp:YCBL_ECOLI | P75849 |

Description: HYPOTHETICAL 23.8 KD PROTEIN IN MUKB-ASPC INTERGENIC REGION

| ORF Name | NTID | AAID | NT Length | AA Length | Score | Probability |
|---|---|---|---|---|---|---|
| 20891965_f2_254 | 1001 | 5173 | 88 | 267 | 189 | 8.2e-15 |
| Protein name | | | | | Locus Name | Acc# |
| transposon gamma-delta resolvase (transposon | | | | | gp:AF053946 | AF053946 |

Description: Yersinia pestis plasmid pCD1, complete plasmid sequence.

| ORF Name | NTID | AAID | NT Length | AA Length | Score | Probability |
|---|---|---|---|---|---|---|
| 20915627_c1_866 | 1002 | 5174 | 418 | 1257 | 1307 | 2.8e-133 |
| Protein name | | | | | Locus Name | Acc# |
| | | | | | sp:MOEA_ECOLI | P12281 |

Description
MOLYBDOPTERIN BIOSYNTHESIS MOEA PROTEIN

| ORF Name | NTID | AAID | NT Length | AA Length | Score | Probability |
|---|---|---|---|---|---|---|
| 20917841_c3_1524 | 1003 | 5175 | 86 | 261 | | |
| Protein name | | | | | Locus Name | Acc# |

Description
NO-HIT

| ORF Name | NTID | AAID | NT Length | AA Length | Score | Probability |
|---|---|---|---|---|---|---|
| 210025_f1_233 | 1004 | 5176 | 319 | 960 | 263 | 1.1e-25 |
| Protein name | | | | | Locus Name | Acc# |
| core protein | | | | | gp:ECRHSEH2 | AF044501 |

Description
Escherichia coli strain ec45 RhsE accessory genetic element coreprotein gene, partial cds, and dsORF-e4, complete cds; and RhsHaccessory genetic element unknown (450), core protein, and dsORF-h1genes, complete cds.

| ORF Name | NTID | AAID | NT Length | AA Length | Score | Probability |
|---|---|---|---|---|---|---|
| 210075_c1_962 | 1005 | 5177 | 279 | 840 | 1106 | 5.5e-112 |
| Protein name | | | | | Locus Name | Acc# |
| | | | | | sp:NAGB_ECOLI | P09375:O68 |

Description
PHOSPHATE DEAMINASE) (GNPDA) (GLCN6P DEAMINASE)

| ORF Name | NTID | AAID | NT Length | AA Length | Score | Probability |
|---|---|---|---|---|---|---|
| 2110135_c1_1024 | 1006 | 5178 | 78 | 237 | | |
| Protein name | | | | | Locus Name | Acc# |

Description
NO-HIT

| ORF Name | NTID | AAID | NT Length | AA Length | Score | Probability |
|---|---|---|---|---|---|---|
| 213965_c3_1546 | 1007 | 5179 | 342 | 1029 | 462 | 9.7e-44 |
| Protein name | | | | | Locus Name | Acc# |
| | | | | | sp:RLPA_ECOLI | P10100 |

Description: RARE LIPOPROTEIN A PRECURSOR

| ORF Name | NTID | AAID | NT Length | AA Length | Score | Probability |
|---|---|---|---|---|---|---|
| 214175_c1_1056 | 1008 | 5180 | 361 | 1086 | 543 | 2.5e-52 |
| Protein name | | | | | Locus Name | Acc# |
| ORF5 | | | | | gp:AF152923 | AF152923 |

Description: Yersinia pestis CH971662 cryptic plasmid pYC, complete sequence.

| ORF Name | NTID | AAID | NT Length | AA Length | Score | Probability |
|---|---|---|---|---|---|---|
| 21492691_c2_1137 | 1009 | 5181 | 605 | 1818 | 2402 | 2.6e-249 |
| Protein name | | | | | Locus Name | Acc# |
| | | | | | sp:YCAO_ECOLI | P75838 |

Description: HYPOTHETICAL 65.7 KD PROTEIN IN FOCA-SERC INTERGENIC REGION

| ORF Name | NTID | AAID | NT Length | AA Length | Score | Probability |
|---|---|---|---|---|---|---|
| 21517251_f2_423 | 1010 | 5182 | 1534 | 4605 | 98 | 7.6e-07 |
| Protein name | | | | | Locus Name | Acc# |
| repeat organellar protein | | | | | pir:T18372 | T18372 |

Description:

| ORF Name | NTID | AAID | NT Length | AA Length | Score | Probability |
|---|---|---|---|---|---|---|
| 2152137_c3_1497 | 1011 | 5183 | 187 | 564 | 775 | 6.6e-77 |
| Protein name | | | | | Locus Name | Acc# |
| uroepithelial cell adherence protein | | | | | gp:PMU28420 | U28420 |

Description: Proteus mirabilis uroepithelial cell adherence protein (uca) gene, complete cds.

| ORF Name | NTID | AAID | NT Length | AA Length | Score | Probability |
|---|---|---|---|---|---|---|
| 21521931_c3_1540 | 1012 | 5184 | 870 | 2613 | 3770 | 0.0 |
| Protein name | | | | | Locus Name | Acc# |
| leucine tRNA synthetase | | | | | gp:ECU82598 | U82598 |

Description: Escherichia coli genomic sequence of minutes 9 to 12.

| ORF Name | NTID | AAID | NT Length | AA Length | Score | Probability |
|---|---|---|---|---|---|---|
| 21568801_c2_1260 | 1013 | 5185 | 487 | 1464 | 2122 | 1.2e-219 |
| Protein name | | | | | Locus Name | Acc# |
| MiaB protein | | | | | gp:STY249116 | AJ249116 |

Description: Salmonella typhimurium yleB (partial), miaB, ybeZ and ybeY(partial) genes.

| ORF Name | NTID | AAID | NT Length | AA Length | Score | Probability |
|---|---|---|---|---|---|---|
| 21593800_f3_625 | 1014 | 5186 | 478 | 1437 | 1073 | 1.7e-108 |
| Protein name | | | | | Locus Name | Acc# |
| | | | | | gp:AP000363 | AP000363 |

Description: Bacteriophage VT2-Sa, complete genome sequence.

| ORF Name | NTID | AAID | NT Length | AA Length | Score | Probability |
|---|---|---|---|---|---|---|
| 21601566_c3_1398 | 1015 | 5187 | 513 | 1542 | | |
| Protein name | | | | | Locus Name | Acc# |

Description: NO-HIT

| ORF Name | NTID | AAID | NT Length | AA Length | Score | Probability |
|---|---|---|---|---|---|---|
| 21657591_f1_94 | 1016 | 5188 | 275 | 828 | 341 | 6.4e-31 |
| Protein name | | | | | Locus Name | Acc# |
| | | | | | gp:STY224978 | AJ224978 |

Description: Salmonella typhimurium, Salmonella Pathogenicity Island 2 (SPI2)genes, ttr gene cluster.

| ORF Name | NTID | AAID | NT Length | AA Length | Score | Probability |
|---|---|---|---|---|---|---|
| 21681527_f3_635 | 1017 | 5189 | 134 | 405 | | |
| Protein name | | | | | Locus Name | Acc# |

Description
NO-HIT

| ORF Name | NTID | AAID | NT Length | AA Length | Score | Probability |
|---|---|---|---|---|---|---|
| 21720275_f2_360 | 1018 | 5190 | 95 | 288 | 233 | 1.8e-19 |
| Protein name | | | | | Locus Name | Acc# |
| hypothetical protein b0671 | | | | | pir:H64801 | H64801 |

Description

| ORF Name | NTID | AAID | NT Length | AA Length | Score | Probability |
|---|---|---|---|---|---|---|
| 21735637_f3_583 | 1019 | 5191 | 83 | 252 | | |
| Protein name | | | | | Locus Name | Acc# |

Description
NO-HIT

| ORF Name | NTID | AAID | NT Length | AA Length | Score | Probability |
|---|---|---|---|---|---|---|
| 21913387_f2_399 | 1020 | 5192 | 391 | 1176 | 1565 | 1.3e-160 |
| Protein name | | | | | Locus Name | Acc# |
| | | | | | sp:PGMU_ECOLI | P36938 |

Description
PHOSPHOGLUCOMUTASE, (GLUCOSE PHOSPHOMUTASE) (PGM)

| ORF Name | NTID | AAID | NT Length | AA Length | Score | Probability |
|---|---|---|---|---|---|---|
| 22038917_c1_807 | 1021 | 5193 | 72 | 219 | | |
| Protein name | | | | | Locus Name | Acc# |

Description
NO-HIT

| ORF Name | NTID | AAID | NT Length | AA Length | Score | Probability |
|---|---|---|---|---|---|---|
| 22038918_c1_959 | 1022 | 5194 | 247 | 744 | 710 | 5.1e-70 |
| Protein name | | | | | Locus Name | Acc# |
| exonuclease | | | | | gp:AP000363 | AP000363 |

Description
Bacteriophage VT2-Sa, complete genome sequence.

| ORF Name | NTID | AAID | NT Length | AA Length | Score | Probability |
|---|---|---|---|---|---|---|
| 22056562_c1_1050 | 1023 | 5195 | 87 | 264 | 406 | 8.3e-38 |
| Protein name | | | | | Locus Name | Acc# |
| NrpB | | | | | gp:PMU46488 | U46488 |

Description
Proteus mirabilis NrpS (nrpS) gene, partial cds, NrpU (nrpU), NrpT(nrpT), NrpA (nrpA), NrpB (nrpB), NrpG (nrpG) and IrpP (irpP)genes, complete cds.

| ORF Name | NTID | AAID | NT Length | AA Length | Score | Probability |
|---|---|---|---|---|---|---|
| 22069055_f1_130 | 1024 | 5196 | 290 | 873 | 112 | 0.0022 |
| Protein name | | | | | Locus Name | Acc# |
| | | | | | sp:DNAK_LACLA | P42368 |

Description
DNAK PROTEIN (HEAT SHOCK PROTEIN 70) (HSP70)

| ORF Name | NTID | AAID | NT Length | AA Length | Score | Probability |
|---|---|---|---|---|---|---|
| 22069416_f2_461 | 1025 | 5197 | 79 | 240 | 162 | 6.0e-12 |
| Protein name | | | | | Locus Name | Acc# |
| | | | | | gp:D90840 | D90840:AB0 |

Description
E.coli genomic DNA, Kohara clone #350(44.9-45.2 min.).

| ORF Name | NTID | AAID | NT Length | AA Length | Score | Probability |
|---|---|---|---|---|---|---|
| 22266057_c1_1110 | 1026 | 5198 | 429 | 1290 | 763 | 1.2e-75 |
| Protein name | | | | | Locus Name | Acc# |
| | | | | | sp:Y588_HAEIN | Q57051:O05 |

Description
HYPOTHETICAL PROTEIN HI0588

| ORF Name | NTID | AAID | NT Length | AA Length | Score | Probability |
|---|---|---|---|---|---|---|
| 22272941_c1_946 | 1027 | 5199 | 68 | 207 | | |
| Protein name | | | | | Locus Name | Acc# |

Description

NO-HIT

| ORF Name | NTID | AAID | NT Length | AA Length | Score | Probability |
|---|---|---|---|---|---|---|
| 22273387_c1_1077 | 1028 | 5200 | 100 | 303 | 77 | 0.018 |
| Protein name | | | | | Locus Name | Acc# |
| dJ913G4.1 (PLCB1 | | | | | gp:HSDJ913G4 | AL049632 |

Description

Human DNA sequence from clone 913G4 on chromosome 20. Contains part of the gene for PLCB1 (1-Phosphatidylinositol-4,5-bisphosphatePhosphodiesterase Beta 1, EC 3.1.4.11, Pospholipase C Beta 1),ESTs, an STS, GSSs and a putative CpG island, complete sequence.

| ORF Name | NTID | AAID | NT Length | AA Length | Score | Probability |
|---|---|---|---|---|---|---|
| 22397155_c3_1451 | 1029 | 5201 | 176 | 531 | 367 | 1.1e-33 |
| Protein name | | | | | Locus Name | Acc# |
| | | | | | sp:YOHJ_ECOLI | P33372 |

Description

HYPOTHETICAL 14.6 KD PROTEIN IN PBPG-CDD INTERGENIC REGION

| ORF Name | NTID | AAID | NT Length | AA Length | Score | Probability |
|---|---|---|---|---|---|---|
| 22460917_f3_671 | 1030 | 5202 | 145 | 438 | | |
| Protein name | | | | | Locus Name | Acc# |

Description

NO-HIT

| ORF Name | NTID | AAID | NT Length | AA Length | Score | Probability |
|---|---|---|---|---|---|---|
| 22462688_c1_1035 | 1031 | 5203 | 343 | 1032 | 1325 | 3.4e-135 |
| Protein name | | | | | Locus Name | Acc# |
| | | | | | sp:GSHB_ECOLI | P04425 |

Description

SYNTHETASE) (GSH-S) (GSHASE)

| ORF Name | NTID | AAID | NT Length | AA Length | Score | Probability |
|---|---|---|---|---|---|---|
| 22462927_c2_1176 | 1032 | 5204 | 392 | 1179 | 777 | 4.0e-77 |
| Protein name | | | | | Locus Name | Acc# |
| | | | | | sp:METC_BORAV | Q07703 |

Description (CYSTEINE LYASE) (OSTEOTOXIN)

| ORF Name | NTID | AAID | NT Length | AA Length | Score | Probability |
|---|---|---|---|---|---|---|
| 22469838_c1_1055 | 1033 | 5205 | 916 | 2751 | 1342 | 5.4e-137 |
| Protein name | | | | | Locus Name | Acc# |
| VirB4 | | | | | gp:AF141604 | AF141604 |

Description

Brucella suis VirB1 (virB1), VirB2 (virB2), VirB3 (virB3), VirB4(virB4), VirB5 (virB5), VirB6 (virB6), VirB7 (virB7), VirB8(virB8), VirB9 (virB9), VirB10 (virB10), VirB11 (virB11), and ORF12genes, complete cds.

| ORF Name | NTID | AAID | NT Length | AA Length | Score | Probability |
|---|---|---|---|---|---|---|
| 22542751_f3_519 | 1034 | 5206 | 142 | 429 | 498 | 1.5e-47 |

| Protein name | Locus Name | Acc# |
|---|---|---|
| | sp:TNPT_PSEPU | P30739 |

Description

RESOLVASE/RECOMBINASE

| ORF Name | NTID | AAID | NT Length | AA Length | Score | Probability |
|---|---|---|---|---|---|---|
| 22690932_c3_1478 | 1035 | 5207 | 299 | 900 | 371 | 4.3e-34 |

| Protein name | Locus Name | Acc# |
|---|---|---|
| probable transcription activator ptxR | pir:S77670 | S77670:S77 |

Description

| ORF Name | NTID | AAID | NT Length | AA Length | Score | Probability |
|---|---|---|---|---|---|---|
| 22698765_c2_1320 | 1036 | 5208 | 382 | 1149 | 1552 | 3.0e-159 |

| Protein name | Locus Name | Acc# |
|---|---|---|
| | sp:YGGW_ECOLI | P52062 |

Description

HYPOTHETICAL 42.6 KD PROTEIN IN GSHB-ANSB INTERGENIC REGION (O378)

| ORF Name | NTID | AAID | NT Length | AA Length | Score | Probability |
|---|---|---|---|---|---|---|
| 22710442_c3_1566 | 1037 | 5209 | 77 | 234 | | |
| Protein name | | | | | Locus Name | Acc# |

Description
NO-HIT

| ORF Name | NTID | AAID | NT Length | AA Length | Score | Probability |
|---|---|---|---|---|---|---|
| 22754653_c1_789 | 1038 | 5210 | 439 | 1320 | | |
| Protein name | | | | | Locus Name | Acc# |

Description
NO-HIT

| ORF Name | NTID | AAID | NT Length | AA Length | Score | Probability |
|---|---|---|---|---|---|---|
| 22786303_f3_597 | 1039 | 5211 | 244 | 735 | 198 | 9.2e-16 |
| Protein name | | | | | Locus Name | Acc# |
| | | | | | sp:YECD_ECOLI | P37347:P76 |

Description
HYPOTHETICAL 21.7 KD PROTEIN IN ASPS-BISZ INTERGENIC REGION

| ORF Name | NTID | AAID | NT Length | AA Length | Score | Probability |
|---|---|---|---|---|---|---|
| 22869088_c1_791 | 1040 | 5212 | 256 | 771 | | |
| Protein name | | | | | Locus Name | Acc# |

Description
NO-HIT

| ORF Name | NTID | AAID | NT Length | AA Length | Score | Probability |
|---|---|---|---|---|---|---|
| 22922700_c3_1562 | 1041 | 5213 | 67 | 204 | | |
| Protein name | | | | | Locus Name | Acc# |

Description
NO-HIT

| ORF Name | NTID | AAID | NT Length | AA Length | Score | Probability |
|---|---|---|---|---|---|---|
| 22945180_f1_47 | 1042 | 5214 | 324 | 975 | 1086 | 7.3e-110 |
| Protein name | | | | | Locus Name | Acc# |
|  | | | | | sp:YNEH_ECOLI | P77470 |

Description

HYPOTHETICAL 33.5 KD PROTEIN IN UXAB-MARR INTERGENIC REGION

| ORF Name | NTID | AAID | NT Length | AA Length | Score | Probability |
|---|---|---|---|---|---|---|
| 23441425_c1_881 | 1043 | 5215 | 69 | 210 | | |
| Protein name | | | | | Locus Name | Acc# |

Description

NO-HIT

| ORF Name | NTID | AAID | NT Length | AA Length | Score | Probability |
|---|---|---|---|---|---|---|
| 2345002_c2_1157 | 1044 | 5216 | 96 | 291 | 369 | 6.9e-34 |
| Protein name | | | | | Locus Name | Acc# |
| glutaredoxin-1 homolog | | | | | gp:AF117952 | AF117952 |

Description

Salmonella typhimurium strain TA1535 glutaredoxin-1 homolog andnitroreductase A homolog (snrA) genes, complete cds; ribosomalprotein S6 modification protein homolog gene, partial cds; andunknown gene.

| ORF Name | NTID | AAID | NT Length | AA Length | Score | Probability |
|---|---|---|---|---|---|---|
| 23455187_c1_1081 | 1045 | 5217 | 74 | 225 | 93 | 0.0046 |
| Protein name | | | | | Locus Name | Acc# |
| orf1386 | | | | | gp:AF160864 | AF160864 |

Description

Tetrahymena pyriformis mitochondrial DNA, complete genome.

| ORF Name | NTID | AAID | NT Length | AA Length | Score | Probability |
|---|---|---|---|---|---|---|
| 23464092_c2_1123 | 1046 | 5218 | 187 | 564 | | |
| Protein name | | | | | Locus Name | Acc# |

Description

NO-HIT

| ORF Name | NTID | AAID | NT Length | AA Length | Score | Probability |
|---|---|---|---|---|---|---|
| 23475301_f3_628 | 1047 | 5219 | 199 | 600 | 241 | 7.1e-29 |
| Protein name | | | | | Locus Name | Acc# |
| | | | | | sp:YAGU_ECOLI | P77262 |

Description
HYPOTHETICAL 23.0 KD PROTEIN IN INTF-EAEH INTERGENIC REGION

| ORF Name | NTID | AAID | NT Length | AA Length | Score | Probability |
|---|---|---|---|---|---|---|
| 23476567_c3_1584 | 1048 | 5220 | 730 | 2193 | 1733 | 2.0e-178 |
| Protein name | | | | | Locus Name | Acc# |
| | | | | | sp:FCT_ERWCH | Q47162 |

Description
FERRICHRYSOBACTIN RECEPTOR PRECURSOR

| ORF Name | NTID | AAID | NT Length | AA Length | Score | Probability |
|---|---|---|---|---|---|---|
| 23478412_f3_653 | 1049 | 5221 | 75 | 228 | | |
| Protein name | | | | | Locus Name | Acc# |

Description
NO-HIT

| ORF Name | NTID | AAID | NT Length | AA Length | Score | Probability |
|---|---|---|---|---|---|---|
| 23488377_f2_352 | 1050 | 5222 | 142 | 429 | 154 | 4.2e-11 |
| Protein name | | | | | Locus Name | Acc# |
| suppressor for copper-sensitivity A | | | | | gp:STU75949 | U75949 |

Description
Salmonella typhimurium curved DNA-binding protein (cbpA) gene andAgp (agp) gene, partial cds; operon 1 containing suppressor forcopper-sensitivity A (scsA) gene, complete cds; operon 2 containingsuppressor for copper-sensitivity B (scsB), suppressor forcopper-sensitivity C (scsC), and suppressor for copper-sensitivityD (scsD) genes, complete cds.

| ORF Name | NTID | AAID | NT Length | AA Length | Score | Probability |
|---|---|---|---|---|---|---|
| 23546911_c1_1039 | 1051 | 5223 | 204 | 615 | 775 | 6.6e-77 |
| Protein name | | | | | Locus Name | Acc# |
| | | | | | sp:YGGV_ECOLI | P52061 |

Description
HYPOTHETICAL 21.0 KD PROTEIN IN GSHB-ANSB INTERGENIC REGION (O197)

| ORF Name | NTID | AAID | NT Length | AA Length | Score | Probability |
|---|---|---|---|---|---|---|
| 23546952_f2_262 | 1052 | 5224 | 184 | 555 | 572 | 2.1e-55 |
| Protein name | | | | | Locus Name | Acc# |
| | | | | | sp:YKGB_ECOLI | P75685 |

Description
HYPOTHETICAL 22.3 KD PROTEIN IN EAEH-BETA INTERGENIC REGION

| ORF Name | NTID | AAID | NT Length | AA Length | Score | Probability |
|---|---|---|---|---|---|---|
| 23563155_c3_1456 | 1053 | 5225 | 264 | 795 | 932 | 1.5e-93 |
| Protein name | | | | | Locus Name | Acc# |
| | | | | | sp:MOEB_ECOLI | P12282 |

Description
MOLYBDOPTERIN BIOSYNTHESIS MOEB PROTEIN

| ORF Name | NTID | AAID | NT Length | AA Length | Score | Probability |
|---|---|---|---|---|---|---|
| 23572177_c1_794 | 1054 | 5226 | 158 | 477 | 245 | 9.6e-21 |
| Protein name | | | | | Locus Name | Acc# |
| hemolysin-coregulated protein | | | | | pir:T10891 | T10891 |

Description

| ORF Name | NTID | AAID | NT Length | AA Length | Score | Probability |
|---|---|---|---|---|---|---|
| 23574211_f1_171 | 1055 | 5227 | 157 | 474 | 556 | 1.1e-53 |
| Protein name | | | | | Locus Name | Acc# |
| | | | | | sp:MOAE_ECOLI | P30749 |

Description
SUBUNIT)

| ORF Name | NTID | AAID | NT Length | AA Length | Score | Probability |
|---|---|---|---|---|---|---|
| 23628380_f2_485 | 1056 | 5228 | 437 | 1314 | 1860 | 7.0e-192 |
| Protein name | | | | | Locus Name | Acc# |
| | | | | | sp:SYS_ECOLI | P09156 |

Description
SERYL-TRNA SYNTHETASE, (SERINE--TRNA LIGASE) (SERRS)

| ORF Name | NTID | AAID | NT Length | AA Length | Score | Probability |
|---|---|---|---|---|---|---|
| 23634675_c2_1255 | 1057 | 5229 | 107 | 324 | 139 | 1.6e-09 |
| Protein name | | | | | Locus Name | Acc# |
| hypothetical protein Y1115 | | | | | pir:T15030 | T15030 |

Description: hypothetical protein Y1115 ... pir:T15030 ... T15030

| ORF Name | NTID | AAID | NT Length | AA Length | Score | Probability |
|---|---|---|---|---|---|---|
| 23636715_c3_1400 | 1058 | 5230 | 456 | 1371 | | |
| Protein name | | | | | Locus Name | Acc# |

Description: NO-HIT

| ORF Name | NTID | AAID | NT Length | AA Length | Score | Probability |
|---|---|---|---|---|---|---|
| 23641702_c2_1214 | 1059 | 5231 | 427 | 1284 | 1959 | 2.3e-202 |
| Protein name | | | | | Locus Name | Acc# |
| citrate synthase | | | | | gp:AF056043 | AF056043 |

Description: Salmonella typhimurium citrate synthase (gltA) gene, complete cds.

| ORF Name | NTID | AAID | NT Length | AA Length | Score | Probability |
|---|---|---|---|---|---|---|
| 23673318_c3_1510 | 1060 | 5232 | 71 | 216 | | |
| Protein name | | | | | Locus Name | Acc# |

Description: NO-HIT

| ORF Name | NTID | AAID | NT Length | AA Length | Score | Probability |
|---|---|---|---|---|---|---|
| 23711076_c1_890 | 1061 | 5233 | 429 | 1290 | 1692 | 4.4e-174 |
| Protein name | | | | | Locus Name | Acc# |
| BioA | | | | | gp:AF191556 | AF191556 |

Description: Xenorhabdus nematophilus YbhE (ybhE) gene, partial cds; Var1 (var1) and BioA (bioA) genes, complete cds; and unknown gene.

300

| ORF Name | NTID | AAID | NT Length | AA Length | Score | Probability |
|---|---|---|---|---|---|---|
| 23720627_c3_1625 | 1062 | 5234 | 84 | 255 | | |
| Protein name | | | | | Locus Name | Acc# |

Description
NO-HIT

| ORF Name | NTID | AAID | NT Length | AA Length | Score | Probability |
|---|---|---|---|---|---|---|
| 23851703_f2_426 | 1063 | 5235 | 260 | 783 | 838 | 1.4e-83 |
| Protein name | | | | | Locus Name | Acc# |
| | | | | | sp:MODA_ECOLI | P37329 |

Description
MOLYBDATE-BINDING PERIPLASMIC PROTEIN PRECURSOR

| ORF Name | NTID | AAID | NT Length | AA Length | Score | Probability |
|---|---|---|---|---|---|---|
| 23912593_f1_110 | 1064 | 5236 | 688 | 2067 | 1764 | 1.0e-181 |
| Protein name | | | | | Locus Name | Acc# |
| PTS permease for N-acetylglucosamine and | | | | | gp:VFU65014 | U65014 |

Description
Vibrio furnissii PTS permease for N-acetylglucosamine and glucose(nagE) gene, complete cds.

| ORF Name | NTID | AAID | NT Length | AA Length | Score | Probability |
|---|---|---|---|---|---|---|
| 2399086_f3_521 | 1065 | 5237 | 188 | 567 | 278 | 3.3e-24 |
| Protein name | | | | | Locus Name | Acc# |
| PilL | | | | | gp:STAF000001 | AF000001:A |

Description
Salmonella typhi topoisomerase B (topB), single strand bindingprotein (ssb), Ytl2 homolog (ytl2) genes, complete cds; pil operon,complete sequence; Rci (rci) gene, complete cds.

| ORF Name | NTID | AAID | NT Length | AA Length | Score | Probability |
|---|---|---|---|---|---|---|
| 23990927_c1_817 | 1066 | 5238 | 424 | 1275 | 167 | 1.1e-14 |
| Protein name | | | | | Locus Name | Acc# |
| HecA | | | | | gp:ERWHRPN | L39897 |

Description

Erwinia chrysanthemi phospholipase C (plcA) gene, partial cds; HrpF(hrpF), HrpG (hrpG), HrcC (hrcC), HrpT (hrpT), HrpV (hrpV), HrpNharpin (hrpN), ORF1, and HecB (hecB) genes, complete cds; and HecA(hecA) gene, partial cds.

| ORF Name | NTID | AAID | NT Length | AA Length | Score | Probability |
|---|---|---|---|---|---|---|
| 24011562_f2_389 | 1067 | 5239 | 132 | 399 | | |
| Protein name | | | | | Locus Name | Acc# |

Description

NO-HIT

| ORF Name | NTID | AAID | NT Length | AA Length | Score | Probability |
|---|---|---|---|---|---|---|
| 24017958_f2_453 | 1068 | 5240 | 647 | 1944 | 697 | 1.2e-68 |
| Protein name | | | | | Locus Name | Acc# |
| | | | | | sp:ASMA_ECOLI | P28249:P76 |

Description

ASMA PROTEIN PRECURSOR

| ORF Name | NTID | AAID | NT Length | AA Length | Score | Probability |
|---|---|---|---|---|---|---|
| 24027131_f2_380 | 1069 | 5241 | 462 | 1389 | 440 | 2.1e-41 |
| Protein name | | | | | Locus Name | Acc# |
| 60 kDA protein | | | | | gp:BMB19202 | Y19202 |

Description

Bacteriophage MB78 ORF1 for 62 kDA protein.

| ORF Name | NTID | AAID | NT Length | AA Length | Score | Probability |
|---|---|---|---|---|---|---|
| 24062785_f3_634 | 1070 | 5242 | 123 | 372 | | |
| Protein name | | | | | Locus Name | Acc# |

Description

NO-HIT

| ORF Name | NTID | AAID | NT Length | AA Length | Score | Probability |
|---|---|---|---|---|---|---|
| 24088203_f1_215 | 1071 | 5243 | 269 | 810 | 920 | 2.8e-92 |
| Protein name | | | | | Locus Name | Acc# |
| MukE protein | | | | | gp:D90730 | D90730:AB0 |

Description: Escherichia coli genomic DNA. (20.9 - 21.3 min).

| ORF Name | NTID | AAID | NT Length | AA Length | Score | Probability |
|---|---|---|---|---|---|---|
| 24114627_c2_1186 | 1072 | 5244 | 323 | 972 | 1116 | 4.8e-113 |
| Protein name | | | | | Locus Name | Acc# |
| | | | | | sp:YBHK_ECOLI | P75767 |

Description: HYPOTHETICAL 32.8 KD PROTEIN IN UVRB-MOAA INTERGENIC REGION

| ORF Name | NTID | AAID | NT Length | AA Length | Score | Probability |
|---|---|---|---|---|---|---|
| 2422202_c1_971 | 1073 | 5245 | 241 | 726 | 1098 | 3.9e-111 |
| Protein name | | | | | Locus Name | Acc# |
| | | | | | sp:GLTL_ECOLI | P41076 |

Description: GLUTAMATE/ASPARTATE TRANSPORT ATP-BINDING PROTEIN GLTL

| ORF Name | NTID | AAID | NT Length | AA Length | Score | Probability |
|---|---|---|---|---|---|---|
| 24226692_f1_181 | 1074 | 5246 | 196 | 591 | 452 | 1.1e-42 |
| Protein name | | | | | Locus Name | Acc# |
| conserved hypothetical protein yvdD | | | | | pir:D70033 | D70033 |

Description:

| ORF Name | NTID | AAID | NT Length | AA Length | Score | Probability |
|---|---|---|---|---|---|---|
| 24239442_c2_1171 | 1075 | 5247 | 310 | 933 | 968 | 2.3e-97 |
| Protein name | | | | | Locus Name | Acc# |
| | | | | | sp:CDD_ECOLI | P13652 |

Description: CYTIDINE DEAMINASE, (CYTIDINE AMINOHYDROLASE) (CDA)

| ORF Name | NTID | AAID | NT Length | AA Length | Score | Probability |
|---|---|---|---|---|---|---|
| 24259652_c3_1629 | 1076 | 5248 | 109 | 330 | 262 | 1.5e-22 |
| Protein name | | | | | Locus Name | Acc# |
| | | | | | sp:YA53_HAEIN | Q57498 |

Description: HYPOTHETICAL PROTEIN HI1053

| ORF Name | NTID | AAID | NT Length | AA Length | Score | Probability |
|---|---|---|---|---|---|---|
| 24259687_c3_1422 | 1077 | 5249 | 111 | 336 | 91 | 0.0021 |
| Protein name | | | | | Locus Name | Acc# |
| maturase | | | | | gp:AF015641 | AF015641 |

Description: Pentachondra pumila maturase (matK) gene, chloroplast gene encodingchloroplast protein, partial cds.

| ORF Name | NTID | AAID | NT Length | AA Length | Score | Probability |
|---|---|---|---|---|---|---|
| 24261510_c2_1316 | 1078 | 5250 | 313 | 942 | 925 | 8.4e-93 |
| Protein name | | | | | Locus Name | Acc# |
| | | | | | sp:LYSR_ECOLI | P03030:Q46 |

Description: TRANSCRIPTIONAL ACTIVATOR PROTEIN LYSR

| ORF Name | NTID | AAID | NT Length | AA Length | Score | Probability |
|---|---|---|---|---|---|---|
| 24267827_c2_1281 | 1079 | 5251 | 391 | 1176 | 1228 | 6.5e-125 |
| Protein name | | | | | Locus Name | Acc# |
| | | | | | sp:EMRA_ECOLI | P27303:P77 |

Description: MULTIDRUG RESISTANCE PROTEIN A

| ORF Name | NTID | AAID | NT Length | AA Length | Score | Probability |
|---|---|---|---|---|---|---|
| 24276502_f1_5 | 1080 | 5252 | 328 | 987 | 233 | 1.0e-18 |
| Protein name | | | | | Locus Name | Acc# |
| HlyB | | | | | gp:ECU12572 | U12572 |

Description: Escherichia coli EHEC HlyA (hlyA) gene, partial cds, and hemolysintransporter HlyB (hlyB) gene, partial cds.

| ORF Name | NTID | AAID | NT Length | AA Length | Score | Probability |
|---|---|---|---|---|---|---|
| 2430276_f2_246 | 1081 | 5253 | 394 | 1185 | 535 | 1.8e-51 |
| Protein name | | | | | Locus Name | Acc# |
| | | | | | sp:HLYB_PASHA | P16532 |

Description
LEUKOTOXIN SECRETION ATP-BINDING PROTEIN

| ORF Name | NTID | AAID | NT Length | AA Length | Score | Probability |
|---|---|---|---|---|---|---|
| 24306887_c3_1550 | 1082 | 5254 | 145 | 438 | 410 | 3.1e-38 |
| Protein name | | | | | Locus Name | Acc# |
| | | | | | sp:NRDI_SALTY | Q56109 |

Description
NRDI PROTEIN

| ORF Name | NTID | AAID | NT Length | AA Length | Score | Probability |
|---|---|---|---|---|---|---|
| 24345632_f2_301 | 1083 | 5255 | 451 | 1356 | 1500 | 9.8e-154 |
| Protein name | | | | | Locus Name | Acc# |
| | | | | | sp:Y164_HAEIN | P43955:P43 |

Description
HYPOTHETICAL PROTEIN HI0164/165

| ORF Name | NTID | AAID | NT Length | AA Length | Score | Probability |
|---|---|---|---|---|---|---|
| 24391886_c2_1268 | 1084 | 5256 | 321 | 966 | 1150 | 1.2e-116 |
| Protein name | | | | | Locus Name | Acc# |
| | | | | | sp:YBEJ_ECOLI | P37902:P41 |

Description
REGION PRECURSOR

| ORF Name | NTID | AAID | NT Length | AA Length | Score | Probability |
|---|---|---|---|---|---|---|
| 24397591_f2_475 | 1085 | 5257 | 382 | 1149 | 1279 | 2.6e-130 |
| Protein name | | | | | Locus Name | Acc# |
| | | | | | sp:YBJF_ECOLI | P75817 |

Description
(EC 2.1.1.-)

| ORF Name | NTID | AAID | NT Length | AA Length | Score | Probability |
|---|---|---|---|---|---|---|
| 24400305_f2_400 | 1086 | 5258 | 161 | 486 | 407 | 6.5e-38 |
| Protein name | | | | | Locus Name | Acc# |
| | | | | | sp:YEHS_ECOLI | P33355 |

Description
HYPOTHETICAL 18.0 KD PROTEIN IN MOLR-BGLX INTERGENIC REGION

| ORF Name | NTID | AAID | NT Length | AA Length | Score | Probability |
|---|---|---|---|---|---|---|
| 244050_f1_183 | 1087 | 5259 | 228 | 687 | 937 | 4.5e-94 |
| Protein name | | | | | Locus Name | Acc# |
| | | | | | sp:GCH1_ECOLI | P27511 |

Description
GTP CYCLOHYDROLASE I, (GTP-CH-I)

| ORF Name | NTID | AAID | NT Length | AA Length | Score | Probability |
|---|---|---|---|---|---|---|
| 24413952_f1_188 | 1088 | 5260 | 476 | 1431 | 1847 | 1.7e-190 |
| Protein name | | | | | Locus Name | Acc# |
| | | | | | sp:DCUC_ECOLI | Q47134 |

Description
C4-DICARBOXYLATE ANAEROBIC CARRIER

| ORF Name | NTID | AAID | NT Length | AA Length | Score | Probability |
|---|---|---|---|---|---|---|
| 24414581_f1_134 | 1089 | 5261 | 106 | 321 | | |
| Protein name | | | | | Locus Name | Acc# |

Description
NO-HIT

| ORF Name | NTID | AAID | NT Length | AA Length | Score | Probability |
|---|---|---|---|---|---|---|
| 24415907_c2_1325 | 1090 | 5262 | 357 | 1074 | 1266 | 6.1e-129 |
| Protein name | | | | | Locus Name | Acc# |
| | | | | | sp:MLTC_ECOLI | P52066:P76 |

Description
(MUREIN HYDROLASE C)

| ORF Name | NTID | AAID | NT Length | AA Length | Score | Probability |
|---|---|---|---|---|---|---|
| 24415952_c2_1344 | 1091 | 5263 | 302 | 909 | 407 | 6.5e-38 |
| Protein name | | | | | Locus Name | Acc# |
| VirB9 | | | | | gp:AF141604 | AF141604 |

Description

Brucella suis VirB1 (virB1), VirB2 (virB2), VirB3 (virB3), VirB4(virB4), VirB5 (virB5), VirB6 (virB6), VirB7 (virB7), VirB8(virB8), VirB9 (virB9), VirB10 (virB10), VirB11 (virB11), and ORF12genes, complete cds.

| ORF Name | NTID | AAID | NT Length | AA Length | Score | Probability |
|---|---|---|---|---|---|---|
| 24416002_f1_152 | 1092 | 5264 | 126 | 381 | 506 | 2.1e-48 |

Protein name:
Locus Name: sp:DHSC_ECOLI
Acc#: P10446

Description: SUCCINATE DEHYDROGENASE CYTOCHROME B-556 SUBUNIT

| ORF Name | NTID | AAID | NT Length | AA Length | Score | Probability |
|---|---|---|---|---|---|---|
| 24417552_f3_743 | 1093 | 5265 | 237 | 714 | 892 | 2.6e-89 |

Protein name:
Locus Name: sp:KCY_ECOLI
Acc#: P23863:P03

Description: (CMP KINASE) (MSSA PROTEIN) (P25)

| ORF Name | NTID | AAID | NT Length | AA Length | Score | Probability |
|---|---|---|---|---|---|---|
| 24417837_f2_495 | 1094 | 5266 | 259 | 780 | 943 | 1.0e-94 |

Protein name: 3-deoxy-manno-octulosonate cytidylyltransferase,:CMP-3-deoxy-D-manno-octu
Locus Name: pir:A26322
Acc#: A26322:E64

Description:

| ORF Name | NTID | AAID | NT Length | AA Length | Score | Probability |
|---|---|---|---|---|---|---|
| 2447880_f2_331 | 1095 | 5267 | 377 | 1134 | 1000 | 9.5e-101 |

Protein name:
Locus Name: sp:YFIF_ECOLI
Acc#: P33635

Description: HYPOTHETICAL TRNA/RRNA METHYLTRANSFERASE YFIF,

| ORF_Name | NTID | AAID | NT Length | AA Length | Score | Probability |
|---|---|---|---|---|---|---|
| 24484805_f2_353 | 1096 | 5268 | 183 | 552 | 454 | 6.8e-43 |

| Protein name | Locus Name | Acc# |
|---|---|---|
| suppressor for copper-sensitivity D | gp:STU75949 | U75949 |

Description

Salmonella typhimurium curved DNA-binding protein (cbpA) gene and Agp (agp) gene, partial cds; operon 1 containing suppressor for copper-sensitivity A (scsA) gene, complete cds; operon 2 containing suppressor for copper-sensitivity B (scsB), suppressor for copper-sensitivity C (scsC), and suppressor for copper-sensitivityD (scsD) genes, complete cds.

| ORF_Name | NTID | AAID | NT Length | AA Length | Score | Probability |
|---|---|---|---|---|---|---|
| 24487875_c1_944 | 1097 | 5269 | 286 | 861 | 527 | 1.3e-50 |

| Protein name | Locus Name | Acc# |
|---|---|---|
|  | sp:RANT_BPP22 | P03037 |

Description

ANTIREPRESSOR PROTEIN ANT

| ORF_Name | NTID | AAID | NT Length | AA Length | Score | Probability |
|---|---|---|---|---|---|---|
| 24492656_f3_647 | 1098 | 5270 | 86 | 261 | | |

| Protein name | Locus Name | Acc# |
|---|---|---|

Description

NO-HIT

| ORF_Name | NTID | AAID | NT Length | AA Length | Score | Probability |
|---|---|---|---|---|---|---|
| 24613752_f2_491 | 1099 | 5271 | 564 | 1695 | 2675 | 3.0e-278 |

| Protein name | Locus Name | Acc# |
|---|---|---|
|  | sp:RS1_ECOLI | P02349:P77 |

Description

30S RIBOSOMAL PROTEIN S1

308

| ORF Name | NTID | AAID | NT Length | AA Length | Score | Probability |
|---|---|---|---|---|---|---|
| 24641676_c3_1445 | 1100 | 5272 | 362 | 1089 | 1282 | 1.2e-130 |
| Protein name | | | | | Locus Name | Acc# |
| | | | | | sp:HIS8_ECOLI | P06986 |

Description
(PHOSPHATE TRANSAMINASE)

| ORF Name | NTID | AAID | NT Length | AA Length | Score | Probability |
|---|---|---|---|---|---|---|
| 24644037_f2_414 | 1101 | 5273 | 390 | 1173 | 1805 | 4.7e-186 |
| Protein name | | | | | Locus Name | Acc# |
| | | | | | sp:SUCC_ECOLI | P07460 |

Description
SUCCINYL-COA SYNTHETASE BETA CHAIN, (SCS-BETA)

| ORF Name | NTID | AAID | NT Length | AA Length | Score | Probability |
|---|---|---|---|---|---|---|
| 24644753_c3_1595 | 1102 | 5274 | 234 | 705 | 824 | 4.2e-82 |
| Protein name | | | | | Locus Name | Acc# |
| | | | | | sp:YGGS_ECOLI | P52054 |

Description
HYPOTHETICAL 25.8 KD PROTEIN IN GSHB-ANSB INTERGENIC REGION

| ORF Name | NTID | AAID | NT Length | AA Length | Score | Probability |
|---|---|---|---|---|---|---|
| 24647330_f2_466 | 1103 | 5275 | 402 | 1209 | 1333 | 4.9e-136 |
| Protein name | | | | | Locus Name | Acc# |
| | | | | | sp:DACC_ECOLI | P08506:P77 |

Description
(DD-CARBOXYPEPTIDASE) (PBP-6)

| ORF Name | NTID | AAID | NT Length | AA Length | Score | Probability |
|---|---|---|---|---|---|---|
| 24649192_c2_1254 | 1104 | 5276 | 181 | 546 | | |
| Protein name | | | | | Locus Name | Acc# |

Description
NO-HIT

| ORF Name | NTID | AAID | NT Length | AA Length | Score | Probability |
|---|---|---|---|---|---|---|
| 24792265_f3_579 | 1105 | 5277 | 434 | 1305 | 1132 | 9.7e-115 |

Protein name | Locus Name | Acc#
---|---|---
yafA protein, 49K | pir:QQEC49 | H64748:A04

Description

| ORF Name | NTID | AAID | NT Length | AA Length | Score | Probability |
|---|---|---|---|---|---|---|
| 24799077_c2_1120 | 1106 | 5278 | 166 | 501 | 528 | 9.8e-51 |

Protein name | Locus Name | Acc#
---|---|---
unknown | gp:AF044503 | AF044503

Description

Escherichia coli strain ec11 unknown (498), hcp gene, complete cds;and RhsG accessory genetic element VgrG protein, core component anddsORF-g1 genes, complete cds.

| ORF Name | NTID | AAID | NT Length | AA Length | Score | Probability |
|---|---|---|---|---|---|---|
| 24805425_c2_1216 | 1107 | 5279 | 373 | 1122 | 803 | 7.1e-80 |

Protein name | Locus Name | Acc#
---|---|---
 | sp:YEHL_ECOLI | P33348

Description

HYPOTHETICAL 42.4 KD PROTEIN IN MOLR-BGLX INTERGENIC REGION

| ORF Name | NTID | AAID | NT Length | AA Length | Score | Probability |
|---|---|---|---|---|---|---|
| 24822840_c1_1049 | 1108 | 5280 | 261 | 786 | 1349 | 9.8e-138 |

Protein name | Locus Name | Acc#
---|---|---
NrpT | gp:PMU46488 | U46488

Description

Proteus mirabilis NrpS (nrpS) gene, partial cds, NrpU (nrpU), NrpT(nrpT), NrpA (nrpA), NrpB (nrpB), NrpG (nrpG) and IrpP (irpP)genes, complete cds.

| ORF Name | NTID | AAID | NT Length | AA Length | Score | Probability |
|---|---|---|---|---|---|---|
| 24855253_c2_1308 | 1109 | 5281 | 75 | 228 | 242 | 2.0e-20 |

Protein name | Locus Name | Acc#
---|---|---
 | sp:YJBJ_ECOLI | P32691

Description 8.3 KD PROTEIN IN DINF-QOR INTERGENIC REGION (O69)

| ORF Name | NTID | AAID | NT Length | AA Length | Score | Probability |
|---|---|---|---|---|---|---|
| 24870450_c3_1575 | 1110 | 5282 | 287 | 864 | 928 | 4.0e-93 |
| Protein name | | | | | Locus Name | Acc# |
| hypothetical protein b2611 | | | | | pir:F65039 | F65039 |

Description

| ORF Name | NTID | AAID | NT Length | AA Length | Score | Probability |
|---|---|---|---|---|---|---|
| 2507842_c1_852 | 1111 | 5283 | 208 | 627 | 640 | 1.3e-62 |
| Protein name | | | | | Locus Name | Acc# |
| | | | | | sp:HIS5_ECOLI | P10375 |

Description
AMIDOTRANSFERASE HISH,

| ORF Name | NTID | AAID | NT Length | AA Length | Score | Probability |
|---|---|---|---|---|---|---|
| 252177_f3_630 | 1112 | 5284 | 275 | 828 | 254 | 1.1e-21 |
| Protein name | | | | | Locus Name | Acc# |
| P43 | | | | | gp:AF157835 | AF157835 |

Description
Bacteriophage APSE-1, complete genome.

| ORF Name | NTID | AAID | NT Length | AA Length | Score | Probability |
|---|---|---|---|---|---|---|
| 25422825_f1_11 | 1113 | 5285 | 334 | 1005 | 339 | 1.0e-30 |
| Protein name | | | | | Locus Name | Acc# |
| | | | | | sp:YA52_HAEIN | P45008 |

Description
HYPOTHETICAL TRANSCRIPTIONAL REGULATOR HI1052

| ORF Name | NTID | AAID | NT Length | AA Length | Score | Probability |
|---|---|---|---|---|---|---|
| 25525428_f2_419 | 1114 | 5286 | 229 | 690 | 964 | 6.2e-97 |
| Protein name | | | | | Locus Name | Acc# |
| | | | | | sp:TOLQ_ECOLI | P05828 |

Description
TOLQ PROTEIN

| ORF Name | NTID | AAID | NT Length | AA Length | Score | Probability |
|---|---|---|---|---|---|---|
| 25572187_f2_242 | 1115 | 5287 | 286 | 861 | 236 | 1.8e-24 |
| Protein name | | | | | Locus Name | Acc# |
| | | | | | sp:ROB_ECOLI | P27292 |

Description: RIGHT ORIGIN-BINDING PROTEIN

| ORF Name | NTID | AAID | NT Length | AA Length | Score | Probability |
|---|---|---|---|---|---|---|
| 25580438_c1_1013 | 1116 | 5288 | 61 | 186 | 77 | 0.017 |
| Protein name | | | | | Locus Name | Acc# |
| hypothetical protein HP1569 | | | | | pir:A64716 | A64716 |

Description:

| ORF Name | NTID | AAID | NT Length | AA Length | Score | Probability |
|---|---|---|---|---|---|---|
| 25582635_f3_639 | 1117 | 5289 | 94 | 285 | 111 | 1.5e-06 |
| Protein name | | | | | Locus Name | Acc# |
| | | | | | sp:RMNT_BPP22 | P03049 |

Description: REGULATORY PROTEIN MNT

| ORF Name | NTID | AAID | NT Length | AA Length | Score | Probability |
|---|---|---|---|---|---|---|
| 25583562_c1_844 | 1118 | 5290 | 462 | 1389 | 1790 | 1.8e-184 |
| Protein name | | | | | Locus Name | Acc# |
| | | | | | sp:SDAC_ECOLI | P36559 |

Description: SERINE TRANSPORTER

| ORF Name | NTID | AAID | NT Length | AA Length | Score | Probability |
|---|---|---|---|---|---|---|
| 25587937_c1_981 | 1119 | 5291 | 715 | 2148 | 2909 | 0.0 |
| Protein name | | | | | Locus Name | Acc# |
| ribonucleotide reductase R1 subunit | | | | | gp:MSGRSOR | L34407 |

Description: Mycobacterium tuberculosis ribonucleotide reductase R1 subunit.

312

| ORF Name | NTID | AAID | NT Length | AA Length | Score | Probability |
|---|---|---|---|---|---|---|
| 25594000_c2_1165 | 1120 | 5292 | 69 | 210 | | |
| Protein name | | | | | Locus Name | Acc# |

Description: NO-HIT

| ORF Name | NTID | AAID | NT Length | AA Length | Score | Probability |
|---|---|---|---|---|---|---|
| 25602217_c3_1593 | 1121 | 5293 | 225 | 678 | 383 | 2.3e-35 |
| Protein name | | | | | Locus Name | Acc# |
| hypothetical protein | | | | | gp:AF130250 | AF130250 |

Description: Ralstonia eutropha macR' gene, partial cds; macB, maleylacetatereductase (macA), and hypothetical protein genes, complete cds; andhypothetical protein gene, partial cds.

| ORF Name | NTID | AAID | NT Length | AA Length | Score | Probability |
|---|---|---|---|---|---|---|
| 25626635_f2_311 | 1122 | 5294 | 426 | 1281 | 1566 | 1.0e-160 |
| Protein name | | | | | Locus Name | Acc# |
| | | | | | sp:PROA_SERMA | P17857 |

Description: DEHYDROGENASE)

| ORF Name | NTID | AAID | NT Length | AA Length | Score | Probability |
|---|---|---|---|---|---|---|
| 25663317_f1_125 | 1123 | 5295 | 173 | 522 | 192 | 4.0e-15 |
| Protein name | | | | | Locus Name | Acc# |
| | | | | | sp:ENPP_ECOLI | P75719 |

Description: PUTATIVE ENDOPEPTIDASE,

| ORF Name | NTID | AAID | NT Length | AA Length | Score | Probability |
|---|---|---|---|---|---|---|
| 25665902_c1_793 | 1124 | 5296 | 579 | 1740 | | |
| Protein name | | | | | Locus Name | Acc# |

Description: NO-HIT

| ORF Name | NTID | AAID | NT Length | AA Length | Score | Probability |
|---|---|---|---|---|---|---|
| 25673377_f3_629 | 1125 | 5297 | 166 | 501 | 433 | 1.1e-40 |
| Protein name | | | | | Locus Name | Acc# |
| gp19 | | | | | gp:BPS011581 | AJ011581 |

Description

Bacteriophage PS119 lysis genes 13, 19, 15, and packaging gene 3, complete cds.

| ORF Name | NTID | AAID | NT Length | AA Length | Score | Probability |
|---|---|---|---|---|---|---|
| 2589000_f3_751 | 1126 | 5298 | 615 | 1848 | 965 | 6.9e-137 |
| Protein name | | | | | Locus Name | Acc# |
| | | | | | sp:YCBB_ECOLI | P22525:P75 |

Description

HYPOTHETICAL 67.8 KD PROTEIN IN MUKB-ASPC INTERGENIC REGION

| ORF Name | NTID | AAID | NT Length | AA Length | Score | Probability |
|---|---|---|---|---|---|---|
| 2589207_c2_1156 | 1127 | 5299 | 227 | 684 | 795 | 5.0e-79 |
| Protein name | | | | | Locus Name | Acc# |
| | | | | | sp:ARTM_ECOLI | P30862:P77 |

Description

ARGININE TRANSPORT SYSTEM PERMEASE PROTEIN ARTM

| ORF Name | NTID | AAID | NT Length | AA Length | Score | Probability |
|---|---|---|---|---|---|---|
| 25949068_c2_1337 | 1128 | 5300 | 200 | 603 | 603 | 1.1e-58 |
| Protein name | | | | | Locus Name | Acc# |
| hypothetical protein | | | | | pir:T17449 | T17449 |

Description

| ORF Name | NTID | AAID | NT Length | AA Length | Score | Probability |
|---|---|---|---|---|---|---|
| 26056500_f2_259 | 1129 | 5301 | 90 | 273 | 78 | 0.031 |
| Protein name | | | | | Locus Name | Acc# |
| CysB | | | | | gp:PAU95379 | U95379 |

Description

Pseudomonas aeruginosa transcription factor CysB (cysB) and CysH(cysH) genes, complete cds.

| ORF Name | NTID | AAID | NT Length | AA Length | Score | Probability |
|---|---|---|---|---|---|---|
| 26172125_f1_8 | 1130 | 5302 | 77 | 234 | | |
| Protein name | | | | | Locus Name | Acc# |

Description
NO-HIT

| ORF Name | NTID | AAID | NT Length | AA Length | Score | Probability |
|---|---|---|---|---|---|---|
| 26209677_f1_163 | 1131 | 5303 | 360 | 1083 | 1554 | 1.9e-159 |
| Protein name | | | | | Locus Name | Acc# |
| | | | | | sp:AROG_ECOLI | P00886 |

Description
SYNTHETASE) (3-DEOXY-D-ARABINO-HEPTULOSONATE 7-PHOSPHATE SYNTHASE)

| ORF Name | NTID | AAID | NT Length | AA Length | Score | Probability |
|---|---|---|---|---|---|---|
| 26257687_c2_1318 | 1132 | 5304 | 196 | 591 | 665 | 3.0e-65 |
| Protein name | | | | | Locus Name | Acc# |
| hypothetical protein b2948 | | | | | pir:C65080 | C65080 |

Description

| ORF Name | NTID | AAID | NT Length | AA Length | Score | Probability |
|---|---|---|---|---|---|---|
| 26259675_f2_313 | 1133 | 5305 | 401 | 1206 | 1411 | 2.6e-144 |
| Protein name | | | | | Locus Name | Acc# |
| | | | | | sp:YGED_ECOLI | P39196:Q46 |

Description
HYPOTHETICAL 41.7 KD PROTEIN IN MUTH-AAS INTERGENIC REGION

| ORF Name | NTID | AAID | NT Length | AA Length | Score | Probability |
|---|---|---|---|---|---|---|
| 26265806_f1_26 | 1134 | 5306 | 71 | 216 | | |
| Protein name | | | | | Locus Name | Acc# |

Description
NO-HIT

| ORF_Name | NTID | AAID | NT Length | AA Length | Score | Probability |
|---|---|---|---|---|---|---|
| 26289167_c2_1270 | 1135 | 5307 | 353 | 1062 | 1171 | 7.2e-119 |
| Protein name | | | | | Locus Name | Acc# |
| | | | | | sp:HOLA_ECOLI | P28630 |

Description

DNA POLYMERASE III, DELTA SUBUNIT,

| ORF_Name | NTID | AAID | NT Length | AA Length | Score | Probability |
|---|---|---|---|---|---|---|
| 26363577_c1_829 | 1136 | 5308 | 72 | 219 | 361 | 4.9e-33 |
| Protein name | | | | | Locus Name | Acc# |
| translation initiation factor IF-1:translation initiation factor eIF-1 | | | | | pir:FIEC1 | A27855:A41 |

Description

| ORF_Name | NTID | AAID | NT Length | AA Length | Score | Probability |
|---|---|---|---|---|---|---|
| 26366688_c3_1645 | 1137 | 5309 | 269 | 810 | 283 | 9.0e-25 |
| Protein name | | | | | Locus Name | Acc# |
| | | | | | sp:FAPR_ECOLI | P23774 |

Description

987P FIMBRIAL OPERON POSITIVE REGULATORY PROTEIN FAPR

| ORF_Name | NTID | AAID | NT Length | AA Length | Score | Probability |
|---|---|---|---|---|---|---|
| 26376077_f3_587 | 1138 | 5310 | 374 | 1125 | 1319 | 1.5e-134 |
| Protein name | | | | | Locus Name | Acc# |
| | | | | | sp:TYRA_ERWHE | Q02287 |

Description

| ORF_Name | NTID | AAID | NT Length | AA Length | Score | Probability |
|---|---|---|---|---|---|---|
| 26384681_f3_643 | 1139 | 5311 | 114 | 345 | 255 | 8.4e-22 |
| Protein name | | | | | Locus Name | Acc# |
| minor tail protein M homolog:protein gp17 | | | | | pir:T13103 | T13103 |

Description

| ORF Name | NTID | AAID | NT Length | AA Length | Score | Probability |
|---|---|---|---|---|---|---|
| 26439193_c2_1246 | 1140 | 5312 | 197 | 594 | | |
| Protein name | | | | | Locus Name | Acc# |

Description: NO-HIT

| ORF Name | NTID | AAID | NT Length | AA Length | Score | Probability |
|---|---|---|---|---|---|---|
| 26458411_f2_312 | 1141 | 5313 | 177 | 534 | 394 | 1.6e-36 |
| Protein name | | | | | Locus Name | Acc# |
| | | | | | sp:AROL_ECOLI | P08329 |

Description: SHIKIMATE KINASE II, (SKII)

| ORF Name | NTID | AAID | NT Length | AA Length | Score | Probability |
|---|---|---|---|---|---|---|
| 26595877_c3_1596 | 1142 | 5314 | 274 | 825 | 826 | 2.6e-82 |
| Protein name | | | | | Locus Name | Acc# |
| | | | | | sp:PROC_VIBAL | P52053 |

Description: PYRROLINE-5-CARBOXYLATE REDUCTASE, (P5CR) (P5C REDUCTASE)

| ORF Name | NTID | AAID | NT Length | AA Length | Score | Probability |
|---|---|---|---|---|---|---|
| 26603387_c3_1600 | 1143 | 5315 | 347 | 1044 | 1355 | 2.3e-138 |
| Protein name | | | | | Locus Name | Acc# |
| | | | | | sp:MUTY_ECOLI | P17802 |

Description: A/G-SPECIFIC ADENINE GLYCOSYLASE,

| ORF Name | NTID | AAID | NT Length | AA Length | Score | Probability |
|---|---|---|---|---|---|---|
| 26604138_f2_258 | 1144 | 5316 | 194 | 585 | | |
| Protein name | | | | | Locus Name | Acc# |

Description: NO-HIT

| ORF Name | NTID | AAID | NT Length | AA Length | Score | Probability |
|---|---|---|---|---|---|---|
| 26673442_c1_792 | 1145 | 5317 | 222 | 669 | | |
| Protein name | | | | | Locus Name | Acc# |

Description
NO-HIT

| ORF Name | NTID | AAID | NT Length | AA Length | Score | Probability |
|---|---|---|---|---|---|---|
| 26678805_f1_124 | 1146 | 5318 | 99 | 300 | 75 | 0.0099 |
| Protein name | | | | | Locus Name | Acc# |
| gp13 | | | | | gp:BPS011580 | AJ011580 |

Description
Bacteriophage PS34 lysis genes 13, 19, 15, antiterminator gene 23, and packaging gene 3, complete cds.

| ORF Name | NTID | AAID | NT Length | AA Length | Score | Probability |
|---|---|---|---|---|---|---|
| 26741553_f3_670 | 1147 | 5319 | 391 | 1176 | 1483 | 6.2e-152 |
| Protein name | | | | | Locus Name | Acc# |
| subunit II of cytochrome bd | | | | | gp:KPCYDAB | Y10012 |

Description
K.pneumoniae cydA and cydB gene.

| ORF Name | NTID | AAID | NT Length | AA Length | Score | Probability |
|---|---|---|---|---|---|---|
| 26751311_c2_1352 | 1148 | 5320 | 86 | 261 | 89 | 0.0016 |
| Protein name | | | | | Locus Name | Acc# |
| surface antigen | | | | | gp:PMCSAA | L43851 |

Description
Pneumocystis carinii (clone JFSIg2) surface antigen mRNA, 5' end of cds.

| ORF Name | NTID | AAID | NT Length | AA Length | Score | Probability |
|---|---|---|---|---|---|---|
| 26753127_f2_315 | 1149 | 5321 | 68 | 207 | 284 | 7.1e-25 |
| Protein name | | | | | Locus Name | Acc# |
| RsmA protein | | | | | gp:ECA238885 | AJ238885 |

Description
Erwinia carotovora rsmA gene, strain SCC3193.

| ORF Name | NTID | AAID | NT Length | AA Length | Score | Probability |
|---|---|---|---|---|---|---|
| 26758250_c2_1278 | 1150 | 5322 | 424 | 1275 | 1378 | 9.3e-144 |
| Protein name | | | | | Locus Name | Acc# |
| | | | | | sp:PROW_ECOLI | P14176 |

Description
GLYCINE BETAINE/L-PROLINE TRANSPORT SYSTEM PERMEASE PROTEIN PROW

| ORF Name | NTID | AAID | NT Length | AA Length | Score | Probability |
|---|---|---|---|---|---|---|
| 26838216_f2_274 | 1151 | 5323 | 88 | 267 | | |
| Protein name | | | | | Locus Name | Acc# |

Description
NO-HIT

| ORF Name | NTID | AAID | NT Length | AA Length | Score | Probability |
|---|---|---|---|---|---|---|
| 26843782_c2_1284 | 1152 | 5324 | 246 | 741 | 651 | 9.1e-64 |
| Protein name | | | | | Locus Name | Acc# |
| hypothetical protein b2583 | | | | | pir:F65036 | F65036 |

Description

| ORF Name | NTID | AAID | NT Length | AA Length | Score | Probability |
|---|---|---|---|---|---|---|
| 281375_c1_917 | 1153 | 5325 | 399 | 1200 | 751 | 2.3e-74 |
| Protein name | | | | | Locus Name | Acc# |
| | | | | | sp:YEHP_ECOLI | P33352 |

Description
HYPOTHETICAL 42.1 KD PROTEIN IN MOLR-BGLX INTERGENIC REGION

| ORF Name | NTID | AAID | NT Length | AA Length | Score | Probability |
|---|---|---|---|---|---|---|
| 2817125_f3_524 | 1154 | 5326 | 67 | 204 | | |
| Protein name | | | | | Locus Name | Acc# |

Description
NO-HIT

| ORF_Name | NTID | AAID | NT Length | AA Length | Score | Probability |
|---|---|---|---|---|---|---|
| 2823578_f3_767 | 1155 | 5327 | 175 | 528 | 99 | 0.010 |
| Protein name | | | | | Locus Name | Acc# |
| ORF MSV157 hypothetical protein | | | | | gp:AF063866 | AF063866 |

Description

Melanoplus sanguinipes entomopoxvirus, complete genome.

| ORF_Name | NTID | AAID | NT Length | AA Length | Score | Probability |
|---|---|---|---|---|---|---|
| 2824040_c3_1608 | 1156 | 5328 | 105 | 318 | 273 | 1.0e-23 |
| Protein name | | | | | Locus Name | Acc# |
| | | | | | gp:YP102KB | AL031866 |

Description

Yersinia pestis 102 kbases unstable region: from 1 to 119443.

| ORF_Name | NTID | AAID | NT Length | AA Length | Score | Probability |
|---|---|---|---|---|---|---|
| 2832556_f1_230 | 1157 | 5329 | 1586 | 4761 | 550 | 3.8e-76 |
| Protein name | | | | | Locus Name | Acc# |
| core protein | | | | | gp:ECRHSEH2 | AF044501 |

Description

Escherichia coli strain ec45 RhsE accessory genetic element coreprotein gene, partial cds, and dsORF-e4, complete cds; and RhsHaccessory genetic element unknown (450), core protein, and dsORF-h1genes, complete cds.

| ORF_Name | NTID | AAID | NT Length | AA Length | Score | Probability |
|---|---|---|---|---|---|---|
| 290968_f2_384 | 1158 | 5330 | 336 | 1011 | | |
| Protein name | | | | | Locus Name | Acc# |

Description

NO-HIT

| ORF_Name | NTID | AAID | NT Length | AA Length | Score | Probability |
|---|---|---|---|---|---|---|
| 2923202_f3_658 | 1159 | 5331 | 97 | 294 | 336 | 2.2e-30 |
| Protein name | | | | | Locus Name | Acc# |
| unknown | | | | | gp:AF074612 | AF074612 |

Description

Yersinia pestis plasmid pCD1, complete plasmid sequence.

320

| ORF Name | NTID | AAID | NT Length | AA Length | Score | Probability |
|---|---|---|---|---|---|---|
| 2931502_f3_668 | 1160 | 5332 | 239 | 720 | 1144 | 5.2e-116 |
| Protein name | | | | | Locus Name | Acc# |
| | | | | | sp:DHSB_ECOLI | P07014 |

Description
SUCCINATE DEHYDROGENASE IRON-SULFUR PROTEIN,

| ORF Name | NTID | AAID | NT Length | AA Length | Score | Probability |
|---|---|---|---|---|---|---|
| 2931925_c1_988 | 1161 | 5333 | 184 | 555 | 590 | 2.6e-57 |
| Protein name | | | | | Locus Name | Acc# |
| | | | | | sp:MPRA_ECOLI | P24201 |

Description
TRANSCRIPTIONAL REPRESSOR MPRA (EMRR PROTEIN)

| ORF Name | NTID | AAID | NT Length | AA Length | Score | Probability |
|---|---|---|---|---|---|---|
| 29406285_c3_1396 | 1162 | 5334 | 915 | 2748 | 754 | 4.3e-135 |
| Protein name | | | | | Locus Name | Acc# |
| ClpB | | | | | gp:AB012390 | AB012390 |

Description
Thermus thermophilus genes for DnaK, GrpE, DnaJ, DafA, ClpB, complete cds.

| ORF Name | NTID | AAID | NT Length | AA Length | Score | Probability |
|---|---|---|---|---|---|---|
| 2944713_f3_578 | 1163 | 5335 | 67 | 204 | | |
| Protein name | | | | | Locus Name | Acc# |

Description
NO-HIT

| ORF Name | NTID | AAID | NT Length | AA Length | Score | Probability |
|---|---|---|---|---|---|---|
| 29457317_f3_735 | 1164 | 5336 | 353 | 1062 | 1278 | 3.3e-130 |
| Protein name | | | | | Locus Name | Acc# |
| | | | | | sp:YLBC_ECOLI | P77555 |

Description
HYPOTHETICAL 38.0 KD PROTEIN IN GIP-FDRA INTERGENIC REGION

| ORF Name | NTID | AAID | NT Length | AA Length | Score | Probability |
|---|---|---|---|---|---|---|
| 29484441_f1_73 | 1165 | 5337 | 465 | 1398 | 2015 | 2.6e-208 |
| Protein name | | | | | Locus Name | Acc# |
| | | | | | sp:DCUB_ECOLI | P14409 |

Description

ANAEROBIC C4-DICARBOXYLATE TRANSPORTER DCUB

| ORF Name | NTID | AAID | NT Length | AA Length | Score | Probability |
|---|---|---|---|---|---|---|
| 29485050_f2_243 | 1166 | 5338 | 73 | 222 | 95 | 0.00028 |
| Protein name | | | | | Locus Name | Acc# |
| | | | | | sp:YC8A_METJA | P81318 |

Description

HYPOTHETICAL PROTEIN MJ1282.1

| ORF Name | NTID | AAID | NT Length | AA Length | Score | Probability |
|---|---|---|---|---|---|---|
| 29531525_c3_1549 | 1167 | 5339 | 229 | 690 | 657 | 2.1e-64 |
| Protein name | | | | | Locus Name | Acc# |
| lipoate--protein ligase, B:lipoic acid metabolism protein lipB | | | | | pir:H64043 | H64043 |

Description

| ORF Name | NTID | AAID | NT Length | AA Length | Score | Probability |
|---|---|---|---|---|---|---|
| 29532677_f3_568 | 1168 | 5340 | 316 | 951 | 400 | 3.6e-37 |
| Protein name | | | | | Locus Name | Acc# |
| transcription regulator slr1871:protein slr1871:protein slr1871 | | | | | pir:S77111 | S77111 |

Description

| ORF Name | NTID | AAID | NT Length | AA Length | Score | Probability |
|---|---|---|---|---|---|---|
| 29533432_f1_154 | 1169 | 5341 | 300 | 903 | 1405 | 1.1e-143 |
| Protein name | | | | | Locus Name | Acc# |
| succinate--CoA ligase (ADP-forming), alpha chain:succinyl-CoA synthetase (ADP-forming) | | | | | pir:SYECSA | A90499:S61 |

Description

| ORF Name | NTID | AAID | NT Length | AA Length | Score | Probability |
|---|---|---|---|---|---|---|
| 29578412_f3_667 | 1170 | 5342 | 141 | 426 | 441 | 1.6e-41 |
| Protein name | | | | | Locus Name | Acc# |
| | | | | | sp:DHSD_ECOLI | P10445 |

Description: SUCCINATE DEHYDROGENASE HYDROPHOBIC MEMBRANE ANCHOR PROTEIN

| ORF Name | NTID | AAID | NT Length | AA Length | Score | Probability |
|---|---|---|---|---|---|---|
| 29586590_f1_122 | 1171 | 5343 | 154 | 465 | 140 | 1.3e-09 |
| Protein name | | | | | Locus Name | Acc# |
| | | | | | sp:YBCN_ECOLI | Q47269 |

Description: HYPOTHETICAL 17.4 KD PROTEIN IN EMRE-RUS INTERGENIC REGION

| ORF Name | NTID | AAID | NT Length | AA Length | Score | Probability |
|---|---|---|---|---|---|---|
| 29687655_f3_574 | 1172 | 5344 | 200 | 603 | 895 | 1.3e-89 |
| Protein name | | | | | Locus Name | Acc# |
| | | | | | sp:LPCA_ECOLI | P51001 |

Description: PHOSPHOHEPTOSE ISOMERASE,

| ORF Name | NTID | AAID | NT Length | AA Length | Score | Probability |
|---|---|---|---|---|---|---|
| 30084431_c2_1326 | 1173 | 5345 | 72 | 219 | | |
| Protein name | | | | | Locus Name | Acc# |

Description: NO-HIT

| ORF Name | NTID | AAID | NT Length | AA Length | Score | Probability |
|---|---|---|---|---|---|---|
| 30287937_f1_213 | 1174 | 5346 | 92 | 279 | 138 | 2.1e-09 |
| Protein name | | | | | Locus Name | Acc# |
| | | | | | sp:CSPE_ECOLI | P36997:P80 |

Description: COLD SHOCK-LIKE PROTEIN CSPE (CSP-E)

| ORF Name | NTID | AAID | NT Length | AA Length | Score | Probability |
|---|---|---|---|---|---|---|
| 30289807_f2_431 | 1175 | 5347 | 350 | 1053 | 1453 | 9.4e-149 |
| Protein name | | | | | Locus Name | Acc# |
| | | | | | sp:BIOB_SERMA | P36569 |

Description

BIOTIN SYNTHASE, (BIOTIN SYNTHETASE)

| ORF Name | NTID | AAID | NT Length | AA Length | Score | Probability |
|---|---|---|---|---|---|---|
| 30290932_f1_120 | 1176 | 5348 | 116 | 351 | | |
| Protein name | | | | | Locus Name | Acc# |

Description

NO-HIT

| ORF Name | NTID | AAID | NT Length | AA Length | Score | Probability |
|---|---|---|---|---|---|---|
| 30292513_f1_6 | 1177 | 5349 | 424 | 1275 | 322 | 1.5e-28 |
| Protein name | | | | | Locus Name | Acc# |
| alkaline proteinase secretion protein apre (aprE) RP314 | | | | | pir:D71687 | D71687 |

Description

| ORF Name | NTID | AAID | NT Length | AA Length | Score | Probability |
|---|---|---|---|---|---|---|
| 30365932_c1_895 | 1178 | 5350 | 92 | 279 | | |
| Protein name | | | | | Locus Name | Acc# |

Description

NO-HIT

| ORF Name | NTID | AAID | NT Length | AA Length | Score | Probability |
|---|---|---|---|---|---|---|
| 30492755_f2_344 | 1179 | 5351 | 99 | 300 | 335 | 2.8e-30 |
| Protein name | | | | | Locus Name | Acc# |
| cold shock-like protein | | | | | gp:ECU82598 | U82598 |

Description

Escherichia coli genomic sequence of minutes 9 to 12.

| ORF Name | NTID | AAID | NT Length | AA Length | Score | Probability |
|---|---|---|---|---|---|---|
| 30509678_c3_1536 | 1180 | 5352 | 514 | 1545 | 1640 | 1.4e-168 |
| Protein name | | | | | Locus Name | Acc# |
| | | | | | sp:LNT_ECOLI | P23930 |

Description
(COPPER HOMEOSTASIS PROTEIN CUTE)

| ORF Name | NTID | AAID | NT Length | AA Length | Score | Probability |
|---|---|---|---|---|---|---|
| 30708305_f3_644 | 1181 | 5353 | 237 | 714 | 475 | 4.1e-45 |
| Protein name | | | | | Locus Name | Acc# |
| minor tail protein gp20 | | | | | pir:T13106 | T13106 |

Description

| ORF Name | NTID | AAID | NT Length | AA Length | Score | Probability |
|---|---|---|---|---|---|---|
| 30719676_f3_710 | 1182 | 5354 | 150 | 453 | 624 | 6.6e-61 |
| Protein name | | | | | Locus Name | Acc# |
| | | | | | gp:B2U02303 | U02303 |

Description
Bacteriophage If1, complete genome.

| ORF Name | NTID | AAID | NT Length | AA Length | Score | Probability |
|---|---|---|---|---|---|---|
| 30740677_c3_1603 | 1183 | 5355 | 444 | 1335 | 707 | 1.1e-69 |
| Protein name | | | | | Locus Name | Acc# |
| ybtX protein | | | | | pir:T17435 | T17435 |

Description

| ORF Name | NTID | AAID | NT Length | AA Length | Score | Probability |
|---|---|---|---|---|---|---|
| 3140942_f3_592 | 1184 | 5356 | 77 | 234 | | |
| Protein name | | | | | Locus Name | Acc# |

Description
NO-HIT

| ORF Name | NTID | AAID | NT Length | AA Length | Score | Probability |
|---|---|---|---|---|---|---|
| 31443752_f2_322 | 1185 | 5357 | 868 | 2607 | 3673 | 0.0 |
| Protein name | | | | | Locus Name | Acc# |
| | | | | | sp:CLPB_ECOLI | P03815 |

Description
CLPB PROTEIN (HEAT SHOCK PROTEIN F84.1)

| ORF Name | NTID | AAID | NT Length | AA Length | Score | Probability |
|---|---|---|---|---|---|---|
| 3145701_f1_117 | 1186 | 5358 | 219 | 660 | | |
| Protein name | | | | | Locus Name | Acc# |

Description
NO-HIT

| ORF Name | NTID | AAID | NT Length | AA Length | Score | Probability |
|---|---|---|---|---|---|---|
| 3161552_c1_1083 | 1187 | 5359 | 453 | 1362 | 1886 | 1.2e-194 |
| Protein name | | | | | Locus Name | Acc# |
| | | | | | sp:POTE_ECOLI | P24170 |

Description
PUTRESCINE-ORNITHINE ANTIPORTER (PUTRESCINE TRANSPORT PROTEIN)

| ORF Name | NTID | AAID | NT Length | AA Length | Score | Probability |
|---|---|---|---|---|---|---|
| 31698415_c3_1565 | 1188 | 5360 | 67 | 204 | | |
| Protein name | | | | | Locus Name | Acc# |

Description
NO-HIT

| ORF Name | NTID | AAID | NT Length | AA Length | Score | Probability |
|---|---|---|---|---|---|---|
| 31879757_f1_131 | 1189 | 5361 | 103 | 312 | 153 | 1.4e-10 |
| Protein name | | | | | Locus Name | Acc# |
| intimin | | | | | gp:AF099078 | AF099078 |

Description
Escherichia coli enteropathogenic strain REPEC 83/146 intimin (eae)gene, partial cds.

| ORF Name | NTID | AAID | NT Length | AA Length | Score | Probability |
|---|---|---|---|---|---|---|
| 32151702_c3_1648 | 1190 | 5362 | 219 | 660 | 504 | 3.4e-48 |
| Protein name | | | | | Locus Name | Acc# |
| | | | | | sp:PGMB_BACSU | O06995 |

Description: PUTATIVE BETA-PHOSPHOGLUCOMUTASE, (BETA-PGM)

| ORF Name | NTID | AAID | NT Length | AA Length | Score | Probability |
|---|---|---|---|---|---|---|
| 32204182_c3_1430 | 1191 | 5363 | 102 | 309 | 86 | 0.00068 |
| Protein name | | | | | Locus Name | Acc# |
| Bkm-like sex-determining region hypothetical protein CS314 | | | | | pir:B21124 | B21124 |

Description:

| ORF Name | NTID | AAID | NT Length | AA Length | Score | Probability |
|---|---|---|---|---|---|---|
| 32226577_f3_522 | 1192 | 5364 | 90 | 273 | 155 | 3.3e-11 |
| Protein name | | | | | Locus Name | Acc# |
| hypothetical protein (argF-lacZ region) | | | | | pir:I41306 | I41306 |

Description:

| ORF Name | NTID | AAID | NT Length | AA Length | Score | Probability |
|---|---|---|---|---|---|---|
| 32228430_c1_960 | 1193 | 5365 | 82 | 249 | 98 | 3.6e-05 |
| Protein name | | | | | Locus Name | Acc# |
| | | | | | sp:VXIS_BP434 | P11683:P16 |

Description: EXCISIONASE

| ORF Name | NTID | AAID | NT Length | AA Length | Score | Probability |
|---|---|---|---|---|---|---|
| 32228437_f2_464 | 1194 | 5366 | 274 | 825 | 762 | 1.6e-75 |
| Protein name | | | | | Locus Name | Acc# |
| | | | | | sp:YEEZ_ECOLI | P76370 |

Description: HYPOTHETICAL 29.7 KD PROTEIN IN SBCB-HISL INTERGENIC REGION PRECURSOR

| ORF Name | NTID | AAID | NT Length | AA Length | Score | Probability |
|---|---|---|---|---|---|---|
| 32234702_f3_749 | 1195 | 5367 | 1485 | 4458 | 5291 | 0.0 |
| Protein name | | | | | Locus Name | Acc# |
| | | | | | sp:MUKB_ECOLI | P22523:P77 |

Description
CELL DIVISION PROTEIN MUKB

| ORF Name | NTID | AAID | NT Length | AA Length | Score | Probability |
|---|---|---|---|---|---|---|
| 3224012_f2_494 | 1196 | 5368 | 593 | 1782 | 2373 | 3.0e-246 |
| Protein name | | | | | Locus Name | Acc# |
| | | | | | sp:MSBA_ECOLI | P27299 |

Description
PROBABLE TRANSPORT ATP-BINDING PROTEIN MSBA

| ORF Name | NTID | AAID | NT Length | AA Length | Score | Probability |
|---|---|---|---|---|---|---|
| 32500_c3_1617 | 1197 | 5369 | 432 | 1299 | 405 | 1.3e-40 |
| Protein name | | | | | Locus Name | Acc# |
| | | | | | gp:ECPR388 | X81123 |

Description
E.coli plasmid R388 genes.

| ORF Name | NTID | AAID | NT Length | AA Length | Score | Probability |
|---|---|---|---|---|---|---|
| 32604687_f1_10 | 1198 | 5370 | 65 | 198 | 97 | 0.00025 |
| Protein name | | | | | Locus Name | Acc# |
| transposase | | | | | gp:ENETRANSPO | L40841 |

Description
Enterococcus faecium and Insertion sequence IS1216V transposasegenes, complete cds's.

| ORF Name | NTID | AAID | NT Length | AA Length | Score | Probability |
|---|---|---|---|---|---|---|
| 32611516_c1_951 | 1199 | 5371 | 65 | 198 | | |
| Protein name | | | | | Locus Name | Acc# |

Description
NO-HIT

| ORF Name | NTID | AAID | NT Length | AA Length | Score | Probability |
|---|---|---|---|---|---|---|
| 32628375_f3_771 | 1200 | 5372 | 408 | 1224 | 263 | 2.3e-34 |
| Protein name | | | | | Locus Name | Acc# |
| core protein | | | | | gp:ECRHSEH2 | AF044501 |

Description

Escherichia coli strain ec45 RhsE accessory genetic element coreprotein gene, partial cds, and dsORF-e4, complete cds; and RhsHaccessory genetic element unknown (450), core protein, and dsORF-h1genes, complete cds.

| ORF Name | NTID | AAID | NT Length | AA Length | Score | Probability |
|---|---|---|---|---|---|---|
| 32695333_f1_212 | 1201 | 5373 | 348 | 1047 | 974 | 5.4e-98 |
| Protein name | | | | | Locus Name | Acc# |
| | | | | | sp:LPXK_ECOLI | P27300:P75 |

Description

TETRAACYLDISACCHARIDE 4'-KINASE, (LIPID A 4'-KINASE)

| ORF Name | NTID | AAID | NT Length | AA Length | Score | Probability |
|---|---|---|---|---|---|---|
| 33245711_c3_1528 | 1202 | 5374 | 254 | 765 | 116 | 0.00022 |
| Protein name | | | | | Locus Name | Acc# |
| hypothetical protein, MAL4P2.54 | | | | | gp:PFMAL4P2 | AL035475 |

Description

Plasmodium falciparum MAL4P2, complete sequence.

| ORF Name | NTID | AAID | NT Length | AA Length | Score | Probability |
|---|---|---|---|---|---|---|
| 33252213_c3_1419 | 1203 | 5375 | 288 | 867 | 1111 | 1.6e-112 |
| Protein name | | | | | Locus Name | Acc# |
| | | | | | sp:FOCA_ECOLI | P21501 |

Description

PROBABLE FORMATE TRANSPORTER 1 (FORMATE CHANNEL 1)

| ORF Name | NTID | AAID | NT Length | AA Length | Score | Probability |
|---|---|---|---|---|---|---|
| 33257840_f3_770 | 1204 | 5376 | 147 | 444 | | |
| Protein name | | | | | Locus Name | Acc# |

Description

NO-HIT

| ORF Name | NTID | AAID | NT Length | AA Length | Score | Probability |
|---|---|---|---|---|---|---|
| 33478437_f3_669 | 1205 | 5377 | 403 | 1212 | 1619 | 2.4e-166 |
| Protein name | | | | | Locus Name | Acc# |
| dihydrolipoamide S-succinyltransferase,:2-oxoglutarate | | | | pir:XUECSD | | F64808:A30 |

Description dihydrolipoamide S-succinyltransferase,:2-oxoglutarate

| ORF Name | NTID | AAID | NT Length | AA Length | Score | Probability |
|---|---|---|---|---|---|---|
| 33625306_f3_637 | 1206 | 5378 | 137 | 414 | | |
| Protein name | | | | | Locus Name | Acc# |

Description

NO-HIT

| ORF Name | NTID | AAID | NT Length | AA Length | Score | Probability |
|---|---|---|---|---|---|---|
| 33634750_c2_1280 | 1207 | 5379 | 98 | 297 | 274 | 8.1e-24 |
| Protein name | | | | | Locus Name | Acc# |
| hypothetical protein b2680 | | | | pir:A65048 | | A65048 |

Description

| ORF Name | NTID | AAID | NT Length | AA Length | Score | Probability |
|---|---|---|---|---|---|---|
| 33640936_f2_455 | 1208 | 5380 | 486 | 1461 | 2082 | 2.1e-215 |
| Protein name | | | | | Locus Name | Acc# |
| phosphogluconate dehydrogenase (decarboxylating), | | | | pir:I41249 | | I41249 |

Description

| ORF Name | NTID | AAID | NT Length | AA Length | Score | Probability |
|---|---|---|---|---|---|---|
| 33751518_c1_1044 | 1209 | 5381 | 249 | 750 | | |
| Protein name | | | | | Locus Name | Acc# |

Description

NO-HIT

| ORF_Name | NTID | AAID | NT Length | AA Length | Score | Probability |
|---|---|---|---|---|---|---|
| 33756253_c1_1031 | 1210 | 5382 | 292 | 879 | 589 | 3.4e-57 |
| Protein name | | | | | Locus_Name | Acc# |
| | | | | | sp:YAFK_ECOLI | Q47148 |

Description
HYPOTHETICAL 28.0 KD PROTEIN IN GMHA-DINJ INTERGENIC REGION PRECURSOR

| ORF_Name | NTID | AAID | NT Length | AA Length | Score | Probability |
|---|---|---|---|---|---|---|
| 33787531_c3_1543 | 1211 | 5383 | 255 | 768 | 643 | 6.4e-63 |
| Protein name | | | | | Locus_Name | Acc# |
| | | | | | sp:YBEN_ECOLI | P52085 |

Description
HYPOTHETICAL 24.5 KD PROTEIN IN PHPB-HOLA INTERGENIC REGION (ORFUU)

| ORF_Name | NTID | AAID | NT Length | AA Length | Score | Probability |
|---|---|---|---|---|---|---|
| 33835766_f1_196 | 1212 | 5384 | 183 | 552 | 395 | 1.2e-36 |
| Protein name | | | | | Locus_Name | Acc# |
| | | | | | sp:YBJN_ECOLI | P75815 |

Description
HYPOTHETICAL 17.7 KD PROTEIN IN RIMK-POTF INTERGENIC REGION

| ORF_Name | NTID | AAID | NT Length | AA Length | Score | Probability |
|---|---|---|---|---|---|---|
| 33835932_c1_991 | 1213 | 5385 | 516 | 1551 | 2032 | 4.1e-210 |
| Protein name | | | | | Locus_Name | Acc# |
| | | | | | sp:EMRB_ECOLI | P27304:P77 |

Description
MULTIDRUG RESISTANCE PROTEIN B

| ORF_Name | NTID | AAID | NT Length | AA Length | Score | Probability |
|---|---|---|---|---|---|---|
| 33992187_c2_1358 | 1214 | 5386 | 163 | 492 | 222 | 1.8e-17 |
| Protein name | | | | | Locus_Name | Acc# |
| | | | | | sp:VE59_LAMBD | P03754 |

Description
EA59 GENE PROTEIN

| ORF Name | NTID | AAID | NT Length | AA Length | Score | Probability |
|---|---|---|---|---|---|---|
| 34009691_f2_378 | 1215 | 5387 | 66 | 201 | 167 | 1.8e-12 |
| Protein name | | | | | Locus Name | Acc# |
| lipoprotein Rz1 precursor | | | | | pir:JN0750 | JN0750 |

Description

| ORF Name | NTID | AAID | NT Length | AA Length | Score | Probability |
|---|---|---|---|---|---|---|
| 34010963_c1_833 | 1216 | 5388 | 73 | 222 | 276 | 5.0e-24 |
| Protein name | | | | | Locus Name | Acc# |
| | | | | | sp:CSPD_ECOLI | P24245 |

Description

COLD SHOCK-LIKE PROTEIN CSPD (CSP-D)

| ORF Name | NTID | AAID | NT Length | AA Length | Score | Probability |
|---|---|---|---|---|---|---|
| 34018803_c1_848 | 1217 | 5389 | 83 | 252 | 152 | 6.9e-11 |
| Protein name | | | | | Locus Name | Acc# |
| | | | | | gp:VCH231097 | AJ231097 |

Description

Vibrio cholerae z38r gene.

| ORF Name | NTID | AAID | NT Length | AA Length | Score | Probability |
|---|---|---|---|---|---|---|
| 34023508_f3_675 | 1218 | 5390 | 361 | 1086 | 531 | 4.7e-51 |
| Protein name | | | | | Locus Name | Acc# |
| | | | | | sp:TOLA_HAEIN | P44678:P94 |

Description

TOLA PROTEIN

| ORF Name | NTID | AAID | NT Length | AA Length | Score | Probability |
|---|---|---|---|---|---|---|
| 34025312_f2_488 | 1219 | 5391 | 346 | 1041 | 1249 | 3.9e-127 |
| Protein name | | | | | Locus Name | Acc# |
| | | | | | sp:ASG2_ECOLI | P00805 |

Description

AMIDOHYDROLASE II) (L-ASNASE II) (COLASPASE)

| ORF Name | NTID | AAID | NT Length | AA Length | Score | Probability |
|---|---|---|---|---|---|---|
| 34110717_c3_1491 | 1220 | 5392 | 712 | 2139 | | |
| Protein name | | | | | Locus Name | Acc# |

Description
NO-HIT

| ORF Name | NTID | AAID | NT Length | AA Length | Score | Probability |
|---|---|---|---|---|---|---|
| 34164000_c3_1527 | 1221 | 5393 | 69 | 210 | | |
| Protein name | | | | | Locus Name | Acc# |

Description
NO-HIT

| ORF Name | NTID | AAID | NT Length | AA Length | Score | Probability |
|---|---|---|---|---|---|---|
| 34164202_f1_184 | 1222 | 5394 | 383 | 1152 | 745 | 9.9e-74 |
| Protein name | | | | | Locus Name | Acc# |
| | | | | | sp:YEIB_ECOLI | P25747 |

Description
HYPOTHETICAL 43.4 KD PROTEIN IN GALS-FOLE INTERGENIC REGION

| ORF Name | NTID | AAID | NT Length | AA Length | Score | Probability |
|---|---|---|---|---|---|---|
| 3417125_f1_132 | 1223 | 5395 | 172 | 519 | | |
| Protein name | | | | | Locus Name | Acc# |

Description
NO-HIT

| ORF Name | NTID | AAID | NT Length | AA Length | Score | Probability |
|---|---|---|---|---|---|---|
| 34172752_f2_456 | 1224 | 5396 | 390 | 1173 | 1446 | 5.2e-148 |
| Protein name | | | | | Locus Name | Acc# |
| | | | | | sp:ADH2_ECOLI | P37686 |

Description
PROBABLE ALCOHOL DEHYDROGENASE,

| ORF Name | NTID | AAID | NT Length | AA Length | Score | Probability |
|---|---|---|---|---|---|---|
| 34177143_c2_1302 | 1225 | 5397 | 431 | 1296 | 1605 | 7.3e-165 |
| Protein name | | | | | Locus Name | Acc# |
| | | | | | sp:YFJD_ECOLI | P37908:P76 |
| Description | | | | | | |
| HYPOTHETICAL 46.4 KD PROTEIN IN FFH-GRPE INTERGENIC REGION | | | | | | |

| ORF Name | NTID | AAID | NT Length | AA Length | Score | Probability |
|---|---|---|---|---|---|---|
| 34178377_c2_1140 | 1226 | 5398 | 319 | 960 | 114 | 0.00077 |
| Protein name | | | | | Locus Name | Acc# |
| lytic regulatory protein | | | | | gp:SAU67965 | U67965 |
| Description | | | | | | |
| Staphylococcus aureus lytic regulatory protein gene, complete cds. | | | | | | |

| ORF Name | NTID | AAID | NT Length | AA Length | Score | Probability |
|---|---|---|---|---|---|---|
| 34179652_f3_599 | 1227 | 5399 | 803 | 2412 | 1731 | 3.3e-178 |
| Protein name | | | | | Locus Name | Acc# |
| | | | | | sp:HXC1_HAEIN | P44523 |
| Description | | | | | | |
| HEME-HEMOPEXIN UTILIZATION PROTEIN C PRECURSOR | | | | | | |

| ORF Name | NTID | AAID | NT Length | AA Length | Score | Probability |
|---|---|---|---|---|---|---|
| 34189068_c3_1618 | 1228 | 5400 | 136 | 411 | 74 | 0.013 |
| Protein name | | | | | Locus Name | Acc# |
| Rz1 protein precursor | | | | | gp:AF125520 | AF125520 |
| Description | | | | | | |
| Bacteriophage 933W, complete genome. | | | | | | |

| ORF Name | NTID | AAID | NT Length | AA Length | Score | Probability |
|---|---|---|---|---|---|---|
| 34252312_c3_1420 | 1229 | 5401 | 765 | 2298 | 3549 | 0.0 |
| Protein name | | | | | Locus Name | Acc# |
| formate C-acetyltransferase, 1:pyruvate formate-lyase I | | | | | pir:S01788 | S01788:B32 |
| Description | | | | | | |

| ORF Name | NTID | AAID | NT Length | AA Length | Score | Probability |
|---|---|---|---|---|---|---|
| 34261512_f1_147 | 1230 | 5402 | 177 | 534 | 700 | 5.8e-69 |
| Protein name | | | | | Locus Name | Acc# |
| | | | | | sp:PGMU_ECOLI | P36938 |

Description

PHOSPHOGLUCOMUTASE, (GLUCOSE PHOSPHOMUTASE) (PGM)

| ORF Name | NTID | AAID | NT Length | AA Length | Score | Probability |
|---|---|---|---|---|---|---|
| 34267125_c3_1450 | 1231 | 5403 | 683 | 2052 | 2930 | 0.0 |
| Protein name | | | | | Locus Name | Acc# |
| methionyl-tRNA synthetase | | | | | gp:ECOHU47 | U00007 |

Description 47 to 48 centisome region of E.coli K12 BHB2600.

| ORF Name | NTID | AAID | NT Length | AA Length | Score | Probability |
|---|---|---|---|---|---|---|
| 34275303_f2_509 | 1232 | 5404 | 156 | 471 | | |
| Protein name | | | | | Locus Name | Acc# |

Description

NO-HIT

| ORF Name | NTID | AAID | NT Length | AA Length | Score | Probability |
|---|---|---|---|---|---|---|
| 34409807_c3_1616 | 1233 | 5405 | 229 | 690 | 247 | 5.9e-21 |
| Protein name | | | | | Locus Name | Acc# |
| VirB8 homolog | | | | | pir:G47301 | G47301 |

Description

| ORF Name | NTID | AAID | NT Length | AA Length | Score | Probability |
|---|---|---|---|---|---|---|
| 34410412_c2_1261 | 1234 | 5406 | 295 | 888 | 1250 | 3.0e-127 |
| Protein name | | | | | Locus Name | Acc# |
| | | | | | sp:YBEX_ECOLI | P77392 |

Description

HYPOTHETICAL 33.3 KD PROTEIN IN CUTE-ASNB INTERGENIC REGION

| ORF Name | NTID | AAID | NT Length | AA Length | Score | Probability |
|---|---|---|---|---|---|---|
| 34415827_c3_1531 | 1235 | 5407 | 410 | 1233 | 1464 | 6.4e-150 |
| Protein name | | | | | Locus Name | Acc# |
| | | | | | sp:NAGC_ECOLI | P15301 |

Description
N-ACETYLGLUCOSAMINE REPRESSOR

| ORF Name | NTID | AAID | NT Length | AA Length | Score | Probability |
|---|---|---|---|---|---|---|
| 34584561_c3_1472 | 1236 | 5408 | 301 | 906 | 173 | 4.2e-11 |
| Protein name | | | | | Locus Name | Acc# |
| streptomycin resistance protein | | | | | pir:S25259 | S25259 |

Description

| ORF Name | NTID | AAID | NT Length | AA Length | Score | Probability |
|---|---|---|---|---|---|---|
| 34586055_f2_306 | 1237 | 5409 | 345 | 1038 | 910 | 3.3e-91 |
| Protein name | | | | | Locus Name | Acc# |
| | | | | | sp:APBE_HAEIN | P44550 |

Description
THIAMINE BIOSYNTHESIS LIPOPROTEIN APBE PRECURSOR

| ORF Name | NTID | AAID | NT Length | AA Length | Score | Probability |
|---|---|---|---|---|---|---|
| 34640878_f1_121 | 1238 | 5410 | 261 | 786 | 240 | 3.2e-20 |
| Protein name | | | | | Locus Name | Acc# |
| | | | | | sp:VG18_BPP22 | P03687 |

Description
REPLICATION PROTEIN GP18

| ORF Name | NTID | AAID | NT Length | AA Length | Score | Probability |
|---|---|---|---|---|---|---|
| 34645638_f1_201 | 1239 | 5411 | 653 | 1962 | 2095 | 8.7e-217 |
| Protein name | | | | | Locus Name | Acc# |
| | | | | | sp:YBJZ_ECOLI | P75831 |

Description
HYPOTHETICAL ABC TRANSPORTER ATP-BINDING PROTEIN YBJZ

| ORF Name | NTID | AAID | NT Length | AA Length | Score | Probability |
|---|---|---|---|---|---|---|
| 34648416_f3_674 | 1240 | 5412 | 147 | 444 | 525 | 2.0e-50 |
| Protein name | | | | | Locus Name | Acc# |
| | | | | | sp:TOLR_ECOLI | P05829 |

Description

TOLR PROTEIN

| ORF Name | NTID | AAID | NT Length | AA Length | Score | Probability |
|---|---|---|---|---|---|---|
| 35157950_c2_1253 | 1241 | 5413 | 69 | 210 | 177 | 1.5e-13 |
| Protein name | | | | | Locus Name | Acc# |
| single strand binding protein | | | | | gp:STAF000001 | AF000001:A |

Description

Salmonella typhi topoisomerase B (topB), single strand bindingprotein (ssb), Ytl2 homolog (ytl2) genes, complete cds; pil operon,complete sequence; Rci (rci) gene, complete cds.

| ORF Name | NTID | AAID | NT Length | AA Length | Score | Probability |
|---|---|---|---|---|---|---|
| 3515_f1_7 | 1242 | 5414 | 62 | 189 | | |
| Protein name | | | | | Locus Name | Acc# |

Description

NO-HIT

| ORF Name | NTID | AAID | NT Length | AA Length | Score | Probability |
|---|---|---|---|---|---|---|
| 35164000_c2_1128 | 1243 | 5415 | 228 | 687 | 1134 | 6.0e-115 |
| Protein name | | | | | Locus Name | Acc# |
| | | | | | sp:CAT_PROMI | P07641 |

Description

CHLORAMPHENICOL ACETYLTRANSFERASE,

| ORF Name | NTID | AAID | NT Length | AA Length | Score | Probability |
|---|---|---|---|---|---|---|
| 35175441_f2_503 | 1244 | 5416 | 754 | 2265 | 954 | 1.7e-99 |

| Protein name | Locus Name | Acc# |
|---|---|---|
| VgrG protein | gp:AF044503 | AF044503 |

Description

Escherichia coli strain ecl1 unknown (498), hcp gene, complete cds;and RhsG accessory genetic element VgrG protein, core component anddsORF-g1 genes, complete cds.

| ORF Name | NTID | AAID | NT Length | AA Length | Score | Probability |
|---|---|---|---|---|---|---|
| 35178328_f3_563 | 1245 | 5417 | 76 | 231 | 61 | 2.9e-05 |

| Protein name | Locus Name | Acc# |
|---|---|---|
|  | sp:YKFB_ECOLI | P77162 |

Description

HYPOTHETICAL 17.0 KD PROTEIN IN PROA-PERR INTERGENIC REGION PRECURSOR

| ORF Name | NTID | AAID | NT Length | AA Length | Score | Probability |
|---|---|---|---|---|---|---|
| 35211686_c3_1391 | 1246 | 5418 | 60 | 183 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 35257828_f2_483 | 1247 | 5419 | 1282 | 3849 | 2225 | 0.0 |

| Protein name | Locus Name | Acc# |
|---|---|---|
|  | sp:FTSK_ECOLI | P46889:P77 |

Description

CELL DIVISION PROTEIN FTSK

| ORF Name | NTID | AAID | NT Length | AA Length | Score | Probability |
|---|---|---|---|---|---|---|
| 35320336_f1_108 | 1248 | 5420 | 68 | 207 | 107 | 4.0e-06 |

| Protein name | Locus Name | Acc# |
|---|---|---|
| hypothetical protein b0669 | pir:G64801 | G64801 |

Description

| ORF Name | NTID | AAID | NT Length | AA Length | Score | Probability |
|---|---|---|---|---|---|---|
| 35718830_f1_13 | 1249 | 5421 | 359 | 1080 | 576 | 8.1e-56 |
| Protein name | | | | | Locus Name | Acc# |
| | | | | | gp:AB016260 | AB016260:A |

Description
Agrobacterium tumefaciens plasmid pTi-SAKURA, complete sequence.

| ORF Name | NTID | AAID | NT Length | AA Length | Score | Probability |
|---|---|---|---|---|---|---|
| 35938406_f1_168 | 1250 | 5422 | 239 | 720 | 900 | 3.7e-90 |
| Protein name | | | | | Locus Name | Acc# |
| | | | | | sp:MODB_ECOLI | P09834:P77 |

Description
MOLYBDENUM TRANSPORT SYSTEM PERMEASE PROTEIN MODB

| ORF Name | NTID | AAID | NT Length | AA Length | Score | Probability |
|---|---|---|---|---|---|---|
| 35944665_c3_1395 | 1251 | 5423 | 469 | 1410 | 317 | 2.6e-28 |
| Protein name | | | | | Locus Name | Acc# |
| | | | | | gp:VCH231091 | AJ231091 |

Description
Vibrio cholerae z29f gene.

| ORF Name | NTID | AAID | NT Length | AA Length | Score | Probability |
|---|---|---|---|---|---|---|
| 35976562_c3_1607 | 1252 | 5424 | 232 | 699 | 580 | 3.0e-56 |
| Protein name | | | | | Locus Name | Acc# |
| hypothetical protein | | | | | gp:YPS236887 | AJ236887 |

Description
Yersinia pseudotuberculosis DNA for the right arm of the highpathogenicity island.

| ORF Name | NTID | AAID | NT Length | AA Length | Score | Probability |
|---|---|---|---|---|---|---|
| 36050906_c2_1338 | 1253 | 5425 | 273 | 822 | 238 | 5.3e-20 |
| Protein name | | | | | Locus Name | Acc# |
| VirB1 | | | | | gp:AF141604 | AF141604 |

Description

Brucella suis VirB1 (virB1), VirB2 (virB2), VirB3 (virB3), VirB4(virB4), VirB5 (virB5), VirB6 (virB6), VirB7 (virB7), VirB8(virB8), VirB9 (virB9), VirB10 (virB10), VirB11 (virB11), and ORF12genes, complete cds.

| ORF Name | NTID | AAID | NT Length | AA Length | Score | Probability |
|---|---|---|---|---|---|---|
| 36204775_f3_626 | 1254 | 5426 | 118 | 357 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 36359425_f3_672 | 1255 | 5427 | 144 | 435 | 437 | 4.3e-41 |

| Protein name | Locus Name | Acc# |
|---|---|---|
| | sp:YBGC_ECOLI | P08999 |

Description

HYPOTHETICAL 15.6 KD PROTEIN IN CYDB-TOLQ INTERGENIC REGION

| ORF Name | NTID | AAID | NT Length | AA Length | Score | Probability |
|---|---|---|---|---|---|---|
| 36463431_f2_482 | 1256 | 5428 | 63 | 192 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 36501375_c3_1597 | 1257 | 5429 | 193 | 582 | 516 | 1.8e-49 |

| Protein name | Locus Name | Acc# |
|---|---|---|
| | sp:YPI3_VIBAL | P52059 |

Description

HYPOTHETICAL PROTEIN IN PROC 3'REGION (ORF3)

| ORF_Name | NTID | AAID | NT Length | AA Length | Score | Probability |
|---|---|---|---|---|---|---|
| 36580300_f1_162 | 1258 | 5430 | 248 | 747 | 788 | 2.8e-78 |
| Protein name | | | | | Locus Name | Acc# |
| | | | | | sp:PNUC_SALTY | P24520 |

Description: PNUC PROTEIN

| ORF_Name | NTID | AAID | NT Length | AA Length | Score | Probability |
|---|---|---|---|---|---|---|
| 36609712_f3_684 | 1259 | 5431 | 359 | 1080 | 1146 | 3.2e-116 |
| Protein name | | | | | Locus Name | Acc# |
| molybdenum transport protein modC:molybdenum transport protein chlD | | | | | pir:BVECHD | E64812:B26 |

Description

| ORF_Name | NTID | AAID | NT Length | AA Length | Score | Probability |
|---|---|---|---|---|---|---|
| 3906660_c3_1602 | 1260 | 5432 | 450 | 1353 | 1225 | 1.4e-124 |
| Protein name | | | | | Locus Name | Acc# |
| integrase | | | | | gp:ECO245584 | AJ245584 |

Description: Escherichia coli int gene for integrase, strain 3172/97.

| ORF_Name | NTID | AAID | NT Length | AA Length | Score | Probability |
|---|---|---|---|---|---|---|
| 3907588_c1_816 | 1261 | 5433 | 283 | 852 | 471 | 1.1e-44 |
| Protein name | | | | | Locus Name | Acc# |
| hypothetical protein Rv1634 | | | | | pir:H70559 | H70559 |

Description

| ORF_Name | NTID | AAID | NT Length | AA Length | Score | Probability |
|---|---|---|---|---|---|---|
| 3907692_f2_244 | 1262 | 5434 | 2315 | 6948 | 468 | 2.7e-39 |
| Protein name | | | | | Locus Name | Acc# |
| hypothetical protein | | | | | pir:S76109 | S76109 |

Description

| ORF Name | NTID | AAID | NT Length | AA Length | Score | Probability |
|---|---|---|---|---|---|---|
| 3909656_f3_582 | 1263 | 5435 | 367 | 1104 | 1788 | 3.0e-184 |
| Protein name | | | | | Locus Name | Acc# |
| recombination protein recA:recombinase A | | | | | pir:RQEBPM | S04606 |

Description

| ORF Name | NTID | AAID | NT Length | AA Length | Score | Probability |
|---|---|---|---|---|---|---|
| 3910338_c1_849 | 1264 | 5436 | 209 | 630 | 477 | 2.5e-45 |
| Protein name | | | | | Locus Name | Acc# |
| | | | | | sp:YLIJ_ECOLI | P75805 |

Description
HYPOTHETICAL 23.9 KD PROTEIN IN MOEA-DACC INTERGENIC REGION

| ORF Name | NTID | AAID | NT Length | AA Length | Score | Probability |
|---|---|---|---|---|---|---|
| 3912642_c3_1490 | 1265 | 5437 | 884 | 2655 | 241 | 2.3e-30 |
| Protein name | | | | | Locus Name | Acc# |
| | | | | | sp:YEHM_ECOLI | P33349:P33 |

Description
HYPOTHETICAL 83.4 KD PROTEIN IN MOLR-BGLX INTERGENIC REGION

| ORF Name | NTID | AAID | NT Length | AA Length | Score | Probability |
|---|---|---|---|---|---|---|
| 3912687_f1_74 | 1266 | 5438 | 328 | 987 | 1420 | 2.9e-145 |
| Protein name | | | | | Locus Name | Acc# |
| | | | | | sp:RLUD_ECOLI | P33643:P77 |

Description
(PSEUDOURIDYLATE SYNTHASE) (URACIL HYDROLYASE)

| ORF Name | NTID | AAID | NT Length | AA Length | Score | Probability |
|---|---|---|---|---|---|---|
| 3917052_c1_992 | 1267 | 5439 | 896 | 2691 | 3047 | 0.0 |
| Protein name | | | | | Locus Name | Acc# |
| | | | | | sp:YFIQ_ECOLI | P76594:Q47 |

Description
HYPOTHETICAL 98.0 KD PROTEIN IN UNG-PSSA INTERGENIC REGION

| ORF_Name | NTID | AAID | NT Length | AA Length | Score | Probability |
|---|---|---|---|---|---|---|
| 3917938_f2_401 | 1268 | 5440 | 83 | 252 | 252 | 1.7e-21 |

| Protein name | | | | | Locus Name | Acc# |
|---|---|---|---|---|---|---|
| unknown | | | | | gp:AF056093 | AF056093 |

Description: Yersinia enterocolitica plasmid pYV ORF80 gene, complete cds.

| ORF_Name | NTID | AAID | NT Length | AA Length | Score | Probability |
|---|---|---|---|---|---|---|
| 3925268_c2_1183 | 1269 | 5441 | 235 | 708 | 467 | 2.9e-44 |

| Protein name | | | | | Locus Name | Acc# |
|---|---|---|---|---|---|---|
| | | | | | sp:YBIH_ECOLI | P41037:P78 |

Description: HYPOTHETICAL TRANSCRIPTIONAL REGULATOR IN MOAE-RHLE INTERGENIC REGION

| ORF_Name | NTID | AAID | NT Length | AA Length | Score | Probability |
|---|---|---|---|---|---|---|
| 392942_c1_941 | 1270 | 5442 | 72 | 219 | | |

| Protein name | | | | | Locus Name | Acc# |
|---|---|---|---|---|---|---|

Description: NO-HIT

| ORF_Name | NTID | AAID | NT Length | AA Length | Score | Probability |
|---|---|---|---|---|---|---|
| 3937568_c3_1601 | 1271 | 5443 | 93 | 282 | 389 | 5.3e-36 |

| Protein name | | | | | Locus Name | Acc# |
|---|---|---|---|---|---|---|
| hypothetical protein b2962 | | | | | pir:A65082 | A65082 |

Description:

| ORF_Name | NTID | AAID | NT Length | AA Length | Score | Probability |
|---|---|---|---|---|---|---|
| 3941526_c2_1336 | 1272 | 5444 | 103 | 312 | 292 | 1.0e-25 |

| Protein name | | | | | Locus Name | Acc# |
|---|---|---|---|---|---|---|
| hypothetical protein | | | | | pir:T17447 | T17447 |

Description:

| ORF Name | NTID | AAID | NT Length | AA Length | Score | Probability |
|---|---|---|---|---|---|---|
| 3942143_c1_850 | 1273 | 5445 | 302 | 909 | 1300 | 1.5e-132 |
| Protein name | | | | | Locus Name | Acc# |
| | | | | | sp:HIS1_ECOLI | P10366 |

Description: ATP PHOSPHORIBOSYLTRANSFERASE,

| ORF Name | NTID | AAID | NT Length | AA Length | Score | Probability |
|---|---|---|---|---|---|---|
| 3944062_f2_265 | 1274 | 5446 | 791 | 2376 | 127 | 3.5e-09 |
| Protein name | | | | | Locus Name | Acc# |
| heme receptor | | | | | gp:VIBHUTA | L27149 |

Description: Vibrio cholerae heme receptor (hutA) gene, complete cds.

| ORF Name | NTID | AAID | NT Length | AA Length | Score | Probability |
|---|---|---|---|---|---|---|
| 3944192_c3_1432 | 1275 | 5447 | 611 | 1836 | 2209 | 7.3e-229 |
| Protein name | | | | | Locus Name | Acc# |
| ABC-type transport protein aarD | | | | | pir:S70900 | S70900 |

Description:

| ORF Name | NTID | AAID | NT Length | AA Length | Score | Probability |
|---|---|---|---|---|---|---|
| 3945318_c2_1335 | 1276 | 5448 | 91 | 276 | 237 | 6.8e-20 |
| Protein name | | | | | Locus Name | Acc# |
| IrpP | | | | | gp:PMU46488 | U46488 |

Description: Proteus mirabilis NrpS (nrpS) gene, partial cds, NrpU (nrpU), NrpT(nrpT), NrpA (nrpA), NrpB (nrpB), NrpG (nrpG) and IrpP (irpP)genes, complete cds.

| ORF Name | NTID | AAID | NT Length | AA Length | Score | Probability |
|---|---|---|---|---|---|---|
| 395955_f2_432 | 1277 | 5449 | 259 | 780 | 540 | 5.3e-52 |
| Protein name | | | | | Locus Name | Acc# |
| | | | | | sp:BIOC_SERMA | P36571 |

Description: BIOTIN SYNTHESIS PROTEIN BIOC

| ORF Name | NTID | AAID | NT Length | AA Length | Score | Probability |
|---|---|---|---|---|---|---|
| 3959838_f3_642 | 1278 | 5450 | 99 | 300 | 77 | 0.045 |
| Protein name | | | | | Locus Name | Acc# |
| annexin XIIIb | | | | | pir:B57076 | B57076 |

Description

| ORF Name | NTID | AAID | NT Length | AA Length | Score | Probability |
|---|---|---|---|---|---|---|
| 4006291_f2_356 | 1279 | 5451 | 409 | 1230 | 1220 | 4.6e-124 |
| Protein name | | | | | Locus Name | Acc# |
| | | | | | sp:YLEB_ECOLI | P75728:P77 |

Description

HYPOTHETICAL 43.0 KD PROTEIN IN CUTE-GLNX INTERGENIC REGION

| ORF Name | NTID | AAID | NT Length | AA Length | Score | Probability |
|---|---|---|---|---|---|---|
| 4017568_f3_748 | 1280 | 5452 | 443 | 1332 | 1795 | 5.4e-185 |
| Protein name | | | | | Locus Name | Acc# |
| | | | | | sp:MUKF_ECOLI | P36567 |

Description

MUKF PROTEIN (KILLING FACTOR KICB)

| ORF Name | NTID | AAID | NT Length | AA Length | Score | Probability |
|---|---|---|---|---|---|---|
| 4031693_f1_101 | 1281 | 5453 | 681 | 2046 | 1249 | 3.9e-127 |
| Protein name | | | | | Locus Name | Acc# |
| suppressor for copper-sensitivity B | | | | | gp:STU75949 | U75949 |

Description

Salmonella typhimurium curved DNA-binding protein (cbpA) gene andAgp (agp) gene, partial cds; operon 1 containing suppressor forcopper-sensitivity A (scsA) gene, complete cds; operon 2 containingsuppressor for copper-sensitivity B (scsB), suppressor forcopper-sensitivity C (scsC), and suppressor for copper-sensitivityD (scsD) genes, complete cds.

| ORF Name | NTID | AAID | NT Length | AA Length | Score | Probability |
|---|---|---|---|---|---|---|
| 4062768_f1_180 | 1282 | 5454 | 462 | 1389 | 501 | 7.1e-48 |
| Protein name | | | | | Locus Name | Acc# |
| conserved hypothetical protein MTH965 | | | | | pir:B69229 | B69229 |

Description

| ORF_Name | NTID | AAID | NT Length | AA Length | Score | Probability |
|---|---|---|---|---|---|---|
| 4065877_f2_337 | 1283 | 5455 | 416 | 1251 | 800 | 1.5e-79 |
| Protein_name | | | | | Locus Name | Acc# |
| | | | | | sp:YCEE_ECOLI | P25744 |

Description: HYPOTHETICAL 43.9 KD PROTEIN IN MSYB-HTRB INTERGENIC REGION (ORF1)

| ORF_Name | NTID | AAID | NT Length | AA Length | Score | Probability |
|---|---|---|---|---|---|---|
| 4069053_c2_1333 | 1284 | 5456 | 240 | 723 | 1156 | 2.8e-117 |
| Protein_name | | | | | Locus Name | Acc# |
| NrpA | | | | | gp:PMU46488 | U46488 |

Description: Proteus mirabilis NrpS (nrpS) gene, partial cds, NrpU (nrpU), NrpT(nrpT), NrpA (nrpA), NrpB (nrpB), NrpG (nrpG) and IrpP (irpP)genes, complete cds.

| ORF_Name | NTID | AAID | NT Length | AA Length | Score | Probability |
|---|---|---|---|---|---|---|
| 40801_f3_698 | 1285 | 5457 | 723 | 2172 | 2308 | 2.3e-239 |
| Protein_name | | | | | Locus Name | Acc# |
| | | | | | sp:DING_ECOLI | P27296 |

Description: PROBABLE ATP-DEPENDENT HELICASE DING (DNA-DAMAGE-INDUCIBLE PROTEIN G)

| ORF_Name | NTID | AAID | NT Length | AA Length | Score | Probability |
|---|---|---|---|---|---|---|
| 4085890_f1_72 | 1286 | 5458 | 406 | 1221 | 1408 | 5.5e-144 |
| Protein_name | | | | | Locus Name | Acc# |
| | | | | | sp:AROF_ECOLI | P00888 |

Description: SYNTHETASE) (3-DEOXY-D-ARABINO-HEPTULOSONATE 7-PHOSPHATE SYNTHASE)

| ORF_Name | NTID | AAID | NT Length | AA Length | Score | Probability |
|---|---|---|---|---|---|---|
| 40887_f2_493 | 1287 | 5459 | 790 | 2373 | 1268 | 3.8e-129 |
| Protein_name | | | | | Locus Name | Acc# |
| | | | | | sp:YCAI_ECOLI | P37443:P75 |

Description: HYPOTHETICAL 87.3 KD PROTEIN IN HIMD-MSBA INTERGENIC REGION

| ORF Name | NTID | AAID | NT Length | AA Length | Score | Probability |
|---|---|---|---|---|---|---|
| 4095012_c3_1649 | 1288 | 5460 | 677 | 2034 | 1509 | 1.1e-154 |
| Protein name | | | | | Locus Name | Acc# |
| ZapE | | | | | gp:AF064762 | AF064762 |

Description
Proteus mirabilis metalloprotease operon, complete sequence.

| ORF Name | NTID | AAID | NT Length | AA Length | Score | Probability |
|---|---|---|---|---|---|---|
| 4095192_f3_665 | 1289 | 5461 | 263 | 792 | 309 | 1.6e-27 |
| Protein name | | | | | Locus Name | Acc# |
| | | | | | sp:YEAM_ECOLI | P76241 |

Description
HYPOTHETICAL TRANSCRIPTIONAL REGULATOR IN GAPA-RND INTERGENIC REGION

| ORF Name | NTID | AAID | NT Length | AA Length | Score | Probability |
|---|---|---|---|---|---|---|
| 4096068_f3_744 | 1290 | 5462 | 98 | 297 | 435 | 7.0e-41 |
| Protein name | | | | | Locus Name | Acc# |
| | | | | | sp:IHFB_ECOLI | P08756 |

Description
INTEGRATION HOST FACTOR BETA-SUBUNIT (IHF-BETA)

| ORF Name | NTID | AAID | NT Length | AA Length | Score | Probability |
|---|---|---|---|---|---|---|
| 4098263_f2_309 | 1291 | 5463 | 157 | 474 | 718 | 7.2e-71 |
| Protein name | | | | | Locus Name | Acc# |
| | | | | | sp:XGPT_SALTY | P26972 |

Description
XANTHINE-GUANINE PHOSPHORIBOSYLTRANSFERASE, (XGPRT)

| ORF Name | NTID | AAID | NT Length | AA Length | Score | Probability |
|---|---|---|---|---|---|---|
| 4103416_f2_387 | 1292 | 5464 | 248 | 747 | 772 | 1.4e-76 |
| Protein name | | | | | Locus Name | Acc# |
| minor tail protein L homolog:protein gp18 | | | | | pir:T13104 | T13104 |

Description

| ORF Name | NTID | AAID | NT Length | AA Length | Score | Probability |
|---|---|---|---|---|---|---|
| 4104643_c2_1162 | 1293 | 5465 | 209 | 630 | 777 | 4.0e-77 |

| Protein name | Locus Name | Acc# |
|---|---|---|
| hisIE ORF | gp:ECORFBM | D43637:D13 |

Description

Escherichia coli rfb gene cluster encoding phosphomannomutase, GDP-mannose pyrophosphorylase, mannosyltransferase, etc.

| ORF Name | NTID | AAID | NT Length | AA Length | Score | Probability |
|---|---|---|---|---|---|---|
| 4116702_f2_386 | 1294 | 5466 | 979 | 2940 | 804 | 5.6e-80 |

| Protein name | Locus Name | Acc# |
|---|---|---|
| probable minor tail protein precursor H:protein gp16 | pir:T13102 | T13102 |

Description

| ORF Name | NTID | AAID | NT Length | AA Length | Score | Probability |
|---|---|---|---|---|---|---|
| 4119013_f3_581 | 1295 | 5467 | 722 | 2169 | 2279 | 2.8e-236 |

| Protein name | Locus Name | Acc# |
|---|---|---|
| | sp:AAS_ECOLI | P31119:Q46 |

Description

| ORF Name | NTID | AAID | NT Length | AA Length | Score | Probability |
|---|---|---|---|---|---|---|
| 4119068_f1_126 | 1296 | 5468 | 203 | 612 | 93 | 0.042 |

| Protein name | Locus Name | Acc# |
|---|---|---|
| hypothetical protein PAB2181 | pir:F75216 | F75216 |

Description

| ORF Name | NTID | AAID | NT Length | AA Length | Score | Probability |
|---|---|---|---|---|---|---|
| 4120293_c2_1172 | 1297 | 5469 | 244 | 735 | 796 | 3.9e-79 |

| Protein name | Locus Name | Acc# |
|---|---|---|
| | sp:SANA_ECOLI | P33017:P76 |

Description

SANA PROTEIN

| ORF Name | NTID | AAID | NT Length | AA Length | Score | Probability |
|---|---|---|---|---|---|---|
| 4142268_f1_60 | 1298 | 5470 | 354 | 1065 | 1313 | 6.4e-134 |
| Protein name | | | | | Locus Name | Acc# |
| | | | | | sp:DINP_ECOLI | Q47155:Q47 |

Description: DNA-DAMAGE-INDUCIBLE PROTEIN P

| ORF Name | NTID | AAID | NT Length | AA Length | Score | Probability |
|---|---|---|---|---|---|---|
| 4144633_c1_1084 | 1299 | 5471 | 237 | 714 | 229 | 4.8e-19 |
| Protein name | | | | | Locus Name | Acc# |
| inactive regulatory protein | | | | | gp:MSP250372 | AJ250372 |

Description: Mycobacterium sp. GP1 haloalkane dehalogenase gene region.

| ORF Name | NTID | AAID | NT Length | AA Length | Score | Probability |
|---|---|---|---|---|---|---|
| 4146943_c3_1533 | 1300 | 5472 | 94 | 285 | 247 | 5.9e-21 |
| Protein name | | | | | Locus Name | Acc# |
| | | | | | sp:YAIN_ECOLI | P55756:P77 |

Description: HYPOTHETICAL 10.3 KD PROTEIN IN ADHC-TAUA INTERGENIC REGION

| ORF Name | NTID | AAID | NT Length | AA Length | Score | Probability |
|---|---|---|---|---|---|---|
| 4150900_f2_375 | 1301 | 5473 | 235 | 708 | 282 | 1.2e-24 |
| Protein name | | | | | Locus Name | Acc# |
| | | | | | sp:REGQ_BP82 | P13870 |

Description: ANTITERMINATION PROTEIN Q

| ORF Name | NTID | AAID | NT Length | AA Length | Score | Probability |
|---|---|---|---|---|---|---|
| 4187778_c1_923 | 1302 | 5474 | 110 | 333 | 390 | 4.1e-36 |
| Protein name | | | | | Locus Name | Acc# |
| | | | | | sp:YBFE_ECOLI | P75735 |

Description: HYPOTHETICAL 13.9 KD PROTEIN IN FLDA-SEQA INTERGENIC REGION

| ORF_Name | NTID | AAID | NT Length | AA Length | Score | Probability |
|---|---|---|---|---|---|---|
| 42140_f2_349 | 1303 | 5475 | 100 | 303 | 112 | 1.2e-06 |
| Protein name | | | | | Locus_Name | Acc# |
| hypothetical protein APE2527 | | | | | pir:G72485 | G72485 |

Description

| ORF_Name | NTID | AAID | NT Length | AA Length | Score | Probability |
|---|---|---|---|---|---|---|
| 42542_f2_433 | 1304 | 5476 | 686 | 2061 | 2870 | 6.5e-299 |
| Protein name | | | | | Locus_Name | Acc# |
| | | | | | sp:UVRB_ECOLI | P07025 |

Description

EXCINUCLEASE ABC SUBUNIT B

| ORF_Name | NTID | AAID | NT Length | AA Length | Score | Probability |
|---|---|---|---|---|---|---|
| 426342_c2_1298 | 1305 | 5477 | 82 | 249 | | |
| Protein name | | | | | Locus_Name | Acc# |

Description

NO-HIT

| ORF_Name | NTID | AAID | NT Length | AA Length | Score | Probability |
|---|---|---|---|---|---|---|
| 426502_f2_457 | 1306 | 5478 | 82 | 249 | | |
| Protein name | | | | | Locus_Name | Acc# |

Description

NO-HIT

| ORF_Name | NTID | AAID | NT Length | AA Length | Score | Probability |
|---|---|---|---|---|---|---|
| 4313175_f3_677 | 1307 | 5479 | 75 | 228 | 54 | 0.044 |
| Protein name | | | | | Locus_Name | Acc# |
| hypothetical protein C04F2.4 | | | | | pir:T33396 | T33396 |

Description

| ORF_Name | NTID | AAID | NT Length | AA Length | Score | Probability |
|---|---|---|---|---|---|---|
| 4320438_f1_57 | 1308 | 5480 | 411 | 1236 | 1807 | 2.9e-186 |
| Protein name | | | | | Locus Name | Acc# |
| Na+-translocating NADH-ubiquinone oxidoreductase, beta chain | | | | | pir:D64052 | D64052 |

Description

| ORF_Name | NTID | AAID | NT Length | AA Length | Score | Probability |
|---|---|---|---|---|---|---|
| 4331265_c3_1457 | 1309 | 5481 | 133 | 402 | 111 | 1.5e-06 |
| Protein name | | | | | Locus Name | Acc# |
| hypothetical protein PH0853 | | | | | pir:A71136 | A71136 |

Description

| ORF_Name | NTID | AAID | NT Length | AA Length | Score | Probability |
|---|---|---|---|---|---|---|
| 4334693_f3_631 | 1310 | 5482 | 498 | 1497 | 595 | 7.8e-58 |
| Protein name | | | | | Locus Name | Acc# |
| putative large subunit terminase | | | | | gp:AF125520 | AF125520 |

Description
Bacteriophage 933W, complete genome.

| ORF_Name | NTID | AAID | NT Length | AA Length | Score | Probability |
|---|---|---|---|---|---|---|
| 4334842_f3_692 | 1311 | 5483 | 240 | 723 | 807 | 2.7e-80 |
| Protein name | | | | | Locus Name | Acc# |
| | | | | | sp:YBHL_ECOLI | P75768 |

Description
HYPOTHETICAL 25.9 KD PROTEIN IN MOAE-RHLE INTERGENIC REGION

| ORF_Name | NTID | AAID | NT Length | AA Length | Score | Probability |
|---|---|---|---|---|---|---|
| 4335878_c1_865 | 1312 | 5484 | 66 | 201 | | |
| Protein name | | | | | Locus Name | Acc# |

Description
NO-HIT

| ORF Name | NTID | AAID | NT Length | AA Length | Score | Probability |
|---|---|---|---|---|---|---|
| 4350678_c1_854 | 1313 | 5485 | 61 | 186 | | |
| Protein name | | | | | Locus Name | Acc# |

Description
NO-HIT

| ORF Name | NTID | AAID | NT Length | AA Length | Score | Probability |
|---|---|---|---|---|---|---|
| 4383467_c1_1022 | 1314 | 5486 | 489 | 1470 | 1866 | 1.6e-192 |
| Protein name | | | | | Locus Name | Acc# |
| X-His dipeptidase,:aminoacylhistidine dipeptidase:aminopeptidase | | | | | pir:JU0300 | JU0300:A38 |

Description

| ORF Name | NTID | AAID | NT Length | AA Length | Score | Probability |
|---|---|---|---|---|---|---|
| 4391633_c1_1064 | 1315 | 5487 | 596 | 1791 | 565 | 1.2e-54 |
| Protein name | | | | | Locus Name | Acc# |
| | | | | | gp:ECL224861 | AJ224861 |

Description
Enterobacter cloacae plasmid CloDF13 mobilization region.

| ORF Name | NTID | AAID | NT Length | AA Length | Score | Probability |
|---|---|---|---|---|---|---|
| 4392175_f1_172 | 1316 | 5488 | 61 | 186 | | |
| Protein name | | | | | Locus Name | Acc# |

Description
NO-HIT

| ORF Name | NTID | AAID | NT Length | AA Length | Score | Probability |
|---|---|---|---|---|---|---|
| 4406318_c2_1347 | 1317 | 5489 | 104 | 315 | 215 | 1.4e-17 |
| Protein name | | | | | Locus Name | Acc# |
| hypothetical protein kikA (version 1):killing in klebsiellas (kik) protein:orf104 | | | | | pir:A41865 | A41865:I79 |

Description

| ORF Name | NTID | AAID | NT Length | AA Length | Score | Probability |
|---|---|---|---|---|---|---|
| 4459837_c2_1245 | 1318 | 5490 | 217 | 654 | 519 | 8.8e-50 |
| Protein name | | | | | Locus Name | Acc# |
| | | | | | sp:RPC1_LAMBD | P03034 |

Description

REPRESSOR PROTEIN CI

| ORF Name | NTID | AAID | NT Length | AA Length | Score | Probability |
|---|---|---|---|---|---|---|
| 447181_f1_165 | 1319 | 5491 | 287 | 864 | 576 | 8.1e-56 |
| Protein name | | | | | Locus Name | Acc# |
| HecA | | | | | gp:ERWHRPN | L39897 |

Description

Erwinia chrysanthemi phospholipase C (plcA) gene, partial cds; HrpF(hrpF), HrpG (hrpG), HrcC (hrcC), HrpT (hrpT), HrpV (hrpV), HrpNharpin (hrpN), ORF1, and HecB (hecB) genes, complete cds; and HecA(hecA) gene, partial cds.

| ORF Name | NTID | AAID | NT Length | AA Length | Score | Probability |
|---|---|---|---|---|---|---|
| 4485293_c1_1004 | 1320 | 5492 | 388 | 1167 | 1345 | 2.6e-137 |
| Protein name | | | | | Locus Name | Acc# |
| | | | | | sp:PHEA_ECOLI | P07022 |

Description

| ORF Name | NTID | AAID | NT Length | AA Length | Score | Probability |
|---|---|---|---|---|---|---|
| 4490717_c2_1371 | 1321 | 5493 | 908 | 2727 | 1297 | 3.2e-132 |
| Protein name | | | | | Locus Name | Acc# |
| hypothetical protein SCF55.40c | | | | | gp:SCF55 | AL132991 |

Description

Streptomyces coelicolor cosmid F55.

| ORF Name | NTID | AAID | NT Length | AA Length | Score | Probability |
|---|---|---|---|---|---|---|
| 4492063_c1_929 | 1322 | 5494 | 363 | 1092 | 340 | 8.2e-31 |
| Protein name | | | | | Locus Name | Acc# |
| adhesin | | | | | pir:I41205 | I41205 |

Description

| ORF Name | NTID | AAID | NT Length | AA Length | Score | Probability |
|---|---|---|---|---|---|---|
| 4494057_c2_1372 | 1323 | 5495 | 462 | 1389 | 1197 | 1.3e-121 |
| Protein name | | | | | Locus Name | Acc# |
| putative glycoporin | | | | | gp:ECU82290 | U82290 |

Description

Escherichia coli plasmid pRSD2 putative glycoporin (rafY) gene, complete cds.

| ORF Name | NTID | AAID | NT Length | AA Length | Score | Probability |
|---|---|---|---|---|---|---|
| 4502093_f1_133 | 1324 | 5496 | 196 | 591 | | |
| Protein name | | | | | Locus Name | Acc# |

Description

NO-HIT

| ORF Name | NTID | AAID | NT Length | AA Length | Score | Probability |
|---|---|---|---|---|---|---|
| 4508587_f1_158 | 1325 | 5497 | 435 | 1308 | 1741 | 2.8e-179 |
| Protein name | | | | | Locus Name | Acc# |
| TolB protein | | | | | gp:D90713 | D90713:AB0 |

Description

Escherichia coli genomic DNA. (16.5 - 16.9 min).

| ORF Name | NTID | AAID | NT Length | AA Length | Score | Probability |
|---|---|---|---|---|---|---|
| 4510177_f3_530 | 1326 | 5498 | 110 | 333 | 150 | 1.1e-10 |
| Protein name | | | | | Locus Name | Acc# |
| | | | | | sp:LTB4_ECOLI | Q52043 |

Description

CYTOTOXIC PROTEIN LETB (CCDB PROTEIN)

| ORF Name | NTID | AAID | NT Length | AA Length | Score | Probability |
|---|---|---|---|---|---|---|
| 4538311_c1_878 | 1327 | 5499 | 338 | 1017 | 984 | 4.7e-99 |
| Protein name | | | | | Locus Name | Acc# |
| hypothetical protein b0795 precursor | | | | | pir:C64816 | C64816 |

Description

| ORF_Name | NTID | AAID | NT Length | AA Length | Score | Probability |
|---|---|---|---|---|---|---|
| 4539768_f3_691 | 1328 | 5500 | 84 | 255 | 282 | 1.2e-24 |
| Protein name | | | | | Locus_Name | Acc# |
| | | | | | sp:MOAD_ECOLI | P30748:P77 |

Description: SUBUNIT)

| ORF_Name | NTID | AAID | NT Length | AA Length | Score | Probability |
|---|---|---|---|---|---|---|
| 4550678_c1_1074 | 1329 | 5501 | 131 | 396 | 310 | 1.2e-27 |
| Protein name | | | | | Locus_Name | Acc# |
| IS1400 transposase B | | | | | gp:YEN132945 | AJ132945 |

Description: Yersinia enterocolitica WA 314 right arm of the high-pathogenicityisland.

| ORF_Name | NTID | AAID | NT Length | AA Length | Score | Probability |
|---|---|---|---|---|---|---|
| 4558280_f3_538 | 1330 | 5502 | 173 | 522 | | |
| Protein name | | | | | Locus_Name | Acc# |

Description: NO-HIT

| ORF_Name | NTID | AAID | NT Length | AA Length | Score | Probability |
|---|---|---|---|---|---|---|
| 4564033_f2_412 | 1331 | 5503 | 619 | 1860 | 2909 | 0.0 |
| Protein name | | | | | Locus_Name | Acc# |
| | | | | | sp:DHSA_ECOLI | P10444:P78 |

Description: SUCCINATE DEHYDROGENASE FLAVOPROTEIN SUBUNIT,

| ORF_Name | NTID | AAID | NT Length | AA Length | Score | Probability |
|---|---|---|---|---|---|---|
| 4582838_f1_160 | 1332 | 5504 | 260 | 783 | 754 | 1.1e-74 |
| Protein name | | | | | Locus_Name | Acc# |
| | | | | | sp:YBGF_ECOLI | P45955:P75 |

Description: HYPOTHETICAL 28.2 KD PROTEIN IN PAL-LYST INTERGENIC REGION PRECURSOR

| ORF Name | NTID | AAID | NT Length | AA Length | Score | Probability |
|---|---|---|---|---|---|---|
| 4687918_f3_747 | 1333 | 5505 | 260 | 783 | 792 | 1.0e-78 |
| Protein name | | | | | Locus Name | Acc# |
| | | | | | sp:SMTA_ECOLI | P36566:P77 |

Description: SMTA PROTEIN

| ORF Name | NTID | AAID | NT Length | AA Length | Score | Probability |
|---|---|---|---|---|---|---|
| 4687936_c1_902 | 1334 | 5506 | 509 | 1530 | 1650 | 1.2e-169 |
| Protein name | | | | | Locus Name | Acc# |
| | | | | | sp:MODF_ECOLI | P31060 |

Description: PROTEIN PHRA)

| ORF Name | NTID | AAID | NT Length | AA Length | Score | Probability |
|---|---|---|---|---|---|---|
| 4689087_c3_1606 | 1335 | 5507 | 519 | 1560 | 2460 | 1.8e-255 |
| Protein name | | | | | Locus Name | Acc# |
| NrpB | | | | | gp:PMU46488 | U46488 |

Description: Proteus mirabilis NrpS (nrpS) gene, partial cds, NrpU (nrpU), NrpT(nrpT), NrpA (nrpA), NrpB (nrpB), NrpG (nrpG) and IrpP (irpP)genes, complete cds.

| ORF Name | NTID | AAID | NT Length | AA Length | Score | Probability |
|---|---|---|---|---|---|---|
| 4694092_c3_1605 | 1336 | 5508 | 3074 | 9225 | 11238 | 0.0 |
| Protein name | | | | | Locus Name | Acc# |
| NrpS | | | | | gp:PMU46488 | U46488 |

Description: Proteus mirabilis NrpS (nrpS) gene, partial cds, NrpU (nrpU), NrpT(nrpT), NrpA (nrpA), NrpB (nrpB), NrpG (nrpG) and IrpP (irpP)genes, complete cds.

| ORF Name | NTID | AAID | NT Length | AA Length | Score | Probability |
|---|---|---|---|---|---|---|
| 4697802_f1_64 | 1337 | 5509 | 180 | 543 | 491 | 8.2e-47 |
| Protein name | | | | | Locus Name | Acc# |
| | | | | | sp:YGAD_ECOLI | P41053 |

Description: HYPOTHETICAL 17.6 KD PROTEIN IN MLTB-RECA INTERGENIC REGION

| ORF Name | NTID | AAID | NT Length | AA Length | Score | Probability |
|---|---|---|---|---|---|---|
| 4711692_f3_576 | 1338 | 5510 | 203 | 612 | 877 | 1.0e-87 |
| Protein name | | | | | Locus Name | Acc# |
| | | | | | sp:NQRE_VIBAL | Q56589:Q56 |

Description
(NA-NQR COMPLEX SUBUNIT 5)

| ORF Name | NTID | AAID | NT Length | AA Length | Score | Probability |
|---|---|---|---|---|---|---|
| 4712938_f3_660 | 1339 | 5511 | 274 | 825 | 898 | 6.1e-90 |
| Protein name | | | | | Locus Name | Acc# |
| | | | | | sp:YBGI_ECOLI | P75743 |

Description
HYPOTHETICAL 26.9 KD PROTEIN IN PHRB-NEI INTERGENIC REGION

| ORF Name | NTID | AAID | NT Length | AA Length | Score | Probability |
|---|---|---|---|---|---|---|
| 4720268_c1_928 | 1340 | 5512 | 847 | 2544 | 2730 | 4.5e-284 |
| Protein name | | | | | Locus Name | Acc# |
| transmembrane protein | | | | | gp:ECOF17D | L77091 |

Description
Escherichia coli F17d fimbrial gene cluster encoding the majorfimbrial subunit protein (F17d-A), the chaperone protein (F17d-D), the transmembrane protein (F17d-C), the adhesin (F17d-G), completecds.

| ORF Name | NTID | AAID | NT Length | AA Length | Score | Probability |
|---|---|---|---|---|---|---|
| 4722218_f2_413 | 1341 | 5513 | 937 | 2814 | 4050 | 0.0 |
| Protein name | | | | | Locus Name | Acc# |
| | | | | | sp:ODO1_ECOLI | P07015:P78 |

Description
KETOGLUTARATE DEHYDROGENASE)

| ORF Name | NTID | AAID | NT Length | AA Length | Score | Probability |
|---|---|---|---|---|---|---|
| 4725693_c2_1124 | 1342 | 5514 | 1186 | 3561 | 285 | 1.8e-31 |
| Protein name | | | | | Locus Name | Acc# |
| icmF protein | | | | | pir:T18341 | T18341 |

Description

| ORF Name | NTID | AAID | NT Length | AA Length | Score | Probability |
|---|---|---|---|---|---|---|
| 4726555_c1_787 | 1343 | 5515 | 502 | 1509 | 939 | 2.8e-94 |
| Protein name | | | | | Locus Name | Acc# |
| putative 54.5 kDa protein | | | | gp:AF037441 | | AF037441 |

Description

Edwardsiella ictaluri putative 18.8 kDa protein (eip19), putative17.8 kDa protein (eip18), putative 54.5 kDa protein (eip55), andputative 19.5 kDa protein (eip20) genes, complete cds.

| ORF Name | NTID | AAID | NT Length | AA Length | Score | Probability |
|---|---|---|---|---|---|---|
| 4729633_f3_585 | 1344 | 5516 | 456 | 1371 | 2000 | 1.0e-206 |
| Protein name | | | | | Locus Name | Acc# |
| | | | | | sp:SR54_ECOLI | P07019 |

Description

SIGNAL RECOGNITION PARTICLE PROTEIN (FIFTY-FOUR HOMOLOG) (P48)

| ORF Name | NTID | AAID | NT Length | AA Length | Score | Probability |
|---|---|---|---|---|---|---|
| 4740937_f1_123 | 1345 | 5517 | 103 | 312 | 325 | 3.2e-29 |
| Protein name | | | | | Locus Name | Acc# |
| | | | | | sp:YBCO_ECOLI | Q47271:Q37 |

Description

HYPOTHETICAL 10.3 KD PROTEIN IN EMRE-RUS INTERGENIC REGION

| ORF Name | NTID | AAID | NT Length | AA Length | Score | Probability |
|---|---|---|---|---|---|---|
| 4742183_f3_766 | 1346 | 5518 | 146 | 441 | | |
| Protein name | | | | | Locus Name | Acc# |

Description

NO-HIT

| ORF Name | NTID | AAID | NT Length | AA Length | Score | Probability |
|---|---|---|---|---|---|---|
| 4765631_c1_901 | 1347 | 5519 | 78 | 237 | | |
| Protein name | | | | | Locus Name | Acc# |

Description

NO-HIT

| ORF Name | NTID | AAID | NT Length | AA Length | Score | Probability |
|---|---|---|---|---|---|---|
| 4767010_f2_255 | 1348 | 5520 | 63 | 192 | | |
| Protein name | | | | | Locus Name | Acc# |

Description
NO-HIT

| ORF Name | NTID | AAID | NT Length | AA Length | Score | Probability |
|---|---|---|---|---|---|---|
| 4772802_f3_702 | 1349 | 5521 | 397 | 1194 | 307 | 2.6e-27 |
| Protein name | | | | | Locus Name | Acc# |
| | | | | | sp:YJIJ_ECOLI | P39381 |

Description
HYPOTHETICAL 41.4 KD PROTEIN IN IADA-MCRD INTERGENIC REGION (F392)

| ORF Name | NTID | AAID | NT Length | AA Length | Score | Probability |
|---|---|---|---|---|---|---|
| 4786592_f3_614 | 1350 | 5522 | 247 | 744 | 538 | 7.3e-54 |
| Protein name | | | | | Locus Name | Acc# |
| suppressor for copper-sensitivity C | | | | | gp:STU75949 | U75949 |

Description
Salmonella typhimurium curved DNA-binding protein (cbpA) gene andAgp (agp) gene, partial cds; operon 1 containing suppressor forcopper-sensitivity A (scsA) gene, complete cds; operon 2 containingsuppressor for copper-sensitivity B (scsB), suppressor forcopper-sensitivity C (scsC), and suppressor for copper-sensitivityD (scsD) genes, complete cds.

| ORF Name | NTID | AAID | NT Length | AA Length | Score | Probability |
|---|---|---|---|---|---|---|
| 4798431_c1_1051 | 1351 | 5523 | 252 | 759 | 1295 | 5.2e-132 |
| Protein name | | | | | Locus Name | Acc# |
| NrpG | | | | | gp:PMU46488 | U46488 |

Description
Proteus mirabilis NrpS (nrpS) gene, partial cds, NrpU (nrpU), NrpT(nrpT), NrpA (nrpA), NrpB (nrpB), NrpG (nrpG) and IrpP (irpP)genes, complete cds.

| ORF Name | NTID | AAID | NT Length | AA Length | Score | Probability |
|---|---|---|---|---|---|---|
| 4803217_f2_382 | 1352 | 5524 | 221 | 666 | | |
| Protein name | | | | | Locus Name | Acc# |

Description
NO-HIT

| ORF Name | NTID | AAID | NT Length | AA Length | Score | Probability |
|---|---|---|---|---|---|---|
| 4803411_f2_479 | 1353 | 5525 | 107 | 324 | 333 | 4.5e-30 |
| Protein name | | | | | Locus Name | Acc# |
| | | | | | sp:YLJA_ECOLI | P75832 |

Description: 12.2 KD PROTEIN IN CSPD-CLPA INTERGENIC REGION

| ORF Name | NTID | AAID | NT Length | AA Length | Score | Probability |
|---|---|---|---|---|---|---|
| 4806443_f2_383 | 1354 | 5526 | 104 | 315 | | |
| Protein name | | | | | Locus Name | Acc# |

Description: NO-HIT

| ORF Name | NTID | AAID | NT Length | AA Length | Score | Probability |
|---|---|---|---|---|---|---|
| 4812888_f2_256 | 1355 | 5527 | 237 | 714 | | |
| Protein name | | | | | Locus Name | Acc# |

Description: NO-HIT

| ORF Name | NTID | AAID | NT Length | AA Length | Score | Probability |
|---|---|---|---|---|---|---|
| 4823568_c3_1462 | 1356 | 5528 | 594 | 1785 | 2113 | 1.1e-218 |
| Protein name | | | | | Locus Name | Acc# |
| ABC-type transport protein ybhF | | | | | pir:B64816 | B64816 |

Description

| ORF Name | NTID | AAID | NT Length | AA Length | Score | Probability |
|---|---|---|---|---|---|---|
| 4867785_f3_604 | 1357 | 5529 | 166 | 501 | 334 | 3.6e-30 |
| Protein name | | | | | Locus Name | Acc# |
| methylated-DNA--protein-cysteine S-methyltransferase, | | | | | pir:D64604 | D64604 |

Description

| ORF_Name | NTID | AAID | NT Length | AA Length | Score | Probability |
|---|---|---|---|---|---|---|
| 4876642_c2_1356 | 1358 | 5530 | 329 | 990 | 143 | 1.3e-06 |
| Protein name | | | | | Locus Name | Acc# |
| hypothetical protein, MAL4P2.47 | | | | gp:PFMAL4P2 | | AL035475 |

Description: Plasmodium falciparum MAL4P2, complete sequence.

| ORF_Name | NTID | AAID | NT Length | AA Length | Score | Probability |
|---|---|---|---|---|---|---|
| 4877338_f3_558 | 1359 | 5531 | 112 | 339 | 444 | 7.8e-42 |
| Protein name | | | | | Locus Name | Acc# |
| hypothetical protein in mutY 5' region | | | | pir:F65081 | | F65081 |

Description:

| ORF_Name | NTID | AAID | NT Length | AA Length | Score | Probability |
|---|---|---|---|---|---|---|
| 4878568_c3_1534 | 1360 | 5532 | 279 | 840 | 944 | 8.1e-95 |
| Protein name | | | | | Locus Name | Acc# |
| | | | | | sp:YAIM_ECOLI | P51025:P77 |

Description: HYPOTHETICAL 31.4 KD PROTEIN IN MHPT-ADHC INTERGENIC REGION

| ORF_Name | NTID | AAID | NT Length | AA Length | Score | Probability |
|---|---|---|---|---|---|---|
| 4882938_c2_1170 | 1361 | 5533 | 236 | 711 | 888 | 7.0e-89 |
| Protein name | | | | | Locus Name | Acc# |
| | | | | | sp:YOHK_ECOLI | P33373 |

Description: HYPOTHETICAL 24.5 KD PROTEIN IN PBPG-CDD INTERGENIC REGION

| ORF_Name | NTID | AAID | NT Length | AA Length | Score | Probability |
|---|---|---|---|---|---|---|
| 4885302_f2_451 | 1362 | 5534 | 378 | 1137 | 1510 | 8.6e-155 |
| Protein name | | | | | Locus Name | Acc# |
| | | | | | sp:MRP_ECOLI | P21590 |

Description: MRP PROTEIN

| ORF Name | NTID | AAID | NT Length | AA Length | Score | Probability |
|---|---|---|---|---|---|---|
| 4885963_c3_1567 | 1363 | 5535 | 60 | 183 | | |
| Protein name | | | | | Locus Name | Acc# |

Description
NO-HIT

| ORF Name | NTID | AAID | NT Length | AA Length | Score | Probability |
|---|---|---|---|---|---|---|
| 4891562_c1_1082 | 1364 | 5536 | 741 | 2226 | 2920 | 0.0 |
| Protein name | | | | | Locus Name | Acc# |
| | | | | | sp:DCOS_ECOLI | P24169 |

Description
ORNITHINE DECARBOXYLASE, INDUCIBLE,

| ORF Name | NTID | AAID | NT Length | AA Length | Score | Probability |
|---|---|---|---|---|---|---|
| 4892202_c3_1443 | 1365 | 5537 | 234 | 705 | 809 | 1.6e-80 |
| Protein name | | | | | Locus Name | Acc# |
| | | | | | sp:ARTQ_ECOLI | P30861:P77 |

Description
ARGININE TRANSPORT SYSTEM PERMEASE PROTEIN ARTQ

| ORF Name | NTID | AAID | NT Length | AA Length | Score | Probability |
|---|---|---|---|---|---|---|
| 4897143_c3_1604 | 1366 | 5538 | 2037 | 6114 | 4029 | 0.0 |
| Protein name | | | | | Locus Name | Acc# |
| | | | | | sp:HMP2_YEREN | P48633 |

Description
HIGH-MOLECULAR-WEIGHT PROTEIN 2 (HMWP2)

| ORF Name | NTID | AAID | NT Length | AA Length | Score | Probability |
|---|---|---|---|---|---|---|
| 4897193_c3_1440 | 1367 | 5539 | 303 | 912 | 906 | 8.6e-91 |
| Protein name | | | | | Locus Name | Acc# |
| | | | | | sp:YBJE_ECOLI | P75826 |

Description
HYPOTHETICAL 34.4 KD PROTEIN IN POXB-AQPZ INTERGENIC REGION

| ORF_Name | NTID | AAID | NT Length | AA Length | Score | Probability |
|---|---|---|---|---|---|---|
| 4899057_c3_1555 | 1368 | 5540 | 459 | 1380 | 1605 | 7.3e-165 |
| Protein name | | | | | Locus Name | Acc# |
| CDP-DIACYLGLYCEROL--SERINE | | | | gp:D90886 | | D90886:AB0 |

Description
E.coli genomic DNA, Kohara clone #436(58.4-58.8 min.).

| ORF_Name | NTID | AAID | NT Length | AA Length | Score | Probability |
|---|---|---|---|---|---|---|
| 4949135_f2_379 | 1369 | 5541 | 79 | 240 | | |
| Protein name | | | | | Locus Name | Acc# |

Description
NO-HIT

| ORF_Name | NTID | AAID | NT Length | AA Length | Score | Probability |
|---|---|---|---|---|---|---|
| 4953775_f2_425 | 1370 | 5542 | 79 | 240 | 139 | 1.6e-09 |
| Protein name | | | | | Locus Name | Acc# |
| hypothetical protein b0762 | | | | pir:B64812 | | B64812 |

Description

| ORF_Name | NTID | AAID | NT Length | AA Length | Score | Probability |
|---|---|---|---|---|---|---|
| 4959665_f1_159 | 1371 | 5543 | 180 | 543 | 609 | 2.6e-59 |
| Protein name | | | | | Locus Name | Acc# |
| | | | | | sp:PAL_ECOLI | P07176 |

Description
PEPTIDOGLYCAN-ASSOCIATED LIPOPROTEIN PRECURSOR

| ORF_Name | NTID | AAID | NT Length | AA Length | Score | Probability |
|---|---|---|---|---|---|---|
| 4961693_c1_1054 | 1372 | 5544 | 101 | 306 | 143 | 6.2e-10 |
| Protein name | | | | | Locus Name | Acc# |
| unknown protein | | | | gp:BPETOXS | | M14378:M16 |

Description
Bordetella pertussis (strain BP165) toxin gene encoding subunits S1, S2, S3, S4, S5.

| ORF Name | NTID | AAID | NT Length | AA Length | Score | Probability |
|---|---|---|---|---|---|---|
| 5078176_f1_187 | 1373 | 5545 | 259 | 780 | 882 | 3.0e-88 |
| Protein name | | | | | Locus Name | Acc# |
| | | | | | sp:URK_ECOLI | P31218:P78 |

Description: RIBONUCLEOSIDE KINASE)

| ORF Name | NTID | AAID | NT Length | AA Length | Score | Probability |
|---|---|---|---|---|---|---|
| 5085088_c1_856 | 1374 | 5546 | 168 | 507 | 553 | 2.2e-53 |
| Protein name | | | | | Locus Name | Acc# |
| | | | | | sp:YEAK_ECOLI | P76238 |

Description: HYPOTHETICAL 17.9 KD PROTEIN IN GAPA-RND INTERGENIC REGION

| ORF Name | NTID | AAID | NT Length | AA Length | Score | Probability |
|---|---|---|---|---|---|---|
| 5095662_f3_676 | 1375 | 5547 | 67 | 204 | | |
| Protein name | | | | | Locus Name | Acc# |

Description: NO-HIT

| ORF Name | NTID | AAID | NT Length | AA Length | Score | Probability |
|---|---|---|---|---|---|---|
| 5109791_c1_853 | 1376 | 5548 | 247 | 744 | 971 | 1.1e-97 |
| Protein name | | | | | Locus Name | Acc# |
| phosphoribosylformimino-5 aminoimidazole | | | | | gp:AB008676 | AB008676 |

Description: Escherichia coli O157 DNA, map position at 46 min., complete cds.

| ORF Name | NTID | AAID | NT Length | AA Length | Score | Probability |
|---|---|---|---|---|---|---|
| 5110642_c2_1307 | 1377 | 5549 | 292 | 879 | 508 | 1.3e-48 |
| Protein name | | | | | Locus Name | Acc# |
| | | | | | sp:YU33_MYCTU | Q50687 |

Description: HYPOTHETICAL 32.2 KD PROTEIN CY339.33 PRECURSOR

| ORF_Name | NTID | AAID | NT Length | AA Length | Score | Probability |
|---|---|---|---|---|---|---|
| 5113915_c3_1434 | 1378 | 5550 | 237 | 714 | 671 | 6.9e-66 |
| Protein name | | | | | Locus Name | Acc# |
| | | | | | sp:LPTP_ECOLI | P23885 |

Description: LEUCYL/PHENYLALANYL-TRNA--PROTEIN TRANSFERASE,

| ORF_Name | NTID | AAID | NT Length | AA Length | Score | Probability |
|---|---|---|---|---|---|---|
| 5120393_c1_851 | 1379 | 5551 | 440 | 1323 | 1506 | 2.3e-154 |
| Protein name | | | | | Locus Name | Acc# |
| | | | | | sp:HISX_SALTY | P10370 |

Description: HISTIDINOL DEHYDROGENASE, (HDH)

| ORF_Name | NTID | AAID | NT Length | AA Length | Score | Probability |
|---|---|---|---|---|---|---|
| 5130443_c3_1525 | 1380 | 5552 | 76 | 231 | 61 | 0.034 |
| Protein name | | | | | Locus Name | Acc# |
| hypothetical GTP-binding protein homolog | | | | | pir:G64482 | G64482 |

Description:

| ORF_Name | NTID | AAID | NT Length | AA Length | Score | Probability |
|---|---|---|---|---|---|---|
| 5135915_f2_474 | 1381 | 5553 | 108 | 327 | 123 | 8.1e-08 |
| Protein name | | | | | Locus Name | Acc# |
| | | | | | sp:YBJC_ECOLI | P46119 |

Description: HYPOTHETICAL 10.5 KD PROTEIN IN GRXA-MDAA INTERGENIC REGION

| ORF_Name | NTID | AAID | NT Length | AA Length | Score | Probability |
|---|---|---|---|---|---|---|
| 5136003_c2_1250 | 1382 | 5554 | 88 | 267 | 76 | 0.019 |
| Protein name | | | | | Locus Name | Acc# |
| | | | | | sp:RK12_NICSY | P36688 |

Description: 50S RIBOSOMAL PROTEIN L12, CHLOROPLAST PRECURSOR (CL12)

| ORF Name | NTID | AAID | NT Length | AA Length | Score | Probability |
|---|---|---|---|---|---|---|
| 517842_f3_589 | 1383 | 5555 | 89 | 270 | 67 | 0.0021 |
| Protein name | | | | | Locus Name | Acc# |
| envelope glycoprotein | | | | | gp:AF105451 | AF105451 |

Description

HIV-1 isolate A-DII-07 from Italy, envelope glycoprotein, C2-V5region (env) gene, partial cds.

| ORF Name | NTID | AAID | NT Length | AA Length | Score | Probability |
|---|---|---|---|---|---|---|
| 5192207_f3_627 | 1384 | 5556 | 151 | 456 | 144 | 4.8e-10 |
| Protein name | | | | | Locus Name | Acc# |
| hypothetical protein 48 | | | | | pir:T00182 | T00182 |

Description

| ORF Name | NTID | AAID | NT Length | AA Length | Score | Probability |
|---|---|---|---|---|---|---|
| 5214588_f1_54 | 1385 | 5557 | 258 | 777 | 1053 | 2.3e-106 |
| Protein name | | | | | Locus Name | Acc# |
|  | | | | | sp:YAFJ_ECOLI | Q47147 |

Description

HYPOTHETICAL 28.6 KD PROTEIN IN GMHA-DINJ INTERGENIC REGION

| ORF Name | NTID | AAID | NT Length | AA Length | Score | Probability |
|---|---|---|---|---|---|---|
| 5287838_c2_1248 | 1386 | 5558 | 94 | 285 | | |
| Protein name | | | | | Locus Name | Acc# |

Description

NO-HIT

| ORF Name | NTID | AAID | NT Length | AA Length | Score | Probability |
|---|---|---|---|---|---|---|
| 5319467_f2_235 | 1387 | 5559 | 87 | 264 | | |
| Protein name | | | | | Locus Name | Acc# |

Description

NO-HIT

| ORF Name | NTID | AAID | NT Length | AA Length | Score | Probability |
|---|---|---|---|---|---|---|
| 5351693_f2_428 | 1388 | 5560 | 332 | 999 | 810 | 1.3e-80 |
| Protein name | | | | | Locus Name | Acc# |
| | | | | | sp:YBHE_ECOLI | P52697:P75 |

Description: HYPOTHETICAL 36.3 KD PROTEIN IN MODC-BIOA INTERGENIC REGION

| ORF Name | NTID | AAID | NT Length | AA Length | Score | Probability |
|---|---|---|---|---|---|---|
| 5364213_f3_640 | 1389 | 5561 | 292 | 879 | | |
| Protein name | | | | | Locus Name | Acc# |

Description: NO-HIT

| ORF Name | NTID | AAID | NT Length | AA Length | Score | Probability |
|---|---|---|---|---|---|---|
| 53752_c3_1501 | 1390 | 5562 | 63 | 192 | | |
| Protein name | | | | | Locus Name | Acc# |

Description: NO-HIT

| ORF Name | NTID | AAID | NT Length | AA Length | Score | Probability |
|---|---|---|---|---|---|---|
| 553312_c3_1410 | 1391 | 5563 | 311 | 936 | 716 | 1.2e-70 |
| Protein name | | | | | Locus Name | Acc# |
| | | | | | sp:YCBC_ECOLI | P36565:P75 |

Description: HYPOTHETICAL 28.7 KD PROTEIN IN KDSB-MUKF INTERGENIC REGION

| ORF Name | NTID | AAID | NT Length | AA Length | Score | Probability |
|---|---|---|---|---|---|---|
| 55343_c1_880 | 1392 | 5564 | 373 | 1122 | 1442 | 1.4e-147 |
| Protein name | | | | | Locus Name | Acc# |
| | | | | | sp:YBHR_ECOLI | P75774 |

Description: HYPOTHETICAL 41.6 KD PROTEIN IN MOAE-RHLE INTERGENIC REGION

| ORF Name | NTID | AAID | NT Length | AA Length | Score | Probability |
|---|---|---|---|---|---|---|
| 565678_f3_560 | 1393 | 5565 | 325 | 978 | 571 | 2.7e-55 |
| Protein name | | | | | Locus Name | Acc# |
| probable ferrichrome ABC transporter yclQ | | | | | pir:E69763 | E69763 |

Description probable ferrichrome ABC transporter yclQ

| ORF Name | NTID | AAID | NT Length | AA Length | Score | Probability |
|---|---|---|---|---|---|---|
| 573312_c1_1052 | 1394 | 5566 | 106 | 321 | | |
| Protein name | | | | | Locus Name | Acc# |

Description

NO-HIT

| ORF Name | NTID | AAID | NT Length | AA Length | Score | Probability |
|---|---|---|---|---|---|---|
| 585936_f3_659 | 1395 | 5567 | 103 | 312 | 110 | 1.9e-06 |
| Protein name | | | | | Locus Name | Acc# |
| | | | | | sp:YIAG_ECOLI | P37668 |

Description

HYPOTHETICAL 11.0 KD PROTEIN IN BISC-CSPA INTERGENIC REGION (O96)

| ORF Name | NTID | AAID | NT Length | AA Length | Score | Probability |
|---|---|---|---|---|---|---|
| 5879050_f1_214 | 1396 | 5568 | 66 | 201 | 223 | 2.1e-18 |
| Protein name | | | | | Locus Name | Acc# |
| | | | | | sp:YCAR_ECOLI | P75844 |

Description

HYPOTHETICAL 6.9 KD PROTEIN IN MSBA-KDSB INTERGENIC REGION

| ORF Name | NTID | AAID | NT Length | AA Length | Score | Probability |
|---|---|---|---|---|---|---|
| 5892055_f3_624 | 1397 | 5569 | 84 | 255 | 164 | 3.7e-12 |
| Protein name | | | | | Locus Name | Acc# |
| | | | | | gp:AP000363 | AP000363 |

Description

Bacteriophage VT2-Sa, complete genome sequence.

| ORF Name | NTID | AAID | NT Length | AA Length | Score | Probability |
|---|---|---|---|---|---|---|
| 5892337_f3_763 | 1398 | 5570 | 176 | 531 | 782 | 1.2e-77 |
| Protein name | | | | | Locus Name | Acc# |
| hcp | | | | | gp:AF044503 | AF044503 |

Description

Escherichia coli strain ec11 unknown (498), hcp gene, complete cds;and RhsG accessory genetic element VgrG protein, core component anddsORF-g1 genes, complete cds.

| ORF Name | NTID | AAID | NT Length | AA Length | Score | Probability |
|---|---|---|---|---|---|---|
| 589812_f2_402 | 1399 | 5571 | 114 | 345 | 98 | 3.6e-05 |
| Protein name | | | | | Locus Name | Acc# |
| | | | | | gp:CBQPH1 | X75356 |

Description

C.burnetii QpH1 plasmid, complete genomic sequence.

| ORF Name | NTID | AAID | NT Length | AA Length | Score | Probability |
|---|---|---|---|---|---|---|
| 5913876_f3_682 | 1400 | 5572 | 65 | 198 | 80 | 0.0029 |
| Protein name | | | | | Locus Name | Acc# |
| Bkm-like sex-determining region hypothetical protein CS319 | | | | | pir:C21124 | C21124 |

Description

| ORF Name | NTID | AAID | NT Length | AA Length | Score | Probability |
|---|---|---|---|---|---|---|
| 5937838_f1_174 | 1401 | 5573 | 469 | 1410 | 1532 | 4.0e-157 |
| Protein name | | | | | Locus Name | Acc# |
| | | | | | sp:RHLE_ECOLI | P25888 |

Description

PUTATIVE ATP-DEPENDENT RNA HELICASE RHLE

| ORF Name | NTID | AAID | NT Length | AA Length | Score | Probability |
|---|---|---|---|---|---|---|
| 5941376_c3_1627 | 1402 | 5574 | 70 | 213 | 72 | 0.020 |
| Protein name | | | | | Locus Name | Acc# |
| | | | | | sp:YAG6_YEAST | P39710 |

Description

HYPOTHETICAL 12.1 KD PROTEIN IN SEO1-FLO9 INTERGENIC REGION

| ORF_Name | NTID | AAID | NT Length | AA Length | Score | Probability |
|---|---|---|---|---|---|---|
| 5974166_f1_169 | 1403 | 5575 | 391 | 1176 | 1133 | 7.6e-115 |

| Protein name | | | | | Locus Name | Acc# |
|---|---|---|---|---|---|---|
| | | | | | sp:BIOF_ERWHE | Q47829 |

Description
LIGASE)

| ORF_Name | NTID | AAID | NT Length | AA Length | Score | Probability |
|---|---|---|---|---|---|---|
| 5993875_f1_30 | 1404 | 5576 | 74 | 225 | | |

| Protein name | | | | | Locus Name | Acc# |
|---|---|---|---|---|---|---|

Description
NO-HIT

| ORF_Name | NTID | AAID | NT Length | AA Length | Score | Probability |
|---|---|---|---|---|---|---|
| 6053201_f1_14 | 1405 | 5577 | 113 | 342 | 101 | 1.7e-05 |

| Protein name | | | | | Locus Name | Acc# |
|---|---|---|---|---|---|---|
| | | | | | sp:LTA1_ECOLI | P05702 |

Description
LETA PROTEIN (CCDA PROTEIN) (PROTEIN H) (LYNA)

| ORF_Name | NTID | AAID | NT Length | AA Length | Score | Probability |
|---|---|---|---|---|---|---|
| 6063956_c2_1288 | 1406 | 5578 | 156 | 471 | 114 | 1.8e-06 |

| Protein name | | | | | Locus Name | Acc# |
|---|---|---|---|---|---|---|
| hypothetical protein PH0221 | | | | | pir:D71245 | D71245 |

Description

| ORF_Name | NTID | AAID | NT Length | AA Length | Score | Probability |
|---|---|---|---|---|---|---|
| 6251267_f2_294 | 1407 | 5579 | 376 | 1131 | 796 | 3.9e-79 |

| Protein name | | | | | Locus Name | Acc# |
|---|---|---|---|---|---|---|
| hypothetical protein b2950 | | | | | pir:E65080 | E65080 |

Description

| ORF Name | NTID | AAID | NT Length | AA Length | Score | Probability |
|---|---|---|---|---|---|---|
| 6256582_f2_418 | 1408 | 5580 | 471 | 1416 | 439 | 2.7e-41 |аль
| Protein name | | | | | Locus Name | Acc# |
| multidrug-efflux transporter homolog yusP | | | | pir:A70022 | | A70022 |

Description

| ORF Name | NTID | AAID | NT Length | AA Length | Score | Probability |
|---|---|---|---|---|---|---|
| 6260937_f1_56 | 1409 | 5581 | 217 | 654 | 836 | 2.3e-83 |
| Protein name | | | | | Locus Name | Acc# |
| NqrD | | | | gp:AF117331 | | AF117331 |

Description

Vibrio cholerae N16961 Na+-translocating NADH-ubiquinoneoxidoreductase enzyme complex, complete sequence.

| ORF Name | NTID | AAID | NT Length | AA Length | Score | Probability |
|---|---|---|---|---|---|---|
| 6260_c2_1334 | 1410 | 5582 | 304 | 915 | 1540 | 5.7e-158 |
| Protein name | | | | | Locus Name | Acc# |
| NrpA | | | | gp:PMU46488 | | U46488 |

Description

Proteus mirabilis NrpS (nrpS) gene, partial cds, NrpU (nrpU), NrpT(nrpT), NrpA (nrpA), NrpB (nrpB), NrpG (nrpG) and IrpP (irpP)genes, complete cds.

| ORF Name | NTID | AAID | NT Length | AA Length | Score | Probability |
|---|---|---|---|---|---|---|
| 6281567_c2_1194 | 1411 | 5583 | 285 | 858 | 847 | 1.5e-84 |
| Protein name | | | | | Locus Name | Acc# |
| | | | | | sp:MODE_ECOLI | P46930 |

Description

MOLYBDENUM TRANSPORT PROTEIN MODE

| ORF Name | NTID | AAID | NT Length | AA Length | Score | Probability |
|---|---|---|---|---|---|---|
| 6298588_c2_1251 | 1412 | 5584 | 311 | 936 | 141 | 3.4e-07 |
| Protein name | | | | | Locus Name | Acc# |
| gene 35 protein | | | | pir:S41177 | | S43803:T42 |

Description

| ORF_Name | NTID | AAID | NT Length | AA Length | Score | Probability |
|---|---|---|---|---|---|---|
| 6300_f2_427 | 1413 | 5585 | 69 | 210 | 126 | 6.7e-08 |
| Protein name | | | | | Locus Name | Acc# |
| | | | | | gp:ECU07867 | U07867 |

Description

Escherichia coli K12, substrain MC1000 molybdenum transport (modR),(modA), (modB), (modC), (modD), genes, complete cds.

| ORF_Name | NTID | AAID | NT Length | AA Length | Score | Probability |
|---|---|---|---|---|---|---|
| 6347802_c1_1091 | 1414 | 5586 | 69 | 210 | | |
| Protein name | | | | | Locus Name | Acc# |

Description

NO-HIT

| ORF_Name | NTID | AAID | NT Length | AA Length | Score | Probability |
|---|---|---|---|---|---|---|
| 6365927_c1_788 | 1415 | 5587 | 603 | 1812 | | |
| Protein name | | | | | Locus Name | Acc# |

Description

NO-HIT

| ORF_Name | NTID | AAID | NT Length | AA Length | Score | Probability |
|---|---|---|---|---|---|---|
| 6390_f2_238 | 1416 | 5588 | 311 | 936 | 89 | 0.0018 |
| Protein name | | | | | Locus Name | Acc# |
| hypothetical protein TM1330 | | | | | pir:F72267 | F72267 |

Description

| ORF_Name | NTID | AAID | NT Length | AA Length | Score | Probability |
|---|---|---|---|---|---|---|
| 6407510_c3_1441 | 1417 | 5589 | 495 | 1488 | 1460 | 1.7e-149 |
| Protein name | | | | | Locus Name | Acc# |
| | | | | | sp:YBJT_ECOLI | P75822 |

Description

HYPOTHETICAL 53.7 KD PROTEIN IN ARTP-POXB INTERGENIC REGION

| ORF_Name | NTID | AAID | NT Length | AA Length | Score | Probability |
|---|---|---|---|---|---|---|
| 6421968_c3_1594 | 1418 | 5590 | 247 | 744 | 1007 | 1.7e-101 |
| Protein name | | | | | Locus Name | Acc# |
| hypothetical protein in endA-gshB intergenic region | | | | | pir:A65080 | A65080 |

Description

| ORF_Name | NTID | AAID | NT Length | AA Length | Score | Probability |
|---|---|---|---|---|---|---|
| 6485750_c3_1392 | 1419 | 5591 | 63 | 192 | 55 | 0.021 |
| Protein name | | | | | Locus Name | Acc# |
| | | | | | sp:YQHL_BACSU | P54510 |

Description

HYPOTHETICAL 14.6 KD PROTEIN IN GCVT-SPOIIIAA INTERGENIC REGION

| ORF_Name | NTID | AAID | NT Length | AA Length | Score | Probability |
|---|---|---|---|---|---|---|
| 6532193_c1_915 | 1420 | 5592 | 1245 | 3738 | 340 | 9.1e-26 |
| Protein name | | | | | Locus Name | Acc# |
| | | | | | sp:MOLR_ECOLI | P33345 |

Description

MOLYBDATE METABOLISM REGULATOR

| ORF_Name | NTID | AAID | NT Length | AA Length | Score | Probability |
|---|---|---|---|---|---|---|
| 6641875_f1_107 | 1421 | 5593 | 95 | 288 | 103 | 1.1e-05 |
| Protein name | | | | | Locus Name | Acc# |
| hypothetical protein b0663 | | | | | pir:E64801 | E64801 |

Description

| ORF_Name | NTID | AAID | NT Length | AA Length | Score | Probability |
|---|---|---|---|---|---|---|
| 6646068_c3_1541 | 1422 | 5594 | 185 | 558 | 410 | 3.1e-38 |
| Protein name | | | | | Locus Name | Acc# |
| | | | | | sp:RLPB_ECOLI | P10101:P77 |

Description

RARE LIPOPROTEIN B PRECURSOR

| ORF Name | NTID | AAID | NT Length | AA Length | Score | Probability |
|---|---|---|---|---|---|---|
| 6695302_f2_390 | 1423 | 5595 | 102 | 309 | 81 | 0.032 |
| Protein name | | | | | Locus Name | Acc# |
| | | | | | gp:NGOSUCAB | L36381 |

Description

Neisseria gonorrhoeae sucAB-lpd operon, sucB and lpd genes, complete cds, sucA gene partial cds and IS-150-like element 3' end.

| ORF Name | NTID | AAID | NT Length | AA Length | Score | Probability |
|---|---|---|---|---|---|---|
| 6756588_c1_984 | 1424 | 5596 | 352 | 1059 | 1317 | 2.4e-134 |
| Protein name | | | | | Locus Name | Acc# |
| | | | | | sp:PROX_ECOLI | P14177 |

Description

GLYCINE BETAINE-BINDING PERIPLASMIC PROTEIN PRECURSOR

| ORF Name | NTID | AAID | NT Length | AA Length | Score | Probability |
|---|---|---|---|---|---|---|
| 6759566_f1_46 | 1425 | 5597 | 245 | 738 | 1010 | 8.2e-102 |
| Protein name | | | | | Locus Name | Acc# |
| | | | | | sp:YGGH_ECOLI | P32049 |

Description

HYPOTHETICAL 27.3 KD PROTEIN IN ANSB-MUTY INTERGENIC REGION (F239)

| ORF Name | NTID | AAID | NT Length | AA Length | Score | Probability |
|---|---|---|---|---|---|---|
| 6775257_c3_1471 | 1426 | 5598 | 251 | 756 | 1158 | 1.7e-117 |
| Protein name | | | | | Locus Name | Acc# |
| phosphoglycerate mutase, 1 | | | | | pir:C64811 | C64811 |

Description

| ORF Name | NTID | AAID | NT Length | AA Length | Score | Probability |
|---|---|---|---|---|---|---|
| 6829688_f1_206 | 1427 | 5599 | 177 | 534 | 834 | 3.7e-83 |
| Protein name | | | | | Locus Name | Acc# |
| | | | | | gp:PMLRPFTSK | Y10417 |

Description

P.mirabilis lrp and ftsK genes.

| ORF Name | NTID | AAID | NT Length | AA Length | Score | Probability |
|---|---|---|---|---|---|---|
| 6835928_f3_559 | 1428 | 5600 | 258 | 777 | 491 | 8.2e-47 |
| Protein name | | | | | Locus Name | Acc# |
| | | | | | sp:YGGN_ECOLI | P46143 |

Description

HYPOTHETICAL 26.4 KD PROTEIN IN GSHB-ANSB INTERGENIC REGION (F239)

| ORF Name | NTID | AAID | NT Length | AA Length | Score | Probability |
|---|---|---|---|---|---|---|
| 6835952_f3_733 | 1429 | 5601 | 201 | 606 | 659 | 1.3e-64 |
| Protein name | | | | | Locus Name | Acc# |
| | | | | | sp:LOLA_ECOLI | P39178 |

Description

OUTER MEMBRANE LIPOPROTEINS CARRIER PROTEIN PRECURSOR (P20)

| ORF Name | NTID | AAID | NT Length | AA Length | Score | Probability |
|---|---|---|---|---|---|---|
| 6900382_f1_175 | 1430 | 5602 | 311 | 936 | 1170 | 9.1e-119 |
| Protein name | | | | | Locus Name | Acc# |
| | | | | | sp:YOHI_ECOLI | P33371 |

Description

HYPOTHETICAL 35.2 KD PROTEIN IN PBPG-CDD INTERGENIC REGION

| ORF Name | NTID | AAID | NT Length | AA Length | Score | Probability |
|---|---|---|---|---|---|---|
| 6910888_c1_868 | 1431 | 5603 | 311 | 936 | 924 | 1.1e-92 |
| Protein name | | | | | Locus Name | Acc# |
| probable membrane protein ybiF | | | | | pir:E64818 | E64818:I69 |

Description

| ORF Name | NTID | AAID | NT Length | AA Length | Score | Probability |
|---|---|---|---|---|---|---|
| 6917143_f3_586 | 1432 | 5604 | 122 | 369 | 559 | 5.1e-54 |
| Protein name | | | | | Locus Name | Acc# |
| ribosomal protein L19 | | | | | pir:R5EC19 | S07951:A02 |

Description

| ORF Name | NTID | AAID | NT Length | AA Length | Score | Probability |
|---|---|---|---|---|---|---|
| 6925053_c1_955 | 1433 | 5605 | 159 | 480 | | |
| Protein name | | | | | Locus Name | Acc# |

Description: NO-HIT

| ORF Name | NTID | AAID | NT Length | AA Length | Score | Probability |
|---|---|---|---|---|---|---|
| 6929588_f1_155 | 1434 | 5606 | 527 | 1584 | 2257 | 5.9e-234 |
| Protein name | | | | | Locus Name | Acc# |
| cytochrome oxidase d subunit I | | | | | gp:ECOCYD | J03939 |

Description: E.coli cytochrome d oxidase subunits I and II (cyd) genes, completecds.

| ORF Name | NTID | AAID | NT Length | AA Length | Score | Probability |
|---|---|---|---|---|---|---|
| 7070437_f2_505 | 1435 | 5607 | 174 | 525 | | |
| Protein name | | | | | Locus Name | Acc# |

Description: NO-HIT

| ORF Name | NTID | AAID | NT Length | AA Length | Score | Probability |
|---|---|---|---|---|---|---|
| 7087812_c2_1272 | 1436 | 5608 | 413 | 1242 | 1590 | 2.9e-163 |
| Protein name | | | | | Locus Name | Acc# |
| | | | | | sp:RODA_ECOLI | P15035:P13 |

Description: ROD SHAPE-DETERMINING PROTEIN RODA

| ORF Name | NTID | AAID | NT Length | AA Length | Score | Probability |
|---|---|---|---|---|---|---|
| 7147317_c3_1393 | 1437 | 5609 | 147 | 444 | 89 | 0.0094 |
| Protein name | | | | | Locus Name | Acc# |
| putative 18.8 kDa protein | | | | | gp:AF037441 | AF037441 |

Description: Edwardsiella ictaluri putative 18.8 kDa protein (eip19), putative17.8 kDa protein (eip18), putative 54.5 kDa protein (eip55), andputative 19.5 kDa protein (eip20) genes, complete cds.

| ORF Name | NTID | AAID | NT Length | AA Length | Score | Probability |
|---|---|---|---|---|---|---|
| 7159755_f2_319 | 1438 | 5610 | 187 | 564 | 770 | 2.2e-76 |
| Protein name | | | | Locus Name | | Acc# |
| | | | | sp:RIMM_ECOLI | | P21504 |

Description: 16S RRNA PROCESSING PROTEIN RIMM

| ORF Name | NTID | AAID | NT Length | AA Length | Score | Probability |
|---|---|---|---|---|---|---|
| 7164712_c1_870 | 1439 | 5611 | 336 | 1011 | 827 | 2.0e-82 |
| Protein name | | | | Locus Name | | Acc# |
| HexA | | | | gp:AF057064 | | AF057064 |

Description: Erwinia carotovora subsp. atroseptica HexA (hexA) gene, completecds.

| ORF Name | NTID | AAID | NT Length | AA Length | Score | Probability |
|---|---|---|---|---|---|---|
| 7205327_f2_490 | 1440 | 5612 | 362 | 1089 | 1471 | 1.2e-150 |
| Protein name | | | | Locus Name | | Acc# |
| | | | | sp:SERC_YEREN | | P19689 |

Description: PHOSPHOSERINE AMINOTRANSFERASE, (PSAT)

| ORF Name | NTID | AAID | NT Length | AA Length | Score | Probability |
|---|---|---|---|---|---|---|
| 7228376_f2_330 | 1441 | 5613 | 353 | 1062 | 85 | 0.0015 |
| Protein name | | | | Locus Name | | Acc# |
| hypothetical protein C0820w | | | | pir:T18489 | | T18489 |

Description:

| ORF Name | NTID | AAID | NT Length | AA Length | Score | Probability |
|---|---|---|---|---|---|---|
| 7229818_f3_577 | 1442 | 5614 | 79 | 240 | 159 | 1.2e-11 |
| Protein name | | | | Locus Name | | Acc# |
| | | | | sp:Y173_HAEIN | | P43960 |

Description: HYPOTHETICAL PROTEIN HI0173

| ORF Name | NTID | AAID | NT Length | AA Length | Score | Probability |
|---|---|---|---|---|---|---|
| 7289018_f3_532 | 1443 | 5615 | 82 | 249 | | |
| Protein name | | | | | Locus Name | Acc# |
| | | | | | | |

Description
NO-HIT

| ORF Name | NTID | AAID | NT Length | AA Length | Score | Probability |
|---|---|---|---|---|---|---|
| 7300903_f2_434 | 1444 | 5616 | 345 | 1038 | 1290 | 1.8e-131 |
| Protein name | | | | | Locus Name | Acc# |
| | | | | | sp:MOAA_ECOLI | P30745 |

Description
MOLYBDENUM COFACTOR BIOSYNTHESIS PROTEIN A

| ORF Name | NTID | AAID | NT Length | AA Length | Score | Probability |
|---|---|---|---|---|---|---|
| 787515_f3_750 | 1445 | 5617 | 254 | 765 | 1055 | 1.4e-106 |
| Protein name | | | | | Locus Name | Acc# |
| | | | | | sp:APHA_MORMO | Q59544 |

Description
IRREPRESSIBLE ACID PHOSPHATASE)

| ORF Name | NTID | AAID | NT Length | AA Length | Score | Probability |
|---|---|---|---|---|---|---|
| 788928_f2_436 | 1446 | 5618 | 114 | 345 | 282 | 1.2e-24 |
| Protein name | | | | | Locus Name | Acc# |
| | | | | | sp:YEAQ_ECOLI | P76246 |

Description
HYPOTHETICAL 8.7 KD PROTEIN IN GAPA-RND INTERGENIC REGION

| ORF Name | NTID | AAID | NT Length | AA Length | Score | Probability |
|---|---|---|---|---|---|---|
| 790842_c1_964 | 1447 | 5619 | 87 | 264 | | |
| Protein name | | | | | Locus Name | Acc# |

Description
NO-HIT

| ORF_Name | NTID | AAID | NT Length | AA Length | Score | Probability |
|---|---|---|---|---|---|---|
| 820250_c2_1201 | 1448 | 5620 | 60 | 183 | | |
| Protein name | | | | | Locus Name | Acc# |

Description
NO-HIT

| ORF_Name | NTID | AAID | NT Length | AA Length | Score | Probability |
|---|---|---|---|---|---|---|
| 8312_f3_696 | 1449 | 5621 | 468 | 1407 | 751 | 2.3e-74 |
| Protein name | | | | | Locus Name | Acc# |
| probable cis-muconate cycloisomerase | | | | | pir:T39170 | T39170 |

Description

| ORF_Name | NTID | AAID | NT Length | AA Length | Score | Probability |
|---|---|---|---|---|---|---|
| 83168_f1_4 | 1450 | 5622 | 444 | 1335 | 178 | 1.5e-10 |
| Protein name | | | | | Locus Name | Acc# |
| agglutination protein | | | | | pir:S27611 | S27611 |

Description

| ORF_Name | NTID | AAID | NT Length | AA Length | Score | Probability |
|---|---|---|---|---|---|---|
| 863452_f1_75 | 1451 | 5623 | 243 | 732 | 728 | 6.3e-72 |
| Protein name | | | | | Locus Name | Acc# |
| | | | | | sp:YFIH_ECOLI | P33644;Q46 |

Description
HYPOTHETICAL 26.3 KD PROTEIN IN SFHB-CLPB INTERGENIC REGION

| ORF_Name | NTID | AAID | NT Length | AA Length | Score | Probability |
|---|---|---|---|---|---|---|
| 86503_f2_506 | 1452 | 5624 | 78 | 237 | 76 | 0.015 |
| Protein name | | | | | Locus Name | Acc# |
| homeotic protein En-1b | | | | | pir:S35638 | S35638 |

Description

| ORF_Name | NTID | AAID | NT Length | AA Length | Score | Probability |
|---|---|---|---|---|---|---|
| 875027_c3_1633 | 1453 | 5625 | 299 | 900 | 162 | 1.1e-09 |
| Protein name | | | | | Locus Name | Acc# |
| | | | | | sp:VE31_LAMBD | P03753 |

Description: EA31 GENE PROTEIN

| ORF_Name | NTID | AAID | NT Length | AA Length | Score | Probability |
|---|---|---|---|---|---|---|
| 875132_c1_935 | 1454 | 5626 | 117 | 354 | | |
| Protein name | | | | | Locus Name | Acc# |

Description: NO-HIT

| ORF_Name | NTID | AAID | NT Length | AA Length | Score | Probability |
|---|---|---|---|---|---|---|
| 9500_f1_66 | 1455 | 5627 | 886 | 2661 | 3632 | 0.0 |
| Protein name | | | | | Locus Name | Acc# |
| | | | | | sp:SYA_ECOLI | P00957:P78 |

Description: ALANYL-TRNA SYNTHETASE, (ALANINE--TRNA LIGASE) (ALARS)

| ORF_Name | NTID | AAID | NT Length | AA Length | Score | Probability |
|---|---|---|---|---|---|---|
| 960925_f1_3 | 1456 | 5628 | 120 | 363 | 103 | 1.1e-05 |
| Protein name | | | | | Locus Name | Acc# |
| | | | | | gp:PMFIMOPR | Z32686 |

Description: Proteus mirabilis fimbrial operon, strain HI4320.

| ORF_Name | NTID | AAID | NT Length | AA Length | Score | Probability |
|---|---|---|---|---|---|---|
| 970301_f2_376 | 1457 | 5629 | 147 | 444 | | |
| Protein name | | | | | Locus Name | Acc# |

Description: NO-HIT

| ORF Name | NTID | AAID | NT Length | AA Length | Score | Probability |
|---|---|---|---|---|---|---|
| 972276_f1_115 | 1458 | 5630 | 60 | 183 | 109 | 2.8e-06 |
| Protein name | | | | | Locus Name | Acc# |
| hypothetical protein b0538 | | | | | pir:H64785 | H64785 |

Description

| ORF Name | NTID | AAID | NT Length | AA Length | Score | Probability |
|---|---|---|---|---|---|---|
| 9770462_c1_969 | 1459 | 5631 | 231 | 696 | | |
| Protein name | | | | | Locus Name | Acc# |

Description

NO-HIT

| ORF Name | NTID | AAID | NT Length | AA Length | Score | Probability |
|---|---|---|---|---|---|---|
| 977215_c2_1256 | 1460 | 5632 | 337 | 1014 | 642 | 8.2e-63 |
| Protein name | | | | | Locus Name | Acc# |
| integrase-like protein | | | | | gp:BH1236875 | AJ236875 |

Description

Bacteriophage H19J xis, int genes and orf357, orf228, orf189, orf688, orf588, orf312.

| ORF Name | NTID | AAID | NT Length | AA Length | Score | Probability |
|---|---|---|---|---|---|---|
| 9797016_c3_1431 | 1461 | 5633 | 339 | 1020 | 1390 | 4.5e-142 |
| Protein name | | | | | Locus Name | Acc# |
| thioredoxin reductase (NADPH), | | | | | pir:RDECT | A28074:JN0 |

Description

| ORF Name | NTID | AAID | NT Length | AA Length | Score | Probability |
|---|---|---|---|---|---|---|
| 980062_f1_166 | 1462 | 5634 | 117 | 354 | | |
| Protein name | | | | | Locus Name | Acc# |

Description

NO-HIT

| ORF Name | NTID | AAID | NT Length | AA Length | Score | Probability |
|---|---|---|---|---|---|---|
| 9803463_f3_619 | 1463 | 5635 | 81 | 246 | 126 | 3.9e-08 |
| Protein name | | | | | Locus Name | Acc# |
| hypothetical protein b0669 | | | | | pir:G64801 | G64801 |

Description

| ORF Name | NTID | AAID | NT Length | AA Length | Score | Probability |
|---|---|---|---|---|---|---|
| 9804643_f2_403 | 1464 | 5636 | 82 | 249 | 189 | 8.2e-15 |
| Protein name | | | | | Locus Name | Acc# |
| | | | | | sp:YBFA_ECOLI | P28913 |

Description

HYPOTHETICAL 8.3 KD PROTEIN IN KDPA-RHSC INTERGENIC REGION PRECURSOR

| ORF Name | NTID | AAID | NT Length | AA Length | Score | Probability |
|---|---|---|---|---|---|---|
| 9822538_c1_996 | 1465 | 5637 | 115 | 348 | | |
| Protein name | | | | | Locus Name | Acc# |

Description

NO-HIT

| ORF Name | NTID | AAID | NT Length | AA Length | Score | Probability |
|---|---|---|---|---|---|---|
| 9881258_c1_968 | 1466 | 5638 | 203 | 612 | 640 | 1.3e-62 |
| Protein name | | | | | Locus Name | Acc# |
| | | | | | sp:YBEY_ECOLI | P77385 |

Description

HYPOTHETICAL 17.5 KD PROTEIN IN CUTE-ASNB INTERGENIC REGION

| ORF Name | NTID | AAID | NT Length | AA Length | Score | Probability |
|---|---|---|---|---|---|---|
| 9922561_f3_575 | 1467 | 5639 | 287 | 864 | 730 | 3.9e-72 |
| Protein name | | | | | Locus Name | Acc# |
| Na+-translocating NADH-ubiquinone oxidoreductase, gamma chain | | | | | pir:S65528 | S65528 |

Description

| ORF Name | NTID | AAID | NT Length | AA Length | Score | Probability |
|---|---|---|---|---|---|---|
| 9929033_f2_365 | 1468 | 5640 | 61 | 186 | | |
| Protein name | | | | | Locus Name | Acc# |

Description
NO-HIT

| ORF Name | NTID | AAID | NT Length | AA Length | Score | Probability |
|---|---|---|---|---|---|---|
| 994012_f3_645 | 1469 | 5641 | 1398 | 4197 | 2470 | 3.3e-277 |
| Protein name | | | | | Locus Name | Acc# |
| tail tip fiber protein gp21 | | | | | pir:T13107 | T13107 |

Description

| ORF Name | NTID | AAID | NT Length | AA Length | Score | Probability |
|---|---|---|---|---|---|---|
| 9962778_f2_385 | 1470 | 5642 | 298 | 897 | 189 | 1.1e-11 |
| Protein name | | | | | Locus Name | Acc# |
| | | | | | sp:FTSK_ECOLI | P46889:P77 |

Description
CELL DIVISION PROTEIN FTSK

| ORF Name | NTID | AAID | NT Length | AA Length | Score | Probability |
|---|---|---|---|---|---|---|
| 10156550_c3_529 | 1471 | 5643 | 70 | 213 | | |
| Protein name | | | | | Locus Name | Acc# |

Description
NO-HIT

| ORF Name | NTID | AAID | NT Length | AA Length | Score | Probability |
|---|---|---|---|---|---|---|
| 10203156_f1_8 | 1472 | 5644 | 171 | 516 | 546 | 1.2e-52 |
| Protein name | | | | | Locus Name | Acc# |
| transcriptional activator | | | | | gp:ECH132239 | AJ132239 |

Description
Erwinia chrysanthemi rfaH gene, strain 3937.

| ORF Name | NTID | AAID | NT Length | AA Length | Score | Probability |
|---|---|---|---|---|---|---|
| 1052213_c1_323 | 1473 | 5645 | 89 | 270 | 418 | 4.5e-39 |
| Protein name | | | | | Locus Name | Acc# |
| ribosomal protein L27 | | | | | pir:R5EC27 | JS0767:A02 |

Description

| ORF Name | NTID | AAID | NT Length | AA Length | Score | Probability |
|---|---|---|---|---|---|---|
| 10564637_f1_75 | 1474 | 5646 | 78 | 237 | | |
| Protein name | | | | | Locus Name | Acc# |

Description

NO-HIT

| ORF Name | NTID | AAID | NT Length | AA Length | Score | Probability |
|---|---|---|---|---|---|---|
| 10652000_c3_476 | 1475 | 5647 | 404 | 1215 | 1606 | 5.7e-165 |
| Protein name | | | | | Locus Name | Acc# |
| | | | | | sp:YHBZ_ECOLI | P42641 |

Description

REGION

| ORF Name | NTID | AAID | NT Length | AA Length | Score | Probability |
|---|---|---|---|---|---|---|
| 10662827_c2_437 | 1476 | 5648 | 63 | 192 | | |
| Protein name | | | | | Locus Name | Acc# |

Description

NO-HIT

| ORF Name | NTID | AAID | NT Length | AA Length | Score | Probability |
|---|---|---|---|---|---|---|
| 11728931_f2_92 | 1477 | 5649 | 72 | 219 | | |
| Protein name | | | | | Locus Name | Acc# |

Description

NO-HIT

| ORF_Name | NTID | AAID | NT Length | AA Length | Score | Probability |
|---|---|---|---|---|---|---|
| 11834642_c2_445 | 1478 | 5650 | 99 | 300 | 257 | 5.1e-22 |
| Protein name | | | | | Locus Name | Acc# |
| hypothetical 11.3 kD protein in udp-rfaH intergenic region | | | | | pir:E65188 | E65188 |

Description

| ORF_Name | NTID | AAID | NT Length | AA Length | Score | Probability |
|---|---|---|---|---|---|---|
| 12221006_c1_331 | 1479 | 5651 | 515 | 1548 | 2147 | 2.7e-222 |
| Protein name | | | | | Locus Name | Acc# |
| | | | | | sp:NUSA_ECOLI | P03003 |

Description

N UTILIZATION SUBSTANCE PROTEIN A (NUSA PROTEIN) (L FACTOR)

| ORF_Name | NTID | AAID | NT Length | AA Length | Score | Probability |
|---|---|---|---|---|---|---|
| 12221080_c3_500 | 1480 | 5652 | 65 | 198 | | |
| Protein name | | | | | Locus Name | Acc# |

Description

NO-HIT

| ORF_Name | NTID | AAID | NT Length | AA Length | Score | Probability |
|---|---|---|---|---|---|---|
| 12226427_c3_481 | 1481 | 5653 | 296 | 891 | 1068 | 5.9e-108 |
| Protein name | | | | | Locus Name | Acc# |
| 7,8-dihydropteroate synthase | | | | | AE000398 | AE000398:U |

Description

Escherichia coli K-12 MG1655 section 288 of 400 of the completegenome.

| ORF_Name | NTID | AAID | NT Length | AA Length | Score | Probability |
|---|---|---|---|---|---|---|
| 1225251_c2_448 | 1482 | 5654 | 510 | 1533 | 2319 | 1.6e-240 |
| Protein name | | | | | Locus Name | Acc# |
| yigC protein | | | | | pir:D65189 | D65189 |

Description

| ORF_Name | NTID | AAID | NT Length | AA Length | Score | Probability |
|---|---|---|---|---|---|---|
| 1250080_c3_524 | 1483 | 5655 | 464 | 1395 | 1784 | 7.9e-184 |
| Protein name | | | | | Locus Name | Acc# |
| | | | | | sp:YJCD_ECOLI | P32702 |

Description
HYPOTHETICAL 45.7 KD PROTEIN IN SOXR-ACS INTERGENIC REGION (O449)

| ORF_Name | NTID | AAID | NT Length | AA Length | Score | Probability |
|---|---|---|---|---|---|---|
| 12501705_c3_521 | 1484 | 5656 | 302 | 909 | 909 | 4.2e-91 |
| Protein name | | | | | Locus Name | Acc# |
| | | | | | sp:YARA_PROST | P46117 |

Description
HYPOTHETICAL 31.5 KD PROTEIN IN AARA 3'REGION

| ORF_Name | NTID | AAID | NT Length | AA Length | Score | Probability |
|---|---|---|---|---|---|---|
| 12506631_f2_118 | 1485 | 5657 | 310 | 933 | 440 | 2.1e-41 |
| Protein name | | | | | Locus Name | Acc# |
| pirin | | | | | gp:AF154003 | AF154003 |

Description
Lycopersicon esculentum pirin mRNA, complete cds.

| ORF_Name | NTID | AAID | NT Length | AA Length | Score | Probability |
|---|---|---|---|---|---|---|
| 1274012_f2_148 | 1486 | 5658 | 110 | 333 | 350 | 7.2e-32 |
| Protein name | | | | | Locus Name | Acc# |
| | | | | | sp:YHBY_ECOLI | P42550 |

Description
HYPOTHETICAL 10.8 KD PROTEIN IN FTSJ-GREA INTERGENIC REGION (O97)

| ORF_Name | NTID | AAID | NT Length | AA Length | Score | Probability |
|---|---|---|---|---|---|---|
| 13087913_c1_325 | 1487 | 5659 | 85 | 258 | | |
| Protein name | | | | | Locus Name | Acc# |

Description
NO-HIT

| ORF Name | NTID | AAID | NT Length | AA Length | Score | Probability |
|---|---|---|---|---|---|---|
| 1352188_c3_525 | 1488 | 5660 | 295 | 888 | 1057 | 8.6e-107 |
| Protein name | | | | | Locus Name | Acc# |
| hypothetical 33.7 kD protein in pldB-metR intergenic region:hypothetical protein o299 | | | | pir:D65187 | | D65187:S30 |

Description

| ORF Name | NTID | AAID | NT Length | AA Length | Score | Probability |
|---|---|---|---|---|---|---|
| 13673752_c1_350 | 1489 | 5661 | 60 | 183 | | |
| Protein name | | | | | Locus Name | Acc# |

Description

NO-HIT

| ORF Name | NTID | AAID | NT Length | AA Length | Score | Probability |
|---|---|---|---|---|---|---|
| 13759627_c3_499 | 1490 | 5662 | 147 | 444 | 297 | 3.0e-26 |
| Protein name | | | | | Locus Name | Acc# |
| | | | | | sp:YHBP_ECOLI | P45471 |

Description

HYPOTHETICAL 16.8 KD PROTEIN IN SOHA-MTR INTERGENIC REGION (F147)

| ORF Name | NTID | AAID | NT Length | AA Length | Score | Probability |
|---|---|---|---|---|---|---|
| 1384387_f3_276 | 1491 | 5663 | 213 | 642 | 780 | 1.9e-77 |
| Protein name | | | | | Locus Name | Acc# |
| protein-methionine-s-oxide reductase | | | | gp:ECHO12716 | | AJ012716 |

Description

Erwinia chrysanthemi msrA gene and partial ORF1 and ORF2.

| ORF Name | NTID | AAID | NT Length | AA Length | Score | Probability |
|---|---|---|---|---|---|---|
| 1385812_f2_120 | 1492 | 5664 | 133 | 402 | 498 | 1.5e-47 |
| Protein name | | | | | Locus Name | Acc# |
| hypothetical 13.5K protein (mgtA-pyrI intergenic region):hypothetical protein f141 | | | | pir:S56469 | | S56469:F65 |

Description

| ORF Name | NTID | AAID | NT Length | AA Length | Score | Probability |
|---|---|---|---|---|---|---|
| 13939553_c3_505 | 1493 | 5665 | 91 | 276 | 117 | 3.5e-07 |
| Protein name | | | | | Locus Name | Acc# |
| hypothetical protein PH0719 | | | | | pir:H71118 | H71118 |

Description

| ORF Name | NTID | AAID | NT Length | AA Length | Score | Probability |
|---|---|---|---|---|---|---|
| 14120307_f3_225 | 1494 | 5666 | 81 | 246 | | |
| Protein name | | | | | Locus Name | Acc# |

Description
NO-HIT

| ORF Name | NTID | AAID | NT Length | AA Length | Score | Probability |
|---|---|---|---|---|---|---|
| 14220200_c1_371 | 1495 | 5667 | 223 | 672 | 447 | 3.8e-42 |
| Protein name | | | | | Locus Name | Acc# |
| | | | | | sp:YIGP_ECOLI | P27852 |

Description
HYPOTHETICAL 22.2 KD PROTEIN IN UBIE-RFAH INTERGENIC REGION

| ORF Name | NTID | AAID | NT Length | AA Length | Score | Probability |
|---|---|---|---|---|---|---|
| 14266927_c2_432 | 1496 | 5668 | 288 | 867 | 219 | 5.5e-18 |
| Protein name | | | | | Locus Name | Acc# |
| conserved hypothetical protein yjnA | | | | | pir:E69853 | E69853 |

Description

| ORF Name | NTID | AAID | NT Length | AA Length | Score | Probability |
|---|---|---|---|---|---|---|
| 14322132_f1_67 | 1497 | 5669 | 157 | 474 | 664 | 3.8e-65 |
| Protein name | | | | | Locus Name | Acc# |
| | | | | | sp:ARGR_ECOLI | P15282 |

Description
ARGININE REPRESSOR

| ORF Name | NTID | AAID | NT Length | AA Length | Score | Probability |
|---|---|---|---|---|---|---|
| 14470250_f1_33 | 1498 | 5670 | 65 | 198 | | |
| Protein name | | | | | Locus Name | Acc# |

Description
NO-HIT

| ORF Name | NTID | AAID | NT Length | AA Length | Score | Probability |
|---|---|---|---|---|---|---|
| 14489666_f3_233 | 1499 | 5671 | 242 | 729 | 885 | 1.5e-88 |
| Protein name | | | | | Locus Name | Acc# |
| | | | | | sp:YEHT_ECOLI | P33356;P76 |

Description
HYPOTHETICAL 27.9 KD PROTEIN IN MOLR-BGLX INTERGENIC REGION

| ORF Name | NTID | AAID | NT Length | AA Length | Score | Probability |
|---|---|---|---|---|---|---|
| 14569191_c2_385 | 1500 | 5672 | 252 | 759 | 1076 | 8.4e-109 |
| Protein name | | | | | Locus Name | Acc# |
| | | | | | sp:YJFH_ECOLI | P39290 |

Description
HYPOTHETICAL TRNA/RRNA METHYLTRANSFERASE YJFH,

| ORF Name | NTID | AAID | NT Length | AA Length | Score | Probability |
|---|---|---|---|---|---|---|
| 14570887_c3_533 | 1501 | 5673 | 567 | 1704 | 2327 | 2.3e-241 |
| Protein name | | | | | Locus Name | Acc# |
| | | | | | sp:AARF_PROST | O07443 |

Description
REGULATOR)

| ORF Name | NTID | AAID | NT Length | AA Length | Score | Probability |
|---|---|---|---|---|---|---|
| 14650313_c3_489 | 1502 | 5674 | 296 | 891 | 1160 | 1.0e-117 |
| Protein name | | | | | Locus Name | Acc# |
| | | | | | sp:YHBM_ECOLI | P39833 |

Description
HYPOTHETICAL 33.6 KD PROTEIN IN DEAD-PNP INTERGENIC REGION (F294)

| ORF Name | NTID | AAID | NT Length | AA Length | Score | Probability |
|---|---|---|---|---|---|---|
| 14729511_f1_4 | 1503 | 5675 | 397 | 1194 | 1370 | 5.9e-140 |

| Protein name | Locus Name | Acc# |
|---|---|---|
| fatty acid oxidizing complex | gp:ECOFADAB | M59368:M36 |

Description

E.coli fatty acid oxidizing complex (fadA, fadB) genes, completecds.

| ORF Name | NTID | AAID | NT Length | AA Length | Score | Probability |
|---|---|---|---|---|---|---|
| 14877058_f2_113 | 1504 | 5676 | 436 | 1311 | 546 | 5.3e-107 |

| Protein name | Locus Name | Acc# |
|---|---|---|
|  | sp:MTSA_LACLC | P34877 |

Description

METHYLTRANSFERASE SCRFI-A) (M.SCRFI-A) (M.SCRFIA)

| ORF Name | NTID | AAID | NT Length | AA Length | Score | Probability |
|---|---|---|---|---|---|---|
| 15036638_f3_263 | 1505 | 5677 | 408 | 1227 | 1422 | 1.8e-145 |

| Protein name | Locus Name | Acc# |
|---|---|---|
|  | sp:F16P_ECOLI | P09200 |

Description

1-PHOSPHOHYDROLASE) (FBPASE)

| ORF Name | NTID | AAID | NT Length | AA Length | Score | Probability |
|---|---|---|---|---|---|---|
| 15053453_f3_204 | 1506 | 5678 | 258 | 777 | 443 | 1.0e-41 |

| Protein name | Locus Name | Acc# |
|---|---|---|
|  | sp:DEOR_ECOLI | P06217 |

Description

DEOXYRIBOSE OPERON REPRESSOR

| ORF Name | NTID | AAID | NT Length | AA Length | Score | Probability |
|---|---|---|---|---|---|---|
| 15056377_c3_460 | 1507 | 5679 | 81 | 246 | 385 | 1.4e-35 |

| Protein name | Locus Name | Acc# |
|---|---|---|
| ribosomal protein S18 | pir:R3EC18 | S56427:A02 |

Description

| ORF_Name | NTID | AAID | NT Length | AA Length | Score | Probability |
|---|---|---|---|---|---|---|
| 15120930_c2_382 | 1508 | 5680 | 340 | 1023 | 1196 | 1.6e-121 |
| Protein name | | | | | Locus Name | Acc# |
| | | | | | sp:HFLC_ECOLI | P25661 |

Description: HFLC PROTEIN;

| ORF_Name | NTID | AAID | NT Length | AA Length | Score | Probability |
|---|---|---|---|---|---|---|
| 15628302_f2_110 | 1509 | 5681 | 409 | 1230 | 171 | 6.7e-28 |
| Protein name | | | | | Locus Name | Acc# |
| conserved hypothetical protein | | | | | pir:E72265 | E72265 |

Description:

| ORF_Name | NTID | AAID | NT Length | AA Length | Score | Probability |
|---|---|---|---|---|---|---|
| 15633312_c1_310 | 1510 | 5682 | 108 | 327 | 101 | 1.9e-05 |
| Protein name | | | | | Locus Name | Acc# |
| | | | | | gp:ABCARRA | X70360 |

Description: A.brasilense carR gene.

| ORF_Name | NTID | AAID | NT Length | AA Length | Score | Probability |
|---|---|---|---|---|---|---|
| 15814016_f3_188 | 1511 | 5683 | 141 | 426 | 240 | 3.2e-20 |
| Protein name | | | | | Locus Name | Acc# |
| | | | | | sp:YIDB_ECOLI | P09996:P76 |

Description: HYPOTHETICAL 13.8 KD PROTEIN IN IBPA-GYRB INTERGENIC REGION

| ORF_Name | NTID | AAID | NT Length | AA Length | Score | Probability |
|---|---|---|---|---|---|---|
| 15861317_c3_530 | 1512 | 5684 | 192 | 579 | 297 | 3.0e-26 |
| Protein name | | | | | Locus Name | Acc# |
| probable membrane protein yabI | | | | | pir:A64728 | A64728:S40 |

Description:

| ORF Name | NTID | AAID | NT Length | AA Length | Score | Probability |
|---|---|---|---|---|---|---|
| 16132066_f3_257 | 1513 | 5685 | 162 | 489 | 193 | 3.1e-15 |
| Protein name | | | | | Locus Name | Acc# |
| hypothetical protein APE2014 | | | | | pir:H72504 | H72504 |

Description

| ORF Name | NTID | AAID | NT Length | AA Length | Score | Probability |
|---|---|---|---|---|---|---|
| 16211075_c1_327 | 1514 | 5686 | 213 | 642 | 987 | 2.3e-99 |
| Protein name | | | | | Locus Name | Acc# |
| | | | | | sp:FTSJ_ECOLI | P28692 |

Description
CELL DIVISION PROTEIN FTSJ

| ORF Name | NTID | AAID | NT Length | AA Length | Score | Probability |
|---|---|---|---|---|---|---|
| 16290890_c2_454 | 1515 | 5687 | 177 | 534 | 471 | 1.1e-44 |
| Protein name | | | | | Locus Name | Acc# |
| | | | | | gp:ECOUW85 | M87049 |

Description
E. coli genomic sequence of the region from 84.5 to 86.5 minutes.

| ORF Name | NTID | AAID | NT Length | AA Length | Score | Probability |
|---|---|---|---|---|---|---|
| 166025_f1_71 | 1516 | 5688 | 216 | 651 | 858 | 1.1e-85 |
| Protein name | | | | | Locus Name | Acc# |
| inorganic pyrophosphatase,:pyrophosphate phosphohydrolase | | | | | pir:PWEC | A27648:S56 |

Description

| ORF Name | NTID | AAID | NT Length | AA Length | Score | Probability |
|---|---|---|---|---|---|---|
| 19562882_f3_262 | 1517 | 5689 | 106 | 321 | 277 | 3.9e-24 |
| Protein name | | | | | Locus Name | Acc# |
| | | | | | sp:NLP_ECOLI | P18837 |

Description
NER-LIKE PROTEIN

| ORF_Name | NTID | AAID | NT Length | AA Length | Score | Probability |
|---|---|---|---|---|---|---|
| 19568753_c2_394 | 1518 | 5690 | 119 | 360 | 373 | 2.6e-34 |

| Protein name | | | | | Locus_Name | Acc# |
|---|---|---|---|---|---|---|
| | | | | | sp:YTFP_ECOLI | P39323 |

Description
HYPOTHETICAL 12.9 KD PROTEIN IN MSRA-CHPBI INTERGENIC REGION (O113)

| ORF_Name | NTID | AAID | NT Length | AA Length | Score | Probability |
|---|---|---|---|---|---|---|
| 19636015_f3_277 | 1519 | 5691 | 461 | 1386 | 1697 | 1.3e-174 |

| Protein name | | | | | Locus_Name | Acc# |
|---|---|---|---|---|---|---|
| | | | | | sp:YTFL_ECOLI | P39319 |

Description
HYPOTHETICAL 49.8 KD PROTEIN IN CYSQ-MSRA INTERGENIC REGION

| ORF_Name | NTID | AAID | NT Length | AA Length | Score | Probability |
|---|---|---|---|---|---|---|
| 1969452_c1_307 | 1520 | 5692 | 80 | 243 | 131 | 1.2e-08 |

| Protein name | | | | | Locus_Name | Acc# |
|---|---|---|---|---|---|---|
| | | | | | sp:RK36_GUITH | P28528:O46 |

Description
CHLOROPLAST 50S RIBOSOMAL PROTEIN L36

| ORF_Name | NTID | AAID | NT Length | AA Length | Score | Probability |
|---|---|---|---|---|---|---|
| 19783426_c1_297 | 1521 | 5693 | 167 | 504 | 496 | 2.4e-47 |

| Protein name | | | | | Locus_Name | Acc# |
|---|---|---|---|---|---|---|
| | | | | | sp:YJEE_ECOLI | P31805 |

Description
(URF2)

| ORF_Name | NTID | AAID | NT Length | AA Length | Score | Probability |
|---|---|---|---|---|---|---|
| 1986012_c2_383 | 1522 | 5694 | 166 | 501 | 573 | 1.7e-55 |

| Protein name | | | | | Locus_Name | Acc# |
|---|---|---|---|---|---|---|
| | | | | | sp:YJEB_ECOLI | P21498 |

Description
HYPOTHETICAL 15.6 KD PROTEIN IN PURA-VACB INTERGENIC REGION

| ORF Name | NTID | AAID | NT Length | AA Length | Score | Probability |
|---|---|---|---|---|---|---|
| 20085950_c2_430 | 1523 | 5695 | 314 | 945 | 646 | 3.1e-63 |
| Protein name | | | | | Locus Name | Acc# |
| | | | | | sp:YFEU_HAEIN | P44862 |

Description: HYPOTHETICAL PROTEIN HI0754

| ORF Name | NTID | AAID | NT Length | AA Length | Score | Probability |
|---|---|---|---|---|---|---|
| 2031936_f2_109 | 1524 | 5696 | 230 | 693 | 690 | 6.7e-68 |
| Protein name | | | | | Locus Name | Acc# |
| | | | | | sp:DEOC_HAEIN | P44430 |

Description: (DEOXYRIBOALDOLASE)

| ORF Name | NTID | AAID | NT Length | AA Length | Score | Probability |
|---|---|---|---|---|---|---|
| 20710300_f2_94 | 1525 | 5697 | 747 | 2244 | 2490 | 1.2e-258 |
| Protein name | | | | | Locus Name | Acc# |
| | | | | | sp:FADB_ECOLI | P21177 |

Description:

| ORF Name | NTID | AAID | NT Length | AA Length | Score | Probability |
|---|---|---|---|---|---|---|
| 2087777_c2_424 | 1526 | 5698 | 182 | 549 | 412 | 1.9e-38 |
| Protein name | | | | | Locus Name | Acc# |
| | | | | | sp:INTB_ECOLI | P39347 |

Description: PROPHAGE P4 INTEGRASE (INT(P4))

| ORF Name | NTID | AAID | NT Length | AA Length | Score | Probability |
|---|---|---|---|---|---|---|
| 21486692_c3_534 | 1527 | 5699 | 245 | 738 | 381 | 3.7e-35 |
| Protein name | | | | | Locus Name | Acc# |
| | | | | | sp:PEPE_ECOLI | P32666 |

Description: PEPTIDASE E, (ALPHA-ASPARTYL DIPEPTIDASE)

| ORF_Name | NTID | AAID | NT Length | AA Length | Score | Probability |
|---|---|---|---|---|---|---|
| 21517328_c3_531 | 1528 | 5700 | 446 | 1341 | 1326 | 2.7e-135 |
| Protein name | | | | | Locus_Name | Acc# |
| | | | | | sp:YIGN_ECOLI | P27850 |

Description
HYPOTHETICAL 54.7 KD PROTEIN IN UDP-UBIE INTERGENIC REGION PRECURSOR

| ORF_Name | NTID | AAID | NT Length | AA Length | Score | Probability |
|---|---|---|---|---|---|---|
| 21614656_f2_158 | 1529 | 5701 | 496 | 1491 | 1606 | 5.7e-165 |
| Protein name | | | | | Locus_Name | Acc# |
| | | | | | sp:GABD_ECOLI | P25526 |

Description
, (SSDH)

| ORF_Name | NTID | AAID | NT Length | AA Length | Score | Probability |
|---|---|---|---|---|---|---|
| 21681536_c1_326 | 1530 | 5702 | 159 | 480 | 681 | 6.0e-67 |
| Protein name | | | | | Locus_Name | Acc# |
| | | | | | sp:GREA_ECOLI | P21346:P78 |

Description
(GREA)

| ORF_Name | NTID | AAID | NT Length | AA Length | Score | Probability |
|---|---|---|---|---|---|---|
| 21985881_f2_129 | 1531 | 5703 | 104 | 315 | | |
| Protein name | | | | | Locus_Name | Acc# |

Description
NO-HIT

| ORF_Name | NTID | AAID | NT Length | AA Length | Score | Probability |
|---|---|---|---|---|---|---|
| 22006686_f1_3 | 1532 | 5704 | 70 | 213 | | |
| Protein name | | | | | Locus_Name | Acc# |

Description
NO-HIT

| ORF_Name | NTID | AAID | NT Length | AA Length | Score | Probability |
|---|---|---|---|---|---|---|
| 22080262_c2_396 | 1533 | 5705 | 471 | 1416 | 1914 | 1.3e-197 |
| Protein name | | | | | Locus Name | Acc# |
| | | | | | sp:MPL_ECOLI | P37773:P76 |

Description: LIGASE,

| ORF_Name | NTID | AAID | NT Length | AA Length | Score | Probability |
|---|---|---|---|---|---|---|
| 22152175_f2_121 | 1534 | 5706 | 717 | 2154 | 3202 | 0.0 |
| Protein name | | | | | Locus Name | Acc# |
| ribonucleoside-triphosphate reductase, oxygen-sensitive,:anaerobic ribonucleotide | | | | | pir:A47331 | A47331:S56 |

Description:

| ORF_Name | NTID | AAID | NT Length | AA Length | Score | Probability |
|---|---|---|---|---|---|---|
| 22165816_c3_474 | 1535 | 5707 | 82 | 249 | | |
| Protein name | | | | | Locus Name | Acc# |

Description: NO-HIT

| ORF_Name | NTID | AAID | NT Length | AA Length | Score | Probability |
|---|---|---|---|---|---|---|
| 2243806_f2_160 | 1536 | 5708 | 160 | 483 | 456 | 4.2e-43 |
| Protein name | | | | | Locus Name | Acc# |
| transposase homolog A | | | | | gp:HPU95957 | U95957 |

Description: Helicobacter pylori insertion sequence IS606 transposase homologs A(tnpA) and B (tnpB) genes, complete cds.

| ORF_Name | NTID | AAID | NT Length | AA Length | Score | Probability |
|---|---|---|---|---|---|---|
| 22470250_c2_441 | 1537 | 5709 | 265 | 798 | 1091 | 2.2e-110 |
| Protein name | | | | | Locus Name | Acc# |
| uridine phosphorylase | | | | | gp:STUDPHOS | Y13360 |

Description: Salmonella typhimurium udp gene.

396

| ORF Name | NTID | AAID | NT Length | AA Length | Score | Probability |
|---|---|---|---|---|---|---|
| 23495385_c3_480 | 1538 | 5710 | 654 | 1965 | 2843 | 4.8e-296 |

| Protein name | Locus Name | Acc# |
|---|---|---|
| ATP-binding protein | gp:U01376 | U01376:M93 |

Description

Escherichia coli K12 ampicillin-binding protein (dacB),transcription elongation factor (greA), regulatory protein (mrsF),ATP-binding protein (mrsC), dihydropteroate synthase, regulatoryprotein (mrsA), and membrane protein genes, complete cds.

| ORF Name | NTID | AAID | NT Length | AA Length | Score | Probability |
|---|---|---|---|---|---|---|
| 23556552_c1_340 | 1539 | 5711 | 181 | 546 | 436 | 5.5e-41 |

| Protein name | Locus Name | Acc# |
|---|---|---|
| | sp:FIMF_ECOLI | P08189 |

Description

FIMF PROTEIN PRECURSOR

| ORF Name | NTID | AAID | NT Length | AA Length | Score | Probability |
|---|---|---|---|---|---|---|
| 23625025_f1_42 | 1540 | 5712 | 159 | 480 | 569 | 4.4e-55 |

| Protein name | Locus Name | Acc# |
|---|---|---|
| aspartate carbamoyltransferase, regulatory chain | pir:DTEBCT | S00050 |

Description

| ORF Name | NTID | AAID | NT Length | AA Length | Score | Probability |
|---|---|---|---|---|---|---|
| 23632341_c3_532 | 1541 | 5713 | 255 | 768 | 1052 | 2.9e-106 |

| Protein name | Locus Name | Acc# |
|---|---|---|
| | sp:UBIE_ECOLI | P27851 |

Description (EC 2.1.1.-)

| ORF Name | NTID | AAID | NT Length | AA Length | Score | Probability |
|---|---|---|---|---|---|---|
| 23632687_c3_523 | 1542 | 5714 | 399 | 1200 | 287 | 3.4e-25 |

| Protein name | Locus Name | Acc# |
|---|---|---|
| multidrug-efflux transporter homolog yfkF | pir:B69808 | B69808 |

Description

| ORF Name | NTID | AAID | NT Length | AA Length | Score | Probability |
|---|---|---|---|---|---|---|
| 23651957_c2_381 | 1543 | 5715 | 674 | 2025 | 1430 | 3.5e-183 |
| Protein name | | | | | Locus Name | Acc# |
| | | | | | sp:MUTL_ECOLI | P23367 |

Description: DNA MISMATCH REPAIR PROTEIN MUTL

| ORF Name | NTID | AAID | NT Length | AA Length | Score | Probability |
|---|---|---|---|---|---|---|
| 23854757_c3_498 | 1544 | 5716 | 172 | 519 | 510 | 7.9e-49 |
| Protein name | | | | | Locus Name | Acc# |
| | | | | | sp:YHBS_ECOLI | P45473 |

Description: HYPOTHETICAL 18.5 KD PROTEIN IN SOHA-MTR INTERGENIC REGION (F167)

| ORF Name | NTID | AAID | NT Length | AA Length | Score | Probability |
|---|---|---|---|---|---|---|
| 23867150_c1_354 | 1545 | 5717 | 84 | 255 | | |
| Protein name | | | | | Locus Name | Acc# |

Description: NO-HIT

| ORF Name | NTID | AAID | NT Length | AA Length | Score | Probability |
|---|---|---|---|---|---|---|
| 23870637_c3_487 | 1546 | 5718 | 151 | 456 | 484 | 4.5e-46 |
| Protein name | | | | | Locus Name | Acc# |
| | | | | | sp:RBFA_YEREN | O34272 |

Description: RIBOSOME-BINDING FACTOR A (FRAGMENT)

| ORF Name | NTID | AAID | NT Length | AA Length | Score | Probability |
|---|---|---|---|---|---|---|
| 24032562_c2_453 | 1547 | 5719 | 216 | 651 | 642 | 8.2e-63 |
| Protein name | | | | | Locus Name | Acc# |
| | | | | | sp:YIGZ_ECOLI | P27862 |

Description: HYPOTHETICAL 21.9 KD PROTEIN IN PEPQ-TRKH INTERGENIC REGION (O205)

| ORF Name | NTID | AAID | NT Length | AA Length | Score | Probability |
|---|---|---|---|---|---|---|
| 24035427_f1_76 | 1548 | 5720 | 199 | 600 | 496 | 2.4e-47 |
| Protein name | | | | | Locus Name | Acc# |
| | | | | | sp:YTFJ_ECOLI | P39187 |

Description: PROTEIN YTFJ PRECURSOR

| ORF Name | NTID | AAID | NT Length | AA Length | Score | Probability |
|---|---|---|---|---|---|---|
| 24040875_c3_470 | 1549 | 5721 | 88 | 267 | | |
| Protein name | | | | | Locus Name | Acc# |

Description: NO-HIT

| ORF Name | NTID | AAID | NT Length | AA Length | Score | Probability |
|---|---|---|---|---|---|---|
| 24244127_c3_518 | 1550 | 5722 | 555 | 1668 | 472 | 1.2e-51 |
| Protein name | | | | | Locus Name | Acc# |
| DNA restriction homolog ydiS | | | | | pir:D69788 | D69788 |

Description:

| ORF Name | NTID | AAID | NT Length | AA Length | Score | Probability |
|---|---|---|---|---|---|---|
| 24250340_c3_496 | 1551 | 5723 | 236 | 711 | 670 | 8.8e-66 |
| Protein name | | | | | Locus Name | Acc# |
| FimC precursor | | | | | gp:ECFIMCLUS | Z37500 |

Description: E.coli type 1 fimbriae, genes fimB, fimE, fimA, fimI, fimC.

| ORF Name | NTID | AAID | NT Length | AA Length | Score | Probability |
|---|---|---|---|---|---|---|
| 24254386_c3_463 | 1552 | 5724 | 89 | 270 | 336 | 2.2e-30 |
| Protein name | | | | | Locus Name | Acc# |
| | | | | | sp:YKGM_ECOLI | P71302 |

Description: HYPOTHETICAL 9.9 KD PROTEIN IN INTF-EAEH INTERGENIC REGION

| ORF Name | NTID | AAID | NT Length | AA Length | Score | Probability |
|---|---|---|---|---|---|---|
| 24276925_f3_235 | 1553 | 5725 | 222 | 669 | 326 | 2.5e-29 |
| Protein name | | | | | Locus Name | Acc# |
| | | | | | sp:YHE0_HAEIN | P44761 |

Description: HYPOTHETICAL PROTEIN HI0575

| ORF Name | NTID | AAID | NT Length | AA Length | Score | Probability |
|---|---|---|---|---|---|---|
| 24332842_f2_124 | 1554 | 5726 | 312 | 939 | 1264 | 1.0e-128 |
| Protein name | | | | | Locus Name | Acc# |
| STM-proteaseB | | | | | gp:AF088981 | AF088981 |

Description: Proteus mirabilis STM-proteaseR pseudogene, partial sequence; STM-proteaseA gene, complete cds; and STM-proteaseB gene, partial cds.

| ORF Name | NTID | AAID | NT Length | AA Length | Score | Probability |
|---|---|---|---|---|---|---|
| 24335927_f2_115 | 1555 | 5727 | 439 | 1320 | 934 | 9.3e-94 |
| Protein name | | | | | Locus Name | Acc# |
| | | | | | sp:AMPH_ECOLI | P46127:P75 |

Description: PENICILLIN-BINDING PROTEIN AMPH

| ORF Name | NTID | AAID | NT Length | AA Length | Score | Probability |
|---|---|---|---|---|---|---|
| 24397928_f1_44 | 1556 | 5728 | 100 | 303 | 248 | 4.6e-21 |
| Protein name | | | | | Locus Name | Acc# |
| | | | | | sp:YHBQ_ECOLI | P45472 |

Description: HYPOTHETICAL 11.3 KD PROTEIN IN SOHA-MTR INTERGENIC REGION (O100)

| ORF Name | NTID | AAID | NT Length | AA Length | Score | Probability |
|---|---|---|---|---|---|---|
| 24400256_c1_308 | 1557 | 5729 | 216 | 651 | 676 | 2.0e-66 |
| Protein name | | | | | Locus Name | Acc# |
| | | | | | sp:YODA_ECOLI | P76344 |

Description: HYPOTHETICAL 24.8 KD PROTEIN IN DCM-SHIA INTERGENIC REGION

400

| ORF Name | NTID | AAID | NT Length | AA Length | Score | Probability |
|---|---|---|---|---|---|---|
| 24492782_f1_31 | 1558 | 5730 | 67 | 204 | | |
| Protein name | | | | | Locus Name | Acc# |

Description
NO-HIT

| ORF Name | NTID | AAID | NT Length | AA Length | Score | Probability |
|---|---|---|---|---|---|---|
| 24506562_c1_336 | 1559 | 5731 | 421 | 1266 | 1062 | 2.5e-107 |
| Protein name | | | | | Locus Name | Acc# |
| | | | | | sp:YIHN_ECOLI | P32135 |

Description
HYPOTHETICAL 46.3 KD PROTEIN IN GLNA-RBN INTERGENIC REGION (O421)

| ORF Name | NTID | AAID | NT Length | AA Length | Score | Probability |
|---|---|---|---|---|---|---|
| 24650253_c3_469 | 1560 | 5732 | 1272 | 3819 | 3420 | 0.0 |
| Protein name | | | | | Locus Name | Acc# |
| | | | | | sp:YTFN_ECOLI | P39321:P39 |

Description
HYPOTHETICAL 136.8 KD PROTEIN IN MSRA-CHPB INTERGENIC REGION

| ORF Name | NTID | AAID | NT Length | AA Length | Score | Probability |
|---|---|---|---|---|---|---|
| 24664217_f3_224 | 1561 | 5733 | 335 | 1008 | 1726 | 1.1e-177 |
| Protein name | | | | | Locus Name | Acc# |
| STM-proteaseA | | | | | gp:AF088981 | AF088981 |

Description
Proteus mirabilis STM-proteaseR pseudogene, partial sequence;STM-proteaseA gene, complete cds; and STM-proteaseB gene, partialcds.

| ORF Name | NTID | AAID | NT Length | AA Length | Score | Probability |
|---|---|---|---|---|---|---|
| 24883558_c2_403 | 1562 | 5734 | 921 | 2766 | 4243 | 0.0 |
| Protein name | | | | | Locus Name | Acc# |
| initiation factor IF2-alpha | | | | | gp:PVAJ2737 | AJ002737 |

Description
Proteus vulgaris infB gene and partial nusA and rbfA genes.

401

| ORF Name | NTID | AAID | NT Length | AA Length | Score | Probability |
|---|---|---|---|---|---|---|
| 25391936_f3_200 | 1563 | 5735 | 198 | 597 | 187 | 1.3e-14 |

| Protein name | Locus Name | Acc# |
|---|---|---|
|  | gp:AB016260 | AB016260:A |

Description

Agrobacterium tumefaciens plasmid pTi-SAKURA, complete sequence.

| ORF Name | NTID | AAID | NT Length | AA Length | Score | Probability |
|---|---|---|---|---|---|---|
| 25400407_c2_446 | 1564 | 5736 | 177 | 534 | 385 | 1.4e-35 |

| Protein name | Locus Name | Acc# |
|---|---|---|
| TatB protein | gp:ECO5830 | AJ005830 |

Description

Escherichia coli tatABCD operon.

| ORF Name | NTID | AAID | NT Length | AA Length | Score | Probability |
|---|---|---|---|---|---|---|
| 25973177_c3_516 | 1565 | 5737 | 385 | 1158 | 1228 | 6.5e-125 |

| Protein name | Locus Name | Acc# |
|---|---|---|
|  | sp:YJGP_ECOLI | P39340 |

Description

HYPOTHETICAL 40.4 KD PROTEIN IN PEPA-GNTV INTERGENIC REGION (O366)

| ORF Name | NTID | AAID | NT Length | AA Length | Score | Probability |
|---|---|---|---|---|---|---|
| 26022552_c3_488 | 1566 | 5738 | 720 | 2163 | 3071 | 0.0 |

| Protein name | Locus Name | Acc# |
|---|---|---|
| polynucleotide phosphorylase; cytidylate kinase | AE000397 | AE000397:U |

Description

Escherichia coli K-12 MG1655 section 287 of 400 of the completegenome.

| ORF Name | NTID | AAID | NT Length | AA Length | Score | Probability |
|---|---|---|---|---|---|---|
| 26056552_c3_456 | 1567 | 5739 | 314 | 945 | 1242 | 2.1e-126 |

| Protein name | Locus Name | Acc# |
|---|---|---|
|  | sp:MIAA_ECOLI | P16384 |

Description (IPP TRANSFERASE)

402

| ORF Name | NTID | AAID | NT Length | AA Length | Score | Probability |
|---|---|---|---|---|---|---|
| 26223752_c3_475 | 1568 | 5740 | 131 | 396 | 437 | 4.3e-41 |
| Protein name | | | | | Locus Name | Acc# |
| | | | | | sp:RL21_ECOLI | P02422 |

Description: 50S RIBOSOMAL PROTEIN L21

| ORF Name | NTID | AAID | NT Length | AA Length | Score | Probability |
|---|---|---|---|---|---|---|
| 26460010_f3_212 | 1569 | 5741 | 507 | 1524 | 2316 | 3.3e-240 |
| Protein name | | | | | Locus Name | Acc# |
| | | | | | sp:AMPA_ECOLI | P11648 |

Description: AMINOPEPTIDASE A/I,

| ORF Name | NTID | AAID | NT Length | AA Length | Score | Probability |
|---|---|---|---|---|---|---|
| 26600425_c3_537 | 1570 | 5742 | 446 | 1341 | 1698 | 1.0e-174 |
| Protein name | | | | | Locus Name | Acc# |
| | | | | | sp:PEPQ_ECOLI | P21165:P21 |

Description: DIPEPTIDASE) (PROLIDASE) (IMIDODIPEPTIDASE)

| ORF Name | NTID | AAID | NT Length | AA Length | Score | Probability |
|---|---|---|---|---|---|---|
| 26752027_c3_459 | 1571 | 5743 | 138 | 417 | 565 | 1.2e-54 |
| Protein name | | | | | Locus Name | Acc# |
| | | | | | sp:RS6_ECOLI | P02358 |

Description: 30S RIBOSOMAL PROTEIN S6

| ORF Name | NTID | AAID | NT Length | AA Length | Score | Probability |
|---|---|---|---|---|---|---|
| 26768813_c2_405 | 1572 | 5744 | 326 | 981 | 190 | 1.3e-14 |
| Protein name | | | | | Locus Name | Acc# |
| hypothetical protein SCF55.01c | | | | | gp:SCF55 | AL132991 |

Description: Streptomyces coelicolor cosmid F55.

| ORF Name | NTID | AAID | NT Length | AA Length | Score | Probability |
|---|---|---|---|---|---|---|
| 26772251_c1_305 | 1573 | 5745 | 155 | 468 | 628 | 2.5e-61 |
| Protein name | | | | | Locus Name | Acc# |
| | | | | | sp:RL9_ECOLI | P02418 |

Description: 50S RIBOSOMAL PROTEIN L9

| ORF Name | NTID | AAID | NT Length | AA Length | Score | Probability |
|---|---|---|---|---|---|---|
| 2819010_c1_358 | 1574 | 5746 | 126 | 381 | | |
| Protein name | | | | | Locus Name | Acc# |

Description: NO-HIT

| ORF Name | NTID | AAID | NT Length | AA Length | Score | Probability |
|---|---|---|---|---|---|---|
| 2822125_c2_434 | 1575 | 5747 | 95 | 288 | 291 | 1.3e-25 |
| Protein name | | | | | Locus Name | Acc# |
| acetolactate synthase, I small chain | | | | | pir:YCEC1S | G65168:B93 |

Description:

| ORF Name | NTID | AAID | NT Length | AA Length | Score | Probability |
|---|---|---|---|---|---|---|
| 29574063_c2_422 | 1576 | 5748 | 364 | 1095 | 1304 | 5.8e-133 |
| Protein name | | | | | Locus Name | Acc# |
| | | | | | sp:YJGQ_ECOLI | P39341 |

Description: HYPOTHETICAL 39.8 KD PROTEIN IN PEPA-GNTV INTERGENIC REGION (O361)

| ORF Name | NTID | AAID | NT Length | AA Length | Score | Probability |
|---|---|---|---|---|---|---|
| 3011678_c1_299 | 1577 | 5749 | 446 | 1341 | 1791 | 1.4e-184 |
| Protein name | | | | | Locus Name | Acc# |
| | | | | | sp:HFLX_ECOLI | P25519 |

Description: GTP-BINDING PROTEIN HFLX

| ORF Name | NTID | AAID | NT Length | AA Length | Score | Probability |
|---|---|---|---|---|---|---|
| 30207136_f3_237 | 1578 | 5750 | 65 | 198 | | |
| Protein name | | | | | Locus Name | Acc# |

Description
NO-HIT

| ORF Name | NTID | AAID | NT Length | AA Length | Score | Probability |
|---|---|---|---|---|---|---|
| 30603412_c3_457 | 1579 | 5751 | 425 | 1278 | 1298 | 2.5e-132 |
| Protein name | | | | | Locus Name | Acc# |
| | | | | | sp:HFLK_ECOLI | P25662 |

Description
HFLK PROTEIN

| ORF Name | NTID | AAID | NT Length | AA Length | Score | Probability |
|---|---|---|---|---|---|---|
| 31251452_c3_538 | 1580 | 5752 | 483 | 1452 | 2145 | 4.4e-222 |
| Protein name | | | | | Locus Name | Acc# |
| | | | | | sp:TRKH_ECOLI | P21166:P76 |

Description
TRK SYSTEM POTASSIUM UPTAKE PROTEIN TRKH

| ORF Name | NTID | AAID | NT Length | AA Length | Score | Probability |
|---|---|---|---|---|---|---|
| 31256301_f3_294 | 1581 | 5753 | 390 | 1173 | 1532 | 4.0e-157 |
| Protein name | | | | | Locus Name | Acc# |
| | | | | | sp:YJES_ECOLI | P39288 |

Description
HYPOTHETICAL 43.1 KD PROTEIN IN PSD-AMIB INTERGENIC REGION (F379)

| ORF Name | NTID | AAID | NT Length | AA Length | Score | Probability |
|---|---|---|---|---|---|---|
| 32053328_f2_133 | 1582 | 5754 | 68 | 207 | 118 | 6.9e-07 |
| Protein name | | | | | Locus Name | Acc# |
| | | | | | sp:YEHT_ECOLI | P33356:P76 |

Description
HYPOTHETICAL 27.9 KD PROTEIN IN MOLR-BGLX INTERGENIC REGION

| ORF Name | NTID | AAID | NT Length | AA Length | Score | Probability |
|---|---|---|---|---|---|---|
| 32058186_f3_213 | 1583 | 5755 | 975 | 2928 | 4166 | 0.0 |
| Protein name | | | | | Locus Name | Acc# |
| | | | | | sp:SYV_ECOLI | P07118:P78 |

Description

VALYL-TRNA SYNTHETASE, (VALINE--TRNA LIGASE) (VALRS)

| ORF Name | NTID | AAID | NT Length | AA Length | Score | Probability |
|---|---|---|---|---|---|---|
| 32207526_c2_427 | 1584 | 5756 | 105 | 318 | 198 | 3.4e-15 |
| Protein name | | | | | Locus Name | Acc# |
| Int | | | | | gp:AF141323 | AF141323 |

Description

Shigella flexneri SHI-2 pathogenicity island, complete sequence.

| ORF Name | NTID | AAID | NT Length | AA Length | Score | Probability |
|---|---|---|---|---|---|---|
| 32239702_c2_401 | 1585 | 5757 | 445 | 1338 | 1948 | 3.3e-201 |
| Protein name | | | | | Locus Name | Acc# |
| | | | | | sp:MRSA_ECOLI | P31120 |

Description

MRSA PROTEIN

| ORF Name | NTID | AAID | NT Length | AA Length | Score | Probability |
|---|---|---|---|---|---|---|
| 32297557_c3_526 | 1586 | 5758 | 768 | 2307 | 3133 | 0.0 |
| Protein name | | | | | Locus Name | Acc# |
| 5-methyltetrahydropteroyltriglutamate--homocys | | | | | pir:A42863 | F65187:A42 |

Description

| ORF Name | NTID | AAID | NT Length | AA Length | Score | Probability |
|---|---|---|---|---|---|---|
| 32805_c1_309 | 1587 | 5759 | 442 | 1329 | 1777 | 4.4e-183 |
| Protein name | | | | | Locus Name | Acc# |
| hypothetical protein b1432 | | | | | pir:C64895 | C64895 |

Description

| ORF Name | NTID | AAID | NT Length | AA Length | Score | Probability |
|---|---|---|---|---|---|---|
| 33203132_f2_173 | 1588 | 5760 | 103 | 312 | 120 | 1.7e-07 |

| Protein name | Locus Name | Acc# |
|---|---|---|
| unknown | gp:AF047479 | AF047479:M |

Description

Plasmid NR79 transposon Tn2424 DNA integrase (intI1),aminoglycoside 3''-O-nucleotidyltransferase (aadA3), aminoglycoside6'-N-acetyltransferase (aacA1), chloramphenicol acetyltransferase(catB2), ethidium bromide resistance protein (qacEdelta1), anddihydropteroate synthase (sul1) genes, complete cds; and unknowngene.

| ORF Name | NTID | AAID | NT Length | AA Length | Score | Probability |
|---|---|---|---|---|---|---|
| 33234752_c1_303 | 1589 | 5761 | 849 | 2550 | 3155 | 0.0 |

| Protein name | Locus Name | Acc# |
|---|---|---|
| virulence-associated protein vacB homolog | pir:S56404 | S56404:C31 |

Description

| ORF Name | NTID | AAID | NT Length | AA Length | Score | Probability |
|---|---|---|---|---|---|---|
| 33241067_c2_386 | 1590 | 5762 | 110 | 333 | 412 | 1.9e-38 |

| Protein name | Locus Name | Acc# |
|---|---|---|
|  | sp:PRIB_ECOLI | P07013 |

Description

PRIMOSOMAL REPLICATION PROTEIN N

| ORF Name | NTID | AAID | NT Length | AA Length | Score | Probability |
|---|---|---|---|---|---|---|
| 33360925_c3_497 | 1591 | 5763 | 317 | 954 | 731 | 3.0e-72 |

| Protein name | Locus Name | Acc# |
|---|---|---|
| probable fimbrial protein b1502 | pir:A64904 | A64904 |

Description

| ORF Name | NTID | AAID | NT Length | AA Length | Score | Probability |
|---|---|---|---|---|---|---|
| 33382818_c1_298 | 1592 | 5764 | 100 | 303 | 387 | 8.6e-36 |

| Protein name | Locus Name | Acc# |
|---|---|---|
| bacteriocin gene regulator | gp:AF039142 | AF039142 |

Description

Erwinia carotovora bacteriocin gene regulator gene, complete cds.

| ORF Name | NTID | AAID | NT Length | AA Length | Score | Probability |
|---|---|---|---|---|---|---|
| 33601687_f3_282 | 1593 | 5765 | 228 | 687 | 259 | 3.1e-22 |
| Protein name | | | | | Locus Name | Acc# |
| | | | | | sp:YTFB_ECOLI | P39310 |

Description
HYPOTHETICAL 23.5 KD PROTEIN IN RPLI-CPDB INTERGENIC REGION

| ORF Name | NTID | AAID | NT Length | AA Length | Score | Probability |
|---|---|---|---|---|---|---|
| 33774187_c2_433 | 1594 | 5766 | 569 | 1710 | 2057 | 9.3e-213 |
| Protein name | | | | | Locus Name | Acc# |
| | | | | | sp:ILVB_ECOLI | P08142 |

Description
(ACETOHYDROXY-ACID SYNTHASE I LARGE SUBUNIT) (ALS-I)

| ORF Name | NTID | AAID | NT Length | AA Length | Score | Probability |
|---|---|---|---|---|---|---|
| 33777202_c3_490 | 1595 | 5767 | 616 | 1851 | 2438 | 3.9e-253 |
| Protein name | | | | | Locus Name | Acc# |
| probable ATP-dependent RNA helicase deaD | | | | | pir:F65106 | F65106:A42 |

Description

| ORF Name | NTID | AAID | NT Length | AA Length | Score | Probability |
|---|---|---|---|---|---|---|
| 34024187_f1_50 | 1596 | 5768 | 129 | 390 | 190 | 6.5e-15 |
| Protein name | | | | | Locus Name | Acc# |
| | | | | | sp:YJAA_ECOLI | P09162 |

Description
HYPOTHETICAL 14.4 KD PROTEIN IN RRFE-METD INTERGENIC REGION (O127)

| ORF Name | NTID | AAID | NT Length | AA Length | Score | Probability |
|---|---|---|---|---|---|---|
| 34034831_f3_218 | 1597 | 5769 | 353 | 1062 | 1271 | 1.8e-129 |
| Protein name | | | | | Locus Name | Acc# |
| aspartate transcarbamylase catalytic subunit | | | | | gp:AF190426 | AF190426 |

Description
Erwinia herbicola aspartate transcarbamylase gene cluster pyrLBI, complete sequence.

| ORF Name | NTID | AAID | NT Length | AA Length | Score | Probability |
|---|---|---|---|---|---|---|
| 34646952_c1_343 | 1598 | 5770 | 183 | 552 | 543 | 2.5e-52 |
| Protein name | | | | | Locus Name | Acc# |
| | | | | | sp:YHBT_ECOLI | P45474 |

Description: HYPOTHETICAL 19.7 KD PROTEIN IN SOHA-MTR INTERGENIC REGION (F174)

| ORF Name | NTID | AAID | NT Length | AA Length | Score | Probability |
|---|---|---|---|---|---|---|
| 35359518_c1_370 | 1599 | 5771 | 274 | 825 | 342 | 5.0e-31 |
| Protein name | | | | | Locus Name | Acc# |
| protein-tyrosine phosphatase | | | | | gp:AB028630 | AB028630 |

Description: Clostridium perfringens hyp27, bacH, ptp, cpd genes for hypothetical protein, bacterial hemoglobin, protein-tyrosinephosphatase, 2', 3'-cuclic nucleotide 2'-phosphodiesterase, partial and complete cds.

| ORF Name | NTID | AAID | NT Length | AA Length | Score | Probability |
|---|---|---|---|---|---|---|
| 35602087_c1_357 | 1600 | 5772 | 72 | 219 | | |
| Protein name | | | | | Locus Name | Acc# |

Description: NO-HIT

| ORF Name | NTID | AAID | NT Length | AA Length | Score | Probability |
|---|---|---|---|---|---|---|
| 36068882_c2_431 | 1601 | 5773 | 460 | 1383 | 749 | 3.7e-74 |
| Protein name | | | | | Locus Name | Acc# |
| sucrose phosphotransferase enzyme II homolog ybbF | | | | | pir:B69744 | B69744 |

Description:

| ORF Name | NTID | AAID | NT Length | AA Length | Score | Probability |
|---|---|---|---|---|---|---|
| 36517558_c1_368 | 1602 | 5774 | 554 | 1665 | 1985 | 4.0e-205 |
| Protein name | | | | | Locus Name | Acc# |
| | | | | | sp:YJCE_ECOLI | P32703 |

Description: PUTATIVE NA(+)/H(+) EXCHANGER YJCE

| ORF Name | NTID | AAID | NT Length | AA Length | Score | Probability |
|---|---|---|---|---|---|---|
| 36573287_f1_28 | 1603 | 5775 | 210 | 633 | 460 | 1.6e-43 |
| Protein name | | | | | Locus Name | Acc# |
| peptide chain release factor homolog prfH | | | | | pir:E64748 | E64748 |

Description

| ORF Name | NTID | AAID | NT Length | AA Length | Score | Probability |
|---|---|---|---|---|---|---|
| 36585051_c1_355 | 1604 | 5776 | 91 | 276 | 191 | 5.1e-15 |
| Protein name | | | | | Locus Name | Acc# |
| | | | | | sp:YAFX_ECOLI | P75676:P71 |

Description

HYPOTHETICAL 17.4 KD PROTEIN IN PROA-PERR INTERGENIC REGION

| ORF Name | NTID | AAID | NT Length | AA Length | Score | Probability |
|---|---|---|---|---|---|---|
| 36604768_c2_429 | 1605 | 5777 | 311 | 936 | 505 | 2.7e-48 |
| Protein name | | | | | Locus Name | Acc# |
| hypothetical protein F07A11.5 | | | | | pir:T20529 | T20529 |

Description

| ORF Name | NTID | AAID | NT Length | AA Length | Score | Probability |
|---|---|---|---|---|---|---|
| 3906305_f3_261 | 1606 | 5778 | 340 | 1023 | 1281 | 1.6e-130 |
| Protein name | | | | | Locus Name | Acc# |
| | | | | | sp:ISPB_ECOLI | P19641 |

Description

SYNTHETASE) (OPP SYNTHETASE)

| ORF Name | NTID | AAID | NT Length | AA Length | Score | Probability |
|---|---|---|---|---|---|---|
| 3906508_c2_425 | 1607 | 5779 | 394 | 1185 | 130 | 8.4e-06 |
| Protein name | | | | | Locus Name | Acc# |
| NADH dehydrogenase subunit 2 | | | | | gp:AF059348 | AF059348 |

Description

Apis cerana NADH dehydrogenase subunit 2 (ND2) gene, mitochondrialgene encoding mitochondrial protein, partial cds.

| ORF Name | NTID | AAID | NT Length | AA Length | Score | Probability |
|---|---|---|---|---|---|---|
| 3922128_f1_49 | 1608 | 5780 | 600 | 1803 | 2101 | 2.0e-217 |
| Protein name | | | | | Locus Name | Acc# |
| | | | | | sp:YEHU_ECOLI | P33357:P76 |
| Description | | | | | | |
| HYPOTHETICAL 62.1 KD PROTEIN IN MOLR-BGLX INTERGENIC REGION PRECURSOR | | | | | | |

| ORF Name | NTID | AAID | NT Length | AA Length | Score | Probability |
|---|---|---|---|---|---|---|
| 3940963_f1_51 | 1609 | 5781 | 123 | 372 | 93 | 0.0087 |
| Protein name | | | | | Locus Name | Acc# |
| hypothetical protein PFB0650w | | | | | pir:G71609 | G71609 |
| Description | | | | | | |

| ORF Name | NTID | AAID | NT Length | AA Length | Score | Probability |
|---|---|---|---|---|---|---|
| 397300_f3_222 | 1610 | 5782 | 133 | 402 | 92 | 0.018 |
| Protein name | | | | | Locus Name | Acc# |
| galactonolactone dehydrogenase, | | | | | pir:T14463 | T14463 |
| Description | | | | | | |

| ORF Name | NTID | AAID | NT Length | AA Length | Score | Probability |
|---|---|---|---|---|---|---|
| 4035888_c2_410 | 1611 | 5783 | 340 | 1023 | 454 | 6.8e-43 |
| Protein name | | | | | Locus Name | Acc# |
| immunoreactive 36 kDa antigen PG14 | | | | | gp:AF145798 | AF145798 |
| Description | | | | | | |
| Porphyromonas gingivalis strain W50 immunoreactive 36 kDa antigenPG14 gene, complete cds. | | | | | | |

| ORF Name | NTID | AAID | NT Length | AA Length | Score | Probability |
|---|---|---|---|---|---|---|
| 4072968_c3_520 | 1612 | 5784 | 88 | 267 | 111 | 1.5e-06 |
| Protein name | | | | | Locus Name | Acc# |
| | | | | | gp:PMFIMOPR | Z32686 |
| Description | | | | | | |
| Proteus mirabilis fimbrial operon, strain HI4320. | | | | | | |

411

| ORF Name | NTID | AAID | NT Length | AA Length | Score | Probability |
|---|---|---|---|---|---|---|
| 4111587_c1_339 | 1613 | 5785 | 872 | 2619 | 2465 | 5.4e-256 |

| Protein name | | | | | Locus Name | Acc# |
|---|---|---|---|---|---|---|
| | | | | | sp:FIMD_ECOLI | P30130 |

Description: OUTER MEMBRANE USHER PROTEIN FIMD PRECURSOR

| ORF Name | NTID | AAID | NT Length | AA Length | Score | Probability |
|---|---|---|---|---|---|---|
| 4307950_c2_415 | 1614 | 5786 | 87 | 264 | 131 | 1.2e-08 |

| Protein name | | | | | Locus Name | Acc# |
|---|---|---|---|---|---|---|
| | | | | | sp:YBIJ_ECOLI | P41038 |

Description: HYPOTHETICAL 8.6 KD PROTEIN IN DING-GLNQ INTERGENIC REGION PRECURSOR

| ORF Name | NTID | AAID | NT Length | AA Length | Score | Probability |
|---|---|---|---|---|---|---|
| 4312592_f1_15 | 1615 | 5787 | 320 | 963 | 1136 | 3.7e-115 |

| Protein name | | | | | Locus Name | Acc# |
|---|---|---|---|---|---|---|
| trans-activator of metE and metH | | | | | gp:ECOUW85 | M87049 |

Description: E. coli genomic sequence of the region from 84.5 to 86.5 minutes.

| ORF Name | NTID | AAID | NT Length | AA Length | Score | Probability |
|---|---|---|---|---|---|---|
| 4320917_f2_117 | 1616 | 5788 | 167 | 504 | 484 | 4.5e-46 |

| Protein name | | | | | Locus Name | Acc# |
|---|---|---|---|---|---|---|
| | | | | | sp:HOLC_ECOLI | P28905:P11 |

Description: DNA POLYMERASE III, CHI SUBUNIT,

| ORF Name | NTID | AAID | NT Length | AA Length | Score | Probability |
|---|---|---|---|---|---|---|
| 4339138_c1_320 | 1617 | 5789 | 141 | 426 | 150 | 1.1e-10 |

| Protein name | | | | | Locus Name | Acc# |
|---|---|---|---|---|---|---|
| | | | | | sp:RPC1_BPD10 | P07040 |

Description: REPRESSOR PROTEIN CI

| ORF Name | NTID | AAID | NT Length | AA Length | Score | Probability |
|---|---|---|---|---|---|---|
| 4392128_f1_1 | 1618 | 5790 | 76 | 231 | | |
| Protein name | | | | | Locus Name | Acc# |

Description
NO-HIT

| ORF Name | NTID | AAID | NT Length | AA Length | Score | Probability |
|---|---|---|---|---|---|---|
| 445302_f1_37 | 1619 | 5791 | 86 | 261 | 63 | 0.0066 |
| Protein name | | | | | Locus Name | Acc# |
| conserved hypothetical integral membrane protein BB0584 | | | | | pir:G70172 | G70172 |

Description

| ORF Name | NTID | AAID | NT Length | AA Length | Score | Probability |
|---|---|---|---|---|---|---|
| 4489092_c2_449 | 1620 | 5792 | 236 | 711 | 880 | 4.9e-88 |
| Protein name | | | | | Locus Name | Acc# |
| NAD(P)H-flavin reductase, Fre | | | | | gp:XENFRE | D17745 |

Description
Photorhabdus luminescens fre gene for NAD(P)H-flavin reductase, complete cds.

| ORF Name | NTID | AAID | NT Length | AA Length | Score | Probability |
|---|---|---|---|---|---|---|
| 4542828_c1_313 | 1621 | 5793 | 250 | 753 | 970 | 1.4e-97 |
| Protein name | | | | | Locus Name | Acc# |
| ammonium transport system structural protein | | | | | pir:S56439 | S56439:A65 |

Description

| ORF Name | NTID | AAID | NT Length | AA Length | Score | Probability |
|---|---|---|---|---|---|---|
| 4687510_c3_527 | 1622 | 5794 | 288 | 867 | | |
| Protein name | | | | | Locus Name | Acc# |

Description
NO-HIT

| ORF_Name | NTID | AAID | NT Length | AA Length | Score | Probability |
|---|---|---|---|---|---|---|
| 4693803_f1_18 | 1623 | 5795 | 308 | 927 | 823 | 5.4e-82 |
| Protein name | | | | | Locus Name | Acc# |
| | | | | | sp:CZCD_ALCEU | P13512 |

Description: PROTEIN CZCD)

| ORF_Name | NTID | AAID | NT Length | AA Length | Score | Probability |
|---|---|---|---|---|---|---|
| 4720263_f2_132 | 1624 | 5796 | 253 | 762 | 134 | 8.7e-07 |
| Protein name | | | | | Locus Name | Acc# |
| hypothetical protein jhp1045 | | | | | pir:G71856 | G71856 |

Description:

| ORF_Name | NTID | AAID | NT Length | AA Length | Score | Probability |
|---|---|---|---|---|---|---|
| 4726712_f1_90 | 1625 | 5797 | 113 | 342 | 80 | 0.0029 |
| Protein name | | | | | Locus Name | Acc# |
| hypothetical protein Y1074 | | | | | pir:T14991 | T14991 |

Description:

| ORF_Name | NTID | AAID | NT Length | AA Length | Score | Probability |
|---|---|---|---|---|---|---|
| 4727093_c2_411 | 1626 | 5798 | 384 | 1155 | 182 | 2.4e-11 |
| Protein name | | | | | Locus Name | Acc# |
| hypothetical protein jhp1379 | | | | | pir:F71815 | F71815 |

Description:

| ORF_Name | NTID | AAID | NT Length | AA Length | Score | Probability |
|---|---|---|---|---|---|---|
| 4737812_c2_412 | 1627 | 5799 | 205 | 618 | 484 | 4.5e-46 |
| Protein name | | | | | Locus Name | Acc# |
| | | | | | sp:FM1A_ECOLI | P04128 |

Description: TYPE-1 FIMBRIAL PROTEIN, A CHAIN PRECURSOR (TYPE-1A PILIN)

414

| ORF Name | NTID | AAID | NT Length | AA Length | Score | Probability |
|---|---|---|---|---|---|---|
| 4739067_c1_319 | 1628 | 5800 | 118 | 357 | 160 | 9.7e-12 |
| Protein name | | | | | Locus Name | Acc# |
| | | | | | sp:RPC1_BPD10 | P07040 |

Description
REPRESSOR PROTEIN CI

| ORF Name | NTID | AAID | NT Length | AA Length | Score | Probability |
|---|---|---|---|---|---|---|
| 4742252_f2_122 | 1629 | 5801 | 81 | 246 | | |
| Protein name | | | | | Locus Name | Acc# |

Description
NO-HIT

| ORF Name | NTID | AAID | NT Length | AA Length | Score | Probability |
|---|---|---|---|---|---|---|
| 4773567_c1_341 | 1630 | 5802 | 173 | 522 | 461 | 1.2e-43 |
| Protein name | | | | | Locus Name | Acc# |
| | | | | | sp:FIMG_ECOLI | P08190 |

Description
FIMG PROTEIN PRECURSOR

| ORF Name | NTID | AAID | NT Length | AA Length | Score | Probability |
|---|---|---|---|---|---|---|
| 4823587_c1_317 | 1631 | 5803 | 434 | 1305 | 120 | 1.8e-05 |
| Protein name | | | | | Locus Name | Acc# |
| dTDP-4-dehydrorhamnose 3,5-epimerase (RfbD) | | | | | gp:SSU18930 | Y18930 |

Description
Sulfolobus solfataricus 281 kb genomic DNA fragment, strain P2.

| ORF Name | NTID | AAID | NT Length | AA Length | Score | Probability |
|---|---|---|---|---|---|---|
| 4869678_c3_482 | 1632 | 5804 | 117 | 354 | 332 | 5.8e-30 |
| Protein name | | | | | Locus Name | Acc# |
| | | | | | sp:SECG_ECOLI | P33582 |

Description
SUBUNIT) (P12)

| ORF Name | NTID | AAID | NT Length | AA Length | Score | Probability |
|---|---|---|---|---|---|---|
| 4875636_f3_215 | 1633 | 5805 | 64 | 195 | 193 | 3.1e-15 |
| Protein name | | | | | Locus Name | Acc# |
| | | | | | sp:YHFL_ECOLI | P45538 |

Description

HYPOTHETICAL 5.8 KD PROTEIN IN CYSG-TRPS INTERGENIC REGION (O55)

| ORF Name | NTID | AAID | NT Length | AA Length | Score | Probability |
|---|---|---|---|---|---|---|
| 4881510_c2_406 | 1634 | 5806 | 137 | 414 | 345 | 2.4e-31 |
| Protein name | | | | | Locus Name | Acc# |
| probable translation initiation inhibitor PAB0825 | | | | | pir:G75032 | G75032 |

Description

| ORF Name | NTID | AAID | NT Length | AA Length | Score | Probability |
|---|---|---|---|---|---|---|
| 4884633_c2_380 | 1635 | 5807 | 471 | 1416 | 1039 | 7.0e-105 |
| Protein name | | | | | Locus Name | Acc# |
| | | | | | sp:AMIB_ECOLI | P26365 |

Description

N-ACETYLMURAMOYL-L-ALANINE AMIDASE AMIB PRECURSOR,

| ORF Name | NTID | AAID | NT Length | AA Length | Score | Probability |
|---|---|---|---|---|---|---|
| 4938175_c1_361 | 1636 | 5808 | 435 | 1308 | 225 | 7.9e-16 |
| Protein name | | | | | Locus Name | Acc# |
| hypothetical protein ydjA | | | | | pir:E69788 | E69788 |

Description

| ORF Name | NTID | AAID | NT Length | AA Length | Score | Probability |
|---|---|---|---|---|---|---|
| 4969087_c1_338 | 1637 | 5809 | 397 | 1194 | 211 | 1.1e-14 |
| Protein name | | | | | Locus Name | Acc# |
| hypothetical protein jhp1379 | | | | | pir:F71815 | F71815 |

Description

416

| ORF Name | NTID | AAID | NT Length | AA Length | Score | Probability |
|---|---|---|---|---|---|---|
| 5116307_c1_366 | 1638 | 5810 | 68 | 207 | | |
| Protein name | | | | | Locus Name | Acc# |

Description
NO-HIT

| ORF Name | NTID | AAID | NT Length | AA Length | Score | Probability |
|---|---|---|---|---|---|---|
| 5118818_c1_356 | 1639 | 5811 | 278 | 837 | 1148 | 2.0e-116 |
| Protein name | | | | | Locus Name | Acc# |
| | | | | | sp:YAFZ_ECOLI | P77206;Q47 |

Description
HYPOTHETICAL 31.7 KD PROTEIN IN PROA-PERR INTERGENIC REGION

| ORF Name | NTID | AAID | NT Length | AA Length | Score | Probability |
|---|---|---|---|---|---|---|
| 5118843_f3_217 | 1640 | 5812 | 355 | 1068 | 1289 | 2.2e-131 |
| Protein name | | | | | Locus Name | Acc# |
| ornithine carbamoyltransferase, chain I:citrulline phosphorylase chain I:ornithine | | | | | pir:OWECI | A31314;A00 |

Description

| ORF Name | NTID | AAID | NT Length | AA Length | Score | Probability |
|---|---|---|---|---|---|---|
| 5251452_c1_367 | 1641 | 5813 | 167 | 504 | 350 | 7.2e-32 |
| Protein name | | | | | Locus Name | Acc# |
| | | | | | sp:YHHY_ECOLI | P46854 |

Description
HYPOTHETICAL 18.8 KD PROTEIN IN GNTR-GGT INTERGENIC REGION (O162)

| ORF Name | NTID | AAID | NT Length | AA Length | Score | Probability |
|---|---|---|---|---|---|---|
| 5265930_f3_214 | 1642 | 5814 | 209 | 630 | 535 | 1.8e-51 |
| Protein name | | | | | Locus Name | Acc# |
| | | | | | sp:YJGM_ECOLI | P39337 |

Description
HYPOTHETICAL 18.6 KD PROTEIN IN ARGI-VALS INTERGENIC REGION (F97)

| ORF Name | NTID | AAID | NT Length | AA Length | Score | Probability |
|---|---|---|---|---|---|---|
| 5275337_c2_391 | 1643 | 5815 | 69 | 210 | 253 | 1.4e-21 |
| Protein name | | | | | Locus Name | Acc# |
| | | | | | sp:YTFK_ECOLI | P39318 |

Description
HYPOTHETICAL 8.1 KD PROTEIN IN CYSQ-MSRA INTERGENIC REGION

| ORF Name | NTID | AAID | NT Length | AA Length | Score | Probability |
|---|---|---|---|---|---|---|
| 546937_c1_332 | 1644 | 5816 | 98 | 297 | 424 | 1.0e-39 |
| Protein name | | | | | Locus Name | Acc# |
| | | | | | gp:YEY10692 | Y10692 |

Description
Y.enterocolitica yhbB, yhbA, rpsO and pnp genes.

| ORF Name | NTID | AAID | NT Length | AA Length | Score | Probability |
|---|---|---|---|---|---|---|
| 5970253_f3_221 | 1645 | 5817 | 157 | 474 | 651 | 9.1e-64 |
| Protein name | | | | | Locus Name | Acc# |
| | | | | | sp:NRDG_ECOLI | P39329 |

Description
(EC 1.97.1.-)

| ORF Name | NTID | AAID | NT Length | AA Length | Score | Probability |
|---|---|---|---|---|---|---|
| 5972751_c1_312 | 1646 | 5818 | 223 | 672 | 803 | 7.1e-80 |
| Protein name | | | | | Locus Name | Acc# |
| peptidylprolyl isomerase,:FK506-binding protein FKBP22 | | | | | pir:S56432 | S56432:B65 |

Description

| ORF Name | NTID | AAID | NT Length | AA Length | Score | Probability |
|---|---|---|---|---|---|---|
| 6035262_f1_29 | 1647 | 5819 | 292 | 879 | 126 | 1.8e-05 |
| Protein name | | | | | Locus Name | Acc# |
| conserved hypothetical protein | | | | | pir:C75384 | C75384 |

Description

| ORF Name | NTID | AAID | NT Length | AA Length | Score | Probability |
|---|---|---|---|---|---|---|
| 6136301_c3_507 | 1648 | 5820 | 166 | 501 | 513 | 3.8e-49 |
| Protein name | | | | | Locus Name | Acc# |
| | | | | | sp:YJGD_SALTY | Q08019 |

Description
(5.6)

| ORF Name | NTID | AAID | NT Length | AA Length | Score | Probability |
|---|---|---|---|---|---|---|
| 6148442_c3_471 | 1649 | 5821 | 400 | 1203 | 231 | 5.7e-17 |
| Protein name | | | | | Locus Name | Acc# |
| hypothetical protein TM1336 | | | | | pir:H72265 | H72265 |

Description

| ORF Name | NTID | AAID | NT Length | AA Length | Score | Probability |
|---|---|---|---|---|---|---|
| 6437641_f3_278 | 1650 | 5822 | 63 | 192 | | |
| Protein name | | | | | Locus Name | Acc# |

Description
NO-HIT

| ORF Name | NTID | AAID | NT Length | AA Length | Score | Probability |
|---|---|---|---|---|---|---|
| 6445443_c1_316 | 1651 | 5823 | 583 | 1752 | 1965 | 5.2e-203 |
| Protein name | | | | | Locus Name | Acc# |
| | | | | | sp:YTFM_ECOLI | P39320 |

Description
(O577)

| ORF Name | NTID | AAID | NT Length | AA Length | Score | Probability |
|---|---|---|---|---|---|---|
| 6775287_c2_447 | 1652 | 5824 | 262 | 789 | 998 | 1.5e-100 |
| Protein name | | | | | Locus Name | Acc# |
| | | | | | sp:TATC_ECOLI | P27857:P27 |

Description
SEC-INDEPENDENT PROTEIN TRANSLOCASE PROTEIN TATC

419

| ORF_Name | NTID | AAID | NT Length | AA Length | Score | Probability |
|---|---|---|---|---|---|---|
| 6914817_c2_404 | 1653 | 5825 | 322 | 969 | 1087 | 5.7e-110 |
| Protein name | | | | | Locus Name | Acc# |
| | | | | | sp:TRUB_ECOLI | P09171:P76 |

Description
HYDROLYASE) (P35 PROTEIN)

| ORF_Name | NTID | AAID | NT Length | AA Length | Score | Probability |
|---|---|---|---|---|---|---|
| 762_c3_458 | 1654 | 5826 | 443 | 1332 | 1970 | 1.5e-203 |
| Protein name | | | | | Locus Name | Acc# |
| adenylosuccinate synthase, purA:IMP--aspartate ligase | | | | | pir:AJECDS | S56402:A31 |

Description

| ORF_Name | NTID | AAID | NT Length | AA Length | Score | Probability |
|---|---|---|---|---|---|---|
| 78200_c1_318 | 1655 | 5827 | 339 | 1020 | 1303 | 7.4e-133 |
| Protein name | | | | | Locus Name | Acc# |
| | | | | | sp:MDH_ECOLI | P06994:Q59 |

Description
MALATE DEHYDROGENASE,

| ORF_Name | NTID | AAID | NT Length | AA Length | Score | Probability |
|---|---|---|---|---|---|---|
| 787887_f3_190 | 1656 | 5828 | 68 | 207 | 190 | 1.4e-14 |
| Protein name | | | | | Locus Name | Acc# |
| hypothetical protein b3830 | | | | | pir:G65187 | G65187 |

Description

| ORF_Name | NTID | AAID | NT Length | AA Length | Score | Probability |
|---|---|---|---|---|---|---|
| 817175_f2_112 | 1657 | 5829 | 68 | 207 | | |
| Protein name | | | | | Locus Name | Acc# |

Description
NO-HIT

| ORF_Name | NTID | AAID | NT Length | AA Length | Score | Probability |
|---|---|---|---|---|---|---|
| 9772178_f3_258 | 1658 | 5830 | 522 | 1569 | 1535 | 1.9e-157 |
| Protein name | | | | | Locus Name | Acc# |
| | | | | | sp:PBP4_ECOLI | P24228 |

Description

| ORF_Name | NTID | AAID | NT Length | AA Length | Score | Probability |
|---|---|---|---|---|---|---|
| 988292_c2_402 | 1659 | 5831 | 177 | 534 | 657 | 2.1e-64 |
| Protein name | | | | | Locus Name | Acc# |
| | | | | | sp:YHBC_ECOLI | P03843 |

Description
HYPOTHETICAL 16.8 KD PROTEIN IN NUSA-METY INTERGENIC REGION

| ORF_Name | NTID | AAID | NT Length | AA Length | Score | Probability |
|---|---|---|---|---|---|---|
| 9948260_f3_279 | 1660 | 5832 | 72 | 219 | | |
| Protein name | | | | | Locus Name | Acc# |

Description
NO-HIT

| ORF_Name | NTID | AAID | NT Length | AA Length | Score | Probability |
|---|---|---|---|---|---|---|
| 10000933_f1_77 | 1661 | 5833 | 99 | 300 | | |
| Protein name | | | | | Locus Name | Acc# |

Description
NO-HIT

| ORF_Name | NTID | AAID | NT Length | AA Length | Score | Probability |
|---|---|---|---|---|---|---|
| 10163437_f1_176 | 1662 | 5834 | 215 | 648 | 840 | 8.5e-84 |
| Protein name | | | | | Locus Name | Acc# |
| | | | | | sp:YRAO_ECOLI | P45466 |

Description
HYPOTHETICAL 21.1 KD PROTEIN IN AGAI-MTR INTERGENIC REGION (O196)

| ORF_Name | NTID | AAID | NT Length | AA Length | Score | Probability |
|---|---|---|---|---|---|---|
| 10192963_c3_1277 | 1663 | 5835 | 556 | 1671 | 2085 | 1.0e-215 |
| Protein name | | | | | Locus Name | Acc# |
| | | | | | sp:GLPA_ECOLI | P13032:P78 |

Description: (G-3-P DEHYDROGENASE)

| ORF_Name | NTID | AAID | NT Length | AA Length | Score | Probability |
|---|---|---|---|---|---|---|
| 10241665_f3_759 | 1664 | 5836 | 250 | 753 | 801 | 1.2e-79 |
| Protein name | | | | | Locus Name | Acc# |
| | | | | | sp:YHHQ_ECOLI | P37619 |

Description: HYPOTHETICAL 25.3 KD PROTEIN IN FTSY-NIKA INTERGENIC REGION (O221)

| ORF_Name | NTID | AAID | NT Length | AA Length | Score | Probability |
|---|---|---|---|---|---|---|
| 10285682_c3_1283 | 1665 | 5837 | 82 | 249 | | |
| Protein name | | | | | Locus Name | Acc# |

Description: NO-HIT

| ORF_Name | NTID | AAID | NT Length | AA Length | Score | Probability |
|---|---|---|---|---|---|---|
| 10362800_f1_173 | 1666 | 5838 | 242 | 729 | 645 | 3.9e-63 |
| Protein name | | | | | Locus Name | Acc# |
| | | | | | sp:YHAK_ECOLI | P42624 |

Description: HYPOTHETICAL 25.9 KD PROTEIN IN EXUR-TDCC INTERGENIC REGION (O233)

| ORF_Name | NTID | AAID | NT Length | AA Length | Score | Probability |
|---|---|---|---|---|---|---|
| 1047886_f1_15 | 1667 | 5839 | 687 | 2064 | 1470 | 1.5e-150 |
| Protein name | | | | | Locus Name | Acc# |
| | | | | | sp:BETT_ECOLI | P17447 |

Description: HIGH-AFFINITY CHOLINE TRANSPORT PROTEIN

| ORF_Name | NTID | AAID | NT Length | AA Length | Score | Probability |
|---|---|---|---|---|---|---|
| 10547213_f1_19 | 1668 | 5840 | 130 | 393 | 141 | 1.0e-09 |
| Protein name | | | | | Locus Name | Acc# |
| | | | | | sp:YCQ3_YEAST | P25614 |

Description
VERY HYPOTHETICAL 22.8 KD PROTEIN IN PGK1-POL4 INTERGENIC REGION

| ORF_Name | NTID | AAID | NT Length | AA Length | Score | Probability |
|---|---|---|---|---|---|---|
| 10550806_f3_610 | 1669 | 5841 | 209 | 630 | 465 | 4.7e-44 |
| Protein name | | | | | Locus Name | Acc# |
| | | | | | gp:S67816 | S67816 |

Description
.

| ORF_Name | NTID | AAID | NT Length | AA Length | Score | Probability |
|---|---|---|---|---|---|---|
| 10676502_f2_349 | 1670 | 5842 | 63 | 192 | 113 | 1.4e-06 |
| Protein name | | | | | Locus Name | Acc# |
| hypothetical protein | | | | | gp:BSZ75208 | Z75208 |

Description
B.subtilis genomic sequence 89009bp.

| ORF_Name | NTID | AAID | NT Length | AA Length | Score | Probability |
|---|---|---|---|---|---|---|
| 1072842_f2_320 | 1671 | 5843 | 71 | 216 | 106 | 2.6e-05 |
| Protein name | | | | | Locus Name | Acc# |
| stress protein | | | | | pir:D71878 | D71878 |

Description

| ORF_Name | NTID | AAID | NT Length | AA Length | Score | Probability |
|---|---|---|---|---|---|---|
| 1074143_f2_311 | 1672 | 5844 | 165 | 498 | 747 | 6.1e-74 |
| Protein name | | | | | Locus Name | Acc# |
| | | | | | sp:DKSA_ECOLI | P18274 |

Description
DNAK SUPPRESSOR PROTEIN

423

| ORF Name | NTID | AAID | NT Length | AA Length | Score | Probability |
|---|---|---|---|---|---|---|
| 10973411_c2_1193 | 1673 | 5845 | 348 | 1047 | 248 | 3.0e-20 |
| Protein name | | | | | Locus Name | Acc# |
| yhjN protein | | | | | gp:SAU18635 | Y18635 |

Description: Staphylococcus aureus tag, yhjN, gsa-at and pbg (partial) genes.

| ORF Name | NTID | AAID | NT Length | AA Length | Score | Probability |
|---|---|---|---|---|---|---|
| 10975052_f2_372 | 1674 | 5846 | 211 | 636 | 912 | 2.0e-91 |
| Protein name | | | | | Locus Name | Acc# |
| probable iron-sulfur protein b1674 | | | | | pir:B64925 | B64925 |

Description:

| ORF Name | NTID | AAID | NT Length | AA Length | Score | Probability |
|---|---|---|---|---|---|---|
| 111287_f1_229 | 1675 | 5847 | 790 | 2373 | 3306 | 0.0 |
| Protein name | | | | | Locus Name | Acc# |
| putative P-type cation-translocating membrane | | | | | gp:PMPPAA | AJ001437 |

Description: Proteus mirabilis ppaA gene and orf1.

| ORF Name | NTID | AAID | NT Length | AA Length | Score | Probability |
|---|---|---|---|---|---|---|
| 11220937_c3_1310 | 1676 | 5848 | 69 | 210 | | |
| Protein name | | | | | Locus Name | Acc# |

Description: NO-HIT

| ORF Name | NTID | AAID | NT Length | AA Length | Score | Probability |
|---|---|---|---|---|---|---|
| 1171878_c1_859 | 1677 | 5849 | 248 | 747 | 668 | 1.4e-65 |
| Protein name | | | | | Locus Name | Acc# |
| | | | | | sp:S27A_ECOLI | P26428:P76 |

Description: SIGMA CROSS-REACTING PROTEIN 27A (SCRP-27A)

424

| ORF Name | NTID | AAID | NT Length | AA Length | Score | Probability |
|---|---|---|---|---|---|---|
| 11847152_c2_1081 | 1678 | 5850 | 60 | 183 | | |
| Protein name | | | | | Locus Name | Acc# |
| | | | | | | |

Description: NO-HIT

| ORF Name | NTID | AAID | NT Length | AA Length | Score | Probability |
|---|---|---|---|---|---|---|
| 1195338_c1_978 | 1679 | 5851 | 774 | 2325 | 2691 | 2.1e-282 |
| Protein name | | | | | Locus Name | Acc# |
| penicillin-binding protein 1B:peptidoglycan synthetase | | | | | pir:ZPECPB | E64738:A03 |

Description:

| ORF Name | NTID | AAID | NT Length | AA Length | Score | Probability |
|---|---|---|---|---|---|---|
| 1199200_c3_1261 | 1680 | 5852 | 619 | 1860 | 1536 | 6.2e-175 |
| Protein name | | | | | Locus Name | Acc# |
| probable accA3 protein | | | | | pir:F70980 | F70980 |

Description:

| ORF Name | NTID | AAID | NT Length | AA Length | Score | Probability |
|---|---|---|---|---|---|---|
| 120925_c2_1227 | 1681 | 5853 | 343 | 1032 | 1121 | 1.4e-113 |
| Protein name | | | | | Locus Name | Acc# |
| | | | | | sp:Y4XP_RHISN | P55708 |

Description: SULFHYDRYLASE) (O-ACETYLSERINE (THIOL)-LYASE) (CSASE)

| ORF Name | NTID | AAID | NT Length | AA Length | Score | Probability |
|---|---|---|---|---|---|---|
| 12115637_f2_263 | 1682 | 5854 | 155 | 468 | 651 | 9.1e-64 |
| Protein name | | | | | Locus Name | Acc# |
| ZapE | | | | | gp:AF064762 | AF064762 |

Description: Proteus mirabilis metalloprotease operon, complete sequence.

425

| ORF Name | NTID | AAID | NT Length | AA Length | Score | Probability |
|---|---|---|---|---|---|---|
| 1212937_c2_1071 | 1683 | 5855 | 453 | 1362 | 1769 | 3.1e-182 |
| Protein name | | | | | Locus Name | Acc# |
| | | | | | sp:PMBA_ECOLI | P24231 |

Description
PMBA PROTEIN (TLDE PROTEIN)

| ORF Name | NTID | AAID | NT Length | AA Length | Score | Probability |
|---|---|---|---|---|---|---|
| 12147137_c1_840 | 1684 | 5856 | 218 | 657 | 798 | 2.4e-79 |
| Protein name | | | | | Locus Name | Acc# |
| | | | | | sp:YRBC_ECOLI | P45390 |

Description
(F211)

| ORF Name | NTID | AAID | NT Length | AA Length | Score | Probability |
|---|---|---|---|---|---|---|
| 1222187_c3_1318 | 1685 | 5857 | 833 | 2502 | 2934 | 0.0 |
| Protein name | | | | | Locus Name | Acc# |
| | | | | | gp:ECARCB | X53315 |

Description
E. coli arcB gene for ArcB membrane protein.

| ORF Name | NTID | AAID | NT Length | AA Length | Score | Probability |
|---|---|---|---|---|---|---|
| 12226681_f1_168 | 1686 | 5858 | 62 | 189 | | |
| Protein name | | | | | Locus Name | Acc# |

Description
NO-HIT

| ORF Name | NTID | AAID | NT Length | AA Length | Score | Probability |
|---|---|---|---|---|---|---|
| 1228191_f3_672 | 1687 | 5859 | 79 | 240 | | |
| Protein name | | | | | Locus Name | Acc# |

Description
NO-HIT

| ORF Name | NTID | AAID | NT Length | AA Length | Score | Probability |
|---|---|---|---|---|---|---|
| 12369635_f1_215 | 1688 | 5860 | 337 | 1014 | 1622 | 1.2e-166 |
| Protein name | | | | | Locus Name | Acc# |
| yhdG homolog | | | | | gp:AF040379 | AF040379 |

Description

Proteus vulgaris ribosomal protein L11 methyltransferase (prmA)gene, partial cds; yhdG homolog gene, complete cds; and small DNAbinding protein Fis (fis) gene, partial cds.

| ORF Name | NTID | AAID | NT Length | AA Length | Score | Probability |
|---|---|---|---|---|---|---|
| 12537582_f3_552 | 1689 | 5861 | 114 | 345 | 71 | 0.0011 |
| Protein name | | | | | Locus Name | Acc# |
| 'ORF' | | | | | gp:ECO82K | D26562 |

Description

Escherichia coli genome, 2.4-4.1 min region (110,917-193,643 bpfrom 0 min).

| ORF Name | NTID | AAID | NT Length | AA Length | Score | Probability |
|---|---|---|---|---|---|---|
| 12583300_f3_754 | 1690 | 5862 | 79 | 240 | 103 | 1.1e-05 |
| Protein name | | | | | Locus Name | Acc# |
| hypothetical protein APE1082 | | | | | pir:C72708 | C72708 |

Description

| ORF Name | NTID | AAID | NT Length | AA Length | Score | Probability |
|---|---|---|---|---|---|---|
| 12584452_f3_727 | 1691 | 5863 | 211 | 636 | 595 | 7.8e-58 |
| Protein name | | | | | Locus Name | Acc# |
| | | | | | sp:YJGA_ECOLI | P26650 |

Description

PROTEIN) (F183)

| ORF Name | NTID | AAID | NT Length | AA Length | Score | Probability |
|---|---|---|---|---|---|---|
| 12712755_c3_1426 | 1692 | 5864 | 446 | 1341 | 1828 | 1.7e-188 |
| Protein name | | | | | Locus Name | Acc# |
| | | | | | sp:DSDX_ECOLI | P08555:P11 |

Description

DSDX PERMEASE

| ORF Name | NTID | AAID | NT Length | AA Length | Score | Probability |
|---|---|---|---|---|---|---|
| 128385_c3_1288 | 1693 | 5865 | 393 | 1182 | 1035 | 1.8e-104 |
| Protein name | | | | | Locus Name | Acc# |
| | | | | | sp:YHAD_HAEIN | P44507 |

Description: HYPOTHETICAL PROTEIN HI0091

| ORF Name | NTID | AAID | NT Length | AA Length | Score | Probability |
|---|---|---|---|---|---|---|
| 129628_c2_1238 | 1694 | 5866 | 71 | 216 | 84 | 0.0039 |
| Protein name | | | | | Locus Name | Acc# |
| ribosomal protein S2 | | | | | gp:U87145 | U87145 |

Description: Toxoplasma gondii chloroplast, complete genome.

| ORF Name | NTID | AAID | NT Length | AA Length | Score | Probability |
|---|---|---|---|---|---|---|
| 1297175_c3_1271 | 1695 | 5867 | 204 | 615 | 835 | 2.9e-83 |
| Protein name | | | | | Locus Name | Acc# |
| | | | | | sp:YFRA_PROVU | P20925 |

Description: FRD OPERON PROBABLE IRON-SULFUR PROTEIN A (FRAGMENT)

| ORF Name | NTID | AAID | NT Length | AA Length | Score | Probability |
|---|---|---|---|---|---|---|
| 13017757_c2_1161 | 1696 | 5868 | 370 | 1113 | 1549 | 6.3e-159 |
| Protein name | | | | | Locus Name | Acc# |
| | | | | | sp:QUEA_ECOLI | P21516 |

Description: (QUEUOSINE BIOSYNTHESIS PROTEIN QUEA)

| ORF Name | NTID | AAID | NT Length | AA Length | Score | Probability |
|---|---|---|---|---|---|---|
| 13078200_c3_1443 | 1697 | 5869 | 637 | 1914 | 1510 | 8.6e-155 |
| Protein name | | | | | Locus Name | Acc# |
| | | | | | sp:Y4XN_RHISN | P55706 |

Description: HYPOTHETICAL 71.0 KD PROTEIN Y4XN

| ORF Name | NTID | AAID | NT Length | AA Length | Score | Probability |
|---|---|---|---|---|---|---|
| 13101540_f2_468 | 1698 | 5870 | 379 | 1140 | 919 | 3.6e-92 |
| Protein name | | | | | Locus Name | Acc# |
| sn-Glycerol-3-phosphate transport ATP-binding protein | | | | | pir:QRECUC | S47669:S03 |

Description

| ORF Name | NTID | AAID | NT Length | AA Length | Score | Probability |
|---|---|---|---|---|---|---|
| 13161691_f1_212 | 1699 | 5871 | 453 | 1362 | 2056 | 1.2e-212 |
| Protein name | | | | | Locus Name | Acc# |
| | | | | | sp:ACCC_ECOLI | P24182 |

Description

CARBOXYLASE,) (ACC)

| ORF Name | NTID | AAID | NT Length | AA Length | Score | Probability |
|---|---|---|---|---|---|---|
| 1364716_f2_319 | 1700 | 5872 | 444 | 1335 | 1064 | 1.6e-107 |
| Protein name | | | | | Locus Name | Acc# |
| | | | | | sp:YCDB_ECOLI | P31545:P75 |

Description (ORF1)

| ORF Name | NTID | AAID | NT Length | AA Length | Score | Probability |
|---|---|---|---|---|---|---|
| 1367211_c1_794 | 1701 | 5873 | 316 | 951 | 196 | 1.7e-13 |
| Protein name | | | | | Locus Name | Acc# |
| unknown | | | | | gp:AF031571 | AF031571 |

Description

Pseudomonas aeruginosa unknown protein genes, complete cds.

| ORF Name | NTID | AAID | NT Length | AA Length | Score | Probability |
|---|---|---|---|---|---|---|
| 1385925_f3_697 | 1702 | 5874 | 106 | 321 | 323 | 5.2e-29 |
| Protein name | | | | | Locus Name | Acc# |
| | | | | | sp:YQJD_ECOLI | P42617 |

Description

HYPOTHETICAL 11.1 KD PROTEIN IN EXUR-TDCC INTERGENIC REGION

| ORF Name | NTID | AAID | NT Length | AA Length | Score | Probability |
|---|---|---|---|---|---|---|
| 14094186_c3_1405 | 1703 | 5875 | 184 | 555 | 577 | 6.3e-56 |
| Protein name | | | | | Locus Name | Acc# |
| regulatory protein b0447 | | | | pir:G64774 | | G64774 |

Description

| ORF Name | NTID | AAID | NT Length | AA Length | Score | Probability |
|---|---|---|---|---|---|---|
| 14172187_f1_241 | 1704 | 5876 | 154 | 465 | 625 | 5.2e-61 |
| Protein name | | | | | Locus Name | Acc# |
| | | | | | sp:FRDD_PROVU | P20924 |

Description
FUMARATE REDUCTASE 13 KD HYDROPHOBIC PROTEIN

| ORF Name | NTID | AAID | NT Length | AA Length | Score | Probability |
|---|---|---|---|---|---|---|
| 14178200_f3_631 | 1705 | 5877 | 615 | 1848 | 1592 | 1.7e-163 |
| Protein name | | | | | Locus Name | Acc# |
| | | | | | sp:GGT_PSESP | P36267 |

Description
GAMMA-GLUTAMYLTRANSPEPTIDASE PRECURSOR,

| ORF Name | NTID | AAID | NT Length | AA Length | Score | Probability |
|---|---|---|---|---|---|---|
| 14181562_c2_1231 | 1706 | 5878 | 665 | 1998 | 2872 | 4.0e-299 |
| Protein name | | | | | Locus Name | Acc# |
| | | | | | sp:TKT1_ECOLI | P27302 |

Description
TRANSKETOLASE 1, (TK 1)

| ORF Name | NTID | AAID | NT Length | AA Length | Score | Probability |
|---|---|---|---|---|---|---|
| 14255467_c3_1460 | 1707 | 5879 | 165 | 498 | 825 | 3.3e-82 |
| Protein name | | | | | Locus Name | Acc# |
| | | | | | gp:PMFIMOPR | Z32686 |

Description
Proteus mirabilis fimbrial operon, strain HI4320.

430

| ORF Name | NTID | AAID | NT Length | AA Length | Score | Probability |
|---|---|---|---|---|---|---|
| 1440632_c1_982 | 1708 | 5880 | 550 | 1653 | 2511 | 7.2e-261 |
| Protein name | | | | | Locus Name | Acc# |
| CTP synthase,:CTP-synthetase:UTP--ammonia ligase | | | | | pir:SYECTP | H65059;A25 |

Description

| ORF Name | NTID | AAID | NT Length | AA Length | Score | Probability |
|---|---|---|---|---|---|---|
| 1446942_c1_1005 | 1709 | 5881 | 280 | 843 | 1425 | 8.7e-146 |
| Protein name | | | | | Locus Name | Acc# |
| | | | | | gp:PMFIMOPR | Z32686 |

Description

Proteus mirabilis fimbrial operon, strain HI4320.

| ORF Name | NTID | AAID | NT Length | AA Length | Score | Probability |
|---|---|---|---|---|---|---|
| 14474067_f2_308 | 1710 | 5882 | 68 | 207 | | |
| Protein name | | | | | Locus Name | Acc# |

Description

NO-HIT

| ORF Name | NTID | AAID | NT Length | AA Length | Score | Probability |
|---|---|---|---|---|---|---|
| 14479050_f3_771 | 1711 | 5883 | 312 | 939 | | |
| Protein name | | | | | Locus Name | Acc# |

Description

NO-HIT

| ORF Name | NTID | AAID | NT Length | AA Length | Score | Probability |
|---|---|---|---|---|---|---|
| 14492152_f2_407 | 1712 | 5884 | 89 | 270 | 201 | 4.4e-16 |
| Protein name | | | | | Locus Name | Acc# |
| | | | | | sp:YAAA_ECOLI | P11288 |

Description

HYPOTHETICAL 29.6 KD PROTEIN IN THRC-TALB INTERGENIC REGION

| ORF Name | NTID | AAID | NT Length | AA Length | Score | Probability |
|---|---|---|---|---|---|---|
| 14585876_c1_953 | 1713 | 5885 | 216 | 651 | 700 | 5.8e-69 |

| Protein name | Locus Name | Acc# |
|---|---|---|
| adenine phosphoribosyltransferase | gp:ECU82664 | U82664 |

Description

Escherichia coli minutes 9 to 11 genomic sequence.

| ORF Name | NTID | AAID | NT Length | AA Length | Score | Probability |
|---|---|---|---|---|---|---|
| 14634652_c3_1461 | 1714 | 5886 | 525 | 1578 | 1958 | 2.9e-202 |

| Protein name | Locus Name | Acc# |
|---|---|---|
| putative efflux pump component MtrF | gp:AF176820 | AF176820 |

Description

Neisseria gonorrhoeae strain FA19 putative efflux pump component MtrF (mtrF) gene, complete cds.

| ORF Name | NTID | AAID | NT Length | AA Length | Score | Probability |
|---|---|---|---|---|---|---|
| 14640912_f1_226 | 1715 | 5887 | 211 | 636 | 640 | 1.3e-62 |

| Protein name | Locus Name | Acc# |
|---|---|---|
|  | sp:YHHF_ECOLI | P10120 |

Description 21.7 KD PROTEIN IN FTSY-NIKA INTERGENIC REGION

| ORF Name | NTID | AAID | NT Length | AA Length | Score | Probability |
|---|---|---|---|---|---|---|
| 1464590_c2_1131 | 1716 | 5888 | 167 | 504 | 473 | 6.6e-45 |

| Protein name | Locus Name | Acc# |
|---|---|---|
| FkbB-type peptidyl-propyl cis-trans isomerase | gp:AF201388 | AF201388 |

Description

Klebsiella pneumoniae isoleucyl-tRNA synthetase (ileS) gene, partial cds; and prolipoprotein signal peptidase II (lsp) and FkbB-type peptidyl-propyl cis-trans isomerase (slpA) genes, complete cds.

| ORF Name | NTID | AAID | NT Length | AA Length | Score | Probability |
|---|---|---|---|---|---|---|
| 14650308_f3_692 | 1717 | 5889 | 570 | 1713 | 955 | 5.6e-96 |
| Protein name | | | | | Locus Name | Acc# |
| | | | | | sp:YDDA_ECOLI | P31826:P76 |

Description
INTERGENIC REGION (CDS102)

| ORF Name | NTID | AAID | NT Length | AA Length | Score | Probability |
|---|---|---|---|---|---|---|
| 14883462_c3_1427 | 1718 | 5890 | 446 | 1341 | 1642 | 8.8e-169 |
| Protein name | | | | | Locus Name | Acc# |
| | | | | | sp:SDHD_ECOLI | P00926:P78 |

Description
D-SERINE DEHYDRATASE, (D-SERINE DEAMINASE)

| ORF Name | NTID | AAID | NT Length | AA Length | Score | Probability |
|---|---|---|---|---|---|---|
| 15032828_f1_201 | 1719 | 5891 | 159 | 480 | 560 | 4.0e-54 |
| Protein name | | | | | Locus Name | Acc# |
| | | | | | sp:PTSN_ECOLI | P31222 |

Description
(PHOSPHOTRANSFERASE ENZYME II, A COMPONENT)

| ORF Name | NTID | AAID | NT Length | AA Length | Score | Probability |
|---|---|---|---|---|---|---|
| 15053932_f2_417 | 1720 | 5892 | 186 | 561 | 199 | 7.2e-16 |
| Protein name | | | | | Locus Name | Acc# |
| | | | | | sp:FECI_ECOLI | P23484 |

Description
PROBABLE RNA POLYMERASE SIGMA FACTOR FECI

| ORF Name | NTID | AAID | NT Length | AA Length | Score | Probability |
|---|---|---|---|---|---|---|
| 15114752_f1_156 | 1721 | 5893 | 207 | 624 | 774 | 8.4e-77 |
| Protein name | | | | | Locus Name | Acc# |
| | | | | | sp:YAAA_ECOLI | P11288 |

Description
HYPOTHETICAL 29.6 KD PROTEIN IN THRC-TALB INTERGENIC REGION

| ORF Name | NTID | AAID | NT Length | AA Length | Score | Probability |
|---|---|---|---|---|---|---|
| 15626385_c1_987 | 1722 | 5894 | 274 | 825 | 396 | 9.6e-37 |
| Protein name | | | | | Locus Name | Acc# |
| | | | | | sp:FHUC_BACSU | P49938 |

Description
FERRICHROME TRANSPORT ATP-BINDING PROTEIN FHUC

| ORF Name | NTID | AAID | NT Length | AA Length | Score | Probability |
|---|---|---|---|---|---|---|
| 15665677_f3_543 | 1723 | 5895 | 70 | 213 | | |
| Protein name | | | | | Locus Name | Acc# |

Description
NO-HIT

| ORF Name | NTID | AAID | NT Length | AA Length | Score | Probability |
|---|---|---|---|---|---|---|
| 15680437_f1_192 | 1724 | 5896 | 138 | 417 | 473 | 6.6e-45 |
| Protein name | | | | | Locus Name | Acc# |
| | | | | | sp:YHCB_ECOLI | P39436 |

Description
HYPOTHETICAL 15.2 KD PROTEIN IN RPLM-HHOA INTERGENIC REGION (O134)

| ORF Name | NTID | AAID | NT Length | AA Length | Score | Probability |
|---|---|---|---|---|---|---|
| 15712752_c1_880 | 1725 | 5897 | 274 | 825 | 1017 | 1.5e-102 |
| Protein name | | | | | Locus Name | Acc# |
| | | | | | sp:DAPB_ECOLI | P04036 |

Description
DIHYDRODIPICOLINATE REDUCTASE,

| ORF Name | NTID | AAID | NT Length | AA Length | Score | Probability |
|---|---|---|---|---|---|---|
| 15751887_c1_908 | 1726 | 5898 | 66 | 201 | | |
| Protein name | | | | | Locus Name | Acc# |

Description
NO-HIT

| ORF Name | NTID | AAID | NT Length | AA Length | Score | Probability |
|---|---|---|---|---|---|---|
| 157577_c1_1014 | 1727 | 5899 | 80 | 243 | 180 | 7.4e-14 |
| Protein name | | | | | Locus Name | Acc# |
| histidine-rich protein | | | | | pir:A54523 | A54523 |

Description

| ORF Name | NTID | AAID | NT Length | AA Length | Score | Probability |
|---|---|---|---|---|---|---|
| 157780_c2_1130 | 1728 | 5900 | 323 | 972 | 1079 | 4.0e-109 |
| Protein name | | | | | Locus Name | Acc# |
| | | | | | sp:RIBF_ECOLI | P08391:P75 |

Description

| ORF Name | NTID | AAID | NT Length | AA Length | Score | Probability |
|---|---|---|---|---|---|---|
| 157805_c1_862 | 1729 | 5901 | 309 | 930 | 1220 | 4.6e-124 |
| Protein name | | | | | Locus Name | Acc# |
| | | | | | sp:YHAJ_ECOLI | P42623 |

Description
HYPOTHETICAL TRANSCRIPTIONAL REGULATOR IN EXUR-TDCC INTERGENIC REGION

| ORF Name | NTID | AAID | NT Length | AA Length | Score | Probability |
|---|---|---|---|---|---|---|
| 15783133_f1_198 | 1730 | 5902 | 194 | 585 | 720 | 4.4e-71 |
| Protein name | | | | | Locus Name | Acc# |
| | | | | | sp:YRBI_ECOLI | P45396:P45 |

Description
HYPOTHETICAL 20.0 KD PROTEIN IN MURA-RPON INTERGENIC REGION

| ORF Name | NTID | AAID | NT Length | AA Length | Score | Probability |
|---|---|---|---|---|---|---|
| 15817566_c3_1272 | 1731 | 5903 | 111 | 336 | 488 | 1.7e-46 |
| Protein name | | | | | Locus Name | Acc# |
| | | | | | sp:YFRC_PROVU | P20927 |

Description
FRD OPERON HYPOTHETICAL PROTEIN C

| ORF Name | NTID | AAID | NT Length | AA Length | Score | Probability |
|---|---|---|---|---|---|---|
| 15900266_f2_373 | 1732 | 5904 | 266 | 801 | 836 | 2.3e-83 |
| Protein name | | | | | Locus Name | Acc# |
| | | | | | sp:PHSC_ECOLI | P77409 |

Description: PHSC PROTEIN HOMOLOG

| ORF Name | NTID | AAID | NT Length | AA Length | Score | Probability |
|---|---|---|---|---|---|---|
| 16034653_f3_713 | 1733 | 5905 | 484 | 1455 | 1731 | 3.3e-178 |
| Protein name | | | | | Locus Name | Acc# |
| glutamate synthase (NADPH), small chain | | | | | pir:G65112 | G65112:B29 |

Description

| ORF Name | NTID | AAID | NT Length | AA Length | Score | Probability |
|---|---|---|---|---|---|---|
| 16172305_f2_406 | 1734 | 5906 | 100 | 303 | | |
| Protein name | | | | | Locus Name | Acc# |

Description: NO-HIT

| ORF Name | NTID | AAID | NT Length | AA Length | Score | Probability |
|---|---|---|---|---|---|---|
| 16189717_f2_312 | 1735 | 5907 | 287 | 864 | 912 | 2.0e-91 |
| Protein name | | | | | Locus Name | Acc# |
| | | | | | sp:PANC_ECOLI | P31663 |

Description: (PANTOATE ACTIVATING ENZYME)

| ORF Name | NTID | AAID | NT Length | AA Length | Score | Probability |
|---|---|---|---|---|---|---|
| 16205325_f2_360 | 1736 | 5908 | 307 | 924 | 1017 | 1.5e-102 |
| Protein name | | | | | Locus Name | Acc# |
| | | | | | sp:ISPA_ECOLI | P22939 |

Description: (FPP SYNTHASE)

| ORF Name | NTID | AAID | NT Length | AA Length | Score | Probability |
|---|---|---|---|---|---|---|
| 16439027_f2_271 | 1737 | 5909 | 68 | 207 | | |
| Protein name | | | | | Locus Name | Acc# |

Description: NO-HIT

| ORF Name | NTID | AAID | NT Length | AA Length | Score | Probability |
|---|---|---|---|---|---|---|
| 16603457_c2_1223 | 1738 | 5910 | 238 | 717 | 604 | 8.7e-59 |
| Protein name | | | | | Locus Name | Acc# |
| | | | | | sp:YAFS_ECOLI | P75672:P71 |

Description: HYPOTHETICAL 28.0 KD PROTEIN IN GLOB-RNHA INTERGENIC REGION

| ORF Name | NTID | AAID | NT Length | AA Length | Score | Probability |
|---|---|---|---|---|---|---|
| 16828161_f1_200 | 1739 | 5911 | 243 | 732 | 1036 | 1.4e-104 |
| Protein name | | | | | Locus Name | Acc# |
| probable ABC transporter (ntrA/rpoN 5'region) | | | | | pir:C65111 | C65111:I60 |

Description:

| ORF Name | NTID | AAID | NT Length | AA Length | Score | Probability |
|---|---|---|---|---|---|---|
| 16836530_c1_877 | 1740 | 5912 | 380 | 1143 | 1669 | 1.2e-171 |
| Protein name | | | | | Locus Name | Acc# |
| DnaJ | | | | | gp:STU58360 | U58360 |

Description: Salmonella typhimurium plasmid pRS1014 DnaK and DnaJ genes, complete cds.

| ORF Name | NTID | AAID | NT Length | AA Length | Score | Probability |
|---|---|---|---|---|---|---|
| 17000626_f1_102 | 1741 | 5913 | 507 | 1524 | 1909 | 4.5e-197 |
| Protein name | | | | | Locus Name | Acc# |
| | | | | | sp:RBSA_ECOLI | P04983 |

Description: RIBOSE TRANSPORT ATP-BINDING PROTEIN RBSA

| ORF_Name | NTID | AAID | NT Length | AA Length | Score | Probability |
|---|---|---|---|---|---|---|
| 17062500_f3_770 | 1742 | 5914 | 545 | 1638 | 1466 | 3.9e-150 |
| Protein name | | | | | Locus Name | Acc# |
| | | | | | sp:HYFR_ECOLI | P71229:P76 |

Description: HYDROGENASE-4 TRANSCRIPTIONAL ACTIVATOR

| ORF_Name | NTID | AAID | NT Length | AA Length | Score | Probability |
|---|---|---|---|---|---|---|
| 187706_f3_553 | 1743 | 5915 | 533 | 1602 | 1629 | 3.0e-173 |
| Protein name | | | | | Locus Name | Acc# |
| | | | | | sp:PCNB_ECOLI | P13685:P78 |

Description: POLY(A) POLYMERASE, (PAP) (PLASMID COPY NUMBER PROTEIN)

| ORF_Name | NTID | AAID | NT Length | AA Length | Score | Probability |
|---|---|---|---|---|---|---|
| 187840_c2_1070 | 1744 | 5916 | 112 | 339 | 137 | 2.7e-09 |
| Protein name | | | | | Locus Name | Acc# |
| ribonuclease inhibitor homolog yrdF | | | | | pir:C69973 | C69973 |

Description:

| ORF_Name | NTID | AAID | NT Length | AA Length | Score | Probability |
|---|---|---|---|---|---|---|
| 194016_c1_837 | 1745 | 5917 | 285 | 858 | 1077 | 6.6e-109 |
| Protein name | | | | | Locus Name | Acc# |
| | | | | | sp:YRBF_ECOLI | P45393 |

Description: INTERGENIC REGION

| ORF_Name | NTID | AAID | NT Length | AA Length | Score | Probability |
|---|---|---|---|---|---|---|
| 19531551_c3_1334 | 1746 | 5918 | 294 | 885 | 220 | 4.3e-18 |
| Protein name | | | | | Locus Name | Acc# |
| | | | | | sp:TONB_PSEPU | Q05613 |

Description: TONB PROTEIN

| ORF Name | NTID | AAID | NT Length | AA Length | Score | Probability |
|---|---|---|---|---|---|---|
| 19534512_f1_164 | 1747 | 5919 | 565 | 1698 | 2619 | 2.6e-272 |

Protein name: ABC transporter in nadR-slt intergenic region
Locus Name: pir:F65254
Acc#: F65254:S56

Description

| ORF Name | NTID | AAID | NT Length | AA Length | Score | Probability |
|---|---|---|---|---|---|---|
| 19535438_f2_424 | 1748 | 5920 | 226 | 681 | 835 | 2.9e-83 |

Protein name
Locus Name: sp:YQJA_ECOLI
Acc#: P42614

Description: HYPOTHETICAL 24.6 KD PROTEIN IN EXUR-TDCC INTERGENIC REGION

| ORF Name | NTID | AAID | NT Length | AA Length | Score | Probability |
|---|---|---|---|---|---|---|
| 19572262_c1_881 | 1749 | 5921 | 397 | 1194 | 1664 | 4.1e-171 |

Protein name
Locus Name: sp:CARA_SALTY
Acc#: P14845

Description: PHOSPHATE SYNTHETASE GLUTAMINE CHAIN)

| ORF Name | NTID | AAID | NT Length | AA Length | Score | Probability |
|---|---|---|---|---|---|---|
| 19586556_c2_1216 | 1750 | 5922 | 528 | 1587 | 1458 | 2.8e-149 |

Protein name
Locus Name: sp:DGTP_ECOLI
Acc#: P15723

Description: DEOXYGUANOSINETRIPHOSPHATE TRIPHOSPHOHYDROLASE, (DGTPASE)

| ORF Name | NTID | AAID | NT Length | AA Length | Score | Probability |
|---|---|---|---|---|---|---|
| 19589126_c3_1457 | 1751 | 5923 | 286 | 861 | 645 | 3.9e-63 |

Protein name
Locus Name: gp:PMFIMOPR
Acc#: Z32686

Description: Proteus mirabilis fimbrial operon, strain HI4320.

439

| ORF Name | NTID | AAID | NT Length | AA Length | Score | Probability |
|---|---|---|---|---|---|---|
| 195927_f2_359 | 1752 | 5924 | 112 | 339 | 221 | 3.3e-18 |

| Protein name | Locus Name | Acc# |
|---|---|---|
| | sp:EX7S_ECOLI | P22938 |

Description

SMALL SUBUNIT)

| ORF Name | NTID | AAID | NT Length | AA Length | Score | Probability |
|---|---|---|---|---|---|---|
| 19687511_c2_1135 | 1753 | 5925 | 94 | 285 | 80 | 0.021 |

| Protein name | Locus Name | Acc# |
|---|---|---|
| gene cox1 intron protein aI5-beta:protein Q0075 | pir:S78652 | S78652:S78 |

Description

| ORF Name | NTID | AAID | NT Length | AA Length | Score | Probability |
|---|---|---|---|---|---|---|
| 19698750_c3_1291 | 1754 | 5926 | 172 | 519 | 220 | 4.3e-18 |

| Protein name | Locus Name | Acc# |
|---|---|---|
| conserved hypothetical protein yhjH | pir:G69833 | G69833 |

Description

| ORF Name | NTID | AAID | NT Length | AA Length | Score | Probability |
|---|---|---|---|---|---|---|
| 19801302_c3_1404 | 1755 | 5927 | 133 | 402 | 165 | 2.9e-12 |

| Protein name | Locus Name | Acc# |
|---|---|---|
| competence protein | gp:AF052208 | AF052208 |

Description

Streptococcus pneumoniae competence protein (celA) and competenceprotein (celB) genes, complete cds; and unknown gene.

| ORF Name | NTID | AAID | NT Length | AA Length | Score | Probability |
|---|---|---|---|---|---|---|
| 1988513_c2_1186 | 1756 | 5928 | 205 | 618 | 924 | 1.1e-92 |

| Protein name | Locus Name | Acc# |
|---|---|---|
| | sp:RECR_ECOLI | P12727 |

Description

RECOMBINATION PROTEIN RECR

440

| ORF Name | NTID | AAID | NT Length | AA Length | Score | Probability |
|---|---|---|---|---|---|---|
| 20311_f1_196 | 1757 | 5929 | 355 | 1068 | 669 | 1.1e-65 |
| Protein name | | | | | Locus Name | Acc# |
| | | | | | sp:YRBG_ECOLI | P45394 |

Description
HYPOTHETICAL 34.7 KD PROTEIN IN MURA-RPON INTERGENIC REGION (O325)

| ORF Name | NTID | AAID | NT Length | AA Length | Score | Probability |
|---|---|---|---|---|---|---|
| 2033462_f2_473 | 1758 | 5930 | 219 | 660 | 482 | 7.4e-46 |
| Protein name | | | | | Locus Name | Acc# |
| | | | | | sp:YHHN_ECOLI | P37616 |

Description
HYPOTHETICAL 23.8 KD PROTEIN IN FTSY-NIKA INTERGENIC REGION (O208)

| ORF Name | NTID | AAID | NT Length | AA Length | Score | Probability |
|---|---|---|---|---|---|---|
| 203466_c1_883 | 1759 | 5931 | 73 | 222 | | |
| Protein name | | | | | Locus Name | Acc# |

Description
NO-HIT

| ORF Name | NTID | AAID | NT Length | AA Length | Score | Probability |
|---|---|---|---|---|---|---|
| 20397562_c2_1136 | 1760 | 5932 | 382 | 1149 | 1609 | 2.8e-165 |
| Protein name | | | | | Locus Name | Acc# |
| | | | | | sp:MBHT_ECOLI | Q46847 |

Description
(MEMBRANE-BOUND HYDROGENASE 2 SMALL SUBUNIT) (HYD2)

| ORF Name | NTID | AAID | NT Length | AA Length | Score | Probability |
|---|---|---|---|---|---|---|
| 20506510_f2_275 | 1761 | 5933 | 242 | 729 | 236 | 8.6e-20 |
| Protein name | | | | | Locus Name | Acc# |
| hypothetical protein | | | | | pir:B75429 | B75429 |

Description

| ORF Name | NTID | AAID | NT Length | AA Length | Score | Probability |
|---|---|---|---|---|---|---|
| 20506512_f3_562 | 1762 | 5934 | 173 | 522 | | |
| Protein name | | | | | Locus Name | Acc# |

Description
NO-HIT

| ORF Name | NTID | AAID | NT Length | AA Length | Score | Probability |
|---|---|---|---|---|---|---|
| 20525313_c3_1453 | 1763 | 5935 | 225 | 678 | 295 | 4.8e-26 |
| Protein name | | | | | Locus Name | Acc# |
| probable membrane protein yetF | | | | | pir:C69798 | C69798 |

Description

| ORF Name | NTID | AAID | NT Length | AA Length | Score | Probability |
|---|---|---|---|---|---|---|
| 20579150_c2_1024 | 1764 | 5936 | 233 | 702 | 952 | 1.2e-95 |
| Protein name | | | | | Locus Name | Acc# |
| | | | | | sp:NARI_ECOLI | P11350 |

Description
B-NR)

| ORF Name | NTID | AAID | NT Length | AA Length | Score | Probability |
|---|---|---|---|---|---|---|
| 20734651_f1_161 | 1765 | 5937 | 181 | 546 | 476 | 3.2e-45 |
| Protein name | | | | | Locus Name | Acc# |
| | | | | | sp:YJJX_ECOLI | P39411 |

Description
HYPOTHETICAL 18.6 KD PROTEIN IN TRPR-GPMB INTERGENIC REGION (F173)

| ORF Name | NTID | AAID | NT Length | AA Length | Score | Probability |
|---|---|---|---|---|---|---|
| 2087918_c1_941 | 1766 | 5938 | 582 | 1749 | 2036 | 1.6e-210 |
| Protein name | | | | | Locus Name | Acc# |
| | | | | | sp:MDLA_ECOLI | P77265:P30 |

Description
MULTIDRUG RESISTANCE-LIKE ATP-BINDING PROTEIN MDLA

| ORF Name | NTID | AAID | NT Length | AA Length | Score | Probability |
|---|---|---|---|---|---|---|
| 20898427_c2_1151 | 1767 | 5939 | 94 | 285 | | |
| Protein name | | | | | Locus Name | Acc# |

Description
NO-HIT

| ORF Name | NTID | AAID | NT Length | AA Length | Score | Probability |
|---|---|---|---|---|---|---|
| 20945262_f1_197 | 1768 | 5940 | 330 | 993 | 1270 | 2.3e-129 |
| Protein name | | | | | Locus Name | Acc# |
| | | | | | sp:YRBH_ECOLI | P45395 |

Description
HYPOTHETICAL 35.2 KD PROTEIN IN MURA-RPON INTERGENIC REGION (O328)

| ORF Name | NTID | AAID | NT Length | AA Length | Score | Probability |
|---|---|---|---|---|---|---|
| 20970900_c1_842 | 1769 | 5941 | 436 | 1311 | 1857 | 1.5e-191 |
| Protein name | | | | | Locus Name | Acc# |
| | | | | | sp:MURA_ENTCL | P33038 |

Description
TRANSFERASE) (EPT)

| ORF Name | NTID | AAID | NT Length | AA Length | Score | Probability |
|---|---|---|---|---|---|---|
| 20973436_f3_593 | 1770 | 5942 | 187 | 564 | 248 | 4.6e-21 |
| Protein name | | | | | Locus Name | Acc# |
| primosomal protein n'' precursor:primosomal replication protein N | | | | | pir:JQ1149 | JQ1149:PQ0 |

Description

| ORF Name | NTID | AAID | NT Length | AA Length | Score | Probability |
|---|---|---|---|---|---|---|
| 2120937_f2_422 | 1771 | 5943 | 676 | 2031 | 2080 | 3.4e-215 |
| Protein name | | | | | Locus Name | Acc# |
| | | | | | sp:FADH_ECOLI | P42593 |

Description
A REDUCTASE)

| ORF_Name | NTID | AAID | NT Length | AA Length | Score | Probability |
|---|---|---|---|---|---|---|
| 21485677_f1_2 | 1772 | 5944 | 509 | 1530 | 2641 | 1.2e-274 |
| Protein name | | | | | Locus Name | Acc# |
| metalloprotease | | | | | gp:PMU25950 | U25950 |

Description

Proteus mirabilis metalloprotease gene, complete cds.

| ORF_Name | NTID | AAID | NT Length | AA Length | Score | Probability |
|---|---|---|---|---|---|---|
| 21500878_c3_1447 | 1773 | 5945 | 391 | 1176 | 201 | 5.9e-16 |
| Protein name | | | | | Locus Name | Acc# |
| hypothetical protein TM0189 | | | | | pir:E72406 | E72406 |

Description

| ORF_Name | NTID | AAID | NT Length | AA Length | Score | Probability |
|---|---|---|---|---|---|---|
| 21509433_c3_1386 | 1774 | 5946 | 334 | 1005 | 1125 | 5.4e-114 |
| Protein name | | | | | Locus Name | Acc# |
| | | | | | sp:THIL_SALTY | P55881 |

Description

KINASE)

| ORF_Name | NTID | AAID | NT Length | AA Length | Score | Probability |
|---|---|---|---|---|---|---|
| 21640787_f2_352 | 1775 | 5947 | 324 | 975 | 1091 | 2.2e-110 |
| Protein name | | | | | Locus Name | Acc# |
| | | | | | sp:CYOA_ECOLI | P18400 |

Description

SUBUNIT 2)

| ORF_Name | NTID | AAID | NT Length | AA Length | Score | Probability |
|---|---|---|---|---|---|---|
| 21661311_f2_465 | 1776 | 5948 | 160 | 483 | 95 | 0.020 |
| Protein name | | | | | Locus Name | Acc# |
| mRNA maturase bI2:gene cob intron 2 protein | | | | | pir:S23208 | S23208 |

Description

| ORF Name | NTID | AAID | NT Length | AA Length | Score | Probability |
|---|---|---|---|---|---|---|
| 21681557_c2_1101 | 1777 | 5949 | 293 | 882 | 1117 | 3.8e-113 |
| Protein name | | | | | Locus Name | Acc# |
| | | | | | sp:YRAL_ECOLI | P45528 |

Description: HYPOTHETICAL 31.3 KD PROTEIN IN AGAI-MTR INTERGENIC REGION (F286)

| ORF Name | NTID | AAID | NT Length | AA Length | Score | Probability |
|---|---|---|---|---|---|---|
| 21688753_f2_462 | 1778 | 5950 | 63 | 192 | | |
| Protein name | | | | | Locus Name | Acc# |

Description: NO-HIT

| ORF Name | NTID | AAID | NT Length | AA Length | Score | Probability |
|---|---|---|---|---|---|---|
| 21726718_f2_384 | 1779 | 5951 | 306 | 921 | 1090 | 2.7e-110 |
| Protein name | | | | | Locus Name | Acc# |
| | | | | | gp:ECU73857 | U73857 |

Description: Escherichia coli chromosome minutes 6-8.

| ORF Name | NTID | AAID | NT Length | AA Length | Score | Probability |
|---|---|---|---|---|---|---|
| 21741265_c1_983 | 1780 | 5952 | 470 | 1413 | 1422 | 1.8e-145 |
| Protein name | | | | | Locus Name | Acc# |
| | | | | | sp:Y608_HAEIN | Q57486 |

Description: HYPOTHETICAL PROTEIN HI0608

| ORF Name | NTID | AAID | NT Length | AA Length | Score | Probability |
|---|---|---|---|---|---|---|
| 21915917_f3_581 | 1781 | 5953 | 231 | 696 | 487 | 2.2e-46 |
| Protein name | | | | | Locus Name | Acc# |
| | | | | | sp:DCUC_ECOLI | Q47134 |

Description: C4-DICARBOXYLATE ANAEROBIC CARRIER

| ORF_Name | NTID | AAID | NT Length | AA Length | Score | Probability |
|---|---|---|---|---|---|---|
| 21973311_f3_725 | 1782 | 5954 | 156 | 471 | 442 | 1.3e-41 |
| Protein name | | | | | Locus Name | Acc# |
| | | | | | sp:RNK_ECOLI | P40679 |

Description: REGULATOR OF NUCLEOSIDE DIPHOSPHATE KINASE

| ORF_Name | NTID | AAID | NT Length | AA Length | Score | Probability |
|---|---|---|---|---|---|---|
| 2202_c2_1162 | 1783 | 5955 | 111 | 336 | 425 | 8.1e-40 |
| Protein name | | | | | Locus Name | Acc# |
| | | | | | sp:YAJC_ECOLI | P19677 |

Description: HYPOTHETICAL 11.9 KD PROTEIN IN TGT-SECD INTERGENIC REGION (ORF12)

| ORF_Name | NTID | AAID | NT Length | AA Length | Score | Probability |
|---|---|---|---|---|---|---|
| 22046875_c1_939 | 1784 | 5956 | 635 | 1908 | 1301 | 1.2e-132 |
| Protein name | | | | | Locus Name | Acc# |
| | | | | | sp:CYPD_ECOLI | P77241 |

Description: (ROTAMASE D)

| ORF_Name | NTID | AAID | NT Length | AA Length | Score | Probability |
|---|---|---|---|---|---|---|
| 22150257_f3_601 | 1785 | 5957 | 292 | 879 | 953 | 9.0e-96 |
| Protein name | | | | | Locus Name | Acc# |
| acyl-CoA thiolesterase, II | | | | | pir:D64775 | D64775:JH0 |

Description:

| ORF_Name | NTID | AAID | NT Length | AA Length | Score | Probability |
|---|---|---|---|---|---|---|
| 22150277_c1_891 | 1786 | 5958 | 568 | 1707 | 2208 | 9.3e-229 |
| Protein name | | | | | Locus Name | Acc# |
| hydrogenase, 2 large chain:hybC protein | | | | | pir:C55516 | C55516:H65 |

Description:

446

| ORF Name | NTID | AAID | NT Length | AA Length | Score | Probability |
|---|---|---|---|---|---|---|
| 2225662_f3_579 | 1787 | 5959 | 424 | 1275 | 1029 | 8.0e-104 |
| Protein name | | | | | Locus Name | Acc# |
| | | | | | sp:Y4OU_RHISN | P55606 |

Description
HYPOTHETICAL PROTEIN Y4OU PRECURSOR

| ORF Name | NTID | AAID | NT Length | AA Length | Score | Probability |
|---|---|---|---|---|---|---|
| 22297302_f3_630 | 1788 | 5960 | 106 | 321 | | |
| Protein name | | | | | Locus Name | Acc# |

Description
NO-HIT

| ORF Name | NTID | AAID | NT Length | AA Length | Score | Probability |
|---|---|---|---|---|---|---|
| 22384652_f2_316 | 1789 | 5961 | 347 | 1044 | 1443 | 1.1e-147 |
| Protein name | | | | | Locus Name | Acc# |
| | | | | | sp:AFUC_ECOLI | P37009:P77 |

Description
PUTATIVE FERRIC TRANSPORT ATP-BINDING PROTEIN AFUC

| ORF Name | NTID | AAID | NT Length | AA Length | Score | Probability |
|---|---|---|---|---|---|---|
| 22397902_c3_1278 | 1790 | 5962 | 410 | 1233 | 1578 | 5.3e-162 |
| Protein name | | | | | Locus Name | Acc# |
| | | | | | sp:GLPC_ECOLI | P13034:P77 |

Description
DEHYDROGENASE)

| ORF Name | NTID | AAID | NT Length | AA Length | Score | Probability |
|---|---|---|---|---|---|---|
| 2243806_f3_566 | 1791 | 5963 | 160 | 483 | 476 | 3.2e-45 |
| Protein name | | | | | Locus Name | Acc# |
| transposase homolog A | | | | | gp:HPU95957 | U95957 |

Description
Helicobacter pylori insertion sequence IS606 transposase homologs A(tnpA) and B (tnpB) genes, complete cds.

| ORF Name | NTID | AAID | NT Length | AA Length | Score | Probability |
|---|---|---|---|---|---|---|
| 22447305_f2_370 | 1792 | 5964 | 212 | 639 | 554 | 1.7e-53 |
| Protein name | | | | | Locus Name | Acc# |
| | | | | | sp:YAJB_ECOLI | P21515:P46 |

Description: HYPOTHETICAL 23.0 KD PROTEIN IN MALZ-QUEA INTERGENIC REGION (ORF 14)

| ORF Name | NTID | AAID | NT Length | AA Length | Score | Probability |
|---|---|---|---|---|---|---|
| 22455386_f1_125 | 1793 | 5965 | 71 | 216 | | |
| Protein name | | | | | Locus Name | Acc# |

Description: NO-HIT

| ORF Name | NTID | AAID | NT Length | AA Length | Score | Probability |
|---|---|---|---|---|---|---|
| 22459700_c1_811 | 1794 | 5966 | 445 | 1338 | 994 | 4.1e-100 |
| Protein name | | | | | Locus Name | Acc# |
| | | | | | sp:GLPB_ECOLI | P13033 |

Description: (G-3-P DEHYDROGENASE)

| ORF Name | NTID | AAID | NT Length | AA Length | Score | Probability |
|---|---|---|---|---|---|---|
| 22462760_c2_1141 | 1795 | 5967 | 340 | 1023 | 1151 | 9.4e-117 |
| Protein name | | | | | Locus Name | Acc# |
| | | | | | sp:HYPE_ECOLI | P24193:Q46 |

Description: HYDROGENASE ISOENZYMES FORMATION PROTEIN HYPE

| ORF Name | NTID | AAID | NT Length | AA Length | Score | Probability |
|---|---|---|---|---|---|---|
| 22462777_c3_1417 | 1796 | 5968 | 181 | 546 | 737 | 7.0e-73 |
| Protein name | | | | | Locus Name | Acc# |
| hypoxanthine phosphoribosyltransferase | | | | | gp:AF008931 | AF008931 |

Description: Salmonella typhimurium hypoxanthine phosphoribosyltransferase(hprt) gene, complete cds.

| ORF Name | NTID | AAID | NT Length | AA Length | Score | Probability |
|---|---|---|---|---|---|---|
| 22478930_f3_555 | 1797 | 5969 | 521 | 1566 | 726 | 1.0e-71 |
| Protein name | | | | | Locus Name | Acc# |
| | | | | | sp:UHPB_ECOLI | P09835:P76 |

Description
SENSOR PROTEIN UHPB,

| ORF Name | NTID | AAID | NT Length | AA Length | Score | Probability |
|---|---|---|---|---|---|---|
| 22692151_f3_773 | 1798 | 5970 | 565 | 1698 | 1490 | 1.1e-152 |
| Protein name | | | | | Locus Name | Acc# |
| | | | | | sp:YHJW_ECOLI | P37661 |

Description
64.9 KD PROTEIN IN PROK-TAG INTERGENIC REGION

| ORF Name | NTID | AAID | NT Length | AA Length | Score | Probability |
|---|---|---|---|---|---|---|
| 22714061_c3_1456 | 1799 | 5971 | 198 | 597 | 481 | 9.4e-46 |
| Protein name | | | | | Locus Name | Acc# |
| | | | | | gp:PMFIMOPR | Z32686 |

Description
Proteus mirabilis fimbrial operon, strain HI4320.

| ORF Name | NTID | AAID | NT Length | AA Length | Score | Probability |
|---|---|---|---|---|---|---|
| 22735842_c2_1085 | 1800 | 5972 | 390 | 1173 | 1223 | 2.2e-124 |
| Protein name | | | | | Locus Name | Acc# |
| | | | | | sp:YHCM_ECOLI | P46442 |

Description
HYPOTHETICAL 43.1 KD PROTEIN IN RPLM-HHOA INTERGENIC REGION (F375)

| ORF Name | NTID | AAID | NT Length | AA Length | Score | Probability |
|---|---|---|---|---|---|---|
| 22775342_f2_390 | 1801 | 5973 | 398 | 1197 | 1282 | 1.2e-130 |
| Protein name | | | | | Locus Name | Acc# |
| | | | | | sp:METC_ECOLI | P06721 |

Description
(CYSTEINE LYASE)

449

| ORF Name | NTID | AAID | NT Length | AA Length | Score | Probability |
|---|---|---|---|---|---|---|
| 22828133_c3_1328 | 1802 | 5974 | 446 | 1341 | 1476 | 3.4e-151 |
| Protein name | | | | | Locus Name | Acc# |
| | | | | | sp:YGJU_ECOLI | P42602 |

Description

HYPOTHETICAL 43.5 KD PROTEIN IN EBGC-UXAA INTERGENIC REGION (O414)

| ORF Name | NTID | AAID | NT Length | AA Length | Score | Probability |
|---|---|---|---|---|---|---|
| 22864711_f1_103 | 1803 | 5975 | 341 | 1026 | 1167 | 1.9e-118 |
| Protein name | | | | | Locus Name | Acc# |
| ribose operon repressor | | | | | pir:B65179 | B65179:A41 |

Description

| ORF Name | NTID | AAID | NT Length | AA Length | Score | Probability |
|---|---|---|---|---|---|---|
| 22916533_f3_613 | 1804 | 5976 | 672 | 2019 | 3033 | 0.0 |
| Protein name | | | | | Locus Name | Acc# |
| | | | | | sp:CYOB_ECOLI | P18401 |

Description (OXIDASE BO(3) SUBUNIT 1) (CYTOCHROME O UBIQUINOL OXIDASE SUBUNIT 1)

| ORF Name | NTID | AAID | NT Length | AA Length | Score | Probability |
|---|---|---|---|---|---|---|
| 22929817_c3_1358 | 1805 | 5977 | 72 | 219 | | |
| Protein name | | | | | Locus Name | Acc# |

Description

NO-HIT

| ORF Name | NTID | AAID | NT Length | AA Length | Score | Probability |
|---|---|---|---|---|---|---|
| 23468781_f1_46 | 1806 | 5978 | 248 | 747 | 749 | 3.7e-74 |
| Protein name | | | | | Locus Name | Acc# |
| | | | | | sp:SFSA_ECOLI | P18273 |

Description

SUGAR FERMENTATION STIMULATION PROTEIN

450

| ORF Name | NTID | AAID | NT Length | AA Length | Score | Probability |
|---|---|---|---|---|---|---|
| 23475192_f3_507 | 1807 | 5979 | 670 | 2013 | 1442 | 1.4e-147 |
| Protein name | | | | | Locus Name | Acc# |
| ZapE | | | | | gp:AF064762 | AF064762 |

Description
Proteus mirabilis metalloprotease operon, complete sequence.

| ORF Name | NTID | AAID | NT Length | AA Length | Score | Probability |
|---|---|---|---|---|---|---|
| 23494160_c1_838 | 1808 | 5980 | 260 | 783 | 1087 | 5.7e-110 |
| Protein name | | | | | Locus Name | Acc# |
| | | | | | sp:YRBE_ECOLI | P45392 |

Description
HYPOTHETICAL 27.9 KD PROTEIN IN MURA-RPON INTERGENIC REGION (F260)

| ORF Name | NTID | AAID | NT Length | AA Length | Score | Probability |
|---|---|---|---|---|---|---|
| 23540880_f2_336 | 1809 | 5981 | 1053 | 3162 | 4097 | 0.0 |
| Protein name | | | | | Locus Name | Acc# |
| | | | | | sp:ACRB_ECOLI | P31224 |

Description
ACRIFLAVIN RESISTANCE PROTEIN B

| ORF Name | NTID | AAID | NT Length | AA Length | Score | Probability |
|---|---|---|---|---|---|---|
| 23548452_c1_959 | 1810 | 5982 | 299 | 900 | 267 | 4.5e-23 |
| Protein name | | | | | Locus Name | Acc# |
| D-2-hydroxyisocaproate dehydrogenase (DDH) | | | | | gp:D87976 | D87976 |

Description
Brevibacterium lactofermentum DNA for D-2-hydroxyisocaproatedehydrogenase (ddh), complete cds.

| ORF Name | NTID | AAID | NT Length | AA Length | Score | Probability |
|---|---|---|---|---|---|---|
| 23595750_f3_621 | 1811 | 5983 | 320 | 963 | 972 | 8.8e-98 |
| Protein name | | | | | Locus Name | Acc# |
| | | | | | sp:RBSK_ECOLI | P05054 |

Description
RIBOKINASE,

| ORF Name | NTID | AAID | NT Length | AA Length | Score | Probability |
|---|---|---|---|---|---|---|
| 23600306_c2_1143 | 1812 | 5984 | 658 | 1977 | 2473 | 7.7e-257 |
| Protein name | | | | | Locus Name | Acc# |
| | | | | | sp:CN16_YEREN | P53052 |

Description

2',3'-CYCLIC-NUCLEOTIDE 2'-PHOSPHODIESTERASE PRECURSOR,

| ORF Name | NTID | AAID | NT Length | AA Length | Score | Probability |
|---|---|---|---|---|---|---|
| 23602137_c2_1155 | 1813 | 5985 | 61 | 186 | | |
| Protein name | | | | | Locus Name | Acc# |

Description

NO-HIT

| ORF Name | NTID | AAID | NT Length | AA Length | Score | Probability |
|---|---|---|---|---|---|---|
| 23613518_f2_433 | 1814 | 5986 | 1495 | 4488 | 6036 | 0.0 |
| Protein name | | | | | Locus Name | Acc# |
| | | | | | sp:GLTB_ECOLI | P09831 |

Description (GLUTAMATE SYNTHASE ALPHA SUBUNIT) (NADPH-GOGAT) (GLTS ALPHA CHAIN)

| ORF Name | NTID | AAID | NT Length | AA Length | Score | Probability |
|---|---|---|---|---|---|---|
| 23614077_c3_1368 | 1815 | 5987 | 540 | 1623 | 969 | 1.8e-97 |
| Protein name | | | | | Locus Name | Acc# |
| probable 5'-nucleotidase | | | | | pir:F75511 | F75511 |

Description

| ORF Name | NTID | AAID | NT Length | AA Length | Score | Probability |
|---|---|---|---|---|---|---|
| 23626305_c2_1106 | 1816 | 5988 | 161 | 486 | 130 | 4.5e-08 |
| Protein name | | | | | Locus Name | Acc# |
| hypothetical protein Rv3005c | | | | | pir:H70855 | H70855 |

Description

| ORF_Name | NTID | AAID | NT Length | AA Length | Score | Probability |
|---|---|---|---|---|---|---|
| 23628806_c2_1147 | 1817 | 5989 | 455 | 1368 | 1600 | 2.5e-164 |
| Protein name | | | | | Locus Name | Acc# |
| | | | | | sp:BRNQ_ECOLI | P37011:P77 |

Description: (LIV-II)

| ORF_Name | NTID | AAID | NT Length | AA Length | Score | Probability |
|---|---|---|---|---|---|---|
| 23635305_f1_69 | 1818 | 5990 | 494 | 1485 | 832 | 6.0e-83 |
| Protein name | | | | | Locus Name | Acc# |
| conserved hypothetical protein yisQ | | | | | pir:H69837 | H69837 |

Description:

| ORF_Name | NTID | AAID | NT Length | AA Length | Score | Probability |
|---|---|---|---|---|---|---|
| 23649011_c3_1409 | 1819 | 5991 | 674 | 2025 | 2051 | 4.0e-212 |
| Protein name | | | | | Locus Name | Acc# |
| | | | | | sp:DP3X_SALTY | P74876:P74 |

Description:

| ORF_Name | NTID | AAID | NT Length | AA Length | Score | Probability |
|---|---|---|---|---|---|---|
| 23673375_f2_276 | 1820 | 5992 | 61 | 186 | | |
| Protein name | | | | | Locus Name | Acc# |

Description: NO-HIT

| ORF_Name | NTID | AAID | NT Length | AA Length | Score | Probability |
|---|---|---|---|---|---|---|
| 23862500_c3_1451 | 1821 | 5993 | 158 | 477 | 477 | 2.5e-45 |
| Protein name | | | | | Locus Name | Acc# |
| MoaI protein | | | | | gp:KPNMOAIP | D63524 |

Description: Klebsiella aerogenes moaI gene for MoaI protein, complete cds.

| ORF Name | NTID | AAID | NT Length | AA Length | Score | Probability |
|---|---|---|---|---|---|---|
| 23886692_c1_911 | 1822 | 5994 | 77 | 234 | | |
| Protein name | | | | | Locus Name | Acc# |

Description
NO-HIT

| ORF Name | NTID | AAID | NT Length | AA Length | Score | Probability |
|---|---|---|---|---|---|---|
| 23937706_c2_1084 | 1823 | 5995 | 359 | 1080 | 99 | 0.029 |
| Protein name | | | | | Locus Name | Acc# |
| cytochrome-c oxidase, chain III | | | | | pir:S36953 | S36953 |

Description

| ORF Name | NTID | AAID | NT Length | AA Length | Score | Probability |
|---|---|---|---|---|---|---|
| 23939086_c1_1004 | 1824 | 5996 | 190 | 573 | 925 | 8.4e-93 |
| Protein name | | | | | Locus Name | Acc# |
| | | | | | gp:PMFIMOPR | Z32686 |

Description
Proteus mirabilis fimbrial operon, strain HI4320.

| ORF Name | NTID | AAID | NT Length | AA Length | Score | Probability |
|---|---|---|---|---|---|---|
| 23985750_f1_167 | 1825 | 5997 | 950 | 2853 | 734 | 1.5e-72 |
| Protein name | | | | | Locus Name | Acc# |
| | | | | | sp:PQQL_HAEIN | P45181 |

Description
PROBABLE ZINC PROTEASE PQQL,

| ORF Name | NTID | AAID | NT Length | AA Length | Score | Probability |
|---|---|---|---|---|---|---|
| 24017762_f2_434 | 1826 | 5998 | 70 | 213 | 71 | 0.045 |
| Protein name | | | | | Locus Name | Acc# |
| hypothetical protein PH1997 | | | | | pir:E71216 | E71216 |

Description

| ORF Name | NTID | AAID | NT Length | AA Length | Score | Probability |
|---|---|---|---|---|---|---|
| 24018930_f3_509 | 1827 | 5999 | 329 | 990 | 1568 | 6.1e-161 |
| Protein name | | | | | Locus Name | Acc# |
| ZapC | | | | | gp:AF064762 | AF064762 |

Description
Proteus mirabilis metalloprotease operon, complete sequence.

| ORF Name | NTID | AAID | NT Length | AA Length | Score | Probability |
|---|---|---|---|---|---|---|
| 24039067_f2_338 | 1828 | 6000 | 71 | 216 | 313 | 6.0e-28 |
| Protein name | | | | | Locus Name | Acc# |
| | | | | | sp:YMOA_YEREN | P27720 |

Description
MODULATING PROTEIN YMOA (HISTONE-LIKE PROTEIN)

| ORF Name | NTID | AAID | NT Length | AA Length | Score | Probability |
|---|---|---|---|---|---|---|
| 24040812_f3_536 | 1829 | 6001 | 85 | 258 | | |
| Protein name | | | | | Locus Name | Acc# |

Description
NO-HIT

| ORF Name | NTID | AAID | NT Length | AA Length | Score | Probability |
|---|---|---|---|---|---|---|
| 24068807_f3_564 | 1830 | 6002 | 83 | 252 | | |
| Protein name | | | | | Locus Name | Acc# |

Description
NO-HIT

| ORF Name | NTID | AAID | NT Length | AA Length | Score | Probability |
|---|---|---|---|---|---|---|
| 24105062_f2_481 | 1831 | 6003 | 364 | 1095 | 1432 | 1.6e-146 |
| Protein name | | | | | Locus Name | Acc# |
| | | | | | sp:GLPQ_ECOLI | P09394 |

Description
(EC 3.1.4.46) (GLYCEROPHOSPHODIESTER PHOSPHODIESTERASE)

| ORF Name | NTID | AAID | NT Length | AA Length | Score | Probability |
|---|---|---|---|---|---|---|
| 24120265_c3_1416 | 1832 | 6004 | 600 | 1803 | 139 | 9.3e-06 |
| Protein name | | | | | Locus Name | Acc# |
| P75 protein | | | | | gp:MHO243901 | AJ243901 |

Description

Mycoplasma hominis p75 gene, strain PG21.

| ORF Name | NTID | AAID | NT Length | AA Length | Score | Probability |
|---|---|---|---|---|---|---|
| 24219828_c3_1439 | 1833 | 6005 | 71 | 216 | | |
| Protein name | | | | | Locus Name | Acc# |

Description

NO-HIT

| ORF Name | NTID | AAID | NT Length | AA Length | Score | Probability |
|---|---|---|---|---|---|---|
| 24251887_c3_1415 | 1834 | 6006 | 224 | 675 | 230 | 3.7e-19 |
| Protein name | | | | | Locus Name | Acc# |
| hypothetical protein SCF43A.12c | | | | | pir:T36435 | T36435 |

Description

| ORF Name | NTID | AAID | NT Length | AA Length | Score | Probability |
|---|---|---|---|---|---|---|
| 24256465_f1_37 | 1835 | 6007 | 61 | 186 | | |
| Protein name | | | | | Locus Name | Acc# |

Description

NO-HIT

| ORF Name | NTID | AAID | NT Length | AA Length | Score | Probability |
|---|---|---|---|---|---|---|
| 24260327_c2_1180 | 1836 | 6008 | 595 | 1788 | 1913 | 1.7e-197 |
| Protein name | | | | | Locus Name | Acc# |
| | | | | | sp:MDLB_ECOLI | P75706:P30 |

Description

MULTIDRUG RESISTANCE-LIKE ATP-BINDING PROTEIN MDLB

| ORF Name | NTID | AAID | NT Length | AA Length | Score | Probability |
|---|---|---|---|---|---|---|
| 24298125_c1_964 | 1837 | 6009 | 533 | 1602 | 1732 | 2.6e-178 |
| Protein name | | | | | Locus Name | Acc# |
| | | | | | sp:YACK_ECOLI | P36649:P75 |

Description: PROBABLE BLUE-COPPER PROTEIN YACK PRECURSOR

| ORF Name | NTID | AAID | NT Length | AA Length | Score | Probability |
|---|---|---|---|---|---|---|
| 24305282_f1_251 | 1838 | 6010 | 617 | 1854 | 1411 | 2.6e-144 |
| Protein name | | | | | Locus Name | Acc# |
| | | | | | gp:YP102KB | AL031866 |

Description: Yersinia pestis 102 kbases unstable region: from 1 to 119443.

| ORF Name | NTID | AAID | NT Length | AA Length | Score | Probability |
|---|---|---|---|---|---|---|
| 24319442_f3_768 | 1839 | 6011 | 272 | 819 | 1336 | 2.3e-136 |
| Protein name | | | | | Locus Name | Acc# |
| fumarate reductase, iron-sulfur protein:fumarate reductase chain B:succinate | | | | | pir:RDEBIV | S00108 |

Description:

| ORF Name | NTID | AAID | NT Length | AA Length | Score | Probability |
|---|---|---|---|---|---|---|
| 24353426_c3_1286 | 1840 | 6012 | 613 | 1842 | 1462 | 1.0e-149 |
| Protein name | | | | | Locus Name | Acc# |
| | | | | | sp:FTSY_ECOLI | P10121 |

Description: CELL DIVISION PROTEIN FTSY

| ORF Name | NTID | AAID | NT Length | AA Length | Score | Probability |
|---|---|---|---|---|---|---|
| 24391627_c3_1411 | 1841 | 6013 | 659 | 1980 | 3083 | 0.0 |
| Protein name | | | | | Locus Name | Acc# |
| | | | | | sp:YJIY_ECOLI | P39396 |

Description: HYPOTHETICAL 77.9 KD PROTEIN IN MRR-TSR INTERGENIC REGION

| ORF Name | NTID | AAID | NT Length | AA Length | Score | Probability |
|---|---|---|---|---|---|---|
| 24407756_f2_313 | 1842 | 6014 | 214 | 645 | 473 | 6.6e-45 |
| Protein name | | | | | Locus Name | Acc# |
| | | | | | sp:UHPA_SALTY | P27667 |

Description
TRANSCRIPTIONAL REGULATORY PROTEIN UHPA

| ORF Name | NTID | AAID | NT Length | AA Length | Score | Probability |
|---|---|---|---|---|---|---|
| 24408137_f2_273 | 1843 | 6015 | 62 | 189 | | |
| Protein name | | | | | Locus Name | Acc# |

Description
NO-HIT

| ORF Name | NTID | AAID | NT Length | AA Length | Score | Probability |
|---|---|---|---|---|---|---|
| 24412802_c2_1208 | 1844 | 6016 | 103 | 312 | | |
| Protein name | | | | | Locus Name | Acc# |

Description
NO-HIT

| ORF Name | NTID | AAID | NT Length | AA Length | Score | Probability |
|---|---|---|---|---|---|---|
| 24412962_c3_1423 | 1845 | 6017 | 150 | 453 | 230 | 8.9e-19 |
| Protein name | | | | | Locus Name | Acc# |
| | | | | | sp:YHHZ_ECOLI | P46855 |

Description
HYPOTHETICAL 44.2 KD PROTEIN IN GNTR-GGT INTERGENIC REGION (O392)

| ORF Name | NTID | AAID | NT Length | AA Length | Score | Probability |
|---|---|---|---|---|---|---|
| 24413405_f3_778 | 1846 | 6018 | 153 | 462 | 303 | 6.8e-27 |
| Protein name | | | | | Locus Name | Acc# |
| unknown | | | | | gp:AF114793 | AF114793 |

Description
Vitreoscilla sp. YciB homolog, putative transcriptional activator, putative outer membrane protein, BioA homolog, and glutaminesynthetase homolog genes, complete cds; and unknown genes.

| ORF Name | NTID | AAID | NT Length | AA Length | Score | Probability |
|---|---|---|---|---|---|---|
| 24414702_c2_1082 | 1847 | 6019 | 102 | 309 | 183 | 3.6e-14 |

| Protein name | | | | | Locus Name | Acc# |
|---|---|---|---|---|---|---|
| | | | | | sp:YRBB_ECOLI | P45389 |

Description
HYPOTHETICAL 14.4 KD PROTEIN IN MURA-RPON INTERGENIC REGION (F129)

| ORF Name | NTID | AAID | NT Length | AA Length | Score | Probability |
|---|---|---|---|---|---|---|
| 24415877_c3_1343 | 1848 | 6020 | 328 | 987 | 513 | 3.8e-49 |

| Protein name | | | | | Locus Name | Acc# |
|---|---|---|---|---|---|---|
| | | | | | sp:YBEQ_ECOLI | P77234 |

Description
HYPOTHETICAL 37.3 KD PROTEIN IN LEUS-GLTL INTERGENIC REGION

| ORF Name | NTID | AAID | NT Length | AA Length | Score | Probability |
|---|---|---|---|---|---|---|
| 24422817_f2_354 | 1849 | 6021 | 212 | 639 | 819 | 1.4e-81 |

| Protein name | | | | | Locus Name | Acc# |
|---|---|---|---|---|---|---|
| | | | | | sp:CYOC_ECOLI | P18402 |

Description
CYTOCHROME O UBIQUINOL OXIDASE SUBUNIT III,

| ORF Name | NTID | AAID | NT Length | AA Length | Score | Probability |
|---|---|---|---|---|---|---|
| 24430192_f3_550 | 1850 | 6022 | 280 | 843 | 671 | 6.9e-66 |

| Protein name | | | | | Locus Name | Acc# |
|---|---|---|---|---|---|---|
| | | | | | sp:YADT_ECOLI | P37028:P77 |

Description
HYPOTHETICAL 29.4 KD PROTEIN IN HEML-PFS INTERGENIC REGION PRECURSOR

| ORF Name | NTID | AAID | NT Length | AA Length | Score | Probability |
|---|---|---|---|---|---|---|
| 24486018_c1_1002 | 1851 | 6023 | 197 | 594 | 442 | 1.3e-41 |

| Protein name | | | | | Locus Name | Acc# |
|---|---|---|---|---|---|---|
| | | | | | gp:PMFIMOPR | Z32686 |

Description
Proteus mirabilis fimbrial operon, strain HI4320.

| ORF Name | NTID | AAID | NT Length | AA Length | Score | Probability |
|---|---|---|---|---|---|---|
| 24625462_f3_557 | 1852 | 6024 | 347 | 1044 | 1253 | 1.5e-127 |
| Protein name | | | | | Locus Name | Acc# |
| | | | | | sp:Y131_HAEIN | P43951 |

Description: HYPOTHETICAL PROTEIN HI0131 PRECURSOR

| ORF Name | NTID | AAID | NT Length | AA Length | Score | Probability |
|---|---|---|---|---|---|---|
| 24634502_f1_68 | 1853 | 6025 | 299 | 900 | 1004 | 3.6e-101 |
| Protein name | | | | | Locus Name | Acc# |
| | | | | | sp:Y40V_RHISN | P55607 |

Description: HYPOTHETICAL 30.2 KD PROTEIN Y40V

| ORF Name | NTID | AAID | NT Length | AA Length | Score | Probability |
|---|---|---|---|---|---|---|
| 24640943_c1_1009 | 1854 | 6026 | 550 | 1653 | 1120 | 1.8e-113 |
| Protein name | | | | | Locus Name | Acc# |
| melittin resistance protein PqaB | | | | | gp:AF071082 | AF071082 |

Description: Salmonella typhi melittin resistance protein PqaB (pqaB) gene, complete cds; and unknown genes.

| ORF Name | NTID | AAID | NT Length | AA Length | Score | Probability |
|---|---|---|---|---|---|---|
| 24642178_f2_289 | 1855 | 6027 | 193 | 582 | 193 | 3.1e-15 |
| Protein name | | | | | Locus Name | Acc# |
| citrate lyase, beta subunit | | | | | pir:E75303 | E75303 |

Description:

| ORF Name | NTID | AAID | NT Length | AA Length | Score | Probability |
|---|---|---|---|---|---|---|
| 24647200_f2_469 | 1856 | 6028 | 252 | 759 | 816 | 3.0e-81 |
| Protein name | | | | | Locus Name | Acc# |
| | | | | | sp:YGGG_ECOLI | P25894:P76 |

Description: (O294)

| ORF Name | NTID | AAID | NT Length | AA Length | Score | Probability |
|---|---|---|---|---|---|---|
| 24648438_c2_1094 | 1857 | 6029 | 569 | 1710 | 2967 | 0.0 |
| Protein name | | | | | Locus Name | Acc# |
| | | | | | sp:URE1_PROMI | P17086 |

Description
UREASE ALPHA SUBUNIT, (UREA AMIDOHYDROLASE)

| ORF Name | NTID | AAID | NT Length | AA Length | Score | Probability |
|---|---|---|---|---|---|---|
| 24650087_c2_1025 | 1858 | 6030 | 148 | 447 | 596 | 6.1e-58 |
| Protein name | | | | | Locus Name | Acc# |
| | | | | | sp:FDHF_ECOLI | P07658:P78 |

Description
SUBUNIT) (FDH-H)

| ORF Name | NTID | AAID | NT Length | AA Length | Score | Probability |
|---|---|---|---|---|---|---|
| 24710925_c3_1258 | 1859 | 6031 | 62 | 189 | | |
| Protein name | | | | | Locus Name | Acc# |

Description
NO-HIT

| ORF Name | NTID | AAID | NT Length | AA Length | Score | Probability |
|---|---|---|---|---|---|---|
| 24806575_c1_879 | 1860 | 6032 | 172 | 519 | 588 | 4.3e-57 |
| Protein name | | | | | Locus Name | Acc# |
| | | | | | sp:LSPA_ENTAE | P13514 |

Description
PEPTIDASE) (SIGNAL PEPTIDASE II) (SPASE II)

| ORF Name | NTID | AAID | NT Length | AA Length | Score | Probability |
|---|---|---|---|---|---|---|
| 24882802_f1_218 | 1861 | 6033 | 440 | 1323 | 1144 | 5.2e-116 |
| Protein name | | | | | Locus Name | Acc# |
| glycerol-3-phosphate-binding protein precursor:ugpB protein | | | | | pir:JGECGP | S47672:H65 |

Description

| ORF Name | NTID | AAID | NT Length | AA Length | Score | Probability |
|---|---|---|---|---|---|---|
| 24883412_f1_100 | 1862 | 6034 | 211 | 636 | 615 | 5.9e-60 |
| Protein name | | | | | Locus Name | Acc# |
| | | | | | sp:THIJ_ECOLI | Q46948 |

Description: ENZYME

| ORF Name | NTID | AAID | NT Length | AA Length | Score | Probability |
|---|---|---|---|---|---|---|
| 24897003_c3_1364 | 1863 | 6035 | 413 | 1242 | 1736 | 9.6e-179 |
| Protein name | | | | | Locus Name | Acc# |
| | | | | | sp:YEDE_ECOLI | P31064 |

Description: HYPOTHETICAL 44.4 KD PROTEIN IN AMYA-FLIE INTERGENIC REGION (ORF 48)

| ORF Name | NTID | AAID | NT Length | AA Length | Score | Probability |
|---|---|---|---|---|---|---|
| 24901551_c3_1385 | 1864 | 6036 | 142 | 429 | 542 | 3.2e-52 |
| Protein name | | | | | Locus Name | Acc# |
| | | | | | sp:NUSB_ECOLI | P04381 |

Description: N UTILIZATION SUBSTANCE PROTEIN B (NUSB PROTEIN)

| ORF Name | NTID | AAID | NT Length | AA Length | Score | Probability |
|---|---|---|---|---|---|---|
| 2509807_f2_366 | 1865 | 6037 | 65 | 198 | | |
| Protein name | | | | | Locus Name | Acc# |

Description: NO-HIT

| ORF Name | NTID | AAID | NT Length | AA Length | Score | Probability |
|---|---|---|---|---|---|---|
| 2516637_f1_93 | 1866 | 6038 | 64 | 195 | | |
| Protein name | | | | | Locus Name | Acc# |

Description: NO-HIT

| ORF Name | NTID | AAID | NT Length | AA Length | Score | Probability |
|---|---|---|---|---|---|---|
| 25448500_c2_1127 | 1867 | 6039 | 199 | 600 | 843 | 4.1e-84 |
| Protein name | | | | | Locus Name | Acc# |
| | | | | | sp:MOG_ECOLI | P28694 |

Description
MOLYBDOPTERIN BIOSYNTHESIS MOG PROTEIN

| ORF Name | NTID | AAID | NT Length | AA Length | Score | Probability |
|---|---|---|---|---|---|---|
| 25478437_f2_277 | 1868 | 6040 | 173 | 522 | 569 | 4.4e-55 |
| Protein name | | | | | Locus Name | Acc# |
| HpaC | | | | | gp:AF144422 | AF144422 |

Description
Salmonella dublin 4-hydroxyphenylacetate catabolic locus, completesequence.

| ORF Name | NTID | AAID | NT Length | AA Length | Score | Probability |
|---|---|---|---|---|---|---|
| 25525308_c1_847 | 1869 | 6041 | 131 | 396 | 602 | 1.4e-58 |
| Protein name | | | | | Locus Name | Acc# |
| ribosomal protein S9:30S ribosomal subunit protein S9 | | | | | pir:R3EC9 | H65114:I77 |

Description

| ORF Name | NTID | AAID | NT Length | AA Length | Score | Probability |
|---|---|---|---|---|---|---|
| 25548387_c1_789 | 1870 | 6042 | 425 | 1278 | 934 | 9.3e-94 |
| Protein name | | | | | Locus Name | Acc# |
| hypothetical protein HI1728 | | | | | pir:G64138 | G64138 |

Description

| ORF Name | NTID | AAID | NT Length | AA Length | Score | Probability |
|---|---|---|---|---|---|---|
| 25582540_c2_1212 | 1871 | 6043 | 824 | 2475 | 2239 | 4.8e-232 |
| Protein name | | | | | Locus Name | Acc# |
| ATP-dependent helicase hrpB | | | | | pir:D64738 | D64738:S45 |

Description

| ORF Name | NTID | AAID | NT Length | AA Length | Score | Probability |
|---|---|---|---|---|---|---|
| 25587780_f2_355 | 1872 | 6044 | 457 | 1374 | 1497 | 2.0e-153 |
| Protein name | | | | | Locus Name | Acc# |
| | | | | | sp:YAJR_ECOLI | P77726 |

Description

HYPOTHETICAL 49.0 KD PROTEIN IN ABPA-CYOE INTERGENIC REGION

| ORF Name | NTID | AAID | NT Length | AA Length | Score | Probability |
|---|---|---|---|---|---|---|
| 25632683_c2_1047 | 1873 | 6045 | 144 | 435 | 173 | 4.1e-13 |
| Protein name | | | | | Locus Name | Acc# |
| | | | | | sp:YHHM_ECOLI | P37615 |

Description

HYPOTHETICAL 13.5 KD PROTEIN IN FTSY-NIKA INTERGENIC REGION (F119)

| ORF Name | NTID | AAID | NT Length | AA Length | Score | Probability |
|---|---|---|---|---|---|---|
| 25665932_c2_1215 | 1874 | 6046 | 115 | 348 | 556 | 1.1e-53 |
| Protein name | | | | | Locus Name | Acc# |
| | | | | | sp:YADR_ECOLI | P37026 |

Description

HYPOTHETICAL 12.1 KD PROTEIN IN HEML-PFS INTERGENIC REGION

| ORF Name | NTID | AAID | NT Length | AA Length | Score | Probability |
|---|---|---|---|---|---|---|
| 25667777_c1_882 | 1875 | 6047 | 1080 | 3243 | 5040 | 0.0 |
| Protein name | | | | | Locus Name | Acc# |
| carbamoylphosphate synthetase large subunit | | | | | gp:STU81260 | U81260:X13 |

Description

Salmonella typhimurium carbamoylphosphate synthetase small subunit(carA) and carbamoylphosphate synthetase large subunit (carB)genes, complete cds.

| ORF Name | NTID | AAID | NT Length | AA Length | Score | Probability |
|---|---|---|---|---|---|---|
| 25896956_c1_797 | 1876 | 6048 | 177 | 534 | 740 | 3.4e-73 |
| Protein name | | | | | Locus Name | Acc# |
| | | | | | sp:NARK_ECOLI | P10903 |

Description

NITRITE EXTRUSION PROTEIN 1 (NITRITE FACILITATOR 1)

| ORF Name | NTID | AAID | NT Length | AA Length | Score | Probability |
|---|---|---|---|---|---|---|
| 25945328_c3_1381 | 1877 | 6049 | 380 | 1143 | 1789 | 2.3e-184 |
| Protein name | | | | | Locus Name | Acc# |
| queuine tRNA-ribosyltransferase, | | | | | pir:C38530 | C38530:JQ0 |

Description

| ORF Name | NTID | AAID | NT Length | AA Length | Score | Probability |
|---|---|---|---|---|---|---|
| 25994008_f2_337 | 1878 | 6050 | 121 | 366 | 210 | 4.9e-17 |
| Protein name | | | | | Locus Name | Acc# |
| | | | | | sp:YBAJ_ECOLI | P37611:P75 |

Description

HYPOTHETICAL 14.6 KD PROTEIN IN HHA-ACRB INTERGENIC REGION

| ORF Name | NTID | AAID | NT Length | AA Length | Score | Probability |
|---|---|---|---|---|---|---|
| 2601462_c2_1019 | 1879 | 6051 | 547 | 1644 | 531 | 4.7e-51 |
| Protein name | | | | | Locus Name | Acc# |
| hypothetical protein SCF51A.21 | | | | | gp:SC51A | AL121596 |

Description

Streptomyces coelicolor cosmid 51A.

| ORF Name | NTID | AAID | NT Length | AA Length | Score | Probability |
|---|---|---|---|---|---|---|
| 26020215_c2_1096 | 1880 | 6052 | 231 | 696 | 1023 | 3.5e-103 |
| Protein name | | | | | Locus Name | Acc# |
| | | | | | sp:UREF_PROMI | P17091 |

Description

UREASE ACCESSORY PROTEIN UREF

| ORF Name | NTID | AAID | NT Length | AA Length | Score | Probability |
|---|---|---|---|---|---|---|
| 26172258_c2_1217 | 1881 | 6053 | 256 | 771 | 568 | 5.7e-55 |
| Protein name | | | | | Locus Name | Acc# |
| | | | | | sp:YGCA_ECOLI | P55135 |

Description (EC 2.1.1.-)

| ORF Name | NTID | AAID | NT Length | AA Length | Score | Probability |
|---|---|---|---|---|---|---|
| 26175328_c2_1067 | 1882 | 6054 | 353 | 1062 | 1176 | 2.1e-119 |
| Protein name | | | | | Locus Name | Acc# |
| | | | | | sp:MREC_ECOLI | P16926:P13 |

Description
ROD SHAPE-DETERMINING PROTEIN MREC

| ORF Name | NTID | AAID | NT Length | AA Length | Score | Probability |
|---|---|---|---|---|---|---|
| 26181701_c3_1369 | 1883 | 6055 | 431 | 1296 | 1470 | 1.5e-150 |
| Protein name | | | | | Locus Name | Acc# |
| | | | | | sp:PHOR_KLEPN | P45608 |

Description
PHOSPHATE REGULON SENSOR PROTEIN PHOR,

| ORF Name | NTID | AAID | NT Length | AA Length | Score | Probability |
|---|---|---|---|---|---|---|
| 26198828_c2_1117 | 1884 | 6056 | 111 | 336 | 319 | 1.4e-28 |
| Protein name | | | | | Locus Name | Acc# |
| | | | | | sp:TRPR_ENTCL | P39440 |

Description
TRP OPERON REPRESSOR

| ORF Name | NTID | AAID | NT Length | AA Length | Score | Probability |
|---|---|---|---|---|---|---|
| 26290951_c1_938 | 1885 | 6057 | 424 | 1275 | 1931 | 2.1e-199 |
| Protein name | | | | | Locus Name | Acc# |
| ClpX | | | | | gp:YEU66330 | U66330 |

Description
Yersinia enterocolitica ClpX (clpX) gene, complete cds.

| ORF Name | NTID | AAID | NT Length | AA Length | Score | Probability |
|---|---|---|---|---|---|---|
| 26366577_c2_1050 | 1886 | 6058 | 284 | 855 | 1425 | 8.7e-146 |
| Protein name | | | | | Locus Name | Acc# |
| | | | | | sp:RP32_PROMI | P50509 |

Description
RNA POLYMERASE SIGMA-32 FACTOR

| ORF Name | NTID | AAID | NT Length | AA Length | Score | Probability |
|---|---|---|---|---|---|---|
| 26445812_c3_1403 | 1887 | 6059 | 790 | 2373 | 3593 | 0.0 |

| Protein name | Locus Name | Acc# |
|---|---|---|
| ATP-dependent protease LA | gp:ECU82664 | U82664 |

Description
Escherichia coli minutes 9 to 11 genomic sequence.

| ORF Name | NTID | AAID | NT Length | AA Length | Score | Probability |
|---|---|---|---|---|---|---|
| 26462567_f3_739 | 1888 | 6060 | 87 | 264 | 226 | 9.9e-19 |

| Protein name | Locus Name | Acc# |
|---|---|---|
| | sp:YHDT_ECOLI | P45566 |

Description
HYPOTHETICAL 9.1 KD PROTEIN IN ACCC-PANF INTERGENIC REGION (O80)

| ORF Name | NTID | AAID | NT Length | AA Length | Score | Probability |
|---|---|---|---|---|---|---|
| 26580015_f1_97 | 1889 | 6061 | 127 | 384 | 473 | 6.6e-45 |

| Protein name | Locus Name | Acc# |
|---|---|---|
| cytochrome o ubiquinol oxidase C subunit | gp:ECU82664 | U82664 |

Description
Escherichia coli minutes 9 to 11 genomic sequence.

| ORF Name | NTID | AAID | NT Length | AA Length | Score | Probability |
|---|---|---|---|---|---|---|
| 26594058_c1_841 | 1890 | 6062 | 86 | 261 | 334 | 3.6e-30 |

| Protein name | Locus Name | Acc# |
|---|---|---|
| | sp:YRBA_ECOLI | P43781:P76 |

Description
HYPOTHETICAL 9.5 KD PROTEIN IN MURZ-RPON INTERGENIC REGION

| ORF Name | NTID | AAID | NT Length | AA Length | Score | Probability |
|---|---|---|---|---|---|---|
| 26647712_f1_239 | 1891 | 6063 | 456 | 1371 | 2163 | 5.4e-224 |

| Protein name | Locus Name | Acc# |
|---|---|---|
| | sp:GLPT_ECOLI | P08194 |

Description
PERMEASE)

467

| ORF Name | NTID | AAID | NT Length | AA Length | Score | Probability |
|---|---|---|---|---|---|---|
| 26775253_f1_141 | 1892 | 6064 | 391 | 1176 | 1277 | 4.2e-130 |
| Protein name | | | | | Locus Name | Acc# |
| | | | | | sp:YQHD_ECOLI | Q46856 |

Description

HYPOTHETICAL OXIDOREDUCTASE IN METC-SUFI INTERGENIC REGION

| ORF Name | NTID | AAID | NT Length | AA Length | Score | Probability |
|---|---|---|---|---|---|---|
| 26775418_c2_1198 | 1893 | 6065 | 163 | 492 | | |
| Protein name | | | | | Locus Name | Acc# |

Description

NO-HIT

| ORF Name | NTID | AAID | NT Length | AA Length | Score | Probability |
|---|---|---|---|---|---|---|
| 26835256_f2_303 | 1894 | 6066 | 242 | 729 | 840 | 8.5e-84 |
| Protein name | | | | | Locus Name | Acc# |
| | | | | | sp:PFS_ECOLI | P24247 |

Description

| ORF Name | NTID | AAID | NT Length | AA Length | Score | Probability |
|---|---|---|---|---|---|---|
| 2736675_c2_1240 | 1895 | 6067 | 879 | 2640 | 3222 | 0.0 |
| Protein name | | | | | Locus Name | Acc# |
| | | | | | gp:PMFIMOPR | Z32686 |

Description

Proteus mirabilis fimbrial operon, strain HI4320.

| ORF Name | NTID | AAID | NT Length | AA Length | Score | Probability |
|---|---|---|---|---|---|---|
| 2737500_c3_1458 | 1896 | 6068 | 194 | 585 | 951 | 1.5e-95 |
| Protein name | | | | | Locus Name | Acc# |
| | | | | | gp:PMFIMOPR | Z32686 |

Description

Proteus mirabilis fimbrial operon, strain HI4320.

| ORF Name | NTID | AAID | NT Length | AA Length | Score | Probability |
|---|---|---|---|---|---|---|
| 2740915_f3_519 | 1897 | 6069 | 212 | 639 | 999 | 1.2e-100 |
| Protein name | | | | | Locus Name | Acc# |
| | | | | | gp:PMFIMOPR | Z32686 |

Description: Proteus mirabilis fimbrial operon, strain HI4320.

| ORF Name | NTID | AAID | NT Length | AA Length | Score | Probability |
|---|---|---|---|---|---|---|
| 2743828_f1_61 | 1898 | 6070 | 328 | 987 | 277 | 3.9e-24 |
| Protein name | | | | | Locus Name | Acc# |
| | | | | | sp:YCDO_ECOLI | P75902 |

Description: HYPOTHETICAL 41.1 KD PROTEIN IN PUTP-PHOH INTERGENIC REGION

| ORF Name | NTID | AAID | NT Length | AA Length | Score | Probability |
|---|---|---|---|---|---|---|
| 2745217_f1_60 | 1899 | 6071 | 141 | 426 | 180 | 7.4e-14 |
| Protein name | | | | | Locus Name | Acc# |
| hypothetical protein RP394 | | | | | pir:A71697 | A71697 |

Description:

| ORF Name | NTID | AAID | NT Length | AA Length | Score | Probability |
|---|---|---|---|---|---|---|
| 2791665_c2_1233 | 1900 | 6072 | 406 | 1221 | 1731 | 3.3e-178 |
| Protein name | | | | | Locus Name | Acc# |
| phosphoglycerate kinase, | | | | | pir:TVECG | S04733:E65 |

Description:

| ORF Name | NTID | AAID | NT Length | AA Length | Score | Probability |
|---|---|---|---|---|---|---|
| 2812762_c1_823 | 1901 | 6073 | 154 | 465 | 109 | 2.5e-06 |
| Protein name | | | | | Locus Name | Acc# |
| NADH-ubiquinone oxidoreductase subunit 6 | | | | | gp:GPA249395 | AJ249395 |

Description: Globodera pallida mitochondrial COII, ND4, COIII, ND6, ND1, ND3 andcytb genes.

| ORF Name | NTID | AAID | NT Length | AA Length | Score | Probability |
|---|---|---|---|---|---|---|
| 281692_f2_448 | 1902 | 6074 | 107 | 324 | 370 | 5.4e-34 |
| Protein name | | | | | Locus Name | Acc# |
| | | | | | sp:RP5M_KLEPN | P17161:P11 |

Description: PROBABLE SIGMA(54) MODULATION PROTEIN (ORF95)

| ORF Name | NTID | AAID | NT Length | AA Length | Score | Probability |
|---|---|---|---|---|---|---|
| 2909677_f2_266 | 1903 | 6075 | 128 | 387 | 429 | 3.0e-40 |
| Protein name | | | | | Locus Name | Acc# |
| ZapC | | | | | gp:AF064762 | AF064762 |

Description: Proteus mirabilis metalloprotease operon, complete sequence.

| ORF Name | NTID | AAID | NT Length | AA Length | Score | Probability |
|---|---|---|---|---|---|---|
| 2922127_f2_331 | 1904 | 6076 | 450 | 1353 | 728 | 6.3e-72 |
| Protein name | | | | | Locus Name | Acc# |
| | | | | | sp:YHAM_ECOLI | P42626 |

Description: HYPOTHETICAL 19.4 KD PROTEIN IN EXUR-TDCC INTERGENIC REGION (F188)

| ORF Name | NTID | AAID | NT Length | AA Length | Score | Probability |
|---|---|---|---|---|---|---|
| 29304837_f3_611 | 1905 | 6077 | 510 | 1533 | 1671 | 7.4e-172 |
| Protein name | | | | | Locus Name | Acc# |
| | | | | | sp:AMPG_ECOLI | P36670 |

Description: AMPG PROTEIN

| ORF Name | NTID | AAID | NT Length | AA Length | Score | Probability |
|---|---|---|---|---|---|---|
| 29344418_c2_1048 | 1906 | 6078 | 231 | 696 | 985 | 3.7e-99 |
| Protein name | | | | | Locus Name | Acc# |
| | | | | | sp:FTSE_ECOLI | P10115 |

Description: CELL DIVISION ATP-BINDING PROTEIN FTSE

470

| ORF Name | NTID | AAID | NT Length | AA Length | Score | Probability |
|---|---|---|---|---|---|---|
| 29375332_c3_1401 | 1907 | 6079 | 111 | 336 | | |
| Protein name | | | | | Locus Name | Acc# |

Description
NO-HIT

| ORF Name | NTID | AAID | NT Length | AA Length | Score | Probability |
|---|---|---|---|---|---|---|
| 29384625_c3_1273 | 1908 | 6080 | 105 | 318 | 517 | 1.4e-49 |
| Protein name | | | | | Locus Name | Acc# |
| | | | | | sp:SUGE_PROVU | P20928 |

Description
SUGE PROTEIN HOMOLOG

| ORF Name | NTID | AAID | NT Length | AA Length | Score | Probability |
|---|---|---|---|---|---|---|
| 29464012_c1_943 | 1909 | 6081 | 134 | 405 | 410 | 3.1e-38 |
| Protein name | | | | | Locus Name | Acc# |
| PII-protein | | | | | gp:AVU91902 | U91902 |

Description
Azotobacter vinelandii PII-protein (glnB) and methylammoniumtransport protein (amtB) genes, complete cds.

| ORF Name | NTID | AAID | NT Length | AA Length | Score | Probability |
|---|---|---|---|---|---|---|
| 29487925_c2_1232 | 1910 | 6082 | 359 | 1080 | 1436 | 5.9e-147 |
| Protein name | | | | | Locus Name | Acc# |
| glyceraldehyde-3-phosphate dehydrogenase, B | | | | | pir:DEECGB | S04732:F65 |

Description

| ORF Name | NTID | AAID | NT Length | AA Length | Score | Probability |
|---|---|---|---|---|---|---|
| 29547175_c1_812 | 1911 | 6083 | 403 | 1212 | 935 | 7.3e-94 |
| Protein name | | | | | Locus Name | Acc# |
| periplasmic linker protein | | | | | gp:AF029405 | AF029405 |

Description
Pseudomonas putida solvent transporter genes including periplasmiclinker protein (srpA), inner membrane transporter protein (srpB), and outer membrane channel protein (srpC) genes, complete cds.

471

| ORF Name | NTID | AAID | NT Length | AA Length | Score | Probability |
|---|---|---|---|---|---|---|
| 29704417_c3_1393 | 1912 | 6084 | 201 | 606 | 614 | 7.6e-60 |
| Protein name | | | | | Locus Name | Acc# |
| | | | | | sp:YAJQ_ECOLI | P77482 |

Description
HYPOTHETICAL 19.0 KD PROTEIN IN ABPA-CYOE INTERGENIC REGION

| ORF Name | NTID | AAID | NT Length | AA Length | Score | Probability |
|---|---|---|---|---|---|---|
| 29854092_c3_1321 | 1913 | 6085 | 153 | 462 | 543 | 2.5e-52 |
| Protein name | | | | | Locus Name | Acc# |
| | | | | | sp:URE2_PROMI | P17087 |

Description
UREASE BETA SUBUNIT, (UREA AMIDOHYDROLASE)

| ORF Name | NTID | AAID | NT Length | AA Length | Score | Probability |
|---|---|---|---|---|---|---|
| 29922812_f1_190 | 1914 | 6086 | 78 | 237 | 76 | 0.041 |
| Protein name | | | | | Locus Name | Acc# |
| hypothetical protein F58E2.6 | | | | | pir:T33705 | T33705 |

Description

| ORF Name | NTID | AAID | NT Length | AA Length | Score | Probability |
|---|---|---|---|---|---|---|
| 29926390_c3_1339 | 1915 | 6087 | 331 | 996 | 1251 | 2.4e-127 |
| Protein name | | | | | Locus Name | Acc# |
| | | | | | sp:KHSE_SERMA | P27722 |

Description
HOMOSERINE KINASE, (HK)

| ORF Name | NTID | AAID | NT Length | AA Length | Score | Probability |
|---|---|---|---|---|---|---|
| 30111626_c2_1018 | 1916 | 6088 | 285 | 858 | 654 | 4.4e-64 |
| Protein name | | | | | Locus Name | Acc# |
| lactam utilization related protein PAB2445 | | | | | pir:H75074 | H75074 |

Description

| ORF Name | NTID | AAID | NT Length | AA Length | Score | Probability |
|---|---|---|---|---|---|---|
| 30117302_f1_82 | 1917 | 6089 | 81 | 246 | | |
| Protein name | | | | | Locus Name | Acc# |

Description
NO-HIT

| ORF Name | NTID | AAID | NT Length | AA Length | Score | Probability |
|---|---|---|---|---|---|---|
| 30120887_c2_1219 | 1918 | 6090 | 456 | 1371 | 1976 | 3.6e-204 |
| Protein name | | | | | Locus Name | Acc# |
| phosphopyruvate hydratase,:2-phosphoglycerate dehydratase:enolase | | | | | pir:NOEC | G65059:B25 |

Description

| ORF Name | NTID | AAID | NT Length | AA Length | Score | Probability |
|---|---|---|---|---|---|---|
| 30272216_c3_1438 | 1919 | 6091 | 296 | 891 | 851 | 5.8e-85 |
| Protein name | | | | | Locus Name | Acc# |
| | | | | | sp:MAZG_ECOLI | P33646 |

Description
MAZG PROTEIN

| ORF Name | NTID | AAID | NT Length | AA Length | Score | Probability |
|---|---|---|---|---|---|---|
| 30273466_c1_873 | 1920 | 6092 | 219 | 660 | 832 | 6.0e-83 |
| Protein name | | | | | Locus Name | Acc# |
| gpmB protein:hypothetical protein o215b | | | | | pir:S56619 | S56619:B65 |

Description

| ORF Name | NTID | AAID | NT Length | AA Length | Score | Probability |
|---|---|---|---|---|---|---|
| 30339215_f3_614 | 1921 | 6093 | 413 | 1242 | 1241 | 2.7e-126 |
| Protein name | | | | | Locus Name | Acc# |
| cytochrome o ubiquinol oxidase C subunit | | | | | gp:ECU82664 | U82664 |

Description
Escherichia coli minutes 9 to 11 genomic sequence.

| ORF Name | NTID | AAID | NT Length | AA Length | Score | Probability |
|---|---|---|---|---|---|---|
| 30354793_f2_315 | 1922 | 6094 | 713 | 2142 | 2313 | 6.9e-240 |
| Protein name | | | | Locus Name | | Acc# |
| | | | | gp:APU04954 | | U04954 |

Description: Actinobacillus pleuropneumoniae afuA, afuB, afuC, apxIC and RTX-Itoxin determinant (apxIA) genes, complete cds.

| ORF Name | NTID | AAID | NT Length | AA Length | Score | Probability |
|---|---|---|---|---|---|---|
| 30360927_f1_250 | 1923 | 6095 | 124 | 375 | 156 | 2.6e-11 |
| Protein name | | | | Locus Name | | Acc# |
| hypothetical protein APE1291 | | | | pir:D72603 | | D72603 |

Description:

| ORF Name | NTID | AAID | NT Length | AA Length | Score | Probability |
|---|---|---|---|---|---|---|
| 30486566_c2_1129 | 1924 | 6096 | 320 | 963 | 1227 | 8.3e-125 |
| Protein name | | | | Locus Name | | Acc# |
| transcription activator nhaR | | | | pir:QQEC3R | | D64722:S07 |

Description:

| ORF Name | NTID | AAID | NT Length | AA Length | Score | Probability |
|---|---|---|---|---|---|---|
| 30645917_f2_485 | 1925 | 6097 | 152 | 459 | 690 | 6.7e-68 |
| Protein name | | | | Locus Name | | Acc# |
| fumarate reductase, 15K protein:fumarate reductase chain C:succinate dehydrogenase 15K | | | | pir:RDEB15 | | S00109 |

Description:

| ORF Name | NTID | AAID | NT Length | AA Length | Score | Probability |
|---|---|---|---|---|---|---|
| 30757201_c3_1382 | 1926 | 6098 | 172 | 519 | 683 | 3.7e-67 |
| Protein name | | | | Locus Name | | Acc# |
| | | | | sp:YBAD_ECOLI | | P25538 |

Description: HYPOTHETICAL 17.2 KD PROTEIN IN TSX-RIBG INTERGENIC REGION (ORF1)

| ORF Name | NTID | AAID | NT Length | AA Length | Score | Probability |
|---|---|---|---|---|---|---|
| 31266002_f1_136 | 1927 | 6099 | 66 | 201 | 102 | 0.00012 |
| Protein name | | | | | Locus Name | Acc# |
| membrane protein with histidine rich charge | | | | gp:D82060 | | D82060 |

Description

Homo sapiens mRNA for membrane protein with histidine rich chargeclusters, complete cds.

| ORF Name | NTID | AAID | NT Length | AA Length | Score | Probability |
|---|---|---|---|---|---|---|
| 3129750_f1_244 | 1928 | 6100 | 62 | 189 | | |
| Protein name | | | | | Locus Name | Acc# |

Description

NO-HIT

| ORF Name | NTID | AAID | NT Length | AA Length | Score | Probability |
|---|---|---|---|---|---|---|
| 31330_c1_861 | 1929 | 6101 | 107 | 324 | 491 | 8.2e-47 |
| Protein name | | | | | Locus Name | Acc# |
| | | | | | sp:URE3_PROMI | P17088 |

Description

UREASE GAMMA SUBUNIT, (UREA AMIDOHYDROLASE)

| ORF Name | NTID | AAID | NT Length | AA Length | Score | Probability |
|---|---|---|---|---|---|---|
| 31445317_f3_756 | 1930 | 6102 | 122 | 369 | 231 | 2.9e-19 |
| Protein name | | | | | Locus Name | Acc# |
| | | | | | sp:YHHL_ECOLI | P37614 |

Description

HYPOTHETICAL 10.3 KD PROTEIN IN FTSY-NIKA INTERGENIC REGION

| ORF Name | NTID | AAID | NT Length | AA Length | Score | Probability |
|---|---|---|---|---|---|---|
| 31742280_f2_363 | 1931 | 6103 | 304 | 915 | 1169 | 1.2e-118 |
| Protein name | | | | | Locus Name | Acc# |
| | | | | | sp:RBSB_ECOLI | P02925 |

Description

D-RIBOSE-BINDING PERIPLASMIC PROTEIN PRECURSOR

| ORF Name | NTID | AAID | NT Length | AA Length | Score | Probability |
|---|---|---|---|---|---|---|
| 31776403_f1_48 | 1932 | 6104 | 195 | 588 | 490 | 1.0e-46 |
| Protein name | | | | | Locus Name | Acc# |
| | | | | | sp:HPPK_ECOLI | P26281 |

Description: (HPPK) (6-HYDROXYMETHYL-7,8-DIHYDROPTERIN PYROPHOSPHOKINASE) (PPPK)

| ORF Name | NTID | AAID | NT Length | AA Length | Score | Probability |
|---|---|---|---|---|---|---|
| 32228436_c1_944 | 1933 | 6105 | 433 | 1302 | 1476 | 3.4e-151 |
| Protein name | | | | | Locus Name | Acc# |
| | | | | | sp:AMTB_ECOLI | P37905 |

Description: PROBABLE AMMONIUM TRANSPORTER

| ORF Name | NTID | AAID | NT Length | AA Length | Score | Probability |
|---|---|---|---|---|---|---|
| 3228551_c2_1234 | 1934 | 6106 | 71 | 216 | | |
| Protein name | | | | | Locus Name | Acc# |

Description: NO-HIT

| ORF Name | NTID | AAID | NT Length | AA Length | Score | Probability |
|---|---|---|---|---|---|---|
| 32427086_c2_1137 | 1935 | 6107 | 419 | 1260 | 1409 | 4.3e-144 |
| Protein name | | | | | Locus Name | Acc# |
| | | | | | sp:HYBB_ECOLI | P37180 |

Description: PROBABLE NI/FE-HYDROGENASE 2 B-TYPE CYTOCHROME SUBUNIT

| ORF Name | NTID | AAID | NT Length | AA Length | Score | Probability |
|---|---|---|---|---|---|---|
| 32443768_c2_1134 | 1936 | 6108 | 62 | 189 | | |
| Protein name | | | | | Locus Name | Acc# |

Description: NO-HIT

| ORF Name | NTID | AAID | NT Length | AA Length | Score | Probability |
|---|---|---|---|---|---|---|
| 32455262_c2_1229 | 1937 | 6109 | 405 | 1218 | 929 | 3.2e-93 |

| Protein name | Locus Name | Acc# |
|---|---|---|
|  | sp:Y4XM_RHISN | P55705 |

Description

HYPOTHETICAL TRANSPORT PROTEIN Y4XM

| ORF Name | NTID | AAID | NT Length | AA Length | Score | Probability |
|---|---|---|---|---|---|---|
| 32475465_c1_860 | 1938 | 6110 | 298 | 897 | 1475 | 4.4e-151 |

| Protein name | Locus Name | Acc# |
|---|---|---|
|  | sp:URED_PROMI | P17089 |

Description

UREASE ACCESSORY PROTEIN URED

| ORF Name | NTID | AAID | NT Length | AA Length | Score | Probability |
|---|---|---|---|---|---|---|
| 32510_c2_1248 | 1939 | 6111 | 129 | 390 | 230 | 3.7e-19 |

| Protein name | Locus Name | Acc# |
|---|---|---|
| hypothetical protein Rv1767 | pir:H70988 | H70988 |

Description

| ORF Name | NTID | AAID | NT Length | AA Length | Score | Probability |
|---|---|---|---|---|---|---|
| 32673188_c2_1184 | 1940 | 6112 | 133 | 402 | 448 | 3.0e-42 |

| Protein name | Locus Name | Acc# |
|---|---|---|
|  | sp:YCHN_ECOLI | P39164:P76 |

Description

HYPOTHETICAL 12.7 KD PROTEIN IN CHAC-NARL INTERGENIC REGION

| ORF Name | NTID | AAID | NT Length | AA Length | Score | Probability |
|---|---|---|---|---|---|---|
| 32805_c3_1420 | 1941 | 6113 | 442 | 1329 | 1774 | 9.1e-183 |

| Protein name | Locus Name | Acc# |
|---|---|---|
| hypothetical protein b1432 | pir:C64895 | C64895 |

Description

| ORF Name | NTID | AAID | NT Length | AA Length | Score | Probability |
|---|---|---|---|---|---|---|
| 33206406_f3_632 | 1942 | 6114 | 709 | 2130 | 3129 | 0.0 |
| Protein name | | | | | Locus Name | Acc# |
| | | | | | gp:ECU68703 | U68703 |

Description
Escherichia coli K-12 MG1655 genome, ribC-pykF region.

| ORF Name | NTID | AAID | NT Length | AA Length | Score | Probability |
|---|---|---|---|---|---|---|
| 33240927_f1_17 | 1943 | 6115 | 500 | 1503 | 2024 | 2.9e-209 |
| Protein name | | | | | Locus Name | Acc# |
| | | | | | sp:YHIP_ECOLI | P36837:P76 |

Description
HYPOTHETICAL 53.7 KD PROTEIN IN USPA-PRLC INTERGENIC REGION

| ORF Name | NTID | AAID | NT Length | AA Length | Score | Probability |
|---|---|---|---|---|---|---|
| 33259625_c1_1003 | 1944 | 6116 | 872 | 2619 | 4583 | 0.0 |
| Protein name | | | | | Locus Name | Acc# |
| | | | | | gp:PMFIMOPR | Z32686 |

Description
Proteus mirabilis fimbrial operon, strain HI4320.

| ORF Name | NTID | AAID | NT Length | AA Length | Score | Probability |
|---|---|---|---|---|---|---|
| 33301055_c1_972 | 1945 | 6117 | 109 | 330 | 155 | 3.3e-11 |
| Protein name | | | | | Locus Name | Acc# |
| hypothetical protein APE2061 | | | | | pir:G72510 | G72510 |

Description

| ORF Name | NTID | AAID | NT Length | AA Length | Score | Probability |
|---|---|---|---|---|---|---|
| 33359428_c1_966 | 1946 | 6118 | 69 | 210 | 155 | 3.3e-11 |
| Protein name | | | | | Locus Name | Acc# |
| | | | | | sp:YDCY_ECOLI | P76110 |

Description
HYPOTHETICAL 8.8 KD PROTEIN IN TEHB-ANSP INTERGENIC REGION

| ORF Name | NTID | AAID | NT Length | AA Length | Score | Probability |
|---|---|---|---|---|---|---|
| 33366276_f3_664 | 1947 | 6119 | 235 | 708 | 692 | 4.1e-68 |
| Protein name | | | | | Locus Name | Acc# |
| | | | | | sp:YGHB_ECOLI | P33196 |

Description
HYPOTHETICAL 24.1 KD PROTEIN IN METC-SUFI INTERGENIC REGION

| ORF Name | NTID | AAID | NT Length | AA Length | Score | Probability |
|---|---|---|---|---|---|---|
| 33370137_c3_1414 | 1948 | 6120 | 227 | 684 | 100 | 0.0033 |
| Protein name | | | | | Locus Name | Acc# |
| probable tetR-family transcription regulator | | | | | pir:T37168 | T37168 |

Description

| ORF Name | NTID | AAID | NT Length | AA Length | Score | Probability |
|---|---|---|---|---|---|---|
| 33398387_c2_1224 | 1949 | 6121 | 89 | 270 | | |
| Protein name | | | | | Locus Name | Acc# |

Description
NO-HIT

| ORF Name | NTID | AAID | NT Length | AA Length | Score | Probability |
|---|---|---|---|---|---|---|
| 33398517_f1_3 | 1950 | 6122 | 605 | 1818 | 2910 | 0.0 |
| Protein name | | | | | Locus Name | Acc# |
| ZapB | | | | | gp:AF064762 | AF064762 |

Description
Proteus mirabilis metalloprotease operon, complete sequence.

| ORF Name | NTID | AAID | NT Length | AA Length | Score | Probability |
|---|---|---|---|---|---|---|
| 33400457_c1_890 | 1951 | 6123 | 338 | 1017 | 1359 | 8.6e-139 |
| Protein name | | | | | Locus Name | Acc# |
| | | | | | sp:HYBA_ECOLI | P37179 |

Description
HYDROGENASE-2 OPERON PROTEIN HYBA PRECURSOR

| ORF Name | NTID | AAID | NT Length | AA Length | Score | Probability |
|---|---|---|---|---|---|---|
| 33494007_c2_1125 | 1952 | 6124 | 2777 | 8334 | 193 | 1.5e-15 |
| Protein name | | | | | Locus Name | Acc# |
| | | | | | sp:FRPC_NEIME | P55127 |

Description: IRON-REGULATED PROTEIN FRPC

| ORF Name | NTID | AAID | NT Length | AA Length | Score | Probability |
|---|---|---|---|---|---|---|
| 33577_c3_1366 | 1953 | 6125 | 399 | 1200 | 200 | 1.7e-13 |
| Protein name | | | | | Locus Name | Acc# |
| outer membrane protein | | | | | gp:PMU50907 | U50907 |

Description: Pasteurella multocida strain X-73 outer membrane protein (ompH) gene, complete cds.

| ORF Name | NTID | AAID | NT Length | AA Length | Score | Probability |
|---|---|---|---|---|---|---|
| 33598377_c1_951 | 1954 | 6126 | 223 | 672 | 614 | 7.6e-60 |
| Protein name | | | | | Locus Name | Acc# |
| | | | | | sp:ACRR_ECOLI | P34000 |

Description: POTENTIAL ACRAB OPERON REPRESSOR

| ORF Name | NTID | AAID | NT Length | AA Length | Score | Probability |
|---|---|---|---|---|---|---|
| 33756942_c3_1418 | 1955 | 6127 | 267 | 804 | 1065 | 1.2e-107 |
| Protein name | | | | | Locus Name | Acc# |
| | | | | | sp:YADH_ECOLI | P36880:P75 |

Description: HYPOTHETICAL 28.5 KD PROTEIN IN HPT-PAND INTERGENIC REGION

| ORF Name | NTID | AAID | NT Length | AA Length | Score | Probability |
|---|---|---|---|---|---|---|
| 33761568_f1_124 | 1956 | 6128 | 312 | 939 | | |
| Protein name | | | | | Locus Name | Acc# |

Description: NO-HIT

| ORF Name | NTID | AAID | NT Length | AA Length | Score | Probability |
|---|---|---|---|---|---|---|
| 33783567_c2_1139 | 1957 | 6129 | 168 | 507 | 352 | 4.4e-32 |
| Protein name | | | | | Locus Name | Acc# |
| hydrogenase-2 operon protein hybE | | | | pir:F65085 | | F65085:E55 |

Description

| ORF Name | NTID | AAID | NT Length | AA Length | Score | Probability |
|---|---|---|---|---|---|---|
| 3385952_c2_1069 | 1958 | 6130 | 1267 | 3804 | 1884 | 2.0e-194 |
| Protein name | | | | | Locus Name | Acc# |
| | | | | sp:YHDP_ECOLI | | P46474:P76 |

Description
HYPOTHETICAL 107.7 KD PROTEIN IN ARGR-CAFA INTERGENIC REGION

| ORF Name | NTID | AAID | NT Length | AA Length | Score | Probability |
|---|---|---|---|---|---|---|
| 33875261_c1_926 | 1959 | 6131 | 80 | 243 | | |
| Protein name | | | | | Locus Name | Acc# |

Description
NO-HIT

| ORF Name | NTID | AAID | NT Length | AA Length | Score | Probability |
|---|---|---|---|---|---|---|
| 34000927_c1_992 | 1960 | 6132 | 712 | 2139 | 1123 | 8.7e-114 |
| Protein name | | | | | Locus Name | Acc# |
| unidentified ferric siderophore receptor | | | | gp:PAU33150 | | U33150 |

Description
Pseudomonas aeruginosa unidentified ferric siderophore receptor(ufrA) gene, complete cds.

| ORF Name | NTID | AAID | NT Length | AA Length | Score | Probability |
|---|---|---|---|---|---|---|
| 34022550_f1_165 | 1961 | 6133 | 955 | 2868 | 641 | 3.1e-84 |
| Protein name | | | | | Locus Name | Acc# |
| | | | | sp:YDDB_HAEIN | | P45182 |

Description
HYPOTHETICAL PROTEIN HI1369

481

| ORF Name | NTID | AAID | NT Length | AA Length | Score | Probability |
|---|---|---|---|---|---|---|
| 34085931_f1_43 | 1962 | 6134 | 62 | 189 | | |
| Protein name | | | | | Locus Name | Acc# |

Description
NO-HIT

| ORF Name | NTID | AAID | NT Length | AA Length | Score | Probability |
|---|---|---|---|---|---|---|
| 34119017_c1_904 | 1963 | 6135 | 230 | 693 | 1007 | 1.7e-101 |
| Protein name | | | | | Locus Name | Acc# |
| | | | | | sp:PHOB_KLEPN | P45605 |

Description
PHOSPHATE REGULON TRANSCRIPTIONAL REGULATORY PROTEIN PHOB

| ORF Name | NTID | AAID | NT Length | AA Length | Score | Probability |
|---|---|---|---|---|---|---|
| 34160125_c1_914 | 1964 | 6136 | 624 | 1875 | 2504 | 4.0e-260 |
| Protein name | | | | | Locus Name | Acc# |
| SecD protein | | | | | gp:AF163861 | AF163861 |

Description
Enterobacter aerogenes SecD protein (secD) gene, complete cds.

| ORF Name | NTID | AAID | NT Length | AA Length | Score | Probability |
|---|---|---|---|---|---|---|
| 34162501_c3_1410 | 1965 | 6137 | 116 | 351 | 535 | 1.8e-51 |
| Protein name | | | | | Locus Name | Acc# |
| | | | | | sp:YBAB_ECOLI | P17577:P09 |

Description
HYPOTHETICAL 12.0 KD PROTEIN IN DNAX-RECR INTERGENIC REGION

| ORF Name | NTID | AAID | NT Length | AA Length | Score | Probability |
|---|---|---|---|---|---|---|
| 34165903_c1_839 | 1966 | 6138 | 179 | 540 | 502 | 5.6e-48 |
| Protein name | | | | | Locus Name | Acc# |
| | | | | | sp:YRBD_ECOLI | P45391 |

Description
(F183)

482

| ORF Name | NTID | AAID | NT Length | AA Length | Score | Probability |
|---|---|---|---|---|---|---|
| 34173427_f3_742 | 1967 | 6139 | 106 | 321 | 477 | 2.5e-45 |
| Protein name | | | | | Locus Name | Acc# |
| | | | | | sp:FIS_ECOLI | P11028:P37 |

Description: BINDING PROTEIN) (FIS PROTEIN)

| ORF Name | NTID | AAID | NT Length | AA Length | Score | Probability |
|---|---|---|---|---|---|---|
| 34178437_f2_361 | 1968 | 6140 | 645 | 1938 | 2668 | 1.7e-277 |
| Protein name | | | | | Locus Name | Acc# |
| dxs protein | | | | | pir:D64771 | D64771 |

Description:

| ORF Name | NTID | AAID | NT Length | AA Length | Score | Probability |
|---|---|---|---|---|---|---|
| 34180375_c2_1230 | 1969 | 6141 | 156 | 471 | 240 | 3.2e-20 |
| Protein name | | | | | Locus Name | Acc# |
| | | | | | sp:Y4YB_RHISN | P55710 |

Description: HYPOTHETICAL 17.1 KD PROTEIN Y4YB

| ORF Name | NTID | AAID | NT Length | AA Length | Score | Probability |
|---|---|---|---|---|---|---|
| 34191932_f1_209 | 1970 | 6142 | 68 | 207 | | |
| Protein name | | | | | Locus Name | Acc# |

Description: NO-HIT

| ORF Name | NTID | AAID | NT Length | AA Length | Score | Probability |
|---|---|---|---|---|---|---|
| 34407642_c2_1178 | 1971 | 6143 | 137 | 414 | 371 | 4.3e-34 |
| Protein name | | | | | Locus Name | Acc# |
| | | | | | sp:YBAW_ECOLI | P77712 |

Description: HYPOTHETICAL 15.1 KD PROTEIN IN HUPB-COF INTERGENIC REGION

| ORF Name | NTID | AAID | NT Length | AA Length | Score | Probability |
|---|---|---|---|---|---|---|
| 34412780_f3_698 | 1972 | 6144 | 138 | 417 | 363 | 3.0e-33 |

| Protein name | | | | | Locus Name | Acc# |
|---|---|---|---|---|---|---|
| | | | | | gp:ECOUW67 | U18997 |

Description

Escherichia coli K-12 chromosomal region from 67.4 to 76.0 minutes.

| ORF Name | NTID | AAID | NT Length | AA Length | Score | Probability |
|---|---|---|---|---|---|---|
| 34413136_c2_1225 | 1973 | 6145 | 362 | 1089 | 618 | 2.9e-60 |

| Protein name | | | | | Locus Name | Acc# |
|---|---|---|---|---|---|---|
| hypothetical protein TM0190 | | | | | pir:F72406 | F72406 |

Description

| ORF Name | NTID | AAID | NT Length | AA Length | Score | Probability |
|---|---|---|---|---|---|---|
| 34459677_f3_617 | 1974 | 6146 | 320 | 963 | 819 | 1.4e-81 |

| Protein name | | | | | Locus Name | Acc# |
|---|---|---|---|---|---|---|
| | | | | | sp:APBA_ECOLI | P77728:Q46 |

Description (KPA REDUCTASE)

| ORF Name | NTID | AAID | NT Length | AA Length | Score | Probability |
|---|---|---|---|---|---|---|
| 34494012_f1_114 | 1975 | 6147 | 214 | 645 | 715 | 1.5e-70 |

| Protein name | | | | | Locus Name | Acc# |
|---|---|---|---|---|---|---|
| alkylhydrogenperoxide reductase | | | | | gp:LPNTSAA | L46863 |

Description

Legionella pneumophila alkylhydrogenperoxide reductase (tsaA) gene, complete cds and glutaredoxin-like protein (grlA) gene, completecds.

| ORF Name | NTID | AAID | NT Length | AA Length | Score | Probability |
|---|---|---|---|---|---|---|
| 34553178_c3_1425 | 1976 | 6148 | 639 | 1920 | 2355 | 2.5e-244 |

| Protein name | | | | | Locus Name | Acc# |
|---|---|---|---|---|---|---|
| | | | | | sp:GSP_ECOLI | P43675 |

Description

| ORF Name | NTID | AAID | NT Length | AA Length | Score | Probability |
|---|---|---|---|---|---|---|
| 34563936_f3_723 | 1977 | 6149 | 500 | 1503 | 1816 | 3.2e-187 |//
| Protein name | | | | | Locus Name | Acc# |
| | | | | | sp:RP54_KLEPN | P06223 |

Description
RNA POLYMERASE SIGMA-54 FACTOR

| ORF Name | NTID | AAID | NT Length | AA Length | Score | Probability |
|---|---|---|---|---|---|---|
| 34570927_c3_1356 | 1978 | 6150 | 345 | 1038 | 716 | 1.2e-70 |
| Protein name | | | | | Locus Name | Acc# |
| | | | | | gp:ECOEXBBD | M28819 |

Description
E.coli exbB and exbD genes encoding biopolymer transport proteins, complete cds.

| ORF Name | NTID | AAID | NT Length | AA Length | Score | Probability |
|---|---|---|---|---|---|---|
| 34644177_c3_1362 | 1979 | 6151 | 400 | 1203 | 936 | 7.0e-101 |
| Protein name | | | | | Locus Name | Acc# |
| hydrogenase isoenzyme hypB | | | | | gp:ECHYP | X54543 |

Description
E. coli hyp operon encoding hydrogenase isoenzymes.

| ORF Name | NTID | AAID | NT Length | AA Length | Score | Probability |
|---|---|---|---|---|---|---|
| 35162762_f1_149 | 1980 | 6152 | 93 | 282 | 363 | 3.0e-33 |
| Protein name | | | | | Locus Name | Acc# |
| ribosomal protein S20/L26:ribosomal protein L26:ribosomal protein S20 | | | | | pir:R3EC20 | A30425:A02 |

Description

| ORF Name | NTID | AAID | NT Length | AA Length | Score | Probability |
|---|---|---|---|---|---|---|
| 35165937_f1_55 | 1981 | 6153 | 315 | 948 | 989 | 1.4e-99 |
| Protein name | | | | | Locus Name | Acc# |
| | | | | | gp:ECDSDXC | X91821 |

Description
E.coli dsdX and dsdC genes.

485

| ORF Name | NTID | AAID | NT Length | AA Length | Score | Probability |
|---|---|---|---|---|---|---|
| 35179716_c1_878 | 1982 | 6154 | 944 | 2835 | 4090 | 0.0 |
| Protein name | | | | | Locus Name | Acc# |
| isoleucine--tRNA ligase,:isoleucyl-tRNA synthetase | | | | pir:SYECIT | | B64723:S40 |

Description
isoleucine--tRNA ligase,:isoleucyl-tRNA synthetase

| ORF Name | NTID | AAID | NT Length | AA Length | Score | Probability |
|---|---|---|---|---|---|---|
| 35269037_f1_175 | 1983 | 6155 | 589 | 1770 | 1133 | 7.0e-120 |
| Protein name | | | | | Locus Name | Acc# |
| | | | | | sp:YRAM_ECOLI | P45464 |

Description
HYPOTHETICAL 72.8 KD PROTEIN IN AGAI-MTR INTERGENIC REGION (O678)

| ORF Name | NTID | AAID | NT Length | AA Length | Score | Probability |
|---|---|---|---|---|---|---|
| 35317258_f2_489 | 1984 | 6156 | 88 | 267 | 73 | 0.016 |
| Protein name | | | | | Locus Name | Acc# |
| putative ribosomal protein s19 or s24 | | | | gp:ATAC009465 | | AC009465 |

Description
Arabidopsis thaliana chromosome III BAC T9J14 genomic sequence,complete sequence.

| ORF Name | NTID | AAID | NT Length | AA Length | Score | Probability |
|---|---|---|---|---|---|---|
| 35324136_f2_435 | 1985 | 6157 | 483 | 1452 | 1337 | 1.8e-136 |
| Protein name | | | | | Locus Name | Acc# |
| | | | | | sp:YDAJ_HAEIN | P44765 |

Description
HYPOTHETICAL PROTEIN HI0584

| ORF Name | NTID | AAID | NT Length | AA Length | Score | Probability |
|---|---|---|---|---|---|---|
| 35401562_f2_467 | 1986 | 6158 | 349 | 1050 | 914 | 1.2e-91 |
| Protein name | | | | | Locus Name | Acc# |
| | | | | | sp:UGPA_ECOLI | P10905 |

Description
SN-GLYCEROL-3-PHOSPHATE TRANSPORT SYSTEM PERMEASE PROTEIN UGPA

| ORF Name | NTID | AAID | NT Length | AA Length | Score | Probability |
|---|---|---|---|---|---|---|
| 35445313_f1_220 | 1987 | 6159 | 288 | 867 | 803 | 7.1e-80 |
| Protein name | | | | | Locus Name | Acc# |
| | | | | | sp:UGPE_ECOLI | P10906 |

Description: SN-GLYCEROL-3-PHOSPHATE TRANSPORT SYSTEM PERMEASE PROTEIN UGPE

| ORF Name | NTID | AAID | NT Length | AA Length | Score | Probability |
|---|---|---|---|---|---|---|
| 35714693_f3_639 | 1988 | 6160 | 315 | 948 | | |
| Protein name | | | | | Locus Name | Acc# |

Description: NO-HIT

| ORF Name | NTID | AAID | NT Length | AA Length | Score | Probability |
|---|---|---|---|---|---|---|
| 35730318_f2_375 | 1989 | 6161 | 315 | 948 | | |
| Protein name | | | | | Locus Name | Acc# |

Description: NO-HIT

| ORF Name | NTID | AAID | NT Length | AA Length | Score | Probability |
|---|---|---|---|---|---|---|
| 35750316_f2_459 | 1990 | 6162 | 155 | 468 | 551 | 3.6e-53 |
| Protein name | | | | | Locus Name | Acc# |
| type II 3-dehydroquinase | | | | | gp:AF011408 | AF011408 |

Description: Aeromonas salmonicida salmonicida type II 3-dehydroquinase (aroD)gene, complete cds, and acetyl-CoA carboxylase subunit (fabE) gene, partial cds.

| ORF Name | NTID | AAID | NT Length | AA Length | Score | Probability |
|---|---|---|---|---|---|---|
| 35820205_f2_330 | 1991 | 6163 | 235 | 708 | 481 | 9.4e-46 |
| Protein name | | | | | Locus Name | Acc# |
| | | | | | sp:DCUC_ECOLI | Q47134 |

Description: C4-DICARBOXYLATE ANAEROBIC CARRIER

| ORF Name | NTID | AAID | NT Length | AA Length | Score | Probability |
|---|---|---|---|---|---|---|
| 35976550_f3_554 | 1992 | 6164 | 133 | 402 | 521 | 5.4e-50 |
| Protein name | | | | | Locus Name | Acc# |
| | | | | | sp:PAND_ECOLI | P31664 |

Description
(DECARBOXYLASE)

| ORF Name | NTID | AAID | NT Length | AA Length | Score | Probability |
|---|---|---|---|---|---|---|
| 36024193_c1_831 | 1993 | 6165 | 291 | 876 | 435 | 7.0e-41 |
| Protein name | | | | | Locus Name | Acc# |
| | | | | | sp:Y601_SYNY3 | P55175 |

Description
HYPOTHETICAL 30.2 KD PROTEIN SLL0601

| ORF Name | NTID | AAID | NT Length | AA Length | Score | Probability |
|---|---|---|---|---|---|---|
| 36066302_c2_1126 | 1994 | 6166 | 334 | 1005 | 1428 | 4.2e-146 |
| Protein name | | | | | Locus Name | Acc# |
| transaldolase, B | | | | | pir:S40535 | S40535:H64 |

Description

| ORF Name | NTID | AAID | NT Length | AA Length | Score | Probability |
|---|---|---|---|---|---|---|
| 36109827_f3_636 | 1995 | 6167 | 324 | 975 | 339 | 1.0e-30 |
| Protein name | | | | | Locus Name | Acc# |
| hypothetical protein b1669 | | | | | pir:E64924 | E64924 |

Description

| ORF Name | NTID | AAID | NT Length | AA Length | Score | Probability |
|---|---|---|---|---|---|---|
| 36125178_f1_142 | 1996 | 6168 | 285 | 858 | 1067 | 7.5e-108 |
| Protein name | | | | | Locus Name | Acc# |
| | | | | | sp:YQHE_ECOLI | Q46857 |

Description
HYPOTHETICAL OXIDOREDUCTASE IN METC-SUFI INTERGENIC REGION

| ORF Name | NTID | AAID | NT Length | AA Length | Score | Probability |
|---|---|---|---|---|---|---|
| 36132942_f1_26 | 1997 | 6169 | 117 | 354 | 84 | 0.029 |
| Protein name | | | | | Locus Name | Acc# |
| | | | | | sp:Y0C4_MYCTU | Q50583 |

Description
HYPOTHETICAL 44.4 KD PROTEIN CY19G5.04C

| ORF Name | NTID | AAID | NT Length | AA Length | Score | Probability |
|---|---|---|---|---|---|---|
| 36209501_c3_1444 | 1998 | 6170 | 473 | 1422 | 1039 | 7.0e-105 |
| Protein name | | | | | Locus Name | Acc# |
| | | | | | sp:Y4YA_RHISN | P55709 |

Description
HYPOTHETICAL 49.9 KD PROTEIN Y4YA

| ORF Name | NTID | AAID | NT Length | AA Length | Score | Probability |
|---|---|---|---|---|---|---|
| 36214768_c3_1337 | 1999 | 6171 | 644 | 1935 | 1830 | 1.1e-188 |
| Protein name | | | | | Locus Name | Acc# |
| soluble lytic transglycosylase, precursor | | | | | pir:QQECW1 | S56616:G65 |

Description

| ORF Name | NTID | AAID | NT Length | AA Length | Score | Probability |
|---|---|---|---|---|---|---|
| 36225325_f1_57 | 2000 | 6172 | 106 | 321 | 133 | 7.1e-09 |
| Protein name | | | | | Locus Name | Acc# |
| | | | | | gp:PMFIMOPR | Z32686 |

Description
Proteus mirabilis fimbrial operon, strain HI4320.

| ORF Name | NTID | AAID | NT Length | AA Length | Score | Probability |
|---|---|---|---|---|---|---|
| 36225886_f2_436 | 2001 | 6173 | 347 | 1044 | 254 | 1.1e-21 |
| Protein name | | | | | Locus Name | Acc# |
| | | | | | sp:ALBR_KLEOX | P10488 |

Description
ALBICIDIN RESISTANCE PROTEIN

| ORF Name | NTID | AAID | NT Length | AA Length | Score | Probability |
|---|---|---|---|---|---|---|
| 36335416_c2_1022 | 2002 | 6174 | 1260 | 3783 | 5502 | 0.0 |

Protein name: nitrate reductase, 1 alpha chain:respiratory nitrate reductase alpha chain Locus Name: pir:RDECNA     Acc#: E64869:JV0

Description

| ORF Name | NTID | AAID | NT Length | AA Length | Score | Probability |
|---|---|---|---|---|---|---|
| 36360927_f3_565 | 2003 | 6175 | 280 | 843 | 256 | 6.5e-22 |

Protein name: conserved hypothetical protein

Locus Name: pir:A72378     Acc#: A72378

Description

| ORF Name | NTID | AAID | NT Length | AA Length | Score | Probability |
|---|---|---|---|---|---|---|
| 37567_c2_1239 | 2004 | 6176 | 81 | 246 | | |

Protein name:

Locus Name:     Acc#:

Description: NO-HIT

| ORF Name | NTID | AAID | NT Length | AA Length | Score | Probability |
|---|---|---|---|---|---|---|
| 39010_f1_172 | 2005 | 6177 | 139 | 420 | 514 | 3.0e-49 |

Protein name:

Locus Name: sp:YQJF_ECOLI     Acc#: P42619

Description: HYPOTHETICAL 17.2 KD PROTEIN IN EXUR-TDCC INTERGENIC REGION

| ORF Name | NTID | AAID | NT Length | AA Length | Score | Probability |
|---|---|---|---|---|---|---|
| 3907968_c3_1367 | 2006 | 6178 | 261 | 786 | 357 | 1.3e-32 |

Protein name:

Locus Name: sp:RN26_HAEIN     Acc#: P44012

Description: PROBABLE RIBONUCLEASE HI0526 PRECURSOR

| ORF Name | NTID | AAID | NT Length | AA Length | Score | Probability |
|---|---|---|---|---|---|---|
| 3910403_f3_545 | 2007 | 6179 | 162 | 489 | 657 | 2.1e-64 |
| Protein name | | | | | Locus Name | Acc# |
| | | | | | sp:RNH_SALTY | P23329 |

Description

RIBONUCLEASE HI, (RNASE HI) (RIBONUCLEASE H) (RNASE H)

| ORF Name | NTID | AAID | NT Length | AA Length | Score | Probability |
|---|---|---|---|---|---|---|
| 391075_c1_994 | 2008 | 6180 | 397 | 1194 | 1008 | 1.3e-101 |
| Protein name | | | | | Locus Name | Acc# |
| | | | | | sp:Y4XO_RHISN | P55707 |

Description

HYPOTHETICAL 40.9 KD PROTEIN Y4XO

| ORF Name | NTID | AAID | NT Length | AA Length | Score | Probability |
|---|---|---|---|---|---|---|
| 3910893_f1_34 | 2009 | 6181 | 254 | 765 | 753 | 1.4e-74 |
| Protein name | | | | | Locus Name | Acc# |
| | | | | | sp:GLO2_ECOLI | Q47677 |

Description

II) (GLX II)

| ORF Name | NTID | AAID | NT Length | AA Length | Score | Probability |
|---|---|---|---|---|---|---|
| 3912805_f2_374 | 2010 | 6182 | 77 | 234 | | |
| Protein name | | | | | Locus Name | Acc# |

Description

NO-HIT

| ORF Name | NTID | AAID | NT Length | AA Length | Score | Probability |
|---|---|---|---|---|---|---|
| 3915633_f2_430 | 2011 | 6183 | 312 | 939 | 1525 | 2.2e-156 |
| Protein name | | | | | Locus Name | Acc# |
| transcription regulator of urease operon UreR | | | | | pir:A40644 | A40644 |

Description

| ORF Name | NTID | AAID | NT Length | AA Length | Score | Probability |
|---|---|---|---|---|---|---|
| 3928875_c1_965 | 2012 | 6184 | 316 | 951 | 1245 | 1.0e-126 |
| Protein name | | | | | Locus Name | Acc# |
| | | | | | sp:YADG_ECOLI | P36879 |

Description

HYPOTHETICAL ABC TRANSPORTER ATP-BINDING PROTEIN YADG

| ORF Name | NTID | AAID | NT Length | AA Length | Score | Probability |
|---|---|---|---|---|---|---|
| 3929713_c1_955 | 2013 | 6185 | 71 | 216 | 321 | 8.5e-29 |
| Protein name | | | | | Locus Name | Acc# |
| | | | | | sp:YJIX_ECOLI | P39395 |

Description

HYPOTHETICAL 7.7 KD PROTEIN IN MRR-TSR INTERGENIC REGION (F67)

| ORF Name | NTID | AAID | NT Length | AA Length | Score | Probability |
|---|---|---|---|---|---|---|
| 3937785_c2_1040 | 2014 | 6186 | 1047 | 3144 | 3634 | 0.0 |
| Protein name | | | | | Locus Name | Acc# |
| inner membrane transporter protein | | | | | gp:AF029405 | AF029405 |

Description

Pseudomonas putida solvent transporter genes including periplasmic linker protein (srpA), inner membrane transporter protein (srpB), and outer membrane channel protein (srpC) genes, complete cds.

| ORF Name | NTID | AAID | NT Length | AA Length | Score | Probability |
|---|---|---|---|---|---|---|
| 3938213_f2_476 | 2015 | 6187 | 370 | 1113 | 1218 | 7.5e-124 |
| Protein name | | | | | Locus Name | Acc# |
| | | | | | sp:GLDA_CITFR | P45511 |

Description

GLYCEROL DEHYDROGENASE, (GLDH)

| ORF Name | NTID | AAID | NT Length | AA Length | Score | Probability |
|---|---|---|---|---|---|---|
| 3938307_f1_199 | 2016 | 6188 | 184 | 555 | 524 | 2.6e-50 |
| Protein name | | | | | Locus Name | Acc# |
| | | | | | sp:YHBN_ECOLI | P38685 |

Description

PROTEIN YHBN PRECURSOR

| ORF Name | NTID | AAID | NT Length | AA Length | Score | Probability |
|---|---|---|---|---|---|---|
| 3941925_f1_96 | 2017 | 6189 | 256 | 771 | 819 | 1.4e-81 |
| Protein name | | | | | Locus Name | Acc# |
| | | | | | sp:YFEN_ECOLI | P45564 |

Description: HYPOTHETICAL 29.2 KD PROTEIN IN XAPA-LIG INTERGENIC REGION (ORF254)

| ORF Name | NTID | AAID | NT Length | AA Length | Score | Probability |
|---|---|---|---|---|---|---|
| 3942325_f2_377 | 2018 | 6190 | 110 | 333 | | |
| Protein name | | | | | Locus Name | Acc# |

Description: NO-HIT

| ORF Name | NTID | AAID | NT Length | AA Length | Score | Probability |
|---|---|---|---|---|---|---|
| 3943963_f2_324 | 2019 | 6191 | 139 | 420 | 285 | 5.5e-25 |
| Protein name | | | | | Locus Name | Acc# |
| | | | | | gp:ERWHRPI | L25828 |

Description: Erwinia amylovora hrpJ, hrcV, hrpQ, hrcN, hrpO, hrpP, hrcQ, hrcR, hrcS, hrcT, and hrcU genes, complete cds.

| ORF Name | NTID | AAID | NT Length | AA Length | Score | Probability |
|---|---|---|---|---|---|---|
| 3945177_f3_622 | 2020 | 6192 | 135 | 408 | 368 | 8.9e-34 |
| Protein name | | | | | Locus Name | Acc# |
| | | | | | sp:Y947_HAEIN | P71363 |

Description: HYPOTHETICAL PROTEIN HI0947

| ORF Name | NTID | AAID | NT Length | AA Length | Score | Probability |
|---|---|---|---|---|---|---|
| 3945937_c3_1298 | 2021 | 6193 | 484 | 1455 | 1991 | 9.2e-206 |
| Protein name | | | | | Locus Name | Acc# |
| | | | | | sp:TLDD_ECOLI | P46473 |

Description: TLDD PROTEIN

| ORF Name | NTID | AAID | NT Length | AA Length | Score | Probability |
|---|---|---|---|---|---|---|
| 3948937_c1_985 | 2022 | 6194 | 255 | 768 | 977 | 2.6e-98 |
| Protein name | | | | | Locus Name | Acc# |
| | | | | | sp:DP3E_ECOLI | P03007 |

Description
DNA POLYMERASE III, EPSILON CHAIN,

| ORF Name | NTID | AAID | NT Length | AA Length | Score | Probability |
|---|---|---|---|---|---|---|
| 3959387_f2_356 | 2023 | 6195 | 257 | 774 | | |
| Protein name | | | | | Locus Name | Acc# |

Description
NO-HIT

| ORF Name | NTID | AAID | NT Length | AA Length | Score | Probability |
|---|---|---|---|---|---|---|
| 3962750_c3_1459 | 2024 | 6196 | 182 | 549 | 932 | 1.5e-93 |
| Protein name | | | | | Locus Name | Acc# |
| | | | | | gp:PMFIMOPR | Z32686 |

Description
Proteus mirabilis fimbrial operon, strain HI4320.

| ORF Name | NTID | AAID | NT Length | AA Length | Score | Probability |
|---|---|---|---|---|---|---|
| 3963878_c2_1220 | 2025 | 6197 | 548 | 1647 | 834 | 3.7e-83 |
| Protein name | | | | | Locus Name | Acc# |
| | | | | | sp:DCP3_YEAST | P26263 |

Description
PYRUVATE DECARBOXYLASE ISOZYME 3,

| ORF Name | NTID | AAID | NT Length | AA Length | Score | Probability |
|---|---|---|---|---|---|---|
| 3992932_c2_1035 | 2026 | 6198 | 76 | 231 | | |
| Protein name | | | | | Locus Name | Acc# |

Description
NO-HIT

| ORF Name | NTID | AAID | NT Length | AA Length | Score | Probability |
|---|---|---|---|---|---|---|
| 4016068_f1_177 | 2027 | 6199 | 195 | 588 | 621 | 1.4e-60 |
| Protein name | | | | | Locus Name | Acc# |
| | | | | | sp:YRAP_ECOLI | P45467 |

Description
(O191)

| ORF Name | NTID | AAID | NT Length | AA Length | Score | Probability |
|---|---|---|---|---|---|---|
| 4025056_c1_925 | 2028 | 6200 | 486 | 1461 | 1974 | 5.8e-204 |
| Protein name | | | | | Locus Name | Acc# |
| | | | | | sp:THII_ECOLI | P77718 |

Description
THIAMINE BIOSYNTHESIS PROTEIN THII

| ORF Name | NTID | AAID | NT Length | AA Length | Score | Probability |
|---|---|---|---|---|---|---|
| 4063386_f2_440 | 2029 | 6201 | 445 | 1338 | 170 | 2.2e-09 |
| Protein name | | | | | Locus Name | Acc# |
| hypothetical protein | | | | | pir:T13261 | T13261 |

Description

| ORF Name | NTID | AAID | NT Length | AA Length | Score | Probability |
|---|---|---|---|---|---|---|
| 4072253_f1_104 | 2030 | 6202 | 106 | 321 | 206 | 1.3e-16 |
| Protein name | | | | | Locus Name | Acc# |
| hypothetical protein HI0948 | | | | | pir:C64162 | C64162 |

Description

| ORF Name | NTID | AAID | NT Length | AA Length | Score | Probability |
|---|---|---|---|---|---|---|
| 4098378_c3_1346 | 2031 | 6203 | 395 | 1188 | 1223 | 2.2e-124 |
| Protein name | | | | | Locus Name | Acc# |
| sodium-proton antiporter affecting protein | | | | | gp:AF051158 | AF051158 |

Description
Vibrio cholerae sodium-proton antiporter affecting protein (nhaA)gene, complete cds.

| ORF Name | NTID | AAID | NT Length | AA Length | Score | Probability |
|---|---|---|---|---|---|---|
| 4100308_f3_717 | 2032 | 6204 | 477 | 1434 | 1525 | 2.2e-156 |
| Protein name | | | | | Locus Name | Acc# |
| | | | | | sp:DEGQ_ECOLI | P39099 |

Description: PROTEASE DEGQ PRECURSOR,

| ORF Name | NTID | AAID | NT Length | AA Length | Score | Probability |
|---|---|---|---|---|---|---|
| 4101053_f3_684 | 2033 | 6205 | 241 | 726 | 1133 | 7.6e-115 |
| Protein name | | | | | Locus Name | Acc# |
| | | | | | sp:ARCA_ECOLI | P03026 |

Description: AEROBIC RESPIRATION CONTROL PROTEIN ARCA (DYE RESISTANCE PROTEIN)

| ORF Name | NTID | AAID | NT Length | AA Length | Score | Probability |
|---|---|---|---|---|---|---|
| 4101693_c3_1266 | 2034 | 6206 | 245 | 738 | 682 | 4.7e-67 |
| Protein name | | | | | Locus Name | Acc# |
| | | | | | sp:NARJ_ECOLI | P11351 |

Description: RESPIRATORY NITRATE REDUCTASE 1 DELTA CHAIN,

| ORF Name | NTID | AAID | NT Length | AA Length | Score | Probability |
|---|---|---|---|---|---|---|
| 4103590_c1_1006 | 2035 | 6207 | 111 | 336 | 564 | 1.5e-54 |
| Protein name | | | | | Locus Name | Acc# |
| | | | | | gp:PMFIMOPR | Z32686 |

Description: Proteus mirabilis fimbrial operon, strain HI4320.

| ORF Name | NTID | AAID | NT Length | AA Length | Score | Probability |
|---|---|---|---|---|---|---|
| 4104818_c1_981 | 2036 | 6208 | 749 | 2250 | 3085 | 0.0 |
| Protein name | | | | | Locus Name | Acc# |
| | | | | | sp:RELA_ECOLI | P11585 |

Description: (PPGPP SYNTHETASE I)

| ORF Name | NTID | AAID | NT Length | AA Length | Score | Probability |
|---|---|---|---|---|---|---|
| 4116588_c1_937 | 2037 | 6209 | 210 | 633 | 947 | 3.9e-95 |
| Protein name | | | | | Locus Name | Acc# |
| | | | | | sp:CLPP_YEREN | Q60107 |

Description: (ENDOPEPTIDASE CLP)

| ORF Name | NTID | AAID | NT Length | AA Length | Score | Probability |
|---|---|---|---|---|---|---|
| 4116693_c1_958 | 2038 | 6210 | 216 | 651 | 106 | 0.0021 |
| Protein name | | | | | Locus Name | Acc# |
| RepH5 | | | | | gp:AF143461 | AF143461 |

Description: Borrelia hermsii plasmid-encoded RepH5 (repH5) and RepH5- (repH5-)genes, complete cds.

| ORF Name | NTID | AAID | NT Length | AA Length | Score | Probability |
|---|---|---|---|---|---|---|
| 4145657_c2_1164 | 2039 | 6211 | 340 | 1023 | 1285 | 6.0e-131 |
| Protein name | | | | | Locus Name | Acc# |
| protein-export membrane protein secF | | | | | gp:ECU82664 | U82664 |

Description: Escherichia coli minutes 9 to 11 genomic sequence.

| ORF Name | NTID | AAID | NT Length | AA Length | Score | Probability |
|---|---|---|---|---|---|---|
| 4149093_f3_685 | 2040 | 6212 | 303 | 912 | 803 | 7.1e-80 |
| Protein name | | | | | Locus Name | Acc# |
| | | | | | sp:ROB_ECOLI | P27292 |

Description: RIGHT ORIGIN-BINDING PROTEIN

| ORF Name | NTID | AAID | NT Length | AA Length | Score | Probability |
|---|---|---|---|---|---|---|
| 4195393_c3_1361 | 2041 | 6213 | 167 | 504 | 480 | 1.2e-45 |
| Protein name | | | | | Locus Name | Acc# |
| | | | | | sp:HYBD_ECOLI | P37182 |

Description: HYDROGENASE 2 MATURATION PROTEASE,

| ORF_Name | NTID | AAID | NT Length | AA Length | Score | Probability |
|---|---|---|---|---|---|---|
| 423135_c2_1059 | 2042 | 6214 | 109 | 330 | 113 | 9.3e-07 |
| Protein name | | | | | Locus Name | Acc# |
| | | | | | sp:YAFU_ECOLI | P77354 |

Description

HYPOTHETICAL 12.1 KD PROTEIN IN DNAQ-GMHA INTERGENIC REGION

| ORF_Name | NTID | AAID | NT Length | AA Length | Score | Probability |
|---|---|---|---|---|---|---|
| 4297888_f2_346 | 2043 | 6215 | 61 | 186 | | |
| Protein name | | | | | Locus Name | Acc# |

Description

NO-HIT

| ORF_Name | NTID | AAID | NT Length | AA Length | Score | Probability |
|---|---|---|---|---|---|---|
| 4298568_c3_1297 | 2044 | 6216 | 492 | 1479 | 2145 | 4.4e-222 |
| Protein name | | | | | Locus Name | Acc# |
| cytosolic axial filament protein cafA | | | | | pir:A65117 | A65117:JQ1 |

Description

| ORF_Name | NTID | AAID | NT Length | AA Length | Score | Probability |
|---|---|---|---|---|---|---|
| 4322778_c3_1450 | 2045 | 6217 | 379 | 1140 | 1655 | 3.7e-170 |
| Protein name | | | | | Locus Name | Acc# |
| fructose 1,6-bisphosphate aldolase | | | | | gp:AF037440 | AF037440 |

Description

Edwardsiella ictaluri D-3-phosphoglycerate dehydrogenase (serA) gene, partial cds; ribose-5-phosphate isomerase (rpiA), inhibitor of chromosome initiation (iciA), putative 26 kDa protein (yggE), putative 30.6 kDa protein (yggB), and fructose 1,6-bisphosphate aldolase (fda) genes, complete cds; and phosphoglycerate kinase (pgk) gene, partial cds.

| ORF_Name | NTID | AAID | NT Length | AA Length | Score | Probability |
|---|---|---|---|---|---|---|
| 4331537_f2_423 | 2046 | 6218 | 63 | 192 | 69 | 0.042 |
| Protein name | | | | | Locus Name | Acc# |
| hypothetical protein 25 | | | | | pir:S53809 | S53809:S53 |

Description

| ORF Name | NTID | AAID | NT Length | AA Length | Score | Probability |
|---|---|---|---|---|---|---|
| 4331713_f1_210 | 2047 | 6219 | 327 | 984 | 1154 | 4.5e-117 |
| Protein name | | | | | Locus Name | Acc# |
| | | | | | sp:YHDH_ECOLI | P26646 |

Description: HYPOTHETICAL 34.7 KD PROTEIN IN MREB-ACCB INTERGENIC REGION (ORF1)

| ORF Name | NTID | AAID | NT Length | AA Length | Score | Probability |
|---|---|---|---|---|---|---|
| 4344202_c2_1057 | 2048 | 6220 | 252 | 759 | 390 | 4.1e-36 |
| Protein name | | | | | Locus Name | Acc# |
| | | | | | gp:AEODHABL | X91877 |

Description: A.eutrophus odhA, odhB, odhL, ORF1 and ORF5 genes.

| ORF Name | NTID | AAID | NT Length | AA Length | Score | Probability |
|---|---|---|---|---|---|---|
| 4348750_c3_1437 | 2049 | 6221 | 231 | 696 | 615 | 5.9e-60 |
| Protein name | | | | | Locus Name | Acc# |
| | | | | | sp:YGCA_ECOLI | P55135 |

Description: (EC 2.1.1.-)

| ORF Name | NTID | AAID | NT Length | AA Length | Score | Probability |
|---|---|---|---|---|---|---|
| 4375316_f3_560 | 2050 | 6222 | 192 | 579 | 220 | 4.3e-18 |
| Protein name | | | | | Locus Name | Acc# |
| D-serine dehydratase transcriptional activator | | | | | gp:D90866 | D90866:AB0 |

Description: E.coli genomic DNA, Kohara clone #411(53.2-53.6 min.).

| ORF Name | NTID | AAID | NT Length | AA Length | Score | Probability |
|---|---|---|---|---|---|---|
| 4390805_f1_106 | 2051 | 6223 | 123 | 372 | 523 | 3.3e-50 |
| Protein name | | | | | Locus Name | Acc# |
| | | | | | sp:PHNA_ECOLI | P16680 |

Description: PHNA PROTEIN

499

| ORF Name | NTID | AAID | NT Length | AA Length | Score | Probability |
|---|---|---|---|---|---|---|
| 4397055_f2_497 | 2052 | 6224 | 234 | 705 | 847 | 1.5e-84 |
| Protein name | | | | | Locus Name | Acc# |
| | | | | | gp:ECNARL | X14884:X13 |

Description: E.coli narL gene.

| ORF Name | NTID | AAID | NT Length | AA Length | Score | Probability |
|---|---|---|---|---|---|---|
| 4409718_f3_714 | 2053 | 6225 | 427 | 1284 | 745 | 9.9e-74 |
| Protein name | | | | | Locus Name | Acc# |
| | | | | | sp:Y585_HAEIN | P44018 |

Description: HYPOTHETICAL PROTEIN HI0585

| ORF Name | NTID | AAID | NT Length | AA Length | Score | Probability |
|---|---|---|---|---|---|---|
| 442802_f1_171 | 2054 | 6226 | 110 | 333 | 206 | 1.3e-16 |
| Protein name | | | | | Locus Name | Acc# |
| | | | | | sp:YQJK_ECOLI | Q47710 |

Description: HYPOTHETICAL 11.8 KD PROTEIN IN EXUR-TDCE INTERGENIC REGION

| ORF Name | NTID | AAID | NT Length | AA Length | Score | Probability |
|---|---|---|---|---|---|---|
| 444012_c2_1121 | 2055 | 6227 | 195 | 588 | 584 | 1.1e-56 |
| Protein name | | | | | Locus Name | Acc# |
| | | | | | sp:CREA_ECOLI | P08367 |

Description: CREA PROTEIN

| ORF Name | NTID | AAID | NT Length | AA Length | Score | Probability |
|---|---|---|---|---|---|---|
| 4460250_f3_599 | 2056 | 6228 | 429 | 1290 | 1202 | 3.7e-122 |
| Protein name | | | | | Locus Name | Acc# |
| | | | | | sp:ACRA_ECOLI | P31223 |

Description: ACRIFLAVIN RESISTANCE PROTEIN A PRECURSOR

| ORF Name | NTID | AAID | NT Length | AA Length | Score | Probability |
|---|---|---|---|---|---|---|
| 4469001_c2_1153 | 2057 | 6229 | 63 | 192 | | |
| Protein name | | | | | Locus Name | Acc# |

Description: NO-HIT

| ORF Name | NTID | AAID | NT Length | AA Length | Score | Probability |
|---|---|---|---|---|---|---|
| 4490693_f2_318 | 2058 | 6230 | 188 | 567 | 450 | 1.8e-42 |
| Protein name | | | | | Locus Name | Acc# |
| | | | | | gp:YP102KB | AL031866 |

Description: Yersinia pestis 102 kbases unstable region: from 1 to 119443.

| ORF Name | NTID | AAID | NT Length | AA Length | Score | Probability |
|---|---|---|---|---|---|---|
| 4494375_f2_296 | 2059 | 6231 | 447 | 1344 | 925 | 8.4e-93 |
| Protein name | | | | | Locus Name | Acc# |
| | | | | | sp:MLTD_ECOLI | P23931:P32 |

Description: (MUREIN HYDROLASE D) (REGULATORY PROTEIN DNIR)

| ORF Name | NTID | AAID | NT Length | AA Length | Score | Probability |
|---|---|---|---|---|---|---|
| 4500713_f1_42 | 2060 | 6232 | 431 | 1296 | 1898 | 6.6e-196 |

| Protein name | Locus Name | Acc# |
|---|---|---|
| | sp:GSA_ECOLI | P23893:P78 |

Description (GLUTAMATE-1-SEMIALDEHYDE AMINOTRANSFERASE) (GSA-AT)

| ORF Name | NTID | AAID | NT Length | AA Length | Score | Probability |
|---|---|---|---|---|---|---|
| 4500925_f1_49 | 2061 | 6233 | 281 | 846 | 973 | 6.9e-98 |

| Protein name | Locus Name | Acc# |
|---|---|---|
| | sp:PANB_ECOLI | P31057 |

Description (KETOPANTOATE HYDROXYMETHYLTRANSFERASE)

| ORF Name | NTID | AAID | NT Length | AA Length | Score | Probability |
|---|---|---|---|---|---|---|
| 4506518_c1_805 | 2062 | 6234 | 116 | 351 | 604 | 8.7e-59 |
| Protein name | | | | | Locus Name | Acc# |
| | | | | | sp:YFRB_PROVU | P20926 |

Description: FRD OPERON HYPOTHETICAL PROTEIN B

| ORF Name | NTID | AAID | NT Length | AA Length | Score | Probability |
|---|---|---|---|---|---|---|
| 4532638_c2_1140 | 2063 | 6235 | 111 | 336 | 276 | 5.0e-24 |
| Protein name | | | | | Locus Name | Acc# |
| | | | | | sp:HYBG_ECOLI | P37185 |

Description: HYDROGENASE-2 OPERON PROTEIN HYBG

| ORF Name | NTID | AAID | NT Length | AA Length | Score | Probability |
|---|---|---|---|---|---|---|
| 4533160_c2_1080 | 2064 | 6236 | 83 | 252 | | |
| Protein name | | | | | Locus Name | Acc# |

Description: NO-HIT

| ORF Name | NTID | AAID | NT Length | AA Length | Score | Probability |
|---|---|---|---|---|---|---|
| 4548443_c2_1142 | 2065 | 6237 | 83 | 252 | 383 | 2.3e-35 |
| Protein name | | | | | Locus Name | Acc# |
| | | | | | sp:YEDF_ECOLI | P31065 |

Description: HYPOTHETICAL 8.6 KD PROTEIN IN AMYA-FLIE INTERGENIC REGION (ORF 9)

| ORF Name | NTID | AAID | NT Length | AA Length | Score | Probability |
|---|---|---|---|---|---|---|
| 4572213_f1_213 | 2066 | 6238 | 486 | 1461 | 1957 | 3.7e-202 |
| Protein name | | | | | Locus Name | Acc# |
| pantothenate permease:sodium/pantothenate symporter | | | | | pir:D65118 | D65118:JU0 |

Description

502

| ORF Name | NTID | AAID | NT Length | AA Length | Score | Probability |
|---|---|---|---|---|---|---|
| 4692007_f1_58 | 2067 | 6239 | 79 | 240 | 64 | 0.014 |
| Protein name | | | | | Locus Name | Acc# |
| | | | | | gp:LSPLCPRF | X97014 |

Description: L.seeligeri DNA for plcA/prfA operon.

| ORF Name | NTID | AAID | NT Length | AA Length | Score | Probability |
|---|---|---|---|---|---|---|
| 4695962_f1_214 | 2068 | 6240 | 297 | 894 | 1303 | 7.4e-133 |
| Protein name | | | | | Locus Name | Acc# |
| ribosomal protein L11 methyltransferase, prmA | | | | | pir:E65118 | E65118:B49 |

Description:

| ORF Name | NTID | AAID | NT Length | AA Length | Score | Probability |
|---|---|---|---|---|---|---|
| 4698393_c3_1293 | 2069 | 6241 | 324 | 975 | 172 | 1.5e-10 |
| Protein name | | | | | Locus Name | Acc# |
| conserved hypothetical protein ykrP | | | | | pir:A69863 | A69863 |

Description:

| ORF Name | NTID | AAID | NT Length | AA Length | Score | Probability |
|---|---|---|---|---|---|---|
| 4720051_f2_348 | 2070 | 6242 | 76 | 231 | 142 | 7.9e-10 |
| Protein name | | | | | Locus Name | Acc# |
| hypothetical protein | | | | | gp:BSZ75208 | Z75208 |

Description: B.subtilis genomic sequence 89009bp.

| ORF Name | NTID | AAID | NT Length | AA Length | Score | Probability |
|---|---|---|---|---|---|---|
| 4725625_c1_846 | 2071 | 6243 | 145 | 438 | 701 | 4.6e-69 |
| Protein name | | | | | Locus Name | Acc# |
| | | | | | sp:RL13_ECOLI | P02410 |

Description: 50S RIBOSOMAL PROTEIN L13

| ORF Name | NTID | AAID | NT Length | AA Length | Score | Probability |
|---|---|---|---|---|---|---|
| 4729711_f2_502 | 2072 | 6244 | 222 | 669 | 411 | 2.5e-38 |
| Protein name | | | | | Locus Name | Acc# |
| putative GntR-family transcriptional regulator. | | | | | gp:SC6D7 | AL133213 |

Description: Streptomyces coelicolor cosmid 6D7.

| ORF Name | NTID | AAID | NT Length | AA Length | Score | Probability |
|---|---|---|---|---|---|---|
| 4729843_c1_802 | 2073 | 6245 | 400 | 1203 | 840 | 8.5e-84 |
| Protein name | | | | | Locus Name | Acc# |
| lactate oxidase | | | | | gp:SILCT | Y07622 |

Description: S.iniae lctP & lctO genes and ORF1.

| ORF Name | NTID | AAID | NT Length | AA Length | Score | Probability |
|---|---|---|---|---|---|---|
| 4736677_f2_272 | 2074 | 6246 | 66 | 201 | | |
| Protein name | | | | | Locus Name | Acc# |

Description: NO-HIT

| ORF Name | NTID | AAID | NT Length | AA Length | Score | Probability |
|---|---|---|---|---|---|---|
| 4737518_c3_1327 | 2075 | 6247 | 65 | 198 | | |
| Protein name | | | | | Locus Name | Acc# |

Description: NO-HIT

| ORF Name | NTID | AAID | NT Length | AA Length | Score | Probability |
|---|---|---|---|---|---|---|
| 4771930_f3_747 | 2076 | 6248 | 179 | 540 | 218 | 7.0e-18 |
| Protein name | | | | | Locus Name | Acc# |
| | | | | | sp:YHHK_ECOLI | P37613 |

Description: HYPOTHETICAL 14.5 KD PROTEIN IN LIVK-LIVJ INTERGENIC REGION (O127)

504

| ORF_Name | NTID | AAID | NT Length | AA Length | Score | Probability |
|---|---|---|---|---|---|---|
| 4772187_f3_603 | 2077 | 6249 | 241 | 726 | 959 | 2.1e-96 |
| Protein name | | | | | Locus Name | Acc# |
| | | | | | sp:YBAX_ECOLI | P77756 |

Description: HYPOTHETICAL 25.5 KD PROTEIN IN HUPB-COF INTERGENIC REGION

| ORF_Name | NTID | AAID | NT Length | AA Length | Score | Probability |
|---|---|---|---|---|---|---|
| 4775302_f2_268 | 2078 | 6250 | 126 | 381 | 331 | 7.4e-30 |
| Protein name | | | | | Locus Name | Acc# |
| | | | | | sp:YHDN_ECOLI | P36677 |

Description: HYPOTHETICAL 13.9 KD PROTEIN IN MSCL-RPLQ INTERGENIC REGION

| ORF_Name | NTID | AAID | NT Length | AA Length | Score | Probability |
|---|---|---|---|---|---|---|
| 4806677_c1_829 | 2079 | 6251 | 165 | 498 | 590 | 2.6e-57 |
| Protein name | | | | | Locus Name | Acc# |
| | | | | | sp:MRED_ECOLI | P16927 |

Description: ROD SHAPE-DETERMINING PROTEIN MRED

| ORF_Name | NTID | AAID | NT Length | AA Length | Score | Probability |
|---|---|---|---|---|---|---|
| 4819093_f3_642 | 2080 | 6252 | 413 | 1242 | 1074 | 1.4e-108 |
| Protein name | | | | | Locus Name | Acc# |
| exonuclease SbcD | | | | | gp:ECU73857 | U73857 |

Description: Escherichia coli chromosome minutes 6-8.

| ORF_Name | NTID | AAID | NT Length | AA Length | Score | Probability |
|---|---|---|---|---|---|---|
| 4822127_c3_1357 | 2081 | 6253 | 143 | 432 | 504 | 3.4e-48 |
| Protein name | | | | | Locus Name | Acc# |
| | | | | | sp:EXBD_ECOLI | P18784 |

Description: BIOPOLYMER TRANSPORT EXBD PROTEIN

| ORF Name | NTID | AAID | NT Length | AA Length | Score | Probability |
|---|---|---|---|---|---|---|
| 4859512_f3_563 | 2082 | 6254 | 116 | 351 | | |
| Protein name | | | | | Locus Name | Acc# |

Description: NO-HIT

| ORF Name | NTID | AAID | NT Length | AA Length | Score | Probability |
|---|---|---|---|---|---|---|
| 4861550_f3_573 | 2083 | 6255 | 134 | 405 | 289 | 2.1e-25 |
| Protein name | | | | | Locus Name | Acc# |
| yacC protein | | | | | pir:B64735 | B64735:A33 |

Description:

| ORF Name | NTID | AAID | NT Length | AA Length | Score | Probability |
|---|---|---|---|---|---|---|
| 4867842_c2_1189 | 2084 | 6256 | 329 | 990 | 1037 | 1.1e-104 |
| Protein name | | | | | Locus Name | Acc# |
| | | | | | sp:YJIA_ECOLI | P24203 |

Description: HYPOTHETICAL 32.0 KD PROTEIN IN MRR-TSR INTERGENIC REGION (F284)

| ORF Name | NTID | AAID | NT Length | AA Length | Score | Probability |
|---|---|---|---|---|---|---|
| 4869812_f3_724 | 2085 | 6257 | 93 | 282 | 436 | 5.5e-41 |
| Protein name | | | | | Locus Name | Acc# |
| NPR | | | | | gp:AF088980 | AF088980 |

Description: Proteus mirabilis NPR (npr) gene, complete cds; and unknown gene.

| ORF Name | NTID | AAID | NT Length | AA Length | Score | Probability |
|---|---|---|---|---|---|---|
| 4877327_c3_1345 | 2086 | 6258 | 641 | 1926 | 2846 | 2.3e-296 |
| Protein name | | | | | Locus Name | Acc# |
| DnaK | | | | | gp:STU58360 | U58360 |

Description: Salmonella typhimurium plasmid pRS1014 DnaK and DnaJ genes, complete cds.

| ORF_Name | NTID | AAID | NT Length | AA Length | Score | Probability |
|---|---|---|---|---|---|---|
| 4879157_f2_453 | 2087 | 6259 | 77 | 234 | | |
| Protein name | | | | | Locus_Name | Acc# |
| | | | | | | |

Description: NO-HIT

| ORF_Name | NTID | AAID | NT Length | AA Length | Score | Probability |
|---|---|---|---|---|---|---|
| 4879688_c3_1454 | 2088 | 6260 | 178 | 537 | 701 | 4.6e-69 |
| Protein name | | | | | Locus_Name | Acc# |
| | | | | | sp:MRPA_PROMI | Q03011 |

Description: MAJOR MR/P FIMBRIA PROTEIN PRECURSOR

| ORF_Name | NTID | AAID | NT Length | AA Length | Score | Probability |
|---|---|---|---|---|---|---|
| 4881327_f1_14 | 2089 | 6261 | 317 | 954 | 893 | 2.1e-89 |
| Protein name | | | | | Locus_Name | Acc# |
| | | | | | sp:ELAC_ECOLI | Q47012:P77 |

Description: ELAC PROTEIN

| ORF_Name | NTID | AAID | NT Length | AA Length | Score | Probability |
|---|---|---|---|---|---|---|
| 4882318_f3_634 | 2090 | 6262 | 227 | 684 | 863 | 3.1e-86 |
| Protein name | | | | | Locus_Name | Acc# |
| nrfC protein homolog b1671 | | | | | pir:G64924 | G64924 |

Description:

| ORF_Name | NTID | AAID | NT Length | AA Length | Score | Probability |
|---|---|---|---|---|---|---|
| 4882915_c2_1038 | 2091 | 6263 | 91 | 276 | 302 | 8.7e-27 |
| Protein name | | | | | Locus_Name | Acc# |
| | | | | | sp:YHHP_ECOLI | P37618 |

Description: HYPOTHETICAL 9.1 KD PROTEIN IN FTSY-NIKA INTERGENIC REGION

| ORF Name | NTID | AAID | NT Length | AA Length | Score | Probability |
|---|---|---|---|---|---|---|
| 4897800_c2_1175 | 2092 | 6264 | 492 | 1479 | 1728 | 6.8e-178 |
| Protein name | | | | | Locus Name | Acc# |
| | | | | | sp:DBPA_ECOLI | P21693 |

Description
ATP-DEPENDENT RNA HELICASE DBPA

| ORF Name | NTID | AAID | NT Length | AA Length | Score | Probability |
|---|---|---|---|---|---|---|
| 4957691_f3_722 | 2093 | 6265 | 195 | 588 | 473 | 6.6e-45 |
| Protein name | | | | | Locus Name | Acc# |
| | | | | | sp:YRBK_ECOLI | P45397 |

Description
HYPOTHETICAL 21.7 KD PROTEIN IN MURA-RPON INTERGENIC REGION (O191)

| ORF Name | NTID | AAID | NT Length | AA Length | Score | Probability |
|---|---|---|---|---|---|---|
| 4957788_f1_70 | 2094 | 6266 | 434 | 1305 | 837 | 1.8e-83 |
| Protein name | | | | | Locus Name | Acc# |
| | | | | | sp:PEPT_BACSU | P55179 |

Description
PEPTIDASE T, (AMINOTRIPEPTIDASE) (TRIPEPTIDASE)

| ORF Name | NTID | AAID | NT Length | AA Length | Score | Probability |
|---|---|---|---|---|---|---|
| 4970068_f3_638 | 2095 | 6267 | 312 | 939 | | |
| Protein name | | | | | Locus Name | Acc# |

Description
NO-HIT

| ORF Name | NTID | AAID | NT Length | AA Length | Score | Probability |
|---|---|---|---|---|---|---|
| 5081303_c3_1363 | 2096 | 6268 | 405 | 1218 | 1335 | 3.0e-136 |
| Protein name | | | | | Locus Name | Acc# |
| | | | | | sp:HYPD_ECOLI | P24192:Q46 |

Description
HYDROGENASE ISOENZYMES FORMATION PROTEIN HYPD

| ORF Name | NTID | AAID | NT Length | AA Length | Score | Probability |
|---|---|---|---|---|---|---|
| 5085766_f1_262 | 2097 | 6269 | 70 | 213 | | |
| Protein name | | | | | Locus Name | Acc# |

Description
NO-HIT

| ORF Name | NTID | AAID | NT Length | AA Length | Score | Probability |
|---|---|---|---|---|---|---|
| 5120300_c2_1241 | 2098 | 6270 | 254 | 765 | 1012 | 5.1e-102 |
| Protein name | | | | | Locus Name | Acc# |
| | | | | | gp:PMFIMOPR | Z32686 |

Description
Proteus mirabilis fimbrial operon, strain HI4320.

| ORF Name | NTID | AAID | NT Length | AA Length | Score | Probability |
|---|---|---|---|---|---|---|
| 5120300_c2_1246 | 2099 | 6271 | 254 | 765 | 1289 | 2.2e-131 |
| Protein name | | | | | Locus Name | Acc# |
| | | | | | gp:PMFIMOPR | Z32686 |

Description
Proteus mirabilis fimbrial operon, strain HI4320.

| ORF Name | NTID | AAID | NT Length | AA Length | Score | Probability |
|---|---|---|---|---|---|---|
| 5162967_f1_211 | 2100 | 6272 | 182 | 549 | 535 | 1.8e-51 |
| Protein name | | | | | Locus Name | Acc# |
| | | | | | sp:BCCP_ECOLI | P02905 |

Description
BIOTIN CARBOXYL CARRIER PROTEIN OF ACETYL-COA CARBOXYLASE (BCCP)

| ORF Name | NTID | AAID | NT Length | AA Length | Score | Probability |
|---|---|---|---|---|---|---|
| 517842_c2_1016 | 2101 | 6273 | 89 | 270 | | |
| Protein name | | | | | Locus Name | Acc# |

Description
NO-HIT

| ORF Name | NTID | AAID | NT Length | AA Length | Score | Probability |
|---|---|---|---|---|---|---|
| 5192686_f2_379 | 2102 | 6274 | 1244 | 3735 | 906 | 8.6e-91 |//
| Protein name | | | | | Locus Name | Acc# |
| | | | | | sp:SBCC_ECOLI | P13458 |

Description: EXONUCLEASE SBCC

| ORF Name | NTID | AAID | NT Length | AA Length | Score | Probability |
|---|---|---|---|---|---|---|
| 5260802_c3_1319 | 2103 | 6275 | 236 | 711 | 743 | 1.6e-73 |
| Protein name | | | | | Locus Name | Acc# |
| | | | | | sp:MTGA_KLEPN | Q48465 |

Description: (EC 2.4.2.-) (MONOFUNCTIONAL TGASE)

| ORF Name | NTID | AAID | NT Length | AA Length | Score | Probability |
|---|---|---|---|---|---|---|
| 5270016_c3_1347 | 2104 | 6276 | 338 | 1017 | 1327 | 2.1e-135 |
| Protein name | | | | | Locus Name | Acc# |
| | | | | | sp:LYTB_ECOLI | P22565 |

Description: LYTB PROTEIN

| ORF Name | NTID | AAID | NT Length | AA Length | Score | Probability |
|---|---|---|---|---|---|---|
| 5270268_c3_1402 | 2105 | 6277 | 437 | 1314 | 1730 | 4.2e-178 |
| Protein name | | | | | Locus Name | Acc# |
| | | | | | sp:TIG_ECOLI | P22257:P15 |

Description: TRIGGER FACTOR (TF)

| ORF Name | NTID | AAID | NT Length | AA Length | Score | Probability |
|---|---|---|---|---|---|---|
| 5281338_f2_362 | 2106 | 6278 | 324 | 975 | 1376 | 1.4e-140 |
| Protein name | | | | | Locus Name | Acc# |
| | | | | | sp:RBSC_ECOLI | P04984 |

Description: RIBOSE TRANSPORT SYSTEM PERMEASE PROTEIN RBSC

| ORF Name | NTID | AAID | NT Length | AA Length | Score | Probability |
|---|---|---|---|---|---|---|
| 5288532_c1_950 | 2107 | 6279 | 76 | 231 | | |
| Protein name | | | | | Locus Name | Acc# |

Description
NO-HIT

| ORF Name | NTID | AAID | NT Length | AA Length | Score | Probability |
|---|---|---|---|---|---|---|
| 5289013_c2_1097 | 2108 | 6280 | 208 | 627 | 1006 | 2.2e-101 |
| Protein name | | | | | Locus Name | Acc# |
| | | | | | sp:UREG_ECOLI | Q03287 |

Description
UREASE ACCESSORY PROTEIN UREG

| ORF Name | NTID | AAID | NT Length | AA Length | Score | Probability |
|---|---|---|---|---|---|---|
| 5290917_c3_1312 | 2109 | 6281 | 170 | 513 | 489 | 1.3e-46 |
| Protein name | | | | | Locus Name | Acc# |
| | | | | | sp:SSPB_ECOLI | P25663 |

Description
STRINGENT STARVATION PROTEIN B

| ORF Name | NTID | AAID | NT Length | AA Length | Score | Probability |
|---|---|---|---|---|---|---|
| 5292178_f3_633 | 2110 | 6282 | 242 | 729 | 401 | 2.8e-37 |
| Protein name | | | | | Locus Name | Acc# |
| hypothetical protein b1672 | | | | | pir:H64924 | H64924 |

Description

| ORF Name | NTID | AAID | NT Length | AA Length | Score | Probability |
|---|---|---|---|---|---|---|
| 5315756_c1_830 | 2111 | 6283 | 212 | 639 | 563 | 1.9e-54 |
| Protein name | | | | | Locus Name | Acc# |
| | | | | | gp:ECOUW67 | U18997 |

Description
Escherichia coli K-12 chromosomal region from 67.4 to 76.0 minutes.

| ORF_Name | NTID | AAID | NT Length | AA Length | Score | Probability |
|---|---|---|---|---|---|---|
| 5336517_c3_1296 | 2112 | 6284 | 362 | 1089 | 1695 | 2.1e-174 |
| Protein name | | | | | Locus Name | Acc# |
| rod shape-determining protein envB | | | | | pir:BVECEB | E65117:A31 |

Description

| ORF_Name | NTID | AAID | NT Length | AA Length | Score | Probability |
|---|---|---|---|---|---|---|
| 5369002_c2_1177 | 2113 | 6285 | 97 | 294 | 373 | 2.6e-34 |
| Protein name | | | | | Locus Name | Acc# |
| | | | | | sp:DBHB_ECOLI | P02341 |

Description
DNA-BINDING PROTEIN HU-BETA (NS1) (HU-1)

| ORF_Name | NTID | AAID | NT Length | AA Length | Score | Probability |
|---|---|---|---|---|---|---|
| 54213_c3_1408 | 2114 | 6286 | 1155 | 3468 | 2694 | 2.9e-280 |
| Protein name | | | | | Locus Name | Acc# |
| | | | | | sp:AEFA_ECOLI | P77338 |

Description
AEFA PROTEIN

| ORF_Name | NTID | AAID | NT Length | AA Length | Score | Probability |
|---|---|---|---|---|---|---|
| 553883_f2_267 | 2115 | 6287 | 459 | 1380 | 2264 | 1.1e-234 |
| Protein name | | | | | Locus Name | Acc# |
| ZapD | | | | | gp:AF064762 | AF064762 |

Description
Proteus mirabilis metalloprotease operon, complete sequence.

| ORF_Name | NTID | AAID | NT Length | AA Length | Score | Probability |
|---|---|---|---|---|---|---|
| 578450_c3_1311 | 2116 | 6288 | 220 | 663 | 875 | 1.7e-87 |
| Protein name | | | | | Locus Name | Acc# |
| stringent starvation protein | | | | | pir:RGECSS | A26422:G65 |

Description

| ORF Name | NTID | AAID | NT Length | AA Length | Score | Probability |
|---|---|---|---|---|---|---|
| 579682_c3_1419 | 2117 | 6289 | 420 | 1263 | 1333 | 4.9e-136 |
| Protein name | | | | | Locus Name | Acc# |
| transporter homolog ycel | | | | | pir:C69757 | C69757 |

Description

| ORF Name | NTID | AAID | NT Length | AA Length | Score | Probability |
|---|---|---|---|---|---|---|
| 580450_c1_798 | 2118 | 6290 | 291 | 876 | 1181 | 6.2e-120 |
| Protein name | | | | | Locus Name | Acc# |
| | | | | | sp:NARK_ECOLI | P10903 |

Description
NITRITE EXTRUSION PROTEIN 1 (NITRITE FACILITATOR 1)

| ORF Name | NTID | AAID | NT Length | AA Length | Score | Probability |
|---|---|---|---|---|---|---|
| 5860052_c1_1011 | 2119 | 6291 | 71 | 216 | | |
| Protein name | | | | | Locus Name | Acc# |

Description
NO-HIT

| ORF Name | NTID | AAID | NT Length | AA Length | Score | Probability |
|---|---|---|---|---|---|---|
| 5864057_f1_216 | 2120 | 6292 | 415 | 1248 | 744 | 1.3e-73 |
| Protein name | | | | | Locus Name | Acc# |
| | | | | | sp:CYNX_ECOLI | P17583:P75 |

Description
CYANATE TRANSPORT PROTEIN CYNX

| ORF Name | NTID | AAID | NT Length | AA Length | Score | Probability |
|---|---|---|---|---|---|---|
| 5953433_f1_221 | 2121 | 6293 | 444 | 1335 | 694 | 2.5e-68 |
| Protein name | | | | | Locus Name | Acc# |
| transporter homolog yvmA | | | | | pir:G70043 | G70043 |

Description

| ORF Name | NTID | AAID | NT Length | AA Length | Score | Probability |
|---|---|---|---|---|---|---|
| 6048377_f2_484 | 2122 | 6294 | 621 | 1866 | 3157 | 0.0 |
| Protein name | | | | | Locus Name | Acc# |
| | | | | | sp:FRDA_PROVU | P20922 |

Description: FUMARATE REDUCTASE FLAVOPROTEIN SUBUNIT,

| ORF Name | NTID | AAID | NT Length | AA Length | Score | Probability |
|---|---|---|---|---|---|---|
| 6054540_c3_1259 | 2123 | 6295 | 67 | 204 | | |
| Protein name | | | | | Locus Name | Acc# |

Description: NO-HIT

| ORF Name | NTID | AAID | NT Length | AA Length | Score | Probability |
|---|---|---|---|---|---|---|
| 6063956_f1_258 | 2124 | 6296 | 151 | 456 | 114 | 1.8e-06 |
| Protein name | | | | | Locus Name | Acc# |
| hypothetical protein PH0221 | | | | | pir:D71245 | D71245 |

Description:

| ORF Name | NTID | AAID | NT Length | AA Length | Score | Probability |
|---|---|---|---|---|---|---|
| 6251292_f3_569 | 2125 | 6297 | 239 | 720 | 849 | 9.5e-85 |
| Protein name | | | | | Locus Name | Acc# |
| | | | | | sp:YADF_ECOLI | P36857:P75 |

Description: HYPOTHETICAL 25.1 KD PROTEIN IN HPT-PAND INTERGENIC REGION

| ORF Name | NTID | AAID | NT Length | AA Length | Score | Probability |
|---|---|---|---|---|---|---|
| 633342_c1_800 | 2126 | 6298 | 532 | 1599 | 2370 | 6.3e-246 |
| Protein name | | | | | Locus Name | Acc# |
| | | | | | sp:NARH_ECOLI | P11349 |

Description: RESPIRATORY NITRATE REDUCTASE 1 BETA CHAIN,

| ORF Name | NTID | AAID | NT Length | AA Length | Score | Probability |
|---|---|---|---|---|---|---|
| 6447131_c2_1165 | 2127 | 6299 | 157 | 474 | 646 | 3.1e-63 |
| Protein name | | | | | Locus Name | Acc# |
| | | | | | sp:RISB_ECOLI | P25540:P77 |

Description: (LUMAZINE SYNTHASE) (RIBOFLAVIN SYNTHASE BETA CHAIN)

| ORF Name | NTID | AAID | NT Length | AA Length | Score | Probability |
|---|---|---|---|---|---|---|
| 647882_c2_1031 | 2128 | 6300 | 337 | 1014 | 1350 | 7.7e-138 |
| Protein name | | | | | Locus Name | Acc# |
| | | | | | sp:SYK3_ECOLI | P03812:P78 |

Description: HYPOTHETICAL LYSYL-TRNA SYNTHETASE HOMOLOG, (GX)

| ORF Name | NTID | AAID | NT Length | AA Length | Score | Probability |
|---|---|---|---|---|---|---|
| 6542153_c3_1287 | 2129 | 6301 | 334 | 1005 | 953 | 9.0e-96 |
| Protein name | | | | | Locus Name | Acc# |
| | | | | | sp:FTSX_ECOLI | P10122 |

Description: CELL DIVISION PROTEIN FTSX

| ORF Name | NTID | AAID | NT Length | AA Length | Score | Probability |
|---|---|---|---|---|---|---|
| 6640880_c2_1092 | 2130 | 6302 | 72 | 219 | | |
| Protein name | | | | | Locus Name | Acc# |

Description: NO-HIT

| ORF Name | NTID | AAID | NT Length | AA Length | Score | Probability |
|---|---|---|---|---|---|---|
| 672078_c3_1384 | 2131 | 6303 | 121 | 366 | 279 | 2.4e-24 |
| Protein name | | | | | Locus Name | Acc# |
| | | | | | sp:RIBD_ECOLI | P25539 |

Description: RIBOFLAVIN-SPECIFIC DEAMINASE,

| ORF Name | NTID | AAID | NT Length | AA Length | Score | Probability |
|---|---|---|---|---|---|---|
| 6828300_f2_393 | 2132 | 6304 | 2385 | 7158 | 1305 | 3.2e-151 |
| Protein name | | | | | Locus Name | Acc# |
| Invasin. | | | | | gp:D90836 | D90836:AB0 |

Description

E.coli genomic DNA, Kohara clone #345(43.9-44.2 min.).

| ORF Name | NTID | AAID | NT Length | AA Length | Score | Probability |
|---|---|---|---|---|---|---|
| 7056452_c3_1262 | 2133 | 6305 | 265 | 798 | 243 | 1.6e-20 |
| Protein name | | | | | Locus Name | Acc# |
| hypothetical protein slr1262 | | | | | pir:S74895 | S74895 |

Description

| ORF Name | NTID | AAID | NT Length | AA Length | Score | Probability |
|---|---|---|---|---|---|---|
| 7065887_c2_1243 | 2134 | 6306 | 108 | 327 | 352 | 4.4e-32 |
| Protein name | | | | | Locus Name | Acc# |
| | | | | | gp:PMFIMOPR | Z32686 |

Description

Proteus mirabilis fimbrial operon, strain HI4320.

| ORF Name | NTID | AAID | NT Length | AA Length | Score | Probability |
|---|---|---|---|---|---|---|
| 7071055_f2_333 | 2135 | 6307 | 75 | 228 | | |
| Protein name | | | | | Locus Name | Acc# |

Description

NO-HIT

| ORF Name | NTID | AAID | NT Length | AA Length | Score | Probability |
|---|---|---|---|---|---|---|
| 7087962_c2_1075 | 2136 | 6308 | 62 | 189 | 102 | 2.7e-05 |
| Protein name | | | | | Locus Name | Acc# |
| hypothetical protein APE1913 | | | | | pir:A72579 | A72579 |

Description

| ORF Name | NTID | AAID | NT Length | AA Length | Score | Probability |
|---|---|---|---|---|---|---|
| 7205401_c3_1406 | 2137 | 6309 | 94 | 285 | | |
| Protein name | | | | | Locus Name | Acc# |

Description
NO-HIT

| ORF Name | NTID | AAID | NT Length | AA Length | Score | Probability |
|---|---|---|---|---|---|---|
| 7225192_f3_751 | 2138 | 6310 | 66 | 201 | 64 | 0.0077 |
| Protein name | | | | | Locus Name | Acc# |
| | | | | | sp:HPPK_ECOLI | P26281 |

Description
(HPPK) (6-HYDROXYMETHYL-7,8-DIHYDROPTERIN PYROPHOSPHOKINASE) (PPPK)

| ORF Name | NTID | AAID | NT Length | AA Length | Score | Probability |
|---|---|---|---|---|---|---|
| 7266090_f1_202 | 2139 | 6311 | 310 | 933 | 1432 | 1.6e-146 |
| Protein name | | | | | Locus Name | Acc# |
| unknown | | | | | gp:AF088980 | AF088980 |

Description
Proteus mirabilis NPR (npr) gene, complete cds; and unknown gene.

| ORF Name | NTID | AAID | NT Length | AA Length | Score | Probability |
|---|---|---|---|---|---|---|
| 7303437_c1_793 | 2140 | 6312 | 81 | 246 | | |
| Protein name | | | | | Locus Name | Acc# |

Description
NO-HIT

| ORF Name | NTID | AAID | NT Length | AA Length | Score | Probability |
|---|---|---|---|---|---|---|
| 7304557_c1_897 | 2141 | 6313 | 91 | 276 | | |
| Protein name | | | | | Locus Name | Acc# |

Description
NO-HIT

| ORF Name | NTID | AAID | NT Length | AA Length | Score | Probability |
|---|---|---|---|---|---|---|
| 783543_f3_702 | 2142 | 6314 | 138 | 417 | 257 | 5.1e-22 |
| Protein name | | | | | Locus Name | Acc# |
| | | | | | sp:YRAN_ECOLI | P45465 |

Description: HYPOTHETICAL 14.8 KD PROTEIN IN AGAI-MTR INTERGENIC REGION (O131)

| ORF Name | NTID | AAID | NT Length | AA Length | Score | Probability |
|---|---|---|---|---|---|---|
| 788927_c1_874 | 2143 | 6315 | 862 | 2589 | 3313 | 0.0 |
| Protein name | | | | | Locus Name | Acc# |
| | | | | | sp:AK1H_SERMA | P27725:Q59 |

Description

| ORF Name | NTID | AAID | NT Length | AA Length | Score | Probability |
|---|---|---|---|---|---|---|
| 807952_c3_1299 | 2144 | 6316 | 172 | 519 | 355 | 2.1e-32 |
| Protein name | | | | | Locus Name | Acc# |
| | | | | | sp:RN_BACIN | P00649 |

Description: RIBONUCLEASE PRECURSOR, (BINASE)

| ORF Name | NTID | AAID | NT Length | AA Length | Score | Probability |
|---|---|---|---|---|---|---|
| 812707_f2_380 | 2145 | 6317 | 208 | 627 | 241 | 2.5e-20 |
| Protein name | | | | | Locus Name | Acc# |
| | | | | | sp:YC08_YEAST | P37261 |

Description: HYPOTHETICAL 21.1 KD PROTEIN IN FUS1-AGP1 INTERGENIC REGION

| ORF Name | NTID | AAID | NT Length | AA Length | Score | Probability |
|---|---|---|---|---|---|---|
| 817192_f3_691 | 2146 | 6318 | 360 | 1083 | 188 | 2.1e-12 |
| Protein name | | | | | Locus Name | Acc# |
| | | | | | sp:FECR_ECOLI | P23485 |

Description: FECR PROTEIN

518

| ORF Name | NTID | AAID | NT Length | AA Length | Score | Probability |
|---|---|---|---|---|---|---|
| 823338_f1_18 | 2147 | 6319 | 74 | 225 | 167 | 1.8e-12 |
| Protein name | | | | | Locus Name | Acc# |
| hypothetical protein | | | | | pir:S75993 | S75993 |

Description: Proteus mirabilis metalloprotease operon, complete sequence.

| ORF Name | NTID | AAID | NT Length | AA Length | Score | Probability |
|---|---|---|---|---|---|---|
| 834687_f3_508 | 2148 | 6320 | 574 | 1725 | 2919 | 0.0 |
| Protein name | | | | | Locus Name | Acc# |
| ZapE | | | | | gp:AF064762 | AF064762 |

Description: Proteus mirabilis metalloprotease operon, complete sequence.

| ORF Name | NTID | AAID | NT Length | AA Length | Score | Probability |
|---|---|---|---|---|---|---|
| 93752_f3_620 | 2149 | 6321 | 182 | 549 | 443 | 1.0e-41 |
| Protein name | | | | | Locus Name | Acc# |
| | | | | | sp:RBSD_ECOLI | P04982 |

Description: HIGH AFFINITY RIBOSE TRANSPORT PROTEIN RBSD

| ORF Name | NTID | AAID | NT Length | AA Length | Score | Probability |
|---|---|---|---|---|---|---|
| 964668_c2_1242 | 2150 | 6322 | 219 | 660 | 483 | 5.8e-46 |
| Protein name | | | | | Locus Name | Acc# |
| | | | | | gp:PMFIMOPR | Z32686 |

Description: Proteus mirabilis fimbrial operon, strain HI4320.

| ORF Name | NTID | AAID | NT Length | AA Length | Score | Probability |
|---|---|---|---|---|---|---|
| 976577_c2_1095 | 2151 | 6323 | 161 | 486 | 856 | 1.7e-85 |
| Protein name | | | | | Locus Name | Acc# |
| | | | | | sp:UREE_PROMI | P17090 |

Description: UREASE ACCESSORY PROTEIN UREE

| ORF Name | NTID | AAID | NT Length | AA Length | Score | Probability |
|---|---|---|---|---|---|---|
| 9767076_f1_52 | 2152 | 6324 | 458 | 1377 | 1204 | 2.3e-122 |
| Protein name | | | | | Locus Name | Acc# |
| | | | | | sp:UHPC_ECOLI | P09836:P76 |

Description: REGULATORY PROTEIN UHPC

| ORF Name | NTID | AAID | NT Length | AA Length | Score | Probability |
|---|---|---|---|---|---|---|
| 9774087_f1_195 | 2153 | 6325 | 307 | 924 | | |
| Protein name | | | | | Locus Name | Acc# |

Description: NO-HIT

| ORF Name | NTID | AAID | NT Length | AA Length | Score | Probability |
|---|---|---|---|---|---|---|
| 978428_c3_1340 | 2154 | 6326 | 431 | 1296 | 1781 | 1.6e-183 |
| Protein name | | | | | Locus Name | Acc# |
| | | | | | sp:THRC_SERMA | P27735 |

Description: THREONINE SYNTHASE,

| ORF Name | NTID | AAID | NT Length | AA Length | Score | Probability |
|---|---|---|---|---|---|---|
| 9784636_f2_439 | 2155 | 6327 | 384 | 1155 | 1054 | 1.8e-106 |
| Protein name | | | | | Locus Name | Acc# |
| | | | | | sp:DEGS_ECOLI | P31137 |

Description: PROTEASE DEGS PRECURSOR,

| ORF Name | NTID | AAID | NT Length | AA Length | Score | Probability |
|---|---|---|---|---|---|---|
| 9798461_c1_1015 | 2156 | 6328 | 66 | 201 | | |
| Protein name | | | | | Locus Name | Acc# |

Description: NO-HIT

520

| ORF Name | NTID | AAID | NT Length | AA Length | Score | Probability |
|---|---|---|---|---|---|---|
| 9822538_f3_786 | 2157 | 6329 | 173 | 522 | | |
| Protein name | | | | | Locus Name | Acc# |

Description
NO-HIT

| ORF Name | NTID | AAID | NT Length | AA Length | Score | Probability |
|---|---|---|---|---|---|---|
| 9864786_c2_1026 | 2158 | 6330 | 574 | 1725 | 2296 | 4.4e-238 |
| Protein name | | | | | Locus Name | Acc# |
| formate dehydrogenase-H alpha subunit | | | | | gp:ECOUW89 | U00006 |

Description
E. coli chromosomal region from 89.2 to 92.8 minutes.

| ORF Name | NTID | AAID | NT Length | AA Length | Score | Probability |
|---|---|---|---|---|---|---|
| 9881586_c2_1176 | 2159 | 6331 | 118 | 357 | 320 | 1.1e-28 |
| Protein name | | | | | Locus Name | Acc# |
| | | | | | sp:BOLA_ECOLI | P15298 |

Description
BOLA PROTEIN

| ORF Name | NTID | AAID | NT Length | AA Length | Score | Probability |
|---|---|---|---|---|---|---|
| 9893805_c3_1383 | 2160 | 6332 | 264 | 795 | 874 | 2.1e-87 |
| Protein name | | | | | Locus Name | Acc# |
| | | | | | sp:RIBD_ECOLI | P25539 |

Description
RIBOFLAVIN-SPECIFIC DEAMINASE,

| ORF Name | NTID | AAID | NT Length | AA Length | Score | Probability |
|---|---|---|---|---|---|---|
| 9942827_c2_1244 | 2161 | 6333 | 204 | 615 | 871 | 4.4e-87 |
| Protein name | | | | | Locus Name | Acc# |
| | | | | | sp:MRPA_PROMI | Q03011 |

Description
MAJOR MR/P FIMBRIA PROTEIN PRECURSOR

521

| ORF_Name | NTID | AAID | NT Length | AA Length | Score | Probability |
|---|---|---|---|---|---|---|
| 9960885_c2_1150 | 2162 | 6334 | 73 | 222 | | |
| Protein_name | | | | | Locus_Name | Acc# |

Description
NO-HIT

| ORF_Name | NTID | AAID | NT Length | AA Length | Score | Probability |
|---|---|---|---|---|---|---|
| 9960885_c2_1152 | 2163 | 6335 | 168 | 507 | | |
| Protein_name | | | | | Locus_Name | Acc# |

Description
NO-HIT

| ORF_Name | NTID | AAID | NT Length | AA Length | Score | Probability |
|---|---|---|---|---|---|---|
| 14933452_f2_5 | 2164 | 6336 | 349 | 1050 | 1110 | 2.1e-112 |
| Protein_name | | | | | Locus_Name | Acc# |
| UDP-N-acetylpyruvoylglucosamine reductase | | | | | gp:ECOMURBA | L14557 |

Description
Escherichia coli UDP-N-acetylpyruvoylglucosamine reductase (murB) gene, complete cds, and biotin operon repressor/biotin holoenzyme (birA) gene, 3' end.

| ORF_Name | NTID | AAID | NT Length | AA Length | Score | Probability |
|---|---|---|---|---|---|---|
| 157837_c1_8 | 2165 | 6337 | 390 | 1173 | 1283 | 9.7e-131 |
| Protein_name | | | | | Locus_Name | Acc# |
| 96% identity over 316 amino acids with E. coli | | | | | gp:STYSTMF1 | AF170176 |

Description
Salmonella typhimurium fragment STMF1.

| ORF_Name | NTID | AAID | NT Length | AA Length | Score | Probability |
|---|---|---|---|---|---|---|
| 20032937_c1_10 | 2166 | 6338 | 71 | 216 | | |
| Protein_name | | | | | Locus_Name | Acc# |

Description
NO-HIT

522

| ORF_Name | NTID | AAID | NT Length | AA Length | Score | Probability |
|---|---|---|---|---|---|---|
| 24875000_c3_23 | 2167 | 6339 | 73 | 222 | 76 | 0.010 |
| Protein name | | | | | Locus Name | Acc# |
| NADH-ubiquinone oxidoreductase subunit 6 | | | | | gp:GPA249395 | AJ249395 |

Description

Globodera pallida mitochondrial COII, ND4, COIII, ND6, ND1, ND3 and cytb genes.

| ORF_Name | NTID | AAID | NT Length | AA Length | Score | Probability |
|---|---|---|---|---|---|---|
| 30361665_f1_2 | 2168 | 6340 | 326 | 981 | 1128 | 2.6e-114 |
| Protein name | | | | | Locus Name | Acc# |
| Salmonella typhimurium bifunctional protein | | | | | gp:STYSTMF1 | AF170176 |

Description

Salmonella typhimurium fragment STMF1.

| ORF_Name | NTID | AAID | NT Length | AA Length | Score | Probability |
|---|---|---|---|---|---|---|
| 33988937_c1_7 | 2169 | 6341 | 90 | 273 | | |
| Protein name | | | | | Locus Name | Acc# |

Description

NO-HIT

| ORF_Name | NTID | AAID | NT Length | AA Length | Score | Probability |
|---|---|---|---|---|---|---|
| 6063956_c1_13 | 2170 | 6342 | 156 | 471 | 114 | 1.8e-06 |
| Protein name | | | | | Locus Name | Acc# |
| hypothetical protein PH0221 | | | | | pir:D71245 | D71245 |

Description

| ORF_Name | NTID | AAID | NT Length | AA Length | Score | Probability |
|---|---|---|---|---|---|---|
| 9822538_c3_26 | 2171 | 6343 | 173 | 522 | | |
| Protein name | | | | | Locus Name | Acc# |

Description

NO-HIT

| ORF Name | NTID | AAID | NT Length | AA Length | Score | Probability |
|---|---|---|---|---|---|---|
| 10128_f3_448 | 2172 | 6344 | 384 | 1155 | | |
| Protein name | | | | | Locus Name | Acc# |

Description: NO-HIT

| ORF Name | NTID | AAID | NT Length | AA Length | Score | Probability |
|---|---|---|---|---|---|---|
| 10162932_c2_707 | 2173 | 6345 | 643 | 1932 | 2735 | 1.3e-284 |
| Protein name | | | | | Locus Name | Acc# |
| | | | | | sp:PARE_ECOLI | P20083 |

Description: TOPOISOMERASE IV SUBUNIT B,

| ORF Name | NTID | AAID | NT Length | AA Length | Score | Probability |
|---|---|---|---|---|---|---|
| 10275307_c3_883 | 2174 | 6346 | 108 | 327 | 225 | 1.3e-18 |
| Protein name | | | | | Locus Name | Acc# |
| | | | | | sp:YQCC_ECOLI | Q46919 |

Description: HYPOTHETICAL 12.8 KD PROTEIN IN BARA-SYD INTERGENIC REGION

| ORF Name | NTID | AAID | NT Length | AA Length | Score | Probability |
|---|---|---|---|---|---|---|
| 1032777_f2_221 | 2175 | 6347 | 273 | 822 | 669 | 1.1e-65 |
| Protein name | | | | | Locus Name | Acc# |
| | | | | | sp:YGIM_ECOLI | P39202 |

Description: HYPOTHETICAL 23.1 KD PROTEIN IN GLNE-CCA INTERGENIC REGION PRECURSOR

| ORF Name | NTID | AAID | NT Length | AA Length | Score | Probability |
|---|---|---|---|---|---|---|
| 10551578_c2_738 | 2176 | 6348 | 252 | 759 | 901 | 2.9e-90 |
| Protein name | | | | | Locus Name | Acc# |
| | | | | | sp:UPPS_ECOLI | Q47675:P75 |

Description: (DI-TRANS-POLY-CIS-DECAPRENYLCISTRANSFERASE)

| ORF Name | NTID | AAID | NT Length | AA Length | Score | Probability |
|---|---|---|---|---|---|---|
| 10585833_c2_750 | 2177 | 6349 | 197 | 594 | 697 | 1.2e-68 |
| Protein name | | | | | Locus Name | Acc# |
| | | | | | sp:YAED_ECOLI | P31546 |

Description
HYPOTHETICAL 21.3 KD PROTEIN IN ABC-RRSH INTERGENIC REGION

| ORF Name | NTID | AAID | NT Length | AA Length | Score | Probability |
|---|---|---|---|---|---|---|
| 10837777_c2_660 | 2178 | 6350 | 415 | 1248 | 1777 | 4.4e-183 |
| Protein name | | | | | Locus Name | Acc# |
| | | | | | sp:NADR_ECOLI | P27278:P76 |

Description
TRANSCRIPTIONAL REGULATOR NADR

| ORF Name | NTID | AAID | NT Length | AA Length | Score | Probability |
|---|---|---|---|---|---|---|
| 10970327_f3_368 | 2179 | 6351 | 452 | 1359 | 1407 | 7.0e-144 |
| Protein name | | | | | Locus Name | Acc# |
| | | | | | sp:SURA_ECOLI | P21202:P75 |

Description
SURA), (PPIASE) (ROTAMASE C)

| ORF Name | NTID | AAID | NT Length | AA Length | Score | Probability |
|---|---|---|---|---|---|---|
| 10970343_f1_8 | 2180 | 6352 | 88 | 267 | 241 | 2.5e-20 |
| Protein name | | | | | Locus Name | Acc# |
| yaeO protein | | | | | pir:E64743 | E64743 |

Description

| ORF Name | NTID | AAID | NT Length | AA Length | Score | Probability |
|---|---|---|---|---|---|---|
| 10_f3_434 | 2181 | 6353 | 60 | 183 | | |
| Protein name | | | | | Locus Name | Acc# |

Description
NO-HIT

| ORF Name | NTID | AAID | NT Length | AA Length | Score | Probability |
|---|---|---|---|---|---|---|
| 11209683_c2_729 | 2182 | 6354 | 264 | 795 | 921 | 2.2e-92 |
| Protein name | | | | | Locus Name | Acc# |
| | | | | | sp:YQCB_ERWCA | Q47417 |

Description: EXOENZYME REGULATION REGULON ORF1

| ORF Name | NTID | AAID | NT Length | AA Length | Score | Probability |
|---|---|---|---|---|---|---|
| 11728931_f1_2 | 2183 | 6355 | 72 | 219 | | |
| Protein name | | | | | Locus Name | Acc# |

Description: NO-HIT

| ORF Name | NTID | AAID | NT Length | AA Length | Score | Probability |
|---|---|---|---|---|---|---|
| 11882203_c1_527 | 2184 | 6356 | 423 | 1272 | 1816 | 3.2e-187 |
| Protein name | | | | | Locus Name | Acc# |
| | | | | | sp:DEOB_ECOLI | P07651 |

Description: PHOSPHOPENTOMUTASE, (PHOSPHODEOXYRIBOMUTASE)

| ORF Name | NTID | AAID | NT Length | AA Length | Score | Probability |
|---|---|---|---|---|---|---|
| 11924125_f2_278 | 2185 | 6357 | 231 | 696 | 112 | 2.8e-06 |
| Protein name | | | | | Locus Name | Acc# |
| hypothetical protein PH1432 | | | | | pir:C71017 | C71017 |

Description:

| ORF Name | NTID | AAID | NT Length | AA Length | Score | Probability |
|---|---|---|---|---|---|---|
| 1212875_c3_849 | 2186 | 6358 | 437 | 1314 | 110 | 1.7e-05 |
| Protein name | | | | | Locus Name | Acc# |
| | | | | | gp:MGU02129 | U02129 |

Description: Mycoplasma genitalium random genomic clone sa7, partial cds.

| ORF Name | NTID | AAID | NT Length | AA Length | Score | Probability |
|---|---|---|---|---|---|---|
| 1228165_c1_541 | 2187 | 6359 | 236 | 711 | 965 | 4.8e-97 |
| Protein name | | | | | Locus Name | Acc# |
| TerD | | | | | gp:AF168355 | AF168355 |

Description: Proteus mirabilis tellurite resistance locus, complete sequence;and unknown gene.

| ORF Name | NTID | AAID | NT Length | AA Length | Score | Probability |
|---|---|---|---|---|---|---|
| 12303412_c3_806 | 2188 | 6360 | 495 | 1488 | 1703 | 3.0e-175 |
| Protein name | | | | | Locus Name | Acc# |
| | | | | | sp:PPB_SERMA | P19147 |

Description: ALKALINE PHOSPHATASE PRECURSOR, (APASE)

| ORF Name | NTID | AAID | NT Length | AA Length | Score | Probability |
|---|---|---|---|---|---|---|
| 12515625_f2_227 | 2189 | 6361 | 65 | 198 | | |
| Protein name | | | | | Locus Name | Acc# |

Description: NO-HIT

| ORF Name | NTID | AAID | NT Length | AA Length | Score | Probability |
|---|---|---|---|---|---|---|
| 1256293_c3_896 | 2190 | 6362 | 257 | 774 | 447 | 3.8e-42 |
| Protein name | | | | | Locus Name | Acc# |
| | | | | | sp:DHGA_BACME | P10528 |

Description: GLUCOSE 1-DEHYDROGENASE A,

| ORF Name | NTID | AAID | NT Length | AA Length | Score | Probability |
|---|---|---|---|---|---|---|
| 1257188_c1_525 | 2191 | 6363 | 266 | 801 | 1070 | 3.6e-108 |
| Protein name | | | | | Locus Name | Acc# |
| | | | | | sp:DEOC_ECOLI | P00882 |

Description: (DEOXYRIBOALDOLASE)

| ORF Name | NTID | AAID | NT Length | AA Length | Score | Probability |
|---|---|---|---|---|---|---|
| 131558_f1_127 | 2192 | 6364 | 73 | 222 | 129 | 1.9e-08 |

Protein name: unknown protein  
Locus Name: gp:MSGTCWPA  
Acc#: M15467

Description: M.tuberculosis 65 kDa antigen (cell wall protein a) gene.

| ORF Name | NTID | AAID | NT Length | AA Length | Score | Probability |
|---|---|---|---|---|---|---|
| 13671893_c2_705 | 2193 | 6365 | 221 | 666 | 903 | 1.8e-90 |

Protein name  
Locus Name: sp:RIBB_ECOLI  
Acc#: P24199

Description: 3,4-DIHYDROXY-2-BUTANONE 4-PHOSPHATE SYNTHASE (DHBP SYNTHASE)

| ORF Name | NTID | AAID | NT Length | AA Length | Score | Probability |
|---|---|---|---|---|---|---|
| 13728437_c1_586 | 2194 | 6366 | 365 | 1098 | 1303 | 7.4e-133 |

Protein name  
Locus Name: sp:MLTA_ECOLI  
Acc#: P46885:P76

Description: (MUREIN HYDROLASE A) (MLT38)

| ORF Name | NTID | AAID | NT Length | AA Length | Score | Probability |
|---|---|---|---|---|---|---|
| 13867317_f1_88 | 2195 | 6367 | 90 | 273 | 107 | 4.0e-06 |

Protein name  
Locus Name: gp:AB008550  
Acc#: AB008550

Description: Pseudomonas aeruginosa phage phi CTX, complete genome sequence.

| ORF Name | NTID | AAID | NT Length | AA Length | Score | Probability |
|---|---|---|---|---|---|---|
| 13945256_c3_876 | 2196 | 6368 | 167 | 504 | 97 | 4.9e-05 |

Protein name  
Locus Name: sp:YGDB_ECOLI  
Acc#: P08370

Description: HYPOTHETICAL 13.5 KD PROTEIN IN PPDC-PPDB INTERGENIC REGION

| ORF Name | NTID | AAID | NT Length | AA Length | Score | Probability |
|---|---|---|---|---|---|---|
| 14097202_f3_458 | 2197 | 6369 | 264 | 795 | 599 | 2.9e-58 |
| Protein name | | | | | Locus Name | Acc# |
| | | | | | sp:YC72_HAEIN | Q57243:005 |

Description: HYPOTHETICAL ABC TRANSPORTER ATP-BINDING PROTEIN HI1272

| ORF Name | NTID | AAID | NT Length | AA Length | Score | Probability |
|---|---|---|---|---|---|---|
| 14261076_f1_86 | 2198 | 6370 | 342 | 1029 | 126 | 3.6e-05 |
| Protein name | | | | | Locus Name | Acc# |
| R-Reggie-1.1 | | | | | gp:RNU64999 | U64999 |

Description: Rattus norvegicus R-reggie-1.1 mRNA, complete cds.

| ORF Name | NTID | AAID | NT Length | AA Length | Score | Probability |
|---|---|---|---|---|---|---|
| 14331342_f1_6 | 2199 | 6371 | 243 | 732 | 778 | 3.2e-77 |
| Protein name | | | | | Locus Name | Acc# |
| | | | | | sp:YAEB_ECOLI | P28634 |

Description: HYPOTHETICAL 26.4 KD PROTEIN IN PROS-RCSF INTERGENIC REGION (ORF3)

| ORF Name | NTID | AAID | NT Length | AA Length | Score | Probability |
|---|---|---|---|---|---|---|
| 14463936_c1_510 | 2200 | 6372 | 555 | 1668 | 1978 | 2.2e-204 |
| Protein name | | | | | Locus Name | Acc# |
| putative substrate-binding protein | | | | | gp:STU94729 | U94729 |

Description: Salmonella typhimurium oxd-6 operon, putative substrate-bindingprotein (oxd-6a), putative transmembrane protein (oxd-6), putativetransmembrane protein (oxd-6c), putative ATPase (oxd-6d), andputative ATPase (oxd-6e) genes, complete cds.

| ORF Name | NTID | AAID | NT Length | AA Length | Score | Probability |
|---|---|---|---|---|---|---|
| 14472827_c1_539 | 2201 | 6373 | 382 | 1149 | 1977 | 2.8e-204 |
| Protein name | | | | | Locus Name | Acc# |
| TerA | | | | | gp:AF168355 | AF168355 |

Description

Proteus mirabilis tellurite resistance locus, complete sequence;and unknown gene.

| ORF Name | NTID | AAID | NT Length | AA Length | Score | Probability |
|---|---|---|---|---|---|---|
| 14532503_c2_669 | 2202 | 6374 | 438 | 1317 | 412 | 1.9e-38 |
| Protein name | | | | | Locus Name | Acc# |
| | | | | | sp:PGTC_SALTY | P37591 |

Description

PHOSPHOGLYCERATE TRANSPORT REGULATORY PROTEIN PGTC PRECURSOR

| ORF Name | NTID | AAID | NT Length | AA Length | Score | Probability |
|---|---|---|---|---|---|---|
| 14553143_c2_727 | 2203 | 6375 | 319 | 960 | 1312 | 8.2e-134 |
| Protein name | | | | | Locus Name | Acc# |
| | | | | | sp:GCVA_ECOLI | P32064 |

Description (ACTIVATOR)

| ORF Name | NTID | AAID | NT Length | AA Length | Score | Probability |
|---|---|---|---|---|---|---|
| 14570260_f2_311 | 2204 | 6376 | 352 | 1059 | 342 | 5.0e-31 |
| Protein name | | | | | Locus Name | Acc# |
| hypothetical protein 2 | | | | | pir:S62196 | S62196 |

Description

| ORF Name | NTID | AAID | NT Length | AA Length | Score | Probability |
|---|---|---|---|---|---|---|
| 14636012_c1_587 | 2205 | 6377 | 306 | 921 | 1091 | 2.2e-110 |
| Protein name | | | | | Locus Name | Acc# |
| | | | | | sp:YGDL_ECOLI | Q46927 |

Description

HYPOTHETICAL 28.6 KD PROTEIN IN GCVA-MLTA INTERGENIC REGION

| ORF Name | NTID | AAID | NT Length | AA Length | Score | Probability |
|---|---|---|---|---|---|---|
| 14658151_f2_224 | 2206 | 6378 | 240 | 723 | 155 | 3.3e-11 |
| Protein name | | | | | Locus Name | Acc# |
| | | | | | sp:Y644_METJA | Q58060 |

Description
HYPOTHETICAL PROTEIN MJ0644

| ORF Name | NTID | AAID | NT Length | AA Length | Score | Probability |
|---|---|---|---|---|---|---|
| 14875313_f1_48 | 2207 | 6379 | 786 | 2361 | 2612 | 1.4e-271 |
| Protein name | | | | | Locus Name | Acc# |
| | | | | | sp:DPO2_ECOLI | P21189 |

Description
DNA POLYMERASE II, (POL II)

| ORF Name | NTID | AAID | NT Length | AA Length | Score | Probability |
|---|---|---|---|---|---|---|
| 14876050_f1_85 | 2208 | 6380 | 258 | 777 | 409 | 4.0e-38 |
| Protein name | | | | | Locus Name | Acc# |
| | | | | | gp:SMU59239 | U59239 |

Description
Serratia marcescens plasmid R478 orf1, orf2, orf3 genes, completecds, and orf4 gene, partial cds.

| ORF Name | NTID | AAID | NT Length | AA Length | Score | Probability |
|---|---|---|---|---|---|---|
| 15022667_f1_134 | 2209 | 6381 | 129 | 390 | 174 | 3.2e-13 |
| Protein name | | | | | Locus Name | Acc# |
| hypothetical protein APE2422 | | | | | pir:E72472 | E72472 |

Description

| ORF Name | NTID | AAID | NT Length | AA Length | Score | Probability |
|---|---|---|---|---|---|---|
| 15626592_c2_652 | 2210 | 6382 | 276 | 831 | 868 | 9.2e-87 |
| Protein name | | | | | Locus Name | Acc# |
| putative transmembrane protein | | | | | gp:STU94729 | U94729 |

Description
Salmonella typhimurium oxd-6 operon, putative substrate-bindingprotein (oxd-6a), putative transmembrane protein (oxd-6), putativetransmembrane protein (oxd-6c), putative ATPase (oxd-6d), andputative ATPase (oxd-6e) genes, complete cds.

531

| ORF Name | NTID | AAID | NT Length | AA Length | Score | Probability |
|---|---|---|---|---|---|---|
| 156340_c2_633 | 2211 | 6383 | 151 | 456 | | |
| Protein name | | | | | Locus Name | Acc# |

Description
NO-HIT

| ORF Name | NTID | AAID | NT Length | AA Length | Score | Probability |
|---|---|---|---|---|---|---|
| 15658556_c2_735 | 2212 | 6384 | 318 | 957 | 1085 | 9.3e-110 |
| Protein name | | | | | Locus Name | Acc# |
| translation elongation factor EF-Ts | | | | | pir:EFECS | A03525:A45 |

Description

| ORF Name | NTID | AAID | NT Length | AA Length | Score | Probability |
|---|---|---|---|---|---|---|
| 16195962_f1_130 | 2213 | 6385 | 222 | 669 | 97 | 0.0010 |
| Protein name | | | | | Locus Name | Acc# |
| hypothetical protein | | | | | pir:S75243 | S75243 |

Description

| ORF Name | NTID | AAID | NT Length | AA Length | Score | Probability |
|---|---|---|---|---|---|---|
| 162752_f3_366 | 2214 | 6386 | 977 | 2934 | 3842 | 0.0 |
| Protein name | | | | | Locus Name | Acc# |
| probable ATP-dependent helicase hepA | | | | | pir:C64727 | C64727:S15 |

Description

| ORF Name | NTID | AAID | NT Length | AA Length | Score | Probability |
|---|---|---|---|---|---|---|
| 162843_c1_590 | 2215 | 6387 | 196 | 591 | 535 | 1.8e-51 |
| Protein name | | | | | Locus Name | Acc# |
| | | | | | sp:SYDP_ECOLI | P43526 |

Description
SYD PROTEIN

| ORF Name | NTID | AAID | NT Length | AA Length | Score | Probability |
|---|---|---|---|---|---|---|
| 16292786_c1_500 | 2216 | 6388 | 677 | 2034 | 2164 | 4.3e-224 |
| Protein name | | | | | Locus Name | Acc# |
| | | | | | sp:HYFB_ECOLI | P23482 |

Description: HYDROGENASE-4 COMPONENT B,

| ORF Name | NTID | AAID | NT Length | AA Length | Score | Probability |
|---|---|---|---|---|---|---|
| 163452_c2_626 | 2217 | 6389 | 267 | 804 | 980 | 1.2e-98 |
| Protein name | | | | | Locus Name | Acc# |
| electron transfer flavoprotein beta chain fixA | | | | | pir:A64725 | A64725:S40 |

Description:

| ORF Name | NTID | AAID | NT Length | AA Length | Score | Probability |
|---|---|---|---|---|---|---|
| 16425256_f3_375 | 2218 | 6390 | 259 | 780 | 682 | 4.7e-67 |
| Protein name | | | | | Locus Name | Acc# |
| | | | | | sp:YGIB_ECOLI | P24195 |

Description: (O234)

| ORF Name | NTID | AAID | NT Length | AA Length | Score | Probability |
|---|---|---|---|---|---|---|
| 16509683_f1_155 | 2219 | 6391 | 341 | 1026 | 643 | 6.4e-63 |
| Protein name | | | | | Locus Name | Acc# |
| | | | | | sp:YE71_HAEIN | Q57130:O05 |

Description: HYPOTHETICAL ABC TRANSPORTER PERMEASE PROTEIN HI1471

| ORF Name | NTID | AAID | NT Length | AA Length | Score | Probability |
|---|---|---|---|---|---|---|
| 16532667_c1_511 | 2220 | 6392 | 278 | 837 | 656 | 2.7e-64 |
| Protein name | | | | | Locus Name | Acc# |
| putative ATPase | | | | | gp:STU94729 | U94729 |

Description: Salmonella typhimurium oxd-6 operon, putative substrate-bindingprotein (oxd-6a), putative transmembrane protein (oxd-6), putativetransmembrane protein (oxd-6c), putative ATPase (oxd-6d), andputative ATPase (oxd-6e) genes, complete cds.

| ORF Name | NTID | AAID | NT Length | AA Length | Score | Probability |
|---|---|---|---|---|---|---|
| 16835931_f3_432 | 2221 | 6393 | 344 | 1035 | 1285 | 6.0e-131 |
| Protein name | | | | | Locus Name | Acc# |
| | | | | | sp:YJEK_ECOLI | P39280 |

Description

HYPOTHETICAL 38.7 KD PROTEIN IN MOPA-EFP INTERGENIC REGION

| ORF Name | NTID | AAID | NT Length | AA Length | Score | Probability |
|---|---|---|---|---|---|---|
| 16853461_c1_518 | 2222 | 6394 | 92 | 279 | 77 | 0.0061 |
| Protein name | | | | | Locus Name | Acc# |
| | | | | | sp:YJJZ_ECOLI | P55914 |

Description

HYPOTHETICAL 8.7 KD PROTEIN FHUF-HOLD INTERGENIC REGION

| ORF Name | NTID | AAID | NT Length | AA Length | Score | Probability |
|---|---|---|---|---|---|---|
| 16995300_c1_575 | 2223 | 6395 | 114 | 345 | | |
| Protein name | | | | | Locus Name | Acc# |

Description

NO-HIT

| ORF Name | NTID | AAID | NT Length | AA Length | Score | Probability |
|---|---|---|---|---|---|---|
| 17010907_c1_506 | 2224 | 6396 | 141 | 426 | 361 | 4.9e-33 |
| Protein name | | | | | Locus Name | Acc# |
| hypothetical protein b2490 | | | | | pir:A65025 | A65025 |

Description

| ORF Name | NTID | AAID | NT Length | AA Length | Score | Probability |
|---|---|---|---|---|---|---|
| 19556930_f3_395 | 2225 | 6397 | 389 | 1170 | 389 | 5.3e-36 |
| Protein name | | | | | Locus Name | Acc# |
| hypothetical protein | | | | | pir:A75302 | A75302 |

Description

| ORF Name | NTID | AAID | NT Length | AA Length | Score | Probability |
|---|---|---|---|---|---|---|
| 19569401_c3_783 | 2226 | 6398 | 166 | 501 | 184 | 2.8e-14 |
| Protein name | | | | | Locus Name | Acc# |
| sugar-phosphate isomerase | | | | | pir:H72296 | H72296 |

Description

| ORF Name | NTID | AAID | NT Length | AA Length | Score | Probability |
|---|---|---|---|---|---|---|
| 19641666_f3_400 | 2227 | 6399 | 239 | 720 | 742 | 2.1e-73 |
| Protein name | | | | | Locus Name | Acc# |
| | | | | | gp:D90754 | D90754:AB0 |

Description

Escherichia coli genomic DNA. (26.8 - 27.1 min).

| ORF Name | NTID | AAID | NT Length | AA Length | Score | Probability |
|---|---|---|---|---|---|---|
| 19698393_f2_228 | 2228 | 6400 | 269 | 810 | | |
| Protein name | | | | | Locus Name | Acc# |

Description

NO-HIT

| ORF Name | NTID | AAID | NT Length | AA Length | Score | Probability |
|---|---|---|---|---|---|---|
| 19740625_c2_638 | 2229 | 6401 | 197 | 594 | 126 | 4.6e-07 |
| Protein name | | | | | Locus Name | Acc# |
| major subunit of type 1 fimbria | | | | | gp:PMATFGC | Z78535 |

Description

P.mirabilis atf gene cluster.

| ORF Name | NTID | AAID | NT Length | AA Length | Score | Probability |
|---|---|---|---|---|---|---|
| 20068_f1_47 | 2230 | 6402 | 198 | 597 | 194 | 2.4e-15 |
| Protein name | | | | | Locus Name | Acc# |
| hypothetical protein Rv3750c | | | | | pir:G70799 | G70799 |

Description

| ORF Name | NTID | AAID | NT Length | AA Length | Score | Probability |
|---|---|---|---|---|---|---|
| 20099062_f3_364 | 2231 | 6403 | 307 | 924 | 715 | 1.5e-70 |
| Protein name | | | | | Locus Name | Acc# |
| | | | | | sp:YABJ_ECOLI | P31548:P75 |

Description

HYPOTHETICAL ABC TRANSPORTER ATP-BINDING PROTEIN YABJ

| ORF Name | NTID | AAID | NT Length | AA Length | Score | Probability |
|---|---|---|---|---|---|---|
| 20322130_f3_348 | 2232 | 6404 | 476 | 1431 | 1961 | 1.4e-202 |
| Protein name | | | | | Locus Name | Acc# |
| | | | | | sp:YGDH_ECOLI | P37350:Q46 |

Description

HYPOTHETICAL 51.0 KD PROTEIN IN BARA-SDAC INTERGENIC REGION

| ORF Name | NTID | AAID | NT Length | AA Length | Score | Probability |
|---|---|---|---|---|---|---|
| 203455_c3_846 | 2233 | 6405 | 316 | 951 | 487 | 2.2e-46 |
| Protein name | | | | | Locus Name | Acc# |
| | | | | | sp:YGIF_ECOLI | P30871 |

Description

HYPOTHETICAL 48.4 KD PROTEIN IN GLNE-CCA INTERGENIC REGION (ORFXE)

| ORF Name | NTID | AAID | NT Length | AA Length | Score | Probability |
|---|---|---|---|---|---|---|
| 2037812_c2_679 | 2234 | 6406 | 225 | 678 | 1063 | 2.0e-107 |
| Protein name | | | | | Locus Name | Acc# |
| repressor protein | | | | | gp:AF038993 | AF038993 |

Description

Proteus mirabilis repressor protein (tetRJ) and tetracyclineresistance protein (tetAJ) genes, complete cds.

| ORF Name | NTID | AAID | NT Length | AA Length | Score | Probability |
|---|---|---|---|---|---|---|
| 20395968_c1_577 | 2235 | 6407 | 967 | 2904 | 2569 | 5.2e-267 |
| Protein name | | | | | Locus Name | Acc# |
| protease III precursor (pitrilysin) | | | | | gp:ECU29581 | U29581 |

Description

Escherichia coli K-12 genome; approximately 63 to 64 minutes.

536

| ORF Name | NTID | AAID | NT Length | AA Length | Score | Probability |
|---|---|---|---|---|---|---|
| 20526681_c3_854 | 2236 | 6408 | 214 | 645 | 788 | 2.8e-78 |
| Protein name | | | | | Locus Name | Acc# |
| | | | | | sp:YQIE_ECOLI | P36651 |

Description: HYPOTHETICAL 23.7 KD PROTEIN IN ICC-TOLC INTERGENIC REGION (F209)

| ORF Name | NTID | AAID | NT Length | AA Length | Score | Probability |
|---|---|---|---|---|---|---|
| 2133437_c3_891 | 2237 | 6409 | 183 | 552 | 510 | 7.9e-49 |
| Protein name | | | | | Locus Name | Acc# |
| periplasmic protein | | | | | gp:PLU236920 | AJ236920 |

Description: Photorhabdus luminescens yaeL (partial), firA (partial), oma andompH genes.

| ORF Name | NTID | AAID | NT Length | AA Length | Score | Probability |
|---|---|---|---|---|---|---|
| 2145318_f2_213 | 2238 | 6410 | 491 | 1476 | 1547 | 1.0e-158 |
| Protein name | | | | | Locus Name | Acc# |
| HAS ABC exporter outer membrane component | | | | | gp:SMHASF | X98513 |

Description: S.marcescens hasF gene.

| ORF Name | NTID | AAID | NT Length | AA Length | Score | Probability |
|---|---|---|---|---|---|---|
| 21484750_f1_146 | 2239 | 6411 | 103 | 312 | | |
| Protein name | | | | | Locus Name | Acc# |

Description: NO-HIT

| ORF Name | NTID | AAID | NT Length | AA Length | Score | Probability |
|---|---|---|---|---|---|---|
| 21504188_c1_520 | 2240 | 6412 | 172 | 519 | 473 | 6.6e-45 |
| Protein name | | | | | Locus Name | Acc# |
| | | | | | sp:RIMI_ECOLI | P09453 |

Description: (ACETYLATING ENZYME FOR N-TERMINAL OF RIBOSOMAL PROTEIN S18)

| ORF_Name | NTID | AAID | NT Length | AA Length | Score | Probability |
|---|---|---|---|---|---|---|
| 21583412_f3_437 | 2241 | 6413 | 72 | 219 | | |
| Protein name | | | | | Locus Name | Acc# |

Description
NO-HIT

| ORF_Name | NTID | AAID | NT Length | AA Length | Score | Probability |
|---|---|---|---|---|---|---|
| 21598582_c1_497 | 2242 | 6414 | 123 | 372 | 347 | 1.5e-31 |
| Protein name | | | | | Locus Name | Acc# |
| | | | | | sp:YJEI_ECOLI | P39278 |

Description
(O128)

| ORF_Name | NTID | AAID | NT Length | AA Length | Score | Probability |
|---|---|---|---|---|---|---|
| 21663966_c2_725 | 2243 | 6415 | 390 | 1173 | 1394 | 1.7e-142 |
| Protein name | | | | | Locus Name | Acc# |
| | | | | | sp:AMIC_ECOLI | Q46929 |

Description
N-ACETYLMURAMOYL-L-ALANINE AMIDASE AMIC PRECURSOR,

| ORF_Name | NTID | AAID | NT Length | AA Length | Score | Probability |
|---|---|---|---|---|---|---|
| 2167262_c1_576 | 2244 | 6416 | 1129 | 3390 | 3326 | 0.0 |
| Protein name | | | | | Locus Name | Acc# |
| | | | | | sp:EX5C_ECOLI | P07648 |

Description
V GAMMA CHAIN)

| ORF_Name | NTID | AAID | NT Length | AA Length | Score | Probability |
|---|---|---|---|---|---|---|
| 21750675_f1_71 | 2245 | 6417 | 144 | 435 | 108 | 3.2e-06 |
| Protein name | | | | | Locus Name | Acc# |
| conserved hypothetical protein | | | | | pir:H75351 | H75351 |

Description

| ORF Name | NTID | AAID | NT Length | AA Length | Score | Probability |
|---|---|---|---|---|---|---|
| 21753128_c2_659 | 2246 | 6418 | 410 | 1233 | 1829 | 1.3e-188 |
| Protein name | | | | | Locus Name | Acc# |
| | | | | | sp:RADA_ECOLI | P24554 |

Description
DNA REPAIR PROTEIN RADA (DNA REPAIR PROTEIN SMS)

| ORF Name | NTID | AAID | NT Length | AA Length | Score | Probability |
|---|---|---|---|---|---|---|
| 21906962_c3_779 | 2247 | 6419 | 111 | 336 | 155 | 5.9e-10 |
| Protein name | | | | | Locus Name | Acc# |
| | | | | | sp:CSD2_ECOLI | P53513 |

Description
PROTEIN)

| ORF Name | NTID | AAID | NT Length | AA Length | Score | Probability |
|---|---|---|---|---|---|---|
| 21913555_c2_649 | 2248 | 6420 | 589 | 1770 | 2388 | 7.8e-248 |
| Protein name | | | | | Locus Name | Acc# |
| FORMATE HYDROGENLYASE SUBUNIT 5 PRECURSOR (FHL | | | | | gp:D90877 | D90877:AB0 |

Description
E.coli genomic DNA, Kohara clone #424(55.9-56.3 min.).

| ORF Name | NTID | AAID | NT Length | AA Length | Score | Probability |
|---|---|---|---|---|---|---|
| 22073587_c3_775 | 2249 | 6421 | 172 | 519 | 465 | 4.7e-44 |
| Protein name | | | | | Locus Name | Acc# |
| | | | | | sp:FXSA_ECOLI | P37147 |

Description
FXSA PROTEIN

| ORF Name | NTID | AAID | NT Length | AA Length | Score | Probability |
|---|---|---|---|---|---|---|
| 2240681_f1_123 | 2250 | 6422 | 160 | 483 | 472 | 8.5e-45 |
| Protein name | | | | | Locus Name | Acc# |
| transposase homolog A | | | | | gp:HPU95957 | U95957 |

Description
Helicobacter pylori insertion sequence IS606 transposase homologs A(tnpA) and B (tnpB) genes, complete cds.

| ORF Name | NTID | AAID | NT Length | AA Length | Score | Probability |
|---|---|---|---|---|---|---|
| 2243806_f2_266 | 2251 | 6423 | 156 | 471 | 450 | 1.8e-42 |
| Protein name | | | | | Locus Name | Acc# |
| transposase homolog A | | | | | gp:HPU95957 | U95957 |

Description: Helicobacter pylori insertion sequence IS606 transposase homologs A(tnpA) and B (tnpB) genes, complete cds.

| ORF Name | NTID | AAID | NT Length | AA Length | Score | Probability |
|---|---|---|---|---|---|---|
| 22460928_c1_507 | 2252 | 6424 | 64 | 195 | | |
| Protein name | | | | | Locus Name | Acc# |

Description: NO-HIT

| ORF Name | NTID | AAID | NT Length | AA Length | Score | Probability |
|---|---|---|---|---|---|---|
| 22661090_c1_593 | 2253 | 6425 | 827 | 2484 | 3383 | 0.0 |
| Protein name | | | | | Locus Name | Acc# |
| outer membrane antigen | | | | | gp:PLU236920 | AJ236920 |

Description: Photorhabdus luminescens yaeL (partial), firA (partial), oma andompH genes.

| ORF Name | NTID | AAID | NT Length | AA Length | Score | Probability |
|---|---|---|---|---|---|---|
| 22692181_f3_396 | 2254 | 6426 | 157 | 474 | 434 | 9.0e-41 |
| Protein name | | | | | Locus Name | Acc# |
| terW | | | | | gp:PRU49054 | U49054 |

Description: Plasmid R478 region encoding immunity to R478phage/colicin/tellurite resistance cluster, terW, terY and terXgenes, complete cds.

| ORF Name | NTID | AAID | NT Length | AA Length | Score | Probability |
|---|---|---|---|---|---|---|
| 22835052_c3_859 | 2255 | 6427 | 499 | 1500 | 1513 | 4.1e-155 |
| Protein name | | | | | Locus Name | Acc# |
| | | | | | sp:SUFI_ECOLI | P26648 |

Description: SUFI PROTEIN PRECURSOR

| ORF Name | NTID | AAID | NT Length | AA Length | Score | Probability |
|---|---|---|---|---|---|---|
| 22894026_f1_107 | 2256 | 6428 | 245 | 738 | 558 | 6.5e-54 |
| Protein name | | | | | Locus Name | Acc# |
| | | | | | sp:SMP_ECOLI | P18838 |

Description: SMP PROTEIN PRECURSOR

| ORF Name | NTID | AAID | NT Length | AA Length | Score | Probability |
|---|---|---|---|---|---|---|
| 22910818_c1_589 | 2257 | 6429 | 371 | 1116 | 1459 | 2.2e-149 |
| Protein name | | | | | Locus Name | Acc# |
| | | | | | sp:YGDE_ECOLI | P32066 |

Description: HYPOTHETICAL 41.9 KD PROTEIN IN FUCR-GCVA INTERGENIC REGION (ORF3)

| ORF Name | NTID | AAID | NT Length | AA Length | Score | Probability |
|---|---|---|---|---|---|---|
| 22923518_c2_639 | 2258 | 6430 | 236 | 711 | 305 | 4.2e-27 |
| Protein name | | | | | Locus Name | Acc# |
| | | | | | sp:YCBR_ECOLI | P75856 |

Description: REGION PRECURSOR

| ORF Name | NTID | AAID | NT Length | AA Length | Score | Probability |
|---|---|---|---|---|---|---|
| 22925200_f2_303 | 2259 | 6431 | 295 | 888 | 1139 | 1.8e-115 |
| Protein name | | | | | Locus Name | Acc# |
| | | | | | sp:CAID_ECOLI | P31551:P75 |

Description: CARNITINE RACEMASE,

| ORF Name | NTID | AAID | NT Length | AA Length | Score | Probability |
|---|---|---|---|---|---|---|
| 22932893_f3_384 | 2260 | 6432 | 75 | 228 | 357 | 1.3e-32 |
| Protein name | | | | | Locus Name | Acc# |
| ribosomal protein S21 | | | | | pir:R3EC21 | A02749:A30 |

Description

| ORF Name | NTID | AAID | NT Length | AA Length | Score | Probability |
|---|---|---|---|---|---|---|
| 23469213_f1_138 | 2261 | 6433 | 384 | 1155 | 1883 | 2.5e-194 |
| Protein name | | | | | Locus Name | Acc# |
| | | | | | sp:CAIA_ECOLI | P31571 |

Description
PROBABLE CARNITINE OPERON OXIDOREDUCTASE CAIA,

| ORF Name | NTID | AAID | NT Length | AA Length | Score | Probability |
|---|---|---|---|---|---|---|
| 23470952_c2_604 | 2262 | 6434 | 309 | 930 | 182 | 3.9e-12 |
| Protein name | | | | | Locus Name | Acc# |
| spa33 protein | | | | | pir:F49846 | F49846:E42 |

Description

| ORF Name | NTID | AAID | NT Length | AA Length | Score | Probability |
|---|---|---|---|---|---|---|
| 23478311_c3_761 | 2263 | 6435 | 327 | 984 | 284 | 1.0e-24 |
| Protein name | | | | | Locus Name | Acc# |
| methyl-accepting chemotaxis protein (MCP) | | | | | pir:H71917 | H71917 |

Description

| ORF Name | NTID | AAID | NT Length | AA Length | Score | Probability |
|---|---|---|---|---|---|---|
| 23491381_f1_109 | 2264 | 6436 | 1180 | 3543 | 493 | 9.6e-43 |
| Protein name | | | | | Locus Name | Acc# |
| liver stage antigen LSA-1 | | | | | pir:A45592 | S24597:A45 |

Description

| ORF Name | NTID | AAID | NT Length | AA Length | Score | Probability |
|---|---|---|---|---|---|---|
| 2350337_c1_463 | 2265 | 6437 | 739 | 2220 | 226 | 2.0e-15 |
| Protein name | | | | | Locus Name | Acc# |
| | | | | | sp:IPAB_SHIFL | P18011 |

Description
62 KD MEMBRANE ANTIGEN

| ORF Name | NTID | AAID | NT Length | AA Length | Score | Probability |
|---|---|---|---|---|---|---|
| 23570837_f3_459 | 2266 | 6438 | 287 | 864 | 773 | 1.1e-76 |

| Protein name | Locus Name | Acc# |
|---|---|---|
| molybdenum transport protein | gp:AF081283 | AF081283 |

Description

Escherichia coli strain CFT073 alanine racemase (dadX), F536(f536), F304 (f304), O241 (o241), TonB-dependent outer membranereceptor (prrA), molybdenum transport protein (modD), Orf2, andferric enterobactin transport ATP-binding protein (fepC) genes, complete cds.

| ORF Name | NTID | AAID | NT Length | AA Length | Score | Probability |
|---|---|---|---|---|---|---|
| 23594687_c2_730 | 2267 | 6439 | 496 | 1491 | 1994 | 4.4e-206 |

| Protein name | Locus Name | Acc# |
|---|---|---|
|  | sp:PTGB_ECOLI | P05053 |

Description (EC 2.7.1.69) (EII-GLC)

| ORF Name | NTID | AAID | NT Length | AA Length | Score | Probability |
|---|---|---|---|---|---|---|
| 23602050_c3_759 | 2268 | 6440 | 335 | 1008 | 1181 | 6.2e-120 |

| Protein name | Locus Name | Acc# |
|---|---|---|
|  | sp:GNTR_ECOLI | P46860:Q47 |

Description

GLUCONATE UTILIZATION SYSTEM GNT-I TRANSCRIPTIONAL REPRESSOR

| ORF Name | NTID | AAID | NT Length | AA Length | Score | Probability |
|---|---|---|---|---|---|---|
| 23625012_f2_292 | 2269 | 6441 | 466 | 1401 | 2021 | 6.1e-209 |

| Protein name | Locus Name | Acc# |
|---|---|---|
| aspartase | gp:ECOUW93 | U14003 |

Description

Escherichia coli K-12 chromosomal region from 92.8 to 00.1 minutes.

| ORF Name | NTID | AAID | NT Length | AA Length | Score | Probability |
|---|---|---|---|---|---|---|
| 23633557_c1_489 | 2270 | 6442 | 408 | 1227 | 283 | 2.5e-34 |
| Protein name | | | | | Locus Name | Acc# |
| | | | | | sp:YGCG_ECOLI | P55140 |

Description: HYPOTHETICAL 34.9 KD PROTEIN IN CYSJ-ENO INTERGENIC REGION (O313)

| ORF Name | NTID | AAID | NT Length | AA Length | Score | Probability |
|---|---|---|---|---|---|---|
| 23671886_c2_666 | 2271 | 6443 | 182 | 549 | 502 | 5.6e-48 |
| Protein name | | | | | Locus Name | Acc# |
| YRAO | | | | | gp:AB024559 | AB024559 |

Description: Bacillus halodurans gene for YKVW and YRAO, partial cds.

| ORF Name | NTID | AAID | NT Length | AA Length | Score | Probability |
|---|---|---|---|---|---|---|
| 23719212_f2_167 | 2272 | 6444 | 183 | 552 | 312 | 7.6e-28 |
| Protein name | | | | | Locus Name | Acc# |
| exopolysaccharide synthesis regulator rcsF | | | | | pir:D64744 | D64744:B47 |

Description:

| ORF Name | NTID | AAID | NT Length | AA Length | Score | Probability |
|---|---|---|---|---|---|---|
| 238261_f3_369 | 2273 | 6445 | 288 | 867 | 1188 | 1.1e-120 |
| Protein name | | | | | Locus Name | Acc# |
| | | | | | sp:APAH_SALTY | Q56018 |

Description: (DIADENOSINE TETRAPHOSPHATASE)

| ORF Name | NTID | AAID | NT Length | AA Length | Score | Probability |
|---|---|---|---|---|---|---|
| 23859753_f2_249 | 2274 | 6446 | 501 | 1506 | 1113 | 1.0e-112 |
| Protein name | | | | | Locus Name | Acc# |
| | | | | | sp:KPYK_HAEIN | P43924 |

Description: PYRUVATE KINASE, (PK)

| ORF Name | NTID | AAID | NT Length | AA Length | Score | Probability |
|---|---|---|---|---|---|---|
| 24017787_c2_720 | 2275 | 6447 | 172 | 519 | 102 | 0.00012 |
| Protein name | | | | | Locus Name | Acc# |
| unknown | | | | | gp:AF027189 | AF027189 |

Description: Acinetobacter sp. BD413 lytB, comB, comC, comE, and comF genes, complete cds; and unknown genes.

| ORF Name | NTID | AAID | NT Length | AA Length | Score | Probability |
|---|---|---|---|---|---|---|
| 24110050_c3_815 | 2276 | 6448 | 461 | 1386 | 1340 | 8.8e-137 |
| Protein name | | | | | Locus Name | Acc# |
| | | | | | sp:YEIM_HAEIN | P44742 |

Description: HYPOTHETICAL PROTEIN HI0519

| ORF Name | NTID | AAID | NT Length | AA Length | Score | Probability |
|---|---|---|---|---|---|---|
| 24228457_c1_504 | 2277 | 6449 | 185 | 558 | 523 | 3.3e-50 |
| Protein name | | | | | Locus Name | Acc# |
| | | | | | sp:HYFH_ECOLI | P77423 |

Description: HYDROGENASE-4 COMPONENT H

| ORF Name | NTID | AAID | NT Length | AA Length | Score | Probability |
|---|---|---|---|---|---|---|
| 24251540_c1_543 | 2278 | 6450 | 316 | 951 | 352 | 4.4e-32 |
| Protein name | | | | | Locus Name | Acc# |
| probable regulatory protein | | | | | pir:H70840 | H70840 |

Description:

| ORF Name | NTID | AAID | NT Length | AA Length | Score | Probability |
|---|---|---|---|---|---|---|
| 24392942_c1_574 | 2279 | 6451 | 236 | 711 | 231 | 2.9e-19 |
| Protein name | | | | | Locus Name | Acc# |
| | | | | | gp:ECRECC | X03966 |

Description: E. coli recC gene and thyA-recC intergenic region including URF1-3.

| ORF Name | NTID | AAID | NT Length | AA Length | Score | Probability |
|---|---|---|---|---|---|---|
| 24407800_c3_837 | 2280 | 6452 | 107 | 324 | | |
| Protein name | | | | | Locus Name | Acc# |

Description
NO-HIT

| ORF Name | NTID | AAID | NT Length | AA Length | Score | Probability |
|---|---|---|---|---|---|---|
| 24410636_c3_760 | 2281 | 6453 | 197 | 594 | 625 | 5.2e-61 |
| Protein name | | | | | Locus Name | Acc# |
| | | | | | sp:GNTK_ECOLI | P46859:Q59 |

Description
THERMORESISTANT GLUCONOKINASE, (GLUCONATE KINASE 2)

| ORF Name | NTID | AAID | NT Length | AA Length | Score | Probability |
|---|---|---|---|---|---|---|
| 24413426_c2_718 | 2282 | 6454 | 290 | 873 | 1238 | 5.7e-126 |
| Protein name | | | | | Locus Name | Acc# |
| | | | | | sp:TYSY_HAEIN | P44420 |

Description
PROBABLE THYMIDYLATE SYNTHASE, (TS)

| ORF Name | NTID | AAID | NT Length | AA Length | Score | Probability |
|---|---|---|---|---|---|---|
| 24415881_f1_87 | 2283 | 6455 | 315 | 948 | 91 | 0.00029 |
| Protein name | | | | | Locus Name | Acc# |
| | | | | | gp:AC007260 | AC007260 |

Description
Arabidopsis thaliana chromosome I BAC T30F21 genomic sequence, complete sequence.

| ORF Name | NTID | AAID | NT Length | AA Length | Score | Probability |
|---|---|---|---|---|---|---|
| 24495175_c2_643 | 2284 | 6456 | 68 | 207 | | |
| Protein name | | | | | Locus Name | Acc# |

Description
NO-HIT

| ORF Name | NTID | AAID | NT Length | AA Length | Score | Probability |
|---|---|---|---|---|---|---|
| 24511662_f1_49 | 2285 | 6457 | 233 | 702 | 869 | 7.2e-87 |
| Protein name | | | | | Locus Name | Acc# |
| | | | | | sp:RLUA_ECOLI | P39219 |

Description
(PSEUDOURIDYLATE SYNTHASE) (URACIL HYDROLYASE)

| ORF Name | NTID | AAID | NT Length | AA Length | Score | Probability |
|---|---|---|---|---|---|---|
| 2454687_f3_324 | 2286 | 6458 | 110 | 333 | 424 | 1.0e-39 |
| Protein name | | | | | Locus Name | Acc# |
| | | | | | sp:YAEE_ECOLI | P31547 |

Description
HYPOTHETICAL ABC TRANSPORTER PERMEASE PROTEIN YAEE

| ORF Name | NTID | AAID | NT Length | AA Length | Score | Probability |
|---|---|---|---|---|---|---|
| 24636512_c2_658 | 2287 | 6459 | 343 | 1032 | 1153 | 5.8e-117 |
| Protein name | | | | | Locus Name | Acc# |
| | | | | | sp:SERB_ECOLI | P06862 |

Description
PHOSPHOHYDROLASE)

| ORF Name | NTID | AAID | NT Length | AA Length | Score | Probability |
|---|---|---|---|---|---|---|
| 24643927_f1_51 | 2288 | 6460 | 790 | 2373 | 2528 | 1.1e-262 |
| Protein name | | | | | Locus Name | Acc# |
| | | | | | sp:OSTA_ECOLI | P31554:P75 |

Description
ORGANIC SOLVENT TOLERANCE PROTEIN PRECURSOR

| ORF Name | NTID | AAID | NT Length | AA Length | Score | Probability |
|---|---|---|---|---|---|---|
| 24644800_f2_267 | 2289 | 6461 | 290 | 873 | 937 | 4.5e-94 |
| Protein name | | | | | Locus Name | Acc# |
| | | | | | sp:YJJW_ECOLI | P39409 |

Description
HYPOTHETICAL 31.5 KD PROTEIN IN OSMY-DEOC INTERGENIC REGION (F287)

| ORF Name | NTID | AAID | NT Length | AA Length | Score | Probability |
|---|---|---|---|---|---|---|
| 24647175_c2_737 | 2290 | 6462 | 399 | 1200 | 1345 | 2.6e-137 |
| Protein name | | | | | Locus Name | Acc# |
| | | | | | sp:DXR_ECOLI | P45568:P77 |

Description
REDUCTOISOMERASE)

| ORF Name | NTID | AAID | NT Length | AA Length | Score | Probability |
|---|---|---|---|---|---|---|
| 24647187_c2_690 | 2291 | 6463 | 337 | 1014 | 1135 | 4.7e-115 |
| Protein name | | | | | Locus Name | Acc# |
| cyanide insensitive terminal oxidase | | | | | gp:PACIOAB | Y10528 |

Description
P.aeruginosa cioA and cioB genes.

| ORF Name | NTID | AAID | NT Length | AA Length | Score | Probability |
|---|---|---|---|---|---|---|
| 24647192_f3_394 | 2292 | 6464 | 383 | 1152 | 1016 | 1.9e-102 |
| Protein name | | | | | Locus Name | Acc# |
| unknown | | | | | gp:AF168355 | AF168355 |

Description
Proteus mirabilis tellurite resistance locus, complete sequence;and unknown gene.

| ORF Name | NTID | AAID | NT Length | AA Length | Score | Probability |
|---|---|---|---|---|---|---|
| 24647827_c3_884 | 2293 | 6465 | 496 | 1491 | 204 | 1.2e-12 |
| Protein name | | | | | Locus Name | Acc# |
| ORF MSV156 hypothetical protein | | | | | gp:AF063866 | AF063866 |

Description
Melanoplus sanguinipes entomopoxvirus, complete genome.

| ORF Name | NTID | AAID | NT Length | AA Length | Score | Probability |
|---|---|---|---|---|---|---|
| 24792901_f3_323 | 2294 | 6466 | 360 | 1083 | 1323 | 5.6e-135 |
| Protein name | | | | | Locus Name | Acc# |
| | | | | | sp:ABC_ECOLI | P30750:P77 |

Description
ATP-BINDING PROTEIN ABC

548

| ORF Name | NTID | AAID | NT Length | AA Length | Score | Probability |
|---|---|---|---|---|---|---|
| 24803462_c2_641 | 2295 | 6467 | 772 | 2319 | 1226 | 1.1e-124 |

| Protein name | Locus Name | Acc# |
|---|---|---|
| | sp:YRAJ_ECOLI | P42915 |

Description: REGION PRECURSOR

| ORF Name | NTID | AAID | NT Length | AA Length | Score | Probability |
|---|---|---|---|---|---|---|
| 24875016_f1_81 | 2296 | 6468 | 767 | 2304 | 3004 | 0.0 |

| Protein name | Locus Name | Acc# |
|---|---|---|
| CbbBc | gp:REU60056 | U60056 |

Description: Ralstonia eutropha formate dehydrogenase-like protein (cbbBc) gene, complete cds.

| ORF Name | NTID | AAID | NT Length | AA Length | Score | Probability |
|---|---|---|---|---|---|---|
| 2500208_f3_390 | 2297 | 6469 | 241 | 726 | 263 | 1.2e-22 |

| Protein name | Locus Name | Acc# |
|---|---|---|
| cicA protein | gp:CAJ10321 | AJ010321 |

Description: Caulobacter crescentus partial tig gene and clpP, cicA, clpX, lon genes.

| ORF Name | NTID | AAID | NT Length | AA Length | Score | Probability |
|---|---|---|---|---|---|---|
| 250_f3_460 | 2298 | 6470 | 60 | 183 | | |

| Protein name | Locus Name | Acc# |
|---|---|---|
| | | |

Description: NO-HIT

| ORF Name | NTID | AAID | NT Length | AA Length | Score | Probability |
|---|---|---|---|---|---|---|
| 25413175_f2_304 | 2299 | 6471 | 210 | 633 | 822 | 6.9e-82 |

| Protein name | Locus Name | Acc# |
|---|---|---|
| | sp:CAIE_ECOLI | P39206 |

Description: CARNITINE OPERON PROTEIN CAIE

| ORF_Name | NTID | AAID | NT Length | AA Length | Score | Probability |
|---|---|---|---|---|---|---|
| 25413535_f3_455 | 2300 | 6472 | 75 | 228 | | |
| Protein name | | | | | Locus Name | Acc# |

Description: NO-HIT

| ORF_Name | NTID | AAID | NT Length | AA Length | Score | Probability |
|---|---|---|---|---|---|---|
| 25423175_f1_158 | 2301 | 6473 | 656 | 1971 | 1788 | 3.0e-184 |
| Protein name | | | | | Locus Name | Acc# |
| TonB-dependent outer membrane receptor | | | | | gp:AF081283 | AF081283 |

Description: Escherichia coli strain CFT073 alanine racemase (dadX), F536(f536), F304 (f304), O241 (o241), TonB-dependent outer membranereceptor (prrA), molybdenum transport protein (modD), Orf2, andferric enterobactin transport ATP-binding protein (fepC) genes,complete cds.

| ORF_Name | NTID | AAID | NT Length | AA Length | Score | Probability |
|---|---|---|---|---|---|---|
| 25431501_c3_894 | 2302 | 6474 | 268 | 807 | 1390 | 4.5e-142 |
| Protein name | | | | | Locus Name | Acc# |
| | | | | | sp:LPXA_PROMI | P72215 |

Description: (EC 2.3.1.129) (UDP-N-ACETYLGLUCOSAMINE ACYLTRANSFERASE)

| ORF_Name | NTID | AAID | NT Length | AA Length | Score | Probability |
|---|---|---|---|---|---|---|
| 25439192_c1_462 | 2303 | 6475 | 269 | 810 | 410 | 3.1e-38 |
| Protein name | | | | | Locus Name | Acc# |
| | | | | | sp:SPAR_SHIFL | P40706 |

Description: SURFACE PRESENTATION OF ANTIGENS PROTEIN SPAR (SPA29 PROTEIN)

| ORF_Name | NTID | AAID | NT Length | AA Length | Score | Probability |
|---|---|---|---|---|---|---|
| 25500001_f3_362 | 2304 | 6476 | 344 | 1035 | 1150 | 1.2e-116 |
| Protein name | | | | | Locus Name | Acc# |
| | | | | | sp:TBPA_ECOLI | P31550:P75 |

Description: THIAMINE-BINDING PERIPLASMIC PROTEIN PRECURSOR

550

| ORF Name | NTID | AAID | NT Length | AA Length | Score | Probability |
|---|---|---|---|---|---|---|
| 25547175_c3_813 | 2305 | 6477 | 123 | 372 | 140 | 1.3e-09 |
| Protein name | | | | | Locus Name | Acc# |
| | | | | | sp:OSMY_ECOLI | P27291 |

Description
OSMOTICALLY INDUCIBLE PROTEIN Y PRECURSOR

| ORF Name | NTID | AAID | NT Length | AA Length | Score | Probability |
|---|---|---|---|---|---|---|
| 25666067_c3_877 | 2306 | 6478 | 1213 | 3642 | 3391 | 0.0 |
| Protein name | | | | | Locus Name | Acc# |
| | | | | | sp:EX5B_ECOLI | P08394 |

Description
BETA CHAIN)

| ORF Name | NTID | AAID | NT Length | AA Length | Score | Probability |
|---|---|---|---|---|---|---|
| 2578192_c2_627 | 2307 | 6479 | 461 | 1386 | 1667 | 2.0e-171 |
| Protein name | | | | | Locus Name | Acc# |
| | | | | | sp:FIXC_ECOLI | P31575:P75 |

Description
FIXC PROTEIN

| ORF Name | NTID | AAID | NT Length | AA Length | Score | Probability |
|---|---|---|---|---|---|---|
| 25791260_f1_147 | 2308 | 6480 | 277 | 834 | 550 | 4.6e-53 |
| Protein name | | | | | Locus Name | Acc# |
| | | | | | sp:BAX_ECOLI | P27297 |

Description
BAX PROTEIN

| ORF Name | NTID | AAID | NT Length | AA Length | Score | Probability |
|---|---|---|---|---|---|---|
| 25813752_c3_839 | 2309 | 6481 | 457 | 1374 | 1739 | 4.6e-179 |
| Protein name | | | | | Locus Name | Acc# |
| cyanide insensitive terminal oxidase | | | | | gp:PACIOAB | Y10528 |

Description
P.aeruginosa cioA and cioB genes.

551

| ORF Name | NTID | AAID | NT Length | AA Length | Score | Probability |
|---|---|---|---|---|---|---|
| 26052183_c3_895 | 2310 | 6482 | 209 | 630 | 753 | 1.4e-74 |
| Protein name | | | | | Locus Name | Acc# |
| | | | | | sp:RNH2_ECOLI | P10442:P78 |

Description: RIBONUCLEASE HII, (RNASE HII)

| ORF Name | NTID | AAID | NT Length | AA Length | Score | Probability |
|---|---|---|---|---|---|---|
| 26178587_c2_717 | 2311 | 6483 | 754 | 2265 | 2452 | 1.3e-254 |
| Protein name | | | | | Locus Name | Acc# |
| | | | | | sp:PT1P_ECOLI | P37177 |

Description: (PHOSPHOTRANSFERASE SYSTEM, ENZYME I) (ENZYME I-NTR)

| ORF Name | NTID | AAID | NT Length | AA Length | Score | Probability |
|---|---|---|---|---|---|---|
| 26194666_f1_54 | 2312 | 6484 | 133 | 402 | 459 | 2.0e-43 |
| Protein name | | | | | Locus Name | Acc# |
| | | | | | sp:APAG_ECOLI | P05636 |

Description: APAG PROTEIN

| ORF Name | NTID | AAID | NT Length | AA Length | Score | Probability |
|---|---|---|---|---|---|---|
| 26203528_c3_812 | 2313 | 6485 | 550 | 1653 | 2436 | 6.4e-253 |
| Protein name | | | | | Locus Name | Acc# |
| | | | | | sp:RF3_ECOLI | P33998 |

Description: PEPTIDE CHAIN RELEASE FACTOR 3 (RF-3)

| ORF Name | NTID | AAID | NT Length | AA Length | Score | Probability |
|---|---|---|---|---|---|---|
| 26306513_c1_596 | 2314 | 6486 | 1161 | 3486 | 5297 | 0.0 |
| Protein name | | | | | Locus Name | Acc# |
| | | | | | sp:DP3A_SALTY | P14567 |

Description: DNA POLYMERASE III, ALPHA CHAIN,

| ORF Name | NTID | AAID | NT Length | AA Length | Score | Probability |
|---|---|---|---|---|---|---|
| 26375306_c1_514 | 2315 | 6487 | 393 | 1182 | 135 | 4.2e-06 |
| Protein name | | | | | Locus Name | Acc# |
| unknown | | | | | gp:APU33059 | U33059 |

Description

Actinosynnema pretiosum auranticum diaminopimelate decarboxylase(lysA), 3-amino-5-hydroxybenzoic acid synthase, oxidoreductase,phosphatase, and aminodehydroquinate synthase genes, complete cds;transcription activator gene, partial cds; and unknown genes.

| ORF Name | NTID | AAID | NT Length | AA Length | Score | Probability |
|---|---|---|---|---|---|---|
| 26385911_c2_663 | 2316 | 6488 | 145 | 438 | | |
| Protein name | | | | | Locus Name | Acc# |

Description

NO-HIT

| ORF Name | NTID | AAID | NT Length | AA Length | Score | Probability |
|---|---|---|---|---|---|---|
| 26454407_f3_442 | 2317 | 6489 | 737 | 2214 | 1318 | 1.9e-134 |
| Protein name | | | | | Locus Name | Acc# |
| hypothetical protein SCE15.03c | | | | | pir:T36106 | T36106 |

Description

| ORF Name | NTID | AAID | NT Length | AA Length | Score | Probability |
|---|---|---|---|---|---|---|
| 26563802_f1_137 | 2318 | 6490 | 511 | 1536 | 2403 | 2.0e-249 |
| Protein name | | | | | Locus Name | Acc# |
| | | | | | gp:ECCAI | X73904 |

Description

E.coli DNA sequence of cai locus.

| ORF Name | NTID | AAID | NT Length | AA Length | Score | Probability |
|---|---|---|---|---|---|---|
| 26580135_c1_592 | 2319 | 6491 | 198 | 597 | 726 | 1.0e-71 |
| Protein name | | | | | Locus Name | Acc# |
| | | | | | sp:RRF_ECOLI | P16174 |

Description

RIBOSOME RECYCLING FACTOR (RIBOSOME RELEASING FACTOR) (RRF)

| ORF_Name | NTID | AAID | NT Length | AA Length | Score | Probability |
|---|---|---|---|---|---|---|
| 26640702_f1_33 | 2320 | 6492 | 62 | 189 | | |
| Protein name | | | | | Locus Name | Acc# |

Description: NO-HIT

| ORF_Name | NTID | AAID | NT Length | AA Length | Score | Probability |
|---|---|---|---|---|---|---|
| 26765692_c3_866 | 2321 | 6493 | 271 | 816 | 874 | 2.1e-87 |
| Protein name | | | | | Locus Name | Acc# |
| | | | | | sp:DJLA_ECOLI | P31680 |

Description: DNAJ-LIKE PROTEIN DJLA

| ORF_Name | NTID | AAID | NT Length | AA Length | Score | Probability |
|---|---|---|---|---|---|---|
| 26767967_c1_503 | 2322 | 6494 | 526 | 1581 | 1826 | 2.8e-188 |
| Protein name | | | | | Locus Name | Acc# |
| | | | | | sp:HYFF_ECOLI | P77437 |

Description: HYDROGENASE-4 COMPONENT F,

| ORF_Name | NTID | AAID | NT Length | AA Length | Score | Probability |
|---|---|---|---|---|---|---|
| 26776902_c3_889 | 2323 | 6495 | 292 | 879 | 732 | 2.4e-72 |
| Protein name | | | | | Locus Name | Acc# |
| | | | | | sp:CDSA_ECOLI | P06466 |

Description: SYNTHASE)

| ORF_Name | NTID | AAID | NT Length | AA Length | Score | Probability |
|---|---|---|---|---|---|---|
| 2766515_c2_719 | 2324 | 6496 | 197 | 594 | | |
| Protein name | | | | | Locus Name | Acc# |

Description: NO-HIT

| ORF Name | NTID | AAID | NT Length | AA Length | Score | Probability |
|---|---|---|---|---|---|---|
| 2781631_c3_798 | 2325 | 6497 | 314 | 945 | 133 | 1.5e-05 |

| Protein name | Locus Name | Acc# |
|---|---|---|
| hypothetical protein | pir:F75584 | F75584 |

Description

| ORF Name | NTID | AAID | NT Length | AA Length | Score | Probability |
|---|---|---|---|---|---|---|
| 2851562_c1_494 | 2326 | 6498 | 140 | 423 | 452 | 1.1e-42 |

| Protein name | Locus Name | Acc# |
|---|---|---|
|  | sp:CH10_ECOLI | P05380 |

Description

10 KD CHAPERONIN (PROTEIN CPN10) (PROTEIN GROES)

| ORF Name | NTID | AAID | NT Length | AA Length | Score | Probability |
|---|---|---|---|---|---|---|
| 2926501_f2_229 | 2327 | 6499 | 316 | 951 | 877 | 1.0e-87 |

| Protein name | Locus Name | Acc# |
|---|---|---|
| probable membrane protein b1520 | pir:C64906 | C64906 |

Description

| ORF Name | NTID | AAID | NT Length | AA Length | Score | Probability |
|---|---|---|---|---|---|---|
| 29337507_c3_764 | 2328 | 6500 | 140 | 423 | 370 | 5.4e-34 |

| Protein name | Locus Name | Acc# |
|---|---|---|
| transcription activator caiF | pir:B64724 | B64724:JC6 |

Description

| ORF Name | NTID | AAID | NT Length | AA Length | Score | Probability |
|---|---|---|---|---|---|---|
| 2939702_c2_708 | 2329 | 6501 | 985 | 2958 | 2513 | 4.4e-261 |

| Protein name | Locus Name | Acc# |
|---|---|---|
|  | sp:PARC_ECOLI | P20082 |

Description

TOPOISOMERASE IV SUBUNIT A,

| ORF Name | NTID | AAID | NT Length | AA Length | Score | Probability |
|---|---|---|---|---|---|---|
| 29511688_c1_533 | 2330 | 6502 | 124 | 375 | 199 | 7.2e-16 |
| Protein name | | | | | Locus Name | Acc# |
| hypothetical protein PH0571 | | | | | pir:G71171 | G71171 |

Description

| ORF Name | NTID | AAID | NT Length | AA Length | Score | Probability |
|---|---|---|---|---|---|---|
| 29695387_f1_26 | 2331 | 6503 | 145 | 438 | 532 | 3.7e-51 |
| Protein name | | | | | Locus Name | Acc# |
| | | | | | sp:YAEH_ECOLI | P37048 |

Description
HYPOTHETICAL 15.1 KD PROTEIN IN HTRA-DAPD INTERGENIC REGION

| ORF Name | NTID | AAID | NT Length | AA Length | Score | Probability |
|---|---|---|---|---|---|---|
| 29923127_c2_632 | 2332 | 6504 | 214 | 645 | 334 | 3.6e-30 |
| Protein name | | | | | Locus Name | Acc# |
| protein Tp70 | | | | | pir:A71309 | A71309:S18 |

Description

| ORF Name | NTID | AAID | NT Length | AA Length | Score | Probability |
|---|---|---|---|---|---|---|
| 30079552_c3_838 | 2333 | 6505 | 519 | 1560 | 707 | 1.1e-69 |
| Protein name | | | | | Locus Name | Acc# |
| | | | | | sp:MCPC_SALTY | Q02755 |

Description
PROTEIN)

| ORF Name | NTID | AAID | NT Length | AA Length | Score | Probability |
|---|---|---|---|---|---|---|
| 30261635_c3_794 | 2334 | 6506 | 269 | 810 | 892 | 2.6e-89 |
| Protein name | | | | | Locus Name | Acc# |
| | | | | | sp:HYFI_ECOLI | P77668:P76 |

Description
HYDROGENASE-4 COMPONENT I,

| ORF Name | NTID | AAID | NT Length | AA Length | Score | Probability |
|---|---|---|---|---|---|---|
| 30275930_c3_810 | 2335 | 6507 | 61 | 186 | 88 | 0.0012 |
| Protein name | | | | | Locus Name | Acc# |
| | | | | | gp:BLCRO24C | X94331 |

Description
Bacteriophage L cro, 24, c2, and c1 genes.

| ORF Name | NTID | AAID | NT Length | AA Length | Score | Probability |
|---|---|---|---|---|---|---|
| 30682767_c2_664 | 2336 | 6508 | 266 | 801 | 730 | 3.9e-72 |
| Protein name | | | | | Locus Name | Acc# |
| | | | | | sp:YJJV_ECOLI | P39408:P78 |

Description
HYPOTHETICAL 28.9 KD PROTEIN IN OSMY-DEOC INTERGENIC REGION

| ORF Name | NTID | AAID | NT Length | AA Length | Score | Probability |
|---|---|---|---|---|---|---|
| 30736551_c2_726 | 2337 | 6509 | 117 | 354 | | |
| Protein name | | | | | Locus Name | Acc# |

Description
NO-HIT

| ORF Name | NTID | AAID | NT Length | AA Length | Score | Probability |
|---|---|---|---|---|---|---|
| 31261343_c3_811 | 2338 | 6510 | 88 | 267 | 172 | 5.2e-13 |
| Protein name | | | | | Locus Name | Acc# |
| | | | | | sp:RPC2_BPP22 | P03035 |

Description
REPRESSOR PROTEIN C2

| ORF Name | NTID | AAID | NT Length | AA Length | Score | Probability |
|---|---|---|---|---|---|---|
| 31337778_c3_856 | 2339 | 6511 | 197 | 594 | 654 | 4.4e-64 |
| Protein name | | | | | Locus Name | Acc# |
| | | | | | sp:YQIA_ECOLI | P36653 |

Description
HYPOTHETICAL 21.6 KD PROTEIN IN PARE-ICC INTERGENIC REGION (F193)

| ORF Name | NTID | AAID | NT Length | AA Length | Score | Probability |
|---|---|---|---|---|---|---|
| 31406657_f3_385 | 2340 | 6512 | 637 | 1914 | 2726 | 1.2e-283 |
| Protein name | | | | | Locus Name | Acc# |
| | | | | | sp:RPSD_SALTY | P07336 |

Description

RNA POLYMERASE SIGMA FACTOR RPOD (SIGMA-70)

| ORF Name | NTID | AAID | NT Length | AA Length | Score | Probability |
|---|---|---|---|---|---|---|
| 31441915_c2_698 | 2341 | 6513 | 357 | 1074 | 1532 | 4.0e-157 |
| Protein name | | | | | Locus Name | Acc# |
| O-sialoglycoprotein endopeptidase, | | | | | pir:QQECR6 | F65094:D29 |

Description

| ORF Name | NTID | AAID | NT Length | AA Length | Score | Probability |
|---|---|---|---|---|---|---|
| 3156462_c3_858 | 2342 | 6514 | 251 | 756 | 912 | 2.0e-91 |
| Protein name | | | | | Locus Name | Acc# |
| | | | | | sp:PLSC_ECOLI | P26647 |

Description (LPAAT)

| ORF Name | NTID | AAID | NT Length | AA Length | Score | Probability |
|---|---|---|---|---|---|---|
| 31675_c3_802 | 2343 | 6515 | 70 | 213 | 285 | 1.2e-24 |
| Protein name | | | | | Locus Name | Acc# |
| | | | | | sp:RADA_ECOLI | P24554 |

Description

DNA REPAIR PROTEIN RADA (DNA REPAIR PROTEIN SMS)

| ORF Name | NTID | AAID | NT Length | AA Length | Score | Probability |
|---|---|---|---|---|---|---|
| 31698415_f3_321 | 2344 | 6516 | 67 | 204 | | |
| Protein name | | | | | Locus Name | Acc# |

Description

NO-HIT

| ORF Name | NTID | AAID | NT Length | AA Length | Score | Probability |
|---|---|---|---|---|---|---|
| 3176087_f2_226 | 2345 | 6517 | 603 | 1812 | 2095 | 8.7e-217 |
| Protein name | | | | | Locus Name | Acc# |
| | | | | | sp:PRIM_ECOLI | P02923:P02 |

Description: DNA PRIMASE,

| ORF Name | NTID | AAID | NT Length | AA Length | Score | Probability |
|---|---|---|---|---|---|---|
| 32219133_c3_784 | 2346 | 6518 | 217 | 654 | 604 | 8.7e-59 |
| Protein name | | | | | Locus Name | Acc# |
| | | | | | sp:HYFA_ECOLI | P23481:P76 |

Description: HYDROGENASE-4 COMPONENT A,

| ORF Name | NTID | AAID | NT Length | AA Length | Score | Probability |
|---|---|---|---|---|---|---|
| 32228407_f1_63 | 2347 | 6519 | 388 | 1167 | 1644 | 5.4e-169 |
| Protein name | | | | | Locus Name | Acc# |
| | | | | | sp:YGIC_ECOLI | P24196 |

Description: (O386)

| ORF Name | NTID | AAID | NT Length | AA Length | Score | Probability |
|---|---|---|---|---|---|---|
| 32479202_c3_822 | 2348 | 6520 | 436 | 1311 | 710 | 5.1e-70 |
| Protein name | | | | | Locus Name | Acc# |
| | | | | | sp:PGTA_SALTY | P06184 |

Description: PGTA

| ORF Name | NTID | AAID | NT Length | AA Length | Score | Probability |
|---|---|---|---|---|---|---|
| 32613155_f1_90 | 2349 | 6521 | 504 | 1515 | 954 | 7.1e-96 |
| Protein name | | | | | Locus Name | Acc# |
| | | | | | sp:YCGC_ECOLI | P37349:P76 |

Description: HYPOTHETICAL 51.6 KD PROTEIN IN TREA-PTH INTERGENIC REGION

| ORF_Name | NTID | AAID | NT Length | AA Length | Score | Probability |
|---|---|---|---|---|---|---|
| 32805_c1_515 | 2350 | 6522 | 217 | 654 | 727 | 8.0e-72 |
| Protein name | | | | | Locus_Name | Acc# |
| hypothetical protein b1432 | | | | | pir:C64895 | C64895 |

Description

| ORF_Name | NTID | AAID | NT Length | AA Length | Score | Probability |
|---|---|---|---|---|---|---|
| 32805_c2_636 | 2351 | 6523 | 448 | 1347 | 1772 | 1.5e-182 |
| Protein name | | | | | Locus_Name | Acc# |
| hypothetical protein b1432 | | | | | pir:C64895 | C64895 |

Description

| ORF_Name | NTID | AAID | NT Length | AA Length | Score | Probability |
|---|---|---|---|---|---|---|
| 3320327_f1_89 | 2352 | 6524 | 354 | 1065 | 1423 | 1.4e-145 |
| Protein name | | | | | Locus_Name | Acc# |
| hypothetical protein b1200 | | | | | pir:E64866 | E64866 |

Description

| ORF_Name | NTID | AAID | NT Length | AA Length | Score | Probability |
|---|---|---|---|---|---|---|
| 33209537_f3_383 | 2353 | 6525 | 499 | 1500 | 1029 | 8.0e-104 |
| Protein name | | | | | Locus_Name | Acc# |
| 2-dehydro-3-deoxyphosphoheptonate aldolase, T5J17.150:protein T5J17.150:protein T5J17.150 | | | | | pir:T06104 | T06104 |

Description

| ORF_Name | NTID | AAID | NT Length | AA Length | Score | Probability |
|---|---|---|---|---|---|---|
| 33235952_c1_566 | 2354 | 6526 | 161 | 486 | 654 | 4.4e-64 |
| Protein name | | | | | Locus_Name | Acc# |
| | | | | | sp:DYR_ENTAE | P31074 |

Description

DIHYDROFOLATE REDUCTASE,

| ORF Name | NTID | AAID | NT Length | AA Length | Score | Probability |
|---|---|---|---|---|---|---|
| 33361262_c3_795 | 2355 | 6527 | 181 | 546 | 500 | 9.1e-48 |
| Protein name | | | | | Locus Name | Acc# |
| | | | | | sp:HYCI_ECOLI | Q57451 |

Description
HYDROGENASE 3 MATURATION PROTEASE,

| ORF Name | NTID | AAID | NT Length | AA Length | Score | Probability |
|---|---|---|---|---|---|---|
| 33382817_c1_461 | 2356 | 6528 | 85 | 258 | 92 | 0.00016 |
| Protein name | | | | | Locus Name | Acc# |
| flagellar biosynthetic protein (fliP) | | | | | gp:AE000581 | AE000581:A |

Description
Helicobacter pylori 26695 section 59 of 134 of the complete genome.

| ORF Name | NTID | AAID | NT Length | AA Length | Score | Probability |
|---|---|---|---|---|---|---|
| 33400432_c3_880 | 2357 | 6529 | 132 | 399 | 348 | 1.2e-31 |
| Protein name | | | | | Locus Name | Acc# |
| | | | | | sp:YGDD_ECOLI | P32065 |

Description
HYPOTHETICAL 14.3 KD PROTEIN IN FUCR-GCVA INTERGENIC REGION (ORF2)

| ORF Name | NTID | AAID | NT Length | AA Length | Score | Probability |
|---|---|---|---|---|---|---|
| 33476577_c3_808 | 2358 | 6530 | 547 | 1644 | 256 | 9.6e-29 |
| Protein name | | | | | Locus Name | Acc# |
| | | | | | sp:MCRB_ECOLI | P15005 |

Description
5-METHYLCYTOSINE-SPECIFIC RESTRICTION ENZYME B,

| ORF Name | NTID | AAID | NT Length | AA Length | Score | Probability |
|---|---|---|---|---|---|---|
| 3369182_c3_809 | 2359 | 6531 | 476 | 1431 | | |
| Protein name | | | | | Locus Name | Acc# |

Description
NO-HIT

| ORF Name | NTID | AAID | NT Length | AA Length | Score | Probability |
|---|---|---|---|---|---|---|
| 34037716_c3_855 | 2360 | 6532 | 289 | 870 | 921 | 2.2e-92 |

| Protein name | Locus Name | Acc# |
|---|---|---|
| | sp:ICC_ECOLI | P36650 |

Description
ICC PROTEIN

| ORF Name | NTID | AAID | NT Length | AA Length | Score | Probability |
|---|---|---|---|---|---|---|
| 3409776_f2_189 | 2361 | 6533 | 71 | 216 | 52 | 0.026 |

| Protein name | Locus Name | Acc# |
|---|---|---|
| transcription elongation factor tfIIs | pir:S33694 | S33694:S33 |

Description

| ORF Name | NTID | AAID | NT Length | AA Length | Score | Probability |
|---|---|---|---|---|---|---|
| 34156681_f1_5 | 2362 | 6534 | 279 | 840 | 1152 | 7.4e-117 |

| Protein name | Locus Name | Acc# |
|---|---|---|
| | sp:YAEC_ECOLI | P28635 |

Description
PRECURSOR

| ORF Name | NTID | AAID | NT Length | AA Length | Score | Probability |
|---|---|---|---|---|---|---|
| 34173437_c1_508 | 2363 | 6535 | 336 | 1011 | 1057 | 8.6e-107 |

| Protein name | Locus Name | Acc# |
|---|---|---|
| glycosyltransferase | gp:AF146532 | AF146532 |

Description
Klebsiella pneumoniae waa gene cluster.

| ORF Name | NTID | AAID | NT Length | AA Length | Score | Probability |
|---|---|---|---|---|---|---|
| 34197136_c2_605 | 2364 | 6536 | 148 | 447 | 319 | 1.4e-28 |

| Protein name | Locus Name | Acc# |
|---|---|---|
| SpaP | gp:SEU29359 | U29359 |

Description
Salmonella enterica strain s3041 invasion protein SpaO (spaO), SpaP(spaP), and SpaQ (spaQ) genes, complete cds.

| ORF Name | NTID | AAID | NT Length | AA Length | Score | Probability |
|---|---|---|---|---|---|---|
| 34414693_c1_573 | 2365 | 6537 | 296 | 891 | 1148 | 2.0e-116 |
| Protein name | | | | | Locus Name | Acc# |
| | | | | | sp:LGT_SALTY | Q07293 |

Description
PROLIPOPROTEIN DIACYLGLYCERYL TRANSFERASE,

| ORF Name | NTID | AAID | NT Length | AA Length | Score | Probability |
|---|---|---|---|---|---|---|
| 34626392_c3_805 | 2366 | 6538 | 259 | 780 | 1049 | 6.1e-106 |
| Protein name | | | | | Locus Name | Acc# |
| | | | | | gp:B2U02303 | U02303 |

Description
Bacteriophage If1, complete genome.

| ORF Name | NTID | AAID | NT Length | AA Length | Score | Probability |
|---|---|---|---|---|---|---|
| 34664012_f3_440 | 2367 | 6539 | 65 | 198 | | |
| Protein name | | | | | Locus Name | Acc# |

Description
NO-HIT

| ORF Name | NTID | AAID | NT Length | AA Length | Score | Probability |
|---|---|---|---|---|---|---|
| 35275277_c3_790 | 2368 | 6540 | 217 | 654 | 715 | 1.5e-70 |
| Protein name | | | | | Locus Name | Acc# |
| | | | | | sp:HYFE_ECOLI | P77524 |

Description
HYDROGENASE-4 COMPONENT E,

| ORF Name | NTID | AAID | NT Length | AA Length | Score | Probability |
|---|---|---|---|---|---|---|
| 35343763_f1_122 | 2369 | 6541 | 218 | 657 | 251 | 2.2e-21 |
| Protein name | | | | | Locus Name | Acc# |
| conserved hypothetical protein yhfK | | | | | pir:H69830 | H69830 |

Description

| ORF_Name | NTID | AAID | NT Length | AA Length | Score | Probability |
|---|---|---|---|---|---|---|
| 35429686_c1_483 | 2370 | 6542 | 114 | 345 | 438 | 3.4e-41 |
| Protein name | | | | | Locus Name | Acc# |
| | | | | | sp:FIXX_ECOLI | P31576:P75 |

Description: FERREDOXIN LIKE PROTEIN

| ORF_Name | NTID | AAID | NT Length | AA Length | Score | Probability |
|---|---|---|---|---|---|---|
| 35551250_c1_528 | 2371 | 6543 | 264 | 795 | 1061 | 3.2e-107 |
| Protein name | | | | | Locus Name | Acc# |
| purine-nucleoside phosphorylase,:inosine phosphorylase | | | | | pir:A27854 | A41143:A27 |

Description:

| ORF_Name | NTID | AAID | NT Length | AA Length | Score | Probability |
|---|---|---|---|---|---|---|
| 35553427_f3_401 | 2372 | 6544 | 452 | 1359 | 647 | 2.4e-63 |
| Protein name | | | | | Locus Name | Acc# |
| | | | | | sp:UHPC_SALTY | P27669 |

Description: REGULATORY PROTEIN UHPC

| ORF_Name | NTID | AAID | NT Length | AA Length | Score | Probability |
|---|---|---|---|---|---|---|
| 35594008_c3_816 | 2373 | 6545 | 588 | 1767 | 194 | 2.4e-14 |
| Protein name | | | | | Locus Name | Acc# |
| glutamate decarboxylase, 67K, brain | | | | | pir:I53274 | I53274 |

Description:

| ORF_Name | NTID | AAID | NT Length | AA Length | Score | Probability |
|---|---|---|---|---|---|---|
| 35792318_c2_613 | 2374 | 6546 | 449 | 1350 | 1805 | 4.7e-186 |
| Protein name | | | | | Locus Name | Acc# |
| | | | | | sp:GNTU_ECOLI | P46858 |

Description: (SYSTEM)

| ORF Name | NTID | AAID | NT Length | AA Length | Score | Probability |
|---|---|---|---|---|---|---|
| 35829750_c2_606 | 2375 | 6547 | 90 | 273 | 267 | 4.5e-23 |
| Protein name | | | | | Locus Name | Acc# |
| SpaQ | | | | | gp:SEU29354 | U29354 |

Description

Salmonella enterica strain s2995 invasion protein SpaO (spaO), SpaP(spaP) and SpaQ (spaQ) genes, complete cds.

| ORF Name | NTID | AAID | NT Length | AA Length | Score | Probability |
|---|---|---|---|---|---|---|
| 35970000_c3_835 | 2376 | 6548 | 351 | 1056 | 1720 | 4.8e-177 |
| Protein name | | | | | Locus Name | Acc# |
| TerC | | | | | gp:AF168355 | AF168355 |

Description

Proteus mirabilis tellurite resistance locus, complete sequence;and unknown gene.

| ORF Name | NTID | AAID | NT Length | AA Length | Score | Probability |
|---|---|---|---|---|---|---|
| 36016927_c2_640 | 2377 | 6549 | 191 | 576 | | |
| Protein name | | | | | Locus Name | Acc# |

Description

NO-HIT

| ORF Name | NTID | AAID | NT Length | AA Length | Score | Probability |
|---|---|---|---|---|---|---|
| 36110050_f2_293 | 2378 | 6550 | 448 | 1347 | 1802 | 9.8e-186 |
| Protein name | | | | | Locus Name | Acc# |
| | | | | | sp:DCUA_ECOLI | P04539 |

Description

ANAEROBIC C4-DICARBOXYLATE TRANSPORTER DCUA

| ORF Name | NTID | AAID | NT Length | AA Length | Score | Probability |
|---|---|---|---|---|---|---|
| 36365831_f2_196 | 2379 | 6551 | 528 | 1587 | 1911 | 2.7e-197 |
| Protein name | | | | | Locus Name | Acc# |
| | | | | | sp:YABK_ECOLI | P31549:P75 |

Description

HYPOTHETICAL 59.6 KD PROTEIN IN ARAC-TBPA INTERGENIC REGION (ORF101)

| ORF Name | NTID | AAID | NT Length | AA Length | Score | Probability |
|---|---|---|---|---|---|---|
| 36615885_c1_559 | 2380 | 6552 | 323 | 972 | 274 | 8.1e-24 |
| Protein name | | | | | Locus Name | Acc# |
| reverse transcriptase | | | | | gp:VCH249205 | AJ249205 |

Description
Vibrio cholerae ret, abpA and abpB genes and ORF262, ORF206 andORF149.

| ORF Name | NTID | AAID | NT Length | AA Length | Score | Probability |
|---|---|---|---|---|---|---|
| 36615928_c1_481 | 2381 | 6553 | 317 | 954 | 1049 | 6.1e-106 |
| Protein name | | | | | Locus Name | Acc# |
| | | | | | sp:FIXB_ECOLI | P31574 |

Description
FIXB PROTEIN

| ORF Name | NTID | AAID | NT Length | AA Length | Score | Probability |
|---|---|---|---|---|---|---|
| 3906693_c2_711 | 2382 | 6554 | 400 | 1203 | 139 | 1.1e-05 |
| Protein name | | | | | Locus Name | Acc# |
| | | | | | gp:PFMAL3P2 | AL034558:A |

Description
Plasmodium falciparum MAL3P2, complete sequence.

| ORF Name | NTID | AAID | NT Length | AA Length | Score | Probability |
|---|---|---|---|---|---|---|
| 3937568_c2_617 | 2383 | 6555 | 206 | 621 | 589 | 3.4e-57 |
| Protein name | | | | | Locus Name | Acc# |
| chitin binding protein 21 precursor:CBP21 | | | | | pir:JW0070 | JW0070 |

Description

| ORF Name | NTID | AAID | NT Length | AA Length | Score | Probability |
|---|---|---|---|---|---|---|
| 3937588_c3_847 | 2384 | 6556 | 947 | 2844 | 3073 | 0.0 |
| Protein name | | | | | Locus Name | Acc# |
| | | | | | sp:GLNE_ECOLI | P30870:P78 |

Description
SYNTHETASE ADENYLYLTRANSFERASE) (ATASE)

| ORF Name | NTID | AAID | NT Length | AA Length | Score | Probability |
|---|---|---|---|---|---|---|
| 394002_c2_653 | 2385 | 6557 | 222 | 669 | 617 | 3.6e-60 |
| Protein name | | | | Locus Name | | Acc# |
| putative ATPase | | | | gp:STU94729 | | U94729 |

Description

Salmonella typhimurium oxd-6 operon, putative substrate-bindingprotein (oxd-6a), putative transmembrane protein (oxd-6), putativetransmembrane protein (oxd-6c), putative ATPase (oxd-6d), andputative ATPase (oxd-6e) genes, complete cds.

| ORF Name | NTID | AAID | NT Length | AA Length | Score | Probability |
|---|---|---|---|---|---|---|
| 3947338_c3_851 | 2386 | 6558 | 264 | 795 | 744 | 1.3e-73 |
| Protein name | | | | Locus Name | | Acc# |
| | | | | sp:YGID_ECOLI | | P24197 |

Description (F271)

| ORF Name | NTID | AAID | NT Length | AA Length | Score | Probability |
|---|---|---|---|---|---|---|
| 3947918_c2_618 | 2387 | 6559 | 223 | 672 | 625 | 5.2e-61 |
| Protein name | | | | Locus Name | | Acc# |
| | | | | sp:TALC_ECOLI | | P32669 |

Description

TRANSALDOLASE-LIKE PROTEIN TALC,

| ORF Name | NTID | AAID | NT Length | AA Length | Score | Probability |
|---|---|---|---|---|---|---|
| 3956465_c1_542 | 2388 | 6560 | 472 | 1419 | 658 | 1.6e-64 |
| Protein name | | | | Locus Name | | Acc# |
| | | | | sp:MCPC_SALTY | | Q02755 |

Description (PROTEIN)

| ORF Name | NTID | AAID | NT Length | AA Length | Score | Probability |
|---|---|---|---|---|---|---|
| 3984676_c2_662 | 2389 | 6561 | 548 | 1647 | 1665 | 3.2e-171 |
| Protein name | | | | | Locus Name | Acc# |
| | | | | | sp:YJBB_ECOLI | P32683 |

Description

HYPOTHETICAL 59.5 KD PROTEIN IN METH-PEPE INTERGENIC REGION

| ORF Name | NTID | AAID | NT Length | AA Length | Score | Probability |
|---|---|---|---|---|---|---|
| 3989193_c3_814 | 2390 | 6562 | 356 | 1071 | 994 | 4.1e-100 |
| Protein name | | | | | Locus Name | Acc# |
| | | | | | sp:YJJU_ECOLI | P39407 |

Description

HYPOTHETICAL 39.8 KD PROTEIN IN OSMY-DEOC INTERGENIC REGION (O357)

| ORF Name | NTID | AAID | NT Length | AA Length | Score | Probability |
|---|---|---|---|---|---|---|
| 3989683_f1_142 | 2391 | 6563 | 60 | 183 | | |
| Protein name | | | | | Locus Name | Acc# |

Description

NO-HIT

| ORF Name | NTID | AAID | NT Length | AA Length | Score | Probability |
|---|---|---|---|---|---|---|
| 4064002_c1_549 | 2392 | 6564 | 85 | 258 | | |
| Protein name | | | | | Locus Name | Acc# |

Description

NO-HIT

| ORF Name | NTID | AAID | NT Length | AA Length | Score | Probability |
|---|---|---|---|---|---|---|
| 4064393_c2_691 | 2393 | 6565 | 60 | 183 | | |
| Protein name | | | | | Locus Name | Acc# |

Description

NO-HIT

| ORF Name | NTID | AAID | NT Length | AA Length | Score | Probability |
|---|---|---|---|---|---|---|
| 4100067_f2_187 | 2394 | 6566 | 150 | 453 | 383 | 2.3e-35 |
| Protein name | | | | | Locus Name | Acc# |
| | | | | | sp:YGDK_ECOLI | Q46926 |

Description
HYPOTHETICAL 15.9 KD PROTEIN IN GCVA-METZ INTERGENIC REGION (O147)

| ORF Name | NTID | AAID | NT Length | AA Length | Score | Probability |
|---|---|---|---|---|---|---|
| 4100268_c1_464 | 2395 | 6567 | 279 | 840 | 77 | 0.0064 |
| Protein name | | | | | Locus Name | Acc# |
| sipC protein | | | | | pir:S70215 | S70215 |

Description

| ORF Name | NTID | AAID | NT Length | AA Length | Score | Probability |
|---|---|---|---|---|---|---|
| 4103387_c3_778 | 2396 | 6568 | 239 | 720 | 292 | 1.0e-25 |
| Protein name | | | | | Locus Name | Acc# |
| | | | | | sp:FIMC_ECOLI | P31697:P71 |

Description
CHAPERONE PROTEIN FIMC PRECURSOR

| ORF Name | NTID | AAID | NT Length | AA Length | Score | Probability |
|---|---|---|---|---|---|---|
| 4165887_f2_223 | 2397 | 6569 | 237 | 714 | 861 | 5.1e-86 |
| Protein name | | | | | Locus Name | Acc# |
| | | | | | sp:YGIH_ECOLI | P31056 |

Description
HYPOTHETICAL 22.2 KD PROTEIN IN BACA-TTDA INTERGENIC REGION (O205)

| ORF Name | NTID | AAID | NT Length | AA Length | Score | Probability |
|---|---|---|---|---|---|---|
| 417680_f2_184 | 2398 | 6570 | 295 | 888 | 1061 | 3.2e-107 |
| Protein name | | | | | Locus Name | Acc# |
| | | | | | sp:YQCD_ECOLI | Q46920 |

Description
HYPOTHETICAL 32.6 KD PROTEIN IN SYD-SDAC INTERGENIC REGION

| ORF Name | NTID | AAID | NT Length | AA Length | Score | Probability |
|---|---|---|---|---|---|---|
| 4190903_c3_751 | 2399 | 6571 | 306 | 921 | 105 | 0.00038 |
| Protein name | | | | | Locus Name | Acc# |
| beta-glucosidase homolog | | | | | pir:C70177 | C70177 |

Description

| ORF Name | NTID | AAID | NT Length | AA Length | Score | Probability |
|---|---|---|---|---|---|---|
| 4197183_c3_890 | 2400 | 6572 | 451 | 1356 | 1503 | 4.7e-154 |
| Protein name | | | | | Locus Name | Acc# |
| | | | | | sp:YAEL_ECOLI | P37764 |

Description
HYPOTHETICAL 49.1 KD PROTEIN IN CDSA-HLPA INTERGENIC REGION

| ORF Name | NTID | AAID | NT Length | AA Length | Score | Probability |
|---|---|---|---|---|---|---|
| 4303467_c3_782 | 2401 | 6573 | 191 | 576 | 847 | 1.5e-84 |
| Protein name | | | | | Locus Name | Acc# |
| translation elongation factor EF-P | | | | | pir:S34443 | S34443:S56 |

Description

| ORF Name | NTID | AAID | NT Length | AA Length | Score | Probability |
|---|---|---|---|---|---|---|
| 4323411_f3_351 | 2402 | 6574 | 408 | 1227 | 1145 | 4.1e-116 |
| Protein name | | | | | Locus Name | Acc# |
| hypothetical protein b2810 | | | | | pir:F65063 | F65063 |

Description

| ORF Name | NTID | AAID | NT Length | AA Length | Score | Probability |
|---|---|---|---|---|---|---|
| 4328178_c2_607 | 2403 | 6575 | 356 | 1071 | 677 | 1.6e-66 |
| Protein name | | | | | Locus Name | Acc# |
| | | | | | sp:SPAS_SHIFL | P40707 |

Description
SURFACE PRESENTATION OF ANTIGENS PROTEIN SPAS (SPA40 PROTEIN)

| ORF Name | NTID | AAID | NT Length | AA Length | Score | Probability |
|---|---|---|---|---|---|---|
| 4328436_c3_829 | 2404 | 6576 | 152 | 459 | 188 | 1.1e-14 |
| Protein name | | | | | Locus Name | Acc# |
| | | | | | sp:TONB_ENTAE | P46383 |

Description: TONB PROTEIN

| ORF Name | NTID | AAID | NT Length | AA Length | Score | Probability |
|---|---|---|---|---|---|---|
| 4329678_c3_807 | 2405 | 6577 | 139 | 420 | 217 | 8.9e-18 |
| Protein name | | | | | Locus Name | Acc# |
| | | | | | sp:HOLD_ECOLI | P28632 |

Description: DNA POLYMERASE III, PSI SUBUNIT,

| ORF Name | NTID | AAID | NT Length | AA Length | Score | Probability |
|---|---|---|---|---|---|---|
| 4331300_c3_752 | 2406 | 6578 | 182 | 549 | 435 | 7.0e-41 |
| Protein name | | | | | Locus Name | Acc# |
| | | | | | sp:IPPI_SHIFL | P18008 |

Description: IPPI PROTEIN

| ORF Name | NTID | AAID | NT Length | AA Length | Score | Probability |
|---|---|---|---|---|---|---|
| 4351038_c2_628 | 2407 | 6579 | 446 | 1341 | 1810 | 1.4e-186 |
| Protein name | | | | | Locus Name | Acc# |
| | | | | | sp:YAAU_ECOLI | P31679:P31 |

Description: REGION (ORF65/66)

| ORF Name | NTID | AAID | NT Length | AA Length | Score | Probability |
|---|---|---|---|---|---|---|
| 4381443_f2_215 | 2408 | 6580 | 107 | 324 | 288 | 2.7e-25 |
| Protein name | | | | | Locus Name | Acc# |
| | | | | | sp:YQIC_ECOLI | Q46868 |

Description: HYPOTHETICAL 13.8 KD PROTEIN IN RIBB-GLGS INTERGENIC REGION

| ORF Name | NTID | AAID | NT Length | AA Length | Score | Probability |
|---|---|---|---|---|---|---|
| 4416076_f1_145 | 2409 | 6581 | 253 | 762 | | |

Protein name | | | | | Locus Name | Acc#

Description: NO-HIT

| ORF Name | NTID | AAID | NT Length | AA Length | Score | Probability |
|---|---|---|---|---|---|---|
| 4502316_f1_139 | 2410 | 6582 | 410 | 1233 | 1894 | 1.7e-195 |

Protein name | | | | | Locus Name: sp:CAIB_ECOLI | Acc#: P31572

Description: L-CARNITINE DEHYDRATASE, (L-CDHT)

| ORF Name | NTID | AAID | NT Length | AA Length | Score | Probability |
|---|---|---|---|---|---|---|
| 4698592_c1_538 | 2411 | 6583 | 198 | 597 | 1015 | 2.4e-102 |

Protein name: TerZ | | | | | Locus Name: gp:AF168355 | Acc#: AF168355

Description: Proteus mirabilis tellurite resistance locus, complete sequence;and unknown gene.

| ORF Name | NTID | AAID | NT Length | AA Length | Score | Probability |
|---|---|---|---|---|---|---|
| 4707840_f1_7 | 2412 | 6584 | 575 | 1728 | 2440 | 2.4e-253 |

Protein name: proline--tRNA ligase,:global RNA synthesis factor:prolyl-tRNA synthetase | | | | | Locus Name: pir:YPEC | Acc#: B64744:JV0

Description:

| ORF Name | NTID | AAID | NT Length | AA Length | Score | Probability |
|---|---|---|---|---|---|---|
| 4725443_f2_262 | 2413 | 6585 | 342 | 1029 | 941 | 1.7e-94 |

Protein name | | | | | Locus Name: sp:YJJT_ECOLI | Acc#: P39406

Description: HYPOTHETICAL 37.6 KD PROTEIN IN FHUF-HOLD INTERGENIC REGION (F343B)

572

| ORF_Name | NTID | AAID | NT Length | AA Length | Score | Probability |
|---|---|---|---|---|---|---|
| 4727207_f1_53 | 2414 | 6586 | 336 | 1011 | 1213 | 2.5e-123 |
| Protein name | | | | | Locus Name | Acc# |
| | | | | | sp:PDXA_ECOLI | P19624 |

Description
PYRIDOXAL PHOSPHATE BIOSYNTHETIC PROTEIN PDXA

| ORF_Name | NTID | AAID | NT Length | AA Length | Score | Probability |
|---|---|---|---|---|---|---|
| 47581_c1_585 | 2415 | 6587 | 72 | 219 | 102 | 0.00011 |
| Protein name | | | | | Locus Name | Acc# |
| | | | | | sp:AMIC_ECOLI | Q46929 |

Description
N-ACETYLMURAMOYL-L-ALANINE AMIDASE AMIC PRECURSOR,

| ORF_Name | NTID | AAID | NT Length | AA Length | Score | Probability |
|---|---|---|---|---|---|---|
| 4765702_c3_892 | 2416 | 6588 | 342 | 1029 | 1451 | 1.5e-148 |
| Protein name | | | | | Locus Name | Acc# |
| glucosamine N-acyltransferase, | | | | | pir:S41752 | S41752:S35 |

Description

| ORF_Name | NTID | AAID | NT Length | AA Length | Score | Probability |
|---|---|---|---|---|---|---|
| 4803755_c1_517 | 2417 | 6589 | 183 | 552 | 98 | 0.0025 |
| Protein name | | | | | Locus Name | Acc# |
| streptothricine-acetyl-transferase | | | | | gp:CCU01945 | U01945 |

Description
Campylobacter coli BEG4 streptothricine-acetyl-transferase (sat4)gene, complete cds.

| ORF_Name | NTID | AAID | NT Length | AA Length | Score | Probability |
|---|---|---|---|---|---|---|
| 4814812_f2_239 | 2418 | 6590 | 318 | 957 | 562 | 2.5e-54 |
| Protein name | | | | | Locus Name | Acc# |
| hypothetical protein | | | | | pir:B75302 | B75302 |

Description

| ORF Name | NTID | AAID | NT Length | AA Length | Score | Probability |
|---|---|---|---|---|---|---|
| 4814827_c1_509 | 2419 | 6591 | 78 | 237 | 73 | 0.016 |
| Protein name | | | | | Locus Name | Acc# |
| unknown | | | | | gp:AF061244 | AF061244 |

Description

Agrocybe aegerita B type DNA polymerase (Mtpol) gene, complete cds;tRNA-Asn gene, complete sequence; and unknown genes, mitochondrialgenes for mitochondrial products.

| ORF Name | NTID | AAID | NT Length | AA Length | Score | Probability |
|---|---|---|---|---|---|---|
| 4815877_f3_365 | 2420 | 6592 | 202 | 609 | 258 | 4.0e-22 |
| Protein name | | | | | Locus Name | Acc# |
| unknown | | | | | gp:AF079317 | AF079317 |

Description

Sphingomonas aromaticivorans plasmid pNL1, complete plasmidsequence.

| ORF Name | NTID | AAID | NT Length | AA Length | Score | Probability |
|---|---|---|---|---|---|---|
| 4823305_f2_222 | 2421 | 6593 | 416 | 1251 | 1515 | 2.5e-155 |
| Protein name | | | | | Locus Name | Acc# |
| | | | | | sp:CCA_ECOLI | P06961 |

Description (TRNA CCA-PYROPHOSPHORYLASE) (CCA-ADDING ENZYME)

| ORF Name | NTID | AAID | NT Length | AA Length | Score | Probability |
|---|---|---|---|---|---|---|
| 485640_c2_710 | 2422 | 6594 | 1095 | 3288 | 410 | 4.8e-93 |
| Protein name | | | | | Locus Name | Acc# |
| serine protease homologue | | | | | gp:AB015053 | AB015053 |

Description

Pseudomonas fluorescens genes for ABC exporter operon, completecds.

| ORF Name | NTID | AAID | NT Length | AA Length | Score | Probability |
|---|---|---|---|---|---|---|
| 4859766_c2_665 | 2423 | 6595 | 73 | 222 | | |
| Protein name | | | | | Locus Name | Acc# |

Description

NO-HIT

| ORF Name | NTID | AAID | NT Length | AA Length | Score | Probability |
|---|---|---|---|---|---|---|
| 4860317_f2_181 | 2424 | 6596 | 268 | 807 | 1116 | 4.8e-113 |//
| Protein name | | | | | Locus Name | Acc# |
| methionyl aminopeptidase,:peptidase M | | | | | pir:S12027 | S12027:S03 |

Description

| ORF Name | NTID | AAID | NT Length | AA Length | Score | Probability |
|---|---|---|---|---|---|---|
| 4875717_c2_734 | 2425 | 6597 | 244 | 735 | 1135 | 4.7e-115 |
| Protein name | | | | | Locus Name | Acc# |
| ribosomal protein S2 | | | | | pir:R3EC2 | A02696:S45 |

Description

| ORF Name | NTID | AAID | NT Length | AA Length | Score | Probability |
|---|---|---|---|---|---|---|
| 4882211_f2_309 | 2426 | 6598 | 418 | 1257 | | |
| Protein name | | | | | Locus Name | Acc# |

Description
NO-HIT

| ORF Name | NTID | AAID | NT Length | AA Length | Score | Probability |
|---|---|---|---|---|---|---|
| 4882933_c2_700 | 2427 | 6599 | 124 | 375 | 430 | 2.4e-40 |
| Protein name | | | | | Locus Name | Acc# |
| probable dihydroneopterin aldolase, | | | | | pir:H65093 | H65093 |

Description

| ORF Name | NTID | AAID | NT Length | AA Length | Score | Probability |
|---|---|---|---|---|---|---|
| 4891551_f1_166 | 2428 | 6600 | 65 | 198 | 49 | 0.018 |
| Protein name | | | | | Locus Name | Acc# |
| | | | | | gp:ADRE3A | L23218 |

Description
Mastadenovirus sus4 E3 region, pVIII gene, complete cds, and fiberprotein gene, partial cds.

| ORF_Name | NTID | AAID | NT Length | AA Length | Score | Probability |
|---|---|---|---|---|---|---|
| 4892177_c2_731 | 2429 | 6601 | 154 | 465 | 463 | 7.6e-44 |
| Protein name | | | | | Locus_Name | Acc# |
| hypothetical protein b2790 | | | | | pir:B65061 | B65061 |

Description

| ORF_Name | NTID | AAID | NT Length | AA Length | Score | Probability |
|---|---|---|---|---|---|---|
| 4895177_c1_540 | 2430 | 6602 | 131 | 396 | 483 | 5.8e-46 |
| Protein name | | | | | Locus_Name | Acc# |
| TerB | | | | | gp:AF168355 | AF168355 |

Description

Proteus mirabilis tellurite resistance locus, complete sequence;and unknown gene.

| ORF_Name | NTID | AAID | NT Length | AA Length | Score | Probability |
|---|---|---|---|---|---|---|
| 4898937_c1_599 | 2431 | 6603 | 239 | 720 | 374 | 2.1e-34 |
| Protein name | | | | | Locus_Name | Acc# |
| | | | | | sp:CUTF_ECOLI | P40710 |

Description

COPPER HOMEOSTASIS PROTEIN CUTF PRECURSOR (LIPOPROTEIN NLPE)

| ORF_Name | NTID | AAID | NT Length | AA Length | Score | Probability |
|---|---|---|---|---|---|---|
| 4901533_f2_296 | 2432 | 6604 | 1651 | 4956 | 1849 | 0.0 |
| Protein name | | | | | Locus_Name | Acc# |
| probable large glycine/alanine rich protein | | | | | pir:T36105 | T36105 |

Description

| ORF_Name | NTID | AAID | NT Length | AA Length | Score | Probability |
|---|---|---|---|---|---|---|
| 491527_f3_450 | 2433 | 6605 | 479 | 1440 | 613 | 9.7e-60 |
| Protein name | | | | | Locus_Name | Acc# |
| AlgI | | | | | gp:PAU50202 | U50202 |

Description

Pseudomonas aeruginosa alginate gene cluster AlgI (algI), AlgJ(algJ) and AlgF (algF) genes, complete cds.

| ORF Name | NTID | AAID | NT Length | AA Length | Score | Probability |
|---|---|---|---|---|---|---|
| 4945382_c2_635 | 2434 | 6606 | 557 | 1674 | 2425 | 9.4e-252 |
| Protein name | | | | | Locus Name | Acc# |
| chaperonin groEL:heat shock protein groEL:hsp60:ribosomal protein A (misnomer) | | | | pir:BVECGL | | S56371:S01 |
| Description | | | | | | |

| ORF Name | NTID | AAID | NT Length | AA Length | Score | Probability |
|---|---|---|---|---|---|---|
| 4979818_c1_501 | 2435 | 6607 | 320 | 963 | 1110 | 2.1e-112 |
| Protein name | | | | | Locus Name | Acc# |
| | | | | | sp:HYFC_ECOLI | P77858:P78 |
| Description | | | | | | |
| HYDROGENASE-4 COMPONENT C, | | | | | | |

| ORF Name | NTID | AAID | NT Length | AA Length | Score | Probability |
|---|---|---|---|---|---|---|
| 5078418_f2_306 | 2436 | 6608 | 386 | 1161 | | |
| Protein name | | | | | Locus Name | Acc# |
| Description | | | | | | |
| NO-HIT | | | | | | |

| ORF Name | NTID | AAID | NT Length | AA Length | Score | Probability |
|---|---|---|---|---|---|---|
| 5089187_f1_32 | 2437 | 6609 | 109 | 330 | | |
| Protein name | | | | | Locus Name | Acc# |
| Description | | | | | | |
| NO-HIT | | | | | | |

| ORF Name | NTID | AAID | NT Length | AA Length | Score | Probability |
|---|---|---|---|---|---|---|
| 509638_c1_595 | 2438 | 6610 | 391 | 1176 | 1514 | 3.2e-155 |
| Protein name | | | | | Locus Name | Acc# |
| lipid-A-disaccharide synthase, | | | | pir:SYECLA | | F64742:B28 |
| Description | | | | | | |

| ORF Name | NTID | AAID | NT Length | AA Length | Score | Probability |
|---|---|---|---|---|---|---|
| 5100787_f1_156 | 2439 | 6611 | 296 | 891 | 711 | 4.0e-70 |

Protein name | | | | | Locus Name | Acc# |

| Orf2 | gp:AF081283 | AF081283 |
|---|---|---|

Description

Escherichia coli strain CFT073 alanine racemase (dadX), F536(f536), F304 (f304), O241 (o241), TonB-dependent outer membrane receptor (prrA), molybdenum transport protein (modD), Orf2, and ferric enterobactin transport ATP-binding protein (fepC) genes, complete cds.

| ORF Name | NTID | AAID | NT Length | AA Length | Score | Probability |
|---|---|---|---|---|---|---|
| 5110300_f3_343 | 2440 | 6612 | 883 | 2652 | 2996 | 0.0 |

Protein name | | | | | Locus Name | Acc# |

| | sp:GLND_ECOLI | P27249 |
|---|---|---|

Description

TRANSFERASE) (URIDYLYL REMOVING ENZYME) (UTASE)

| ORF Name | NTID | AAID | NT Length | AA Length | Score | Probability |
|---|---|---|---|---|---|---|
| 5110963_f3_402 | 2441 | 6613 | 91 | 276 | 293 | 7.9e-26 |

Protein name | | | | | Locus Name | Acc# |

| | sp:YBII_ECOLI | P41039 |
|---|---|---|

Description

HYPOTHETICAL 9.8 KD PROTEIN IN DING-GLNQ INTERGENIC REGION

| ORF Name | NTID | AAID | NT Length | AA Length | Score | Probability |
|---|---|---|---|---|---|---|
| 5113451_f3_382 | 2442 | 6614 | 176 | 531 | 141 | 1.0e-09 |

Protein name | | | | | Locus Name | Acc# |

| | sp:YWFB_BACSU | P39638 |
|---|---|---|

Description

HYPOTHETICAL 23.3 KD PROTEIN IN ROCC-PTA INTERGENIC REGION

| ORF_Name | NTID | AAID | NT Length | AA Length | Score | Probability |
|---|---|---|---|---|---|---|
| 5119818_c1_502 | 2443 | 6615 | 484 | 1455 | 1775 | 7.1e-183 |
| Protein name | | | | | Locus Name | Acc# |
| | | | | | sp:HYFD_ECOLI | P77416 |

Description: HYDROGENASE-4 COMPONENT D,

| ORF_Name | NTID | AAID | NT Length | AA Length | Score | Probability |
|---|---|---|---|---|---|---|
| 5203568_c1_475 | 2444 | 6616 | 156 | 471 | 234 | 1.4e-19 |
| Protein name | | | | | Locus Name | Acc# |
| | | | | | sp:RECX_ECOLI | P33596:P77 |

Description: REGULATORY PROTEIN RECX (ORAA PROTEIN)

| ORF_Name | NTID | AAID | NT Length | AA Length | Score | Probability |
|---|---|---|---|---|---|---|
| 5259715_c2_670 | 2445 | 6617 | 792 | 2379 | 395 | 1.5e-34 |
| Protein name | | | | | Locus Name | Acc# |
| | | | | | sp:PGTB_SALTY | P37433 |

Description: PHOSPHOGLYCERATE TRANSPORT SYSTEM SENSOR PROTEIN PGTB,

| ORF_Name | NTID | AAID | NT Length | AA Length | Score | Probability |
|---|---|---|---|---|---|---|
| 5266087_c2_608 | 2446 | 6618 | 352 | 1059 | 141 | 8.7e-12 |
| Protein name | | | | | Locus Name | Acc# |
| sspD protein | | | | | pir:S70549 | S70549 |

Description:

| ORF_Name | NTID | AAID | NT Length | AA Length | Score | Probability |
|---|---|---|---|---|---|---|
| 5267787_f2_190 | 2447 | 6619 | 474 | 1425 | 1864 | 2.6e-192 |
| Protein name | | | | | Locus Name | Acc# |
| | | | | | sp:ARGA_ECOLI | P08205:O68 |

Description: SYNTHASE) (AGS)

| ORF Name | NTID | AAID | NT Length | AA Length | Score | Probability |
|---|---|---|---|---|---|---|
| 5292125_f2_294 | 2448 | 6620 | 195 | 588 | 529 | 7.7e-51 |
| Protein name | | | | | Locus Name | Acc# |
| divalent cation tolerance protein cutA3, inner membrane:hypothetical protein 191:yjdC | | | | | pir:S56363 | S56363:S47 |

Description

| ORF Name | NTID | AAID | NT Length | AA Length | Score | Probability |
|---|---|---|---|---|---|---|
| 5343752_f3_399 | 2449 | 6621 | 403 | 1212 | 2009 | 1.1e-207 |
| Protein name | | | | | Locus Name | Acc# |
| tetracycline resistance protein | | | | | gp:AF038993 | AF038993 |

Description

Proteus mirabilis repressor protein (tetRJ) and tetracyclineresistance protein (tetAJ) genes, complete cds.

| ORF Name | NTID | AAID | NT Length | AA Length | Score | Probability |
|---|---|---|---|---|---|---|
| 555266_c3_796 | 2450 | 6622 | 332 | 999 | 1084 | 1.2e-109 |
| Protein name | | | | | Locus Name | Acc# |
| putative transmembrane protein | | | | | gp:STU94729 | U94729 |

Description

Salmonella typhimurium oxd-6 operon, putative substrate-bindingprotein (oxd-6a), putative transmembrane protein (oxd-6), putativetransmembrane protein (oxd-6c), putative ATPase (oxd-6d), andputative ATPase (oxd-6e) genes, complete cds.

| ORF Name | NTID | AAID | NT Length | AA Length | Score | Probability |
|---|---|---|---|---|---|---|
| 5898410_f2_203 | 2451 | 6623 | 276 | 831 | 1002 | 5.8e-101 |
| Protein name | | | | | Locus Name | Acc# |
| | | | | | sp:KSGA_ECOLI | P06992 |

Description (DIMETHYLTRANSFERASE)

| ORF Name | NTID | AAID | NT Length | AA Length | Score | Probability |
|---|---|---|---|---|---|---|
| 5987667_c1_530 | 2452 | 6624 | 275 | 828 | 364 | 2.4e-33 |
| Protein name | | | | | Locus Name | Acc# |
| | | | | | sp:YXIQ_BACSU | P42308 |

Description

HYPOTHETICAL 45.5 KD PROTEIN IN BGLS-KATB INTERGENIC REGION

| ORF Name | NTID | AAID | NT Length | AA Length | Score | Probability |
|---|---|---|---|---|---|---|
| 6058387_c1_597 | 2453 | 6625 | 323 | 972 | 1449 | 2.5e-148 |
| Protein name | | | | | Locus Name | Acc# |
| acetyl-CoA carboxylase,, carboxyltransferase alpha chain | | | | | pir:A43452 | A43452:D28 |

Description

| ORF Name | NTID | AAID | NT Length | AA Length | Score | Probability |
|---|---|---|---|---|---|---|
| 628426_c2_736 | 2454 | 6626 | 250 | 753 | 1114 | 7.9e-113 |
| Protein name | | | | | Locus Name | Acc# |
| uridine 5'-monophosphate kinase,:mukB suppressor protein | | | | | pir:B45269 | B45269:S45 |

Description

| ORF Name | NTID | AAID | NT Length | AA Length | Score | Probability |
|---|---|---|---|---|---|---|
| 6720425_c3_893 | 2455 | 6627 | 162 | 489 | 709 | 6.5e-70 |
| Protein name | | | | | Locus Name | Acc# |
| | | | | | sp:FABZ_YEREN | P32205 |

Description

DEHYDRATASE,

| ORF Name | NTID | AAID | NT Length | AA Length | Score | Probability |
|---|---|---|---|---|---|---|
| 6735015_c3_828 | 2456 | 6628 | 287 | 864 | 331 | 7.4e-30 |
| Protein name | | | | | Locus Name | Acc# |
| MutT/nudix family protein | | | | | pir:A75550 | A75550 |

Description

| ORF Name | NTID | AAID | NT Length | AA Length | Score | Probability |
|---|---|---|---|---|---|---|
| 6751438_c3_803 | 2457 | 6629 | 522 | 1569 | 291 | 1.7e-31 |
| Protein name | | | | | Locus Name | Acc# |
| | | | | | sp:FES_ERWCH | O51900 |

Description
ENTEROCHELIN ESTERASE (FERRIC ENTEROBACTIN ESTERASE)

| ORF Name | NTID | AAID | NT Length | AA Length | Score | Probability |
|---|---|---|---|---|---|---|
| 6839208_c3_777 | 2458 | 6630 | 194 | 585 | | |
| Protein name | | | | | Locus Name | Acc# |

Description
NO-HIT

| ORF Name | NTID | AAID | NT Length | AA Length | Score | Probability |
|---|---|---|---|---|---|---|
| 6908262_f3_447 | 2459 | 6631 | 548 | 1647 | 2020 | 7.7e-209 |
| Protein name | | | | | Locus Name | Acc# |
| | | | | | sp:CAIC_ECOLI | P31552 |

Description
PROBABLE CROTONOBETAINE/CARNITINE-COA LIGASE,

| ORF Name | NTID | AAID | NT Length | AA Length | Score | Probability |
|---|---|---|---|---|---|---|
| 7049018_c3_875 | 2460 | 6632 | 179 | 540 | 825 | 3.3e-82 |
| Protein name | | | | | Locus Name | Acc# |
| | | | | | sp:YGDP_ECOLI | Q46930 |

Description
HYPOTHETICAL 20.8 KD PROTEIN IN PTPH-MUTH INTERGENIC REGION

| ORF Name | NTID | AAID | NT Length | AA Length | Score | Probability |
|---|---|---|---|---|---|---|
| 7062800_f3_349 | 2461 | 6633 | 251 | 756 | 875 | 1.7e-87 |
| Protein name | | | | | Locus Name | Acc# |
| | | | | | sp:EX9_ECOLI | P38506:Q46 |

Description
EXODEOXYRIBONUCLEASE IX, (EXONUCLEASE IX) (EXO IX)

| ORF Name | NTID | AAID | NT Length | AA Length | Score | Probability |
|---|---|---|---|---|---|---|
| 7062936_c1_558 | 2462 | 6634 | 491 | 1476 | 2007 | 1.8e-207 |
| Protein name | | | | | Locus Name | Acc# |
| | | | | | sp:RFAE_ECOLI | P76658 |

Description
ADP-HEPTOSE SYNTHASE,

| ORF Name | NTID | AAID | NT Length | AA Length | Score | Probability |
|---|---|---|---|---|---|---|
| 7112592_f1_4 | 2463 | 6635 | 117 | 354 | 423 | 1.3e-39 |
| Protein name | | | | | Locus Name | Acc# |
| | | | | | sp:YAEE_ECOLI | P31547 |

Description
HYPOTHETICAL ABC TRANSPORTER PERMEASE PROTEIN YAEE

| ORF Name | NTID | AAID | NT Length | AA Length | Score | Probability |
|---|---|---|---|---|---|---|
| 7235378_f1_108 | 2464 | 6636 | 518 | 1557 | 1963 | 8.5e-203 |
| Protein name | | | | | Locus Name | Acc# |
| | | | | | sp:YJJI_ECOLI | P37342:P37 |

Description
HYPOTHETICAL 58.0 KD PROTEIN IN OSMY-DEOC INTERGENIC REGION (F516)

| ORF Name | NTID | AAID | NT Length | AA Length | Score | Probability |
|---|---|---|---|---|---|---|
| 7245161_c1_526 | 2465 | 6637 | 445 | 1338 | 1818 | 2.0e-187 |
| Protein name | | | | | Locus Name | Acc# |
| | | | | | sp:TYPH_ECOLI | P07650 |

Description
THYMIDINE PHOSPHORYLASE, (TDRPASE)

| ORF Name | NTID | AAID | NT Length | AA Length | Score | Probability |
|---|---|---|---|---|---|---|
| 7270832_c1_581 | 2466 | 6638 | 646 | 1941 | 993 | 2.3e-164 |
| Protein name | | | | | Locus Name | Acc# |
| | | | | | sp:EX5A_ECOLI | P04993:Q59 |

Description
ALPHA CHAIN)

| ORF Name | NTID | AAID | NT Length | AA Length | Score | Probability |
|---|---|---|---|---|---|---|
| 7306713_c3_826 | 2467 | 6639 | 114 | 345 | 208 | 8.0e-17 |
| Protein name | | | | | Locus Name | Acc# |
| | | | | | gp:BIU32222 | U32222:X53 |

Description: Bacteriophage 186, complete sequence.

| ORF Name | NTID | AAID | NT Length | AA Length | Score | Probability |
|---|---|---|---|---|---|---|
| 781325_f3_380 | 2468 | 6640 | 83 | 252 | | |
| Protein name | | | | | Locus Name | Acc# |

Description: NO-HIT

| ORF Name | NTID | AAID | NT Length | AA Length | Score | Probability |
|---|---|---|---|---|---|---|
| 781551_f1_120 | 2469 | 6641 | 80 | 243 | 81 | 0.014 |
| Protein name | | | | | Locus Name | Acc# |
| | | | | | sp:PTA_MYCGE | P47541 |

Description: (PHOSPHOTRANSACETYLASE)

| ORF Name | NTID | AAID | NT Length | AA Length | Score | Probability |
|---|---|---|---|---|---|---|
| 816433_f1_128 | 2470 | 6642 | 75 | 228 | 181 | 5.8e-14 |
| Protein name | | | | | Locus Name | Acc# |
| unknown protein | | | | | gp:MSGTCWPA | M15467 |

Description: M.tuberculosis 65 kDa antigen (cell wall protein a) gene.

| ORF Name | NTID | AAID | NT Length | AA Length | Score | Probability |
|---|---|---|---|---|---|---|
| 829687_c3_780 | 2471 | 6643 | 209 | 630 | | |
| Protein name | | | | | Locus Name | Acc# |

Description: NO-HIT

| ORF Name | NTID | AAID | NT Length | AA Length | Score | Probability |
|---|---|---|---|---|---|---|
| 84452_c1_498 | 2472 | 6644 | 271 | 816 | 203 | 2.7e-16 |
| Protein name | | | | | Locus Name | Acc# |
| | | | | | sp:HFB2_HAEIN | P45991 |

Description: CHAPERONE PROTEIN HIFB PRECURSOR

| ORF Name | NTID | AAID | NT Length | AA Length | Score | Probability |
|---|---|---|---|---|---|---|
| 879636_c1_598 | 2473 | 6645 | 453 | 1362 | 1057 | 8.6e-107 |
| Protein name | | | | | Locus Name | Acc# |
| | | | | | sp:MESJ_ECOLI | P52097 |

Description: PUTATIVE CELL CYCLE PROTEIN MESJ

| ORF Name | NTID | AAID | NT Length | AA Length | Score | Probability |
|---|---|---|---|---|---|---|
| 913952_f1_25 | 2474 | 6646 | 274 | 825 | 1275 | 6.8e-130 |
| Protein name | | | | | Locus Name | Acc# |
| | | | | | sp:DAPD_ECOLI | P03948 |

Description: (THP SUCCINYLTRANSFERASE) (TETRAHYDROPICOLINATE SUCCINYLASE)

| ORF Name | NTID | AAID | NT Length | AA Length | Score | Probability |
|---|---|---|---|---|---|---|
| 959405_f1_149 | 2475 | 6647 | 414 | 1245 | 129 | 3.1e-05 |
| Protein name | | | | | Locus Name | Acc# |
| hypothetical protein TP0565 | | | | | pir:C71308 | C71308 |

Description:

| ORF Name | NTID | AAID | NT Length | AA Length | Score | Probability |
|---|---|---|---|---|---|---|
| 973262_c2_686 | 2476 | 6648 | 212 | 639 | 977 | 2.6e-98 |
| Protein name | | | | | Locus Name | Acc# |
| TerE | | | | | gp:AF168355 | AF168355 |

Description: Proteus mirabilis tellurite resistance locus, complete sequence; and unknown gene.

| ORF Name | NTID | AAID | NT Length | AA Length | Score | Probability |
|---|---|---|---|---|---|---|
| 9843833_c1_513 | 2477 | 6649 | 60 | 183 | | |
| Protein name | | | | | Locus Name | Acc# |

Description: NO-HIT

| ORF Name | NTID | AAID | NT Length | AA Length | Score | Probability |
|---|---|---|---|---|---|---|
| 10175181_c3_698 | 2478 | 6650 | 786 | 2361 | 3099 | 0.0 |
| Protein name | | | | | Locus Name | Acc# |
| | | | | | sp:YHGF_ECOLI | P46837:P76 |

Description: HYPOTHETICAL 85.1 KD PROTEIN IN GREB-FEOA INTERGENIC REGION

| ORF Name | NTID | AAID | NT Length | AA Length | Score | Probability |
|---|---|---|---|---|---|---|
| 10240925_f2_196 | 2479 | 6651 | 69 | 210 | 71 | 0.026 |
| Protein name | | | | | Locus Name | Acc# |
| hypothetical protein a159R | | | | | pir:T17650 | T17650 |

Description:

| ORF Name | NTID | AAID | NT Length | AA Length | Score | Probability |
|---|---|---|---|---|---|---|
| 10585431_c1_460 | 2480 | 6652 | 284 | 855 | 916 | 7.5e-92 |
| Protein name | | | | | Locus Name | Acc# |
| | | | | | sp:BIOH_ECOLI | P13001 |

Description: BIOH PROTEIN

| ORF Name | NTID | AAID | NT Length | AA Length | Score | Probability |
|---|---|---|---|---|---|---|
| 10589427_f2_269 | 2481 | 6653 | 279 | 840 | 101 | 0.0097 |
| Protein name | | | | | Locus Name | Acc# |
| | | | | | sp:YRFD_ECOLI | P45753 |

Description: HYPOTHETICAL 30.0 KD PROTEIN IN HOFQ-MRCA INTERGENIC REGION (F268)

| ORF Name | NTID | AAID | NT Length | AA Length | Score | Probability |
|---|---|---|---|---|---|---|
| 10736067_c1_415 | 2482 | 6654 | 224 | 675 | 914 | 1.2e-91 |
| Protein name | | | | | Locus Name | Acc# |
| | | | | | sp:SODM_YEREN | P53655 |

Description

,

| ORF Name | NTID | AAID | NT Length | AA Length | Score | Probability |
|---|---|---|---|---|---|---|
| 10744042_f1_34 | 2483 | 6655 | 101 | 306 | 78 | 0.0048 |
| Protein name | | | | | Locus Name | Acc# |
| | | | | | sp:Y310_HAEIN | P43982 |

Description

HYPOTHETICAL PROTEIN HI0310 PRECURSOR

| ORF Name | NTID | AAID | NT Length | AA Length | Score | Probability |
|---|---|---|---|---|---|---|
| 10744050_c1_431 | 2484 | 6656 | 107 | 324 | 116 | 4.5e-07 |
| Protein name | | | | | Locus Name | Acc# |
| | | | | | gp:PMFIMOPR | Z32686 |

Description

Proteus mirabilis fimbrial operon, strain HI4320.

| ORF Name | NTID | AAID | NT Length | AA Length | Score | Probability |
|---|---|---|---|---|---|---|
| 10814077_c1_427 | 2485 | 6657 | 446 | 1341 | 1967 | 3.2e-203 |
| Protein name | | | | | Locus Name | Acc# |
| glutamate dehydrogenase (NADP+),:glutamic dehydrogenase:NADP-specific glutamate | | | | | pir:A33504 | A33504 |

Description

| ORF Name | NTID | AAID | NT Length | AA Length | Score | Probability |
|---|---|---|---|---|---|---|
| 1173450_c3_706 | 2486 | 6658 | 164 | 495 | 552 | 2.8e-53 |
| Protein name | | | | | Locus Name | Acc# |
| | | | | | sp:YIHZ_ECOLI | P32147 |

Description

HYPOTHETICAL 15.9 KD PROTEIN IN RBN-FDHE INTERGENIC REGION (O145)

| ORF Name | NTID | AAID | NT Length | AA Length | Score | Probability |
|---|---|---|---|---|---|---|
| 11885312_f2_151 | 2487 | 6659 | 88 | 267 | 303 | 6.8e-27 |
| Protein name | | | | | Locus Name | Acc# |
| | | | | | sp:YHEU_ECOLI | P45536 |

Description: HYPOTHETICAL 8.5 KD PROTEIN IN KIFB-PRKB INTERGENIC REGION

| ORF Name | NTID | AAID | NT Length | AA Length | Score | Probability |
|---|---|---|---|---|---|---|
| 11900007_c1_489 | 2488 | 6660 | 85 | 258 | 208 | 9.7e-16 |
| Protein name | | | | | Locus Name | Acc# |
| hypothetical 77K protein (spoT 3' region) | | | | | pir:Q3ECS7 | A30374:Q90 |

Description:

| ORF Name | NTID | AAID | NT Length | AA Length | Score | Probability |
|---|---|---|---|---|---|---|
| 11907201_f2_218 | 2489 | 6661 | 66 | 201 | 108 | 3.2e-06 |
| Protein name | | | | | Locus Name | Acc# |
| hypothetical protein APE1580 | | | | | pir:G72536 | G72536 |

Description:

| ORF Name | NTID | AAID | NT Length | AA Length | Score | Probability |
|---|---|---|---|---|---|---|
| 11954587_f2_187 | 2490 | 6662 | 200 | 603 | | |
| Protein name | | | | | Locus Name | Acc# |

Description: NO-HIT

| ORF Name | NTID | AAID | NT Length | AA Length | Score | Probability |
|---|---|---|---|---|---|---|
| 1203582_c3_736 | 2491 | 6663 | 99 | 300 | 213 | 2.4e-17 |
| Protein name | | | | | Locus Name | Acc# |
| | | | | | sp:YHEL_ECOLI | P45530 |

Description: HYPOTHETICAL 10.7 KD PROTEIN IN RPSL-FKPA INTERGENIC REGION

| ORF Name | NTID | AAID | NT Length | AA Length | Score | Probability |
|---|---|---|---|---|---|---|
| 1206562_f2_178 | 2492 | 6664 | 207 | 624 | 747 | 6.1e-74 |
| Protein name | | | | | Locus Name | Acc# |
| hypothetical 22.0 kD protein in rph-gmk intergenic region | | | | pir:H65165 | | H65165 |

Description

| ORF Name | NTID | AAID | NT Length | AA Length | Score | Probability |
|---|---|---|---|---|---|---|
| 12136078_f2_147 | 2493 | 6665 | 579 | 1740 | 914 | 1.2e-91 |
| Protein name | | | | | Locus Name | Acc# |
| | | | | sp:MCP1_ECOLI | | P02942:P76 |

Description

PROTEIN)

| ORF Name | NTID | AAID | NT Length | AA Length | Score | Probability |
|---|---|---|---|---|---|---|
| 12273312_c2_572 | 2494 | 6666 | 356 | 1071 | 361 | 4.9e-33 |
| Protein name | | | | | Locus Name | Acc# |
| | | | | sp:YGB7_ALCEU | | Q44018 |

Description

HYPOTHETICAL 35.6 KD PROTEIN IN GBD 5'REGION PRECURSOR (ORF7)

| ORF Name | NTID | AAID | NT Length | AA Length | Score | Probability |
|---|---|---|---|---|---|---|
| 1289077_f3_369 | 2495 | 6667 | 320 | 963 | 756 | 6.8e-75 |
| Protein name | | | | | Locus Name | Acc# |
| ferrichrome ABC transporter (permease) homolog yclN | | | | pir:B69763 | | B69763 |

Description

| ORF Name | NTID | AAID | NT Length | AA Length | Score | Probability |
|---|---|---|---|---|---|---|
| 1364200_f2_149 | 2496 | 6668 | 65 | 198 | 71 | 0.026 |
| Protein name | | | | | Locus Name | Acc# |
| hypothetical protein R58 | | | | pir:T13185 | | T13185 |

Description

589

| ORF Name | NTID | AAID | NT Length | AA Length | Score | Probability |
|---|---|---|---|---|---|---|
| 14261717_cl_519 | 2497 | 6669 | 625 | 1878 | 2053 | 2.5e-212 |

| Protein name | Locus Name | Acc# |
|---|---|---|
| | sp:KEFB_ECOLI | P45522 |

Description

ANTIPORTER) (NEM-ACTIVATABLE K+/H+ ANTIPORTER)

| ORF Name | NTID | AAID | NT Length | AA Length | Score | Probability |
|---|---|---|---|---|---|---|
| 1428191_cl_453 | 2498 | 6670 | 300 | 903 | 535 | 1.8e-51 |

| Protein name | Locus Name | Acc# |
|---|---|---|
| oligopeptide transporter putative ATPase domain | gp:AF076683 | AF076683 |

Description

Staphylococcus aureus oligopeptide transporter putative substratebinding domain (opp-1A), oligopeptide transporter putative membranepermease domain (opp-1B), oligopeptide transporter putativemembrane permease domain (opp-1C), oligopeptide transporterputative ATPase domain (opp-1D), and oligopeptide transporterputative ATPase domain (opp-1F) genes, complete cds; and

| ORF Name | NTID | AAID | NT Length | AA Length | Score | Probability |
|---|---|---|---|---|---|---|
| 1439687_c3_666 | 2499 | 6671 | 261 | 786 | 319 | 1.4e-28 |

| Protein name | Locus Name | Acc# |
|---|---|---|
| | sp:YEAM_ECOLI | P76241 |

Description

HYPOTHETICAL TRANSCRIPTIONAL REGULATOR IN GAPA-RND INTERGENIC REGION

| ORF Name | NTID | AAID | NT Length | AA Length | Score | Probability |
|---|---|---|---|---|---|---|
| 14455092_cl_498 | 2500 | 6672 | 121 | 366 | 201 | 4.4e-16 |

| Protein name | Locus Name | Acc# |
|---|---|---|
| | sp:YIDQ_ECOLI | P31454 |

Description

HYPOTHETICAL 14.8 KD PROTEIN IN IBPA-GYRB INTERGENIC REGION

| ORF Name | NTID | AAID | NT Length | AA Length | Score | Probability |
|---|---|---|---|---|---|---|
| 1448375_c1_452 | 2501 | 6673 | 326 | 981 | 718 | 7.2e-71 |
| Protein name | | | | | Locus Name | Acc# |
| nickel transport system permease protein nikB:hypothetical protein o314 | | | | pir:S47696 | | S47696:H65 |

Description

| ORF Name | NTID | AAID | NT Length | AA Length | Score | Probability |
|---|---|---|---|---|---|---|
| 14630281_f2_209 | 2502 | 6674 | 116 | 351 | 273 | 1.0e-23 |
| Protein name | | | | | Locus Name | Acc# |
| glpG protein | | | | pir:BVECGG | | C65138:A30 |

Description

| ORF Name | NTID | AAID | NT Length | AA Length | Score | Probability |
|---|---|---|---|---|---|---|
| 14665700_c1_468 | 2503 | 6675 | 244 | 735 | 216 | 1.1e-17 |
| Protein name | | | | | Locus Name | Acc# |
| | | | | | sp:YBBA_HAEIN | P45247 |

Description
HYPOTHETICAL ABC TRANSPORTER ATP-BINDING PROTEIN HI1549

| ORF Name | NTID | AAID | NT Length | AA Length | Score | Probability |
|---|---|---|---|---|---|---|
| 15792775_c1_446 | 2504 | 6676 | 748 | 2247 | 179 | 2.6e-10 |
| Protein name | | | | | Locus Name | Acc# |
| | | | | | gp:YP102KB | AL031866 |

Description
Yersinia pestis 102 kbases unstable region: from 1 to 119443.

| ORF Name | NTID | AAID | NT Length | AA Length | Score | Probability |
|---|---|---|---|---|---|---|
| 15908205_c3_735 | 2505 | 6677 | 128 | 387 | 342 | 5.0e-31 |
| Protein name | | | | | Locus Name | Acc# |
| | | | | | sp:YHEM_ECOLI | P45531 |

Description
HYPOTHETICAL 13.0 KD PROTEIN IN RPSL-FKPA INTERGENIC REGION

| ORF Name | NTID | AAID | NT Length | AA Length | Score | Probability |
|---|---|---|---|---|---|---|
| 160635_c3_691 | 2506 | 6678 | 320 | 963 | 328 | 1.5e-29 |

Protein name | | | | Locus Name | Acc#

| malonyl COA-acyl carrier protein transacylase (fabD) RP735 | pir:D71633 | D71633 |
|---|---|---|

Description

| ORF Name | NTID | AAID | NT Length | AA Length | Score | Probability |
|---|---|---|---|---|---|---|
| 164062_c3_680 | 2507 | 6679 | 66 | 201 | 62 | 0.0044 |

Protein name | | | | Locus Name | Acc#

| cytochrome b | gp:AF157860 | AF157860 |
|---|---|---|

Description

Spermophilus variegatus utah isolate S12 cytochrome b (cytb) gene, complete cds; mitochondrial gene for mitochondrial product.

| ORF Name | NTID | AAID | NT Length | AA Length | Score | Probability |
|---|---|---|---|---|---|---|
| 16417535_f1_138 | 2508 | 6680 | 105 | 318 | | |

Protein name | | | | Locus Name | Acc#

Description

NO-HIT

| ORF Name | NTID | AAID | NT Length | AA Length | Score | Probability |
|---|---|---|---|---|---|---|
| 16598963_f2_251 | 2509 | 6681 | 926 | 2781 | 113 | 0.023 |

Protein name | | | | Locus Name | Acc#

| | sp:RBP2_PLAVB | Q00799 |
|---|---|---|

Description

RETICULOCYTE BINDING PROTEIN 2 (FRAGMENT)

| ORF Name | NTID | AAID | NT Length | AA Length | Score | Probability |
|---|---|---|---|---|---|---|
| 16798452_f3_403 | 2510 | 6682 | 191 | 576 | 793 | 8.2e-79 |

Protein name | | | | Locus Name | Acc#

| shikimate kinase, I | pir:A65134 | A65134:I41 |
|---|---|---|

Description

592

| ORF Name | NTID | AAID | NT Length | AA Length | Score | Probability |
|---|---|---|---|---|---|---|
| 16829077_f2_198 | 2511 | 6683 | 258 | 777 | 1226 | 1.1e-124 |

| Protein name | Locus Name | Acc# |
|---|---|---|
| peripheral membrane protein | gp:D89963 | D89963 |

Description

Enterobacter cloacae pstS, pstC, pstA, pstB and phoU genes, complete cds.

| ORF Name | NTID | AAID | NT Length | AA Length | Score | Probability |
|---|---|---|---|---|---|---|
| 16834833_c3_652 | 2512 | 6684 | 162 | 489 | 106 | 5.1e-06 |

| Protein name | Locus Name | Acc# |
|---|---|---|
| CspB | gp:AF003592 | AF003592 |

Description

Staphylococcus aureus CspB (cspB) gene, complete cds.

| ORF Name | NTID | AAID | NT Length | AA Length | Score | Probability |
|---|---|---|---|---|---|---|
| 19538906_c3_700 | 2513 | 6685 | 124 | 375 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 19567768_f3_372 | 2514 | 6686 | 809 | 2430 | 1582 | 2.0e-162 |

| Protein name | Locus Name | Acc# |
|---|---|---|
| | sp:DMSA_ECOLI | P18775 |

Description (DMSO REDUCTASE)

| ORF Name | NTID | AAID | NT Length | AA Length | Score | Probability |
|---|---|---|---|---|---|---|
| 19570252_c3_699 | 2515 | 6687 | 255 | 768 | 132 | 6.8e-07 |

| Protein name | Locus Name | Acc# |
|---|---|---|
| conserved hypothetical protein | pir:G75359 | G75359 |

Description

| ORF Name | NTID | AAID | NT Length | AA Length | Score | Probability |
|---|---|---|---|---|---|---|
| 19581468_f2_248 | 2516 | 6688 | 739 | 2220 | 997 | 2.0e-100 |

| Protein name | Locus Name | Acc# |
|---|---|---|
| VgrG protein | gp:AF044503 | AF044503 |

Description

Escherichia coli strain ec11 unknown (498), hcp gene, complete cds; and RhsG accessory genetic element VgrG protein, core component anddsORF-g1 genes, complete cds.

| ORF Name | NTID | AAID | NT Length | AA Length | Score | Probability |
|---|---|---|---|---|---|---|
| 19582536_f2_197 | 2517 | 6689 | 312 | 939 | 1275 | 6.8e-130 |

| Protein name | Locus Name | Acc# |
|---|---|---|
| integral membrane protein A | gp:D89963 | D89963 |

Description

Enterobacter cloacae pstS, pstC, pstA, pstB and phoU genes, complete cds.

| ORF Name | NTID | AAID | NT Length | AA Length | Score | Probability |
|---|---|---|---|---|---|---|
| 19634438_c2_534 | 2518 | 6690 | 727 | 2184 | 3678 | 0.0 |

| Protein name | Locus Name | Acc# |
|---|---|---|
| UmoB | gp:PMU66822 | U66822 |

Description

Proteus mirabilis YrfE (yrfE) gene, partial cds; and UmoB (umoB)gene, complete cds.

| ORF Name | NTID | AAID | NT Length | AA Length | Score | Probability |
|---|---|---|---|---|---|---|
| 19743805_c2_556 | 2519 | 6691 | 376 | 1131 | 112 | 0.00074 |

| Protein name | Locus Name | Acc# |
|---|---|---|
| WbpC | gp:PAU50396 | U50396 |

Description

Pseudomonas aeruginosa Wzz (Rol) (wzz (rol)) gene, partial cds,WbpA (wbpB), WbpB (wbpB), WbpC (wbpC), WbpD (wbpD), WbpE (wbpE),Wzy (Rfc) (wzy (rfc)), Wzx (wzx), HisH (hisH), HisF (hisF), WbpG(wbpG), WbpH (wbpH), WbpI (wbpI), WbpJ (wbpJ), WbpK (wbpK), WbpL(wbpL), WbpM (wbpM) and WbpN (wbpN) genes, complete cds, and UvrB(uvrB) gene, partial cds.

594

| ORF Name | NTID | AAID | NT Length | AA Length | Score | Probability |
|---|---|---|---|---|---|---|
| 19772555_c3_646 | 2520 | 6692 | 69 | 210 | | |
| Protein name | | | | | Locus Name | Acc# |

Description
NO-HIT

| ORF Name | NTID | AAID | NT Length | AA Length | Score | Probability |
|---|---|---|---|---|---|---|
| 19821008_c3_643 | 2521 | 6693 | 253 | 762 | 487 | 2.2e-46 |
| Protein name | | | | | Locus Name | Acc# |
| 2-deoxy-D-gluconate 3-dehydrogenase (kduD) homolog | | | | | pir:F69400 | F69400 |

Description

| ORF Name | NTID | AAID | NT Length | AA Length | Score | Probability |
|---|---|---|---|---|---|---|
| 1989001_c2_581 | 2522 | 6694 | 497 | 1494 | 99 | 0.038 |
| Protein name | | | | | Locus Name | Acc# |
| hypothetical protein sll1006 | | | | | pir:S75002 | S75002 |

Description

| ORF Name | NTID | AAID | NT Length | AA Length | Score | Probability |
|---|---|---|---|---|---|---|
| 19960886_f2_159 | 2523 | 6695 | 88 | 267 | 79 | 0.0039 |
| Protein name | | | | | Locus Name | Acc# |
| hypothetical protein C29F9.13 | | | | | pir:T33584 | T33584 |

Description

| ORF Name | NTID | AAID | NT Length | AA Length | Score | Probability |
|---|---|---|---|---|---|---|
| 20165965_c2_616 | 2524 | 6696 | 320 | 963 | 1303 | 7.4e-133 |
| Protein name | | | | | Locus Name | Acc# |
| | | | | | sp:DPPC_ECOLI | P37315 |

Description
DIPEPTIDE TRANSPORT SYSTEM PERMEASE PROTEIN DPPC

| ORF Name | NTID | AAID | NT Length | AA Length | Score | Probability |
|---|---|---|---|---|---|---|
| 20181503_c1_416 | 2525 | 6697 | 225 | 678 | 735 | 1.1e-72 |
| Protein name | | | | | Locus Name | Acc# |
| | | | | | sp:YIIM_ECOLI | P32157 |

Description

HYPOTHETICAL 26.6 KD PROTEIN IN KDGT-CPXA INTERGENIC REGION (O234)

| ORF Name | NTID | AAID | NT Length | AA Length | Score | Probability |
|---|---|---|---|---|---|---|
| 20507830_c1_500 | 2526 | 6698 | 255 | 768 | 388 | 2.5e-35 |
| Protein name | | | | | Locus Name | Acc# |
| | | | | | sp:YHJK_ECOLI | P37649 |

Description

HYPOTHETICAL 73.1 KD PROTEIN IN DCTA-DPPF INTERGENIC REGION (F651)

| ORF Name | NTID | AAID | NT Length | AA Length | Score | Probability |
|---|---|---|---|---|---|---|
| 2057812_f1_88 | 2527 | 6699 | 73 | 222 | | |
| Protein name | | | | | Locus Name | Acc# |

Description

NO-HIT

| ORF Name | NTID | AAID | NT Length | AA Length | Score | Probability |
|---|---|---|---|---|---|---|
| 20601515_c2_536 | 2528 | 6700 | 165 | 498 | 659 | 1.3e-64 |
| Protein name | | | | | Locus Name | Acc# |
| universal stress protein A | | | | | pir:S47715 | S47715:B65 |

Description

| ORF Name | NTID | AAID | NT Length | AA Length | Score | Probability |
|---|---|---|---|---|---|---|
| 20601593_c1_440 | 2529 | 6701 | 727 | 2184 | 2459 | 2.3e-255 |
| Protein name | | | | | Locus Name | Acc# |
| | | | | | sp:FDHF_ECOLI | P07658:P78 |

Description

SUBUNIT) (FDH-H)

| ORF_Name | NTID | AAID | NT Length | AA Length | Score | Probability |
|---|---|---|---|---|---|---|
| 2126327_c1_486 | 2530 | 6702 | 404 | 1215 | 1608 | 3.5e-165 |

Protein name | | | | | Locus_Name | Acc# |
| | | | | | sp:GLTS_ECOLI | P19933 |

Description: SODIUM/GLUTAMATE SYMPORT CARRIER PROTEIN (GLUTAMATE PERMEASE)

| ORF_Name | NTID | AAID | NT Length | AA Length | Score | Probability |
|---|---|---|---|---|---|---|
| 21485675_c1_511 | 2531 | 6703 | 419 | 1260 | 1470 | 1.5e-150 |

Protein name | | | | | Locus_Name | Acc# |
| | | | | | sp:ARGD_ECOLI | P18335 |

Description: ACETYLORNITHINE AMINOTRANSFERASE, (ACOAT)

| ORF_Name | NTID | AAID | NT Length | AA Length | Score | Probability |
|---|---|---|---|---|---|---|
| 21567092_f2_224 | 2532 | 6704 | 247 | 744 | 110 | 5.6e-06 |

Protein name: mucin-like protein | Locus_Name: gp:AF036441 | Acc#: AF036441

Description: Trypanosoma cruzi mucin-like protein (EMUCt-2) mRNA, complete cds.

| ORF_Name | NTID | AAID | NT Length | AA Length | Score | Probability |
|---|---|---|---|---|---|---|
| 21644400_f1_6 | 2533 | 6705 | 317 | 954 | 183 | 2.9e-12 |

Protein name | | | | | Locus_Name | Acc# |
| | | | | | sp:Y510_ARCFU | O29740 |

Description: HYPOTHETICAL PROTEIN AF0510

| ORF_Name | NTID | AAID | NT Length | AA Length | Score | Probability |
|---|---|---|---|---|---|---|
| 21662567_f1_55 | 2534 | 6706 | 258 | 777 | 1031 | 4.9e-104 |

Protein name | | | | | Locus_Name | Acc# |
| | | | | | sp:PHOU_ECOLI | P07656 |

Description: PHOSPHATE TRANSPORT SYSTEM REGULATORY PROTEIN

| ORF Name | NTID | AAID | NT Length | AA Length | Score | Probability |
|---|---|---|---|---|---|---|
| 21672776_c3_657 | 2535 | 6707 | 361 | 1086 | 832 | 6.0e-83 |
| Protein name | | | | | Locus Name | Acc# |
| hypothetical protein HI0143 | | | | | pir:G64143 | G64143 |

Description

| ORF Name | NTID | AAID | NT Length | AA Length | Score | Probability |
|---|---|---|---|---|---|---|
| 21722162_c2_622 | 2536 | 6708 | 211 | 636 | 237 | 6.8e-20 |
| Protein name | | | | | Locus Name | Acc# |
| | | | | | sp:YFIK_ECOLI | P38101 |

Description
HYPOTHETICAL 21.2 KD PROTEIN IN SRMB-UNG INTERGENIC REGION

| ORF Name | NTID | AAID | NT Length | AA Length | Score | Probability |
|---|---|---|---|---|---|---|
| 21753775_f2_179 | 2537 | 6709 | 216 | 651 | 842 | 5.2e-84 |
| Protein name | | | | | Locus Name | Acc# |
| guanylate kinase GmK | | | | | gp:AF140283 | AF140283 |

Description

| ORF Name | NTID | AAID | NT Length | AA Length | Score | Probability |
|---|---|---|---|---|---|---|
| 22006910_f2_238 | 2538 | 6710 | 72 | 219 | | |
| Protein name | | | | | Locus Name | Acc# |

Description
NO-HIT

| ORF Name | NTID | AAID | NT Length | AA Length | Score | Probability |
|---|---|---|---|---|---|---|
| 22133577_c2_561 | 2539 | 6711 | 183 | 552 | 187 | 1.3e-14 |
| Protein name | | | | | Locus Name | Acc# |
| hypothetical protein | | | | | gp:SYCSLLE | D64003:AB0 |

Description
Synechocystis sp. PCC6803 complete genome, 22/27, 2755703-2868766.

| ORF Name | NTID | AAID | NT Length | AA Length | Score | Probability |
|---|---|---|---|---|---|---|
| 22147187_f3_377 | 2540 | 6712 | 246 | 741 | 527 | 1.3e-50 |
| Protein name | | | | | Locus Name | Acc# |
| | | | | | sp:Y647_HAEIN | Q57424:005 |

Description: HYPOTHETICAL PROTEIN HI0647

| ORF Name | NTID | AAID | NT Length | AA Length | Score | Probability |
|---|---|---|---|---|---|---|
| 22164792_c1_429 | 2541 | 6713 | 349 | 1050 | 810 | 1.3e-80 |
| Protein name | | | | | Locus Name | Acc# |
| RhuM | | | | | gp:AF106566 | AF106566 |

Description: Salmonella typhimurium pathogenicity island SPI-3, completesequence.

| ORF Name | NTID | AAID | NT Length | AA Length | Score | Probability |
|---|---|---|---|---|---|---|
| 22266036_f1_10 | 2542 | 6714 | 66 | 201 | | |
| Protein name | | | | | Locus Name | Acc# |

Description: NO-HIT

| ORF Name | NTID | AAID | NT Length | AA Length | Score | Probability |
|---|---|---|---|---|---|---|
| 22271882_c1_502 | 2543 | 6715 | 473 | 1422 | 2050 | 5.1e-212 |
| Protein name | | | | | Locus Name | Acc# |
| | | | | | sp:GSHR_ECOLI | P06715 |

Description: GLUTATHIONE REDUCTASE, (GR) (GRASE)

| ORF Name | NTID | AAID | NT Length | AA Length | Score | Probability |
|---|---|---|---|---|---|---|
| 22300387_c3_718 | 2544 | 6716 | 346 | 1041 | 1397 | 8.1e-143 |
| Protein name | | | | | Locus Name | Acc# |
| | | | | | sp:DPPF_ECOLI | P37313 |

Description: DIPEPTIDE TRANSPORT ATP-BINDING PROTEIN DPPF

| ORF Name | NTID | AAID | NT Length | AA Length | Score | Probability |
|---|---|---|---|---|---|---|
| 22320912_f2_273 | 2545 | 6717 | 287 | 864 | 1061 | 3.2e-107 |
| Protein name | | | | | Locus Name | Acc# |
| | | | | | sp:DMA_SERMA | P45454 |

Description
DNA ADENINE METHYLASE, (DEOXYADENOSYL-METHYLTRANSFERASE)

| ORF Name | NTID | AAID | NT Length | AA Length | Score | Probability |
|---|---|---|---|---|---|---|
| 2243806_f1_106 | 2546 | 6718 | 160 | 483 | 455 | 5.4e-43 |
| Protein name | | | | | Locus Name | Acc# |
| transposase homolog A | | | | | gp:HPU95957 | U95957 |

Description
Helicobacter pylori insertion sequence IS606 transposase homologs A(tnpA) and B (tnpB) genes, complete cds.

| ORF Name | NTID | AAID | NT Length | AA Length | Score | Probability |
|---|---|---|---|---|---|---|
| 2243806_f2_275 | 2547 | 6719 | 160 | 483 | 469 | 1.8e-44 |
| Protein name | | | | | Locus Name | Acc# |
| transposase homolog A | | | | | gp:HPU95957 | U95957 |

Description
Helicobacter pylori insertion sequence IS606 transposase homologs A(tnpA) and B (tnpB) genes, complete cds.

| ORF Name | NTID | AAID | NT Length | AA Length | Score | Probability |
|---|---|---|---|---|---|---|
| 22464692_f1_119 | 2548 | 6720 | 238 | 717 | 928 | 4.0e-93 |
| Protein name | | | | | Locus Name | Acc# |
| | | | | | sp:YHHW_ECOLI | P46852 |

Description
HYPOTHETICAL 26.3 KD PROTEIN IN GNTR-GGT INTERGENIC REGION (F231)

| ORF Name | NTID | AAID | NT Length | AA Length | Score | Probability |
|---|---|---|---|---|---|---|
| 22657712_f1_51 | 2549 | 6721 | 249 | 750 | 1101 | 1.9e-111 |
| Protein name | | | | | Locus Name | Acc# |
| | | | | | sp:OMPR_ECOLI | P03025 |

Description
TRANSCRIPTIONAL REGULATORY PROTEIN OMPR

600

| ORF_Name | NTID | AAID | NT Length | AA Length | Score | Probability |
|---|---|---|---|---|---|---|
| 22681513_c1_499 | 2550 | 6722 | 340 | 1023 | 1539 | 7.2e-158 |
| Protein name | | | | | Locus Name | Acc# |
| | | | | | sp:DPPB_ECOLI | P37316 |

Description
DIPEPTIDE TRANSPORT SYSTEM PERMEASE PROTEIN DPPB

| ORF_Name | NTID | AAID | NT Length | AA Length | Score | Probability |
|---|---|---|---|---|---|---|
| 22843763_f1_16 | 2551 | 6723 | 235 | 708 | 1057 | 8.6e-107 |
| Protein name | | | | | Locus Name | Acc# |
| | | | | | sp:CRP_ECOLI | P03020 |

Description
PROTEIN)

| ORF_Name | NTID | AAID | NT Length | AA Length | Score | Probability |
|---|---|---|---|---|---|---|
| 22923788_f3_290 | 2552 | 6724 | 92 | 279 | 150 | 1.1e-10 |
| Protein name | | | | | Locus Name | Acc# |
| histidine-rich protein | | | | | pir:A54523 | A54523 |

Description

| ORF_Name | NTID | AAID | NT Length | AA Length | Score | Probability |
|---|---|---|---|---|---|---|
| 23438782_c2_587 | 2553 | 6725 | 369 | 1110 | | |
| Protein name | | | | | Locus Name | Acc# |

Description
NO-HIT

| ORF_Name | NTID | AAID | NT Length | AA Length | Score | Probability |
|---|---|---|---|---|---|---|
| 23439126_c3_658 | 2554 | 6726 | 250 | 753 | | |
| Protein name | | | | | Locus Name | Acc# |

Description
NO-HIT

| ORF Name | NTID | AAID | NT Length | AA Length | Score | Probability |
|---|---|---|---|---|---|---|
| 23442313_f2_229 | 2555 | 6727 | 255 | 768 | 734 | 1.5e-72 |
| Protein name | | | | | Locus Name | Acc# |
| ferrichrome ABC transporter (ATP-binding p) homolog yclP | | | | | pir:D69763 | D69763 |

Description

| ORF Name | NTID | AAID | NT Length | AA Length | Score | Probability |
|---|---|---|---|---|---|---|
| 23475812_f1_98 | 2556 | 6728 | 423 | 1272 | 612 | 1.2e-59 |
| Protein name | | | | | Locus Name | Acc# |
| | | | | | sp:YEGT_ECOLI | P76417:008 |

Description

PUTATIVE NUCLEOSIDE TRANSPORTER YEGT

| ORF Name | NTID | AAID | NT Length | AA Length | Score | Probability |
|---|---|---|---|---|---|---|
| 23487802_f1_133 | 2557 | 6729 | 240 | 723 | 965 | 4.8e-97 |
| Protein name | | | | | Locus Name | Acc# |
| | | | | | sp:RPE_ECOLI | P32661 |

Description

EPIMERASE) (PPE) (R5P3E)

| ORF Name | NTID | AAID | NT Length | AA Length | Score | Probability |
|---|---|---|---|---|---|---|
| 2350130_f1_124 | 2558 | 6730 | 193 | 582 | 686 | 1.8e-67 |
| Protein name | | | | | Locus Name | Acc# |
| | | | | | sp:YRFE_ECOLI | P45799 |

Description

HYPOTHETICAL 21.2 KD PROTEIN IN MRCA-PCKA INTERGENIC REGION (F186)

| ORF Name | NTID | AAID | NT Length | AA Length | Score | Probability |
|---|---|---|---|---|---|---|
| 23600068_c1_521 | 2559 | 6731 | 239 | 720 | 967 | 3.0e-97 |
| Protein name | | | | | Locus Name | Acc# |
| | | | | | sp:YHEO_ECOLI | P45533 |

Description

HYPOTHETICAL 26.8 KD PROTEIN IN RPSL-FKPA INTERGENIC REGION

| ORF_Name | NTID | AAID | NT Length | AA Length | Score | Probability |
|---|---|---|---|---|---|---|
| 23632843_c1_512 | 2560 | 6732 | 139 | 420 | 543 | 2.5e-52 |
| Protein name | | | | | Locus Name | Acc# |
| | | | | | gp:ECCRPGENE | X89443 |

Description: E.chrysanthemi DNA for crp gene.

| ORF_Name | NTID | AAID | NT Length | AA Length | Score | Probability |
|---|---|---|---|---|---|---|
| 23632962_c2_568 | 2561 | 6733 | 529 | 1590 | 1177 | 1.7e-119 |
| Protein name | | | | | Locus Name | Acc# |
| | | | | | sp:NIKA_ECOLI | P33590 |

Description: NICKEL-BINDING PERIPLASMIC PROTEIN PRECURSOR

| ORF_Name | NTID | AAID | NT Length | AA Length | Score | Probability |
|---|---|---|---|---|---|---|
| 23633467_f1_96 | 2562 | 6734 | 322 | 969 | 186 | 1.6e-14 |
| Protein name | | | | | Locus Name | Acc# |
| | | | | | sp:DMSC_HAEIN | P45002:Q48 |

Description: SUBUNIT)

| ORF_Name | NTID | AAID | NT Length | AA Length | Score | Probability |
|---|---|---|---|---|---|---|
| 23634686_c1_497 | 2563 | 6735 | 194 | 585 | 639 | 1.7e-62 |
| Protein name | | | | | Locus Name | Acc# |
| | | | | | sp:3MG1_ECOLI | P05100 |

Description: I)

| ORF_Name | NTID | AAID | NT Length | AA Length | Score | Probability |
|---|---|---|---|---|---|---|
| 23646037_c1_454 | 2564 | 6736 | 259 | 780 | 458 | 2.6e-43 |
| Protein name | | | | | Locus Name | Acc# |
| dipeptide transport system ATP-binding protein | | | | | pir:A71952 | A71952 |

Description

| ORF Name | NTID | AAID | NT Length | AA Length | Score | Probability |
|---|---|---|---|---|---|---|
| 23650338_c1_413 | 2565 | 6737 | 231 | 696 | 613 | 9.7e-60 |

Protein name

| | | | | | Locus Name | Acc# |
|---|---|---|---|---|---|---|
| | | | | | sp:YKGG_ECOLI | P77433 |

Description

HYPOTHETICAL 31.1 KD PROTEIN IN EAEH-BETA INTERGENIC REGION

| ORF Name | NTID | AAID | NT Length | AA Length | Score | Probability |
|---|---|---|---|---|---|---|
| 23697152_c2_541 | 2566 | 6738 | 832 | 2499 | 1632 | 1.0e-167 |

Protein name

| | | | | | Locus Name | Acc# |
|---|---|---|---|---|---|---|
| | | | | | sp:YAGX_ECOLI | P77802 |

Description

HYPOTHETICAL 91.2 KD PROTEIN IN INTF-EAEH INTERGENIC REGION PRECURSOR

| ORF Name | NTID | AAID | NT Length | AA Length | Score | Probability |
|---|---|---|---|---|---|---|
| 23697176_c2_623 | 2567 | 6739 | 515 | 1548 | 1210 | 5.3e-123 |

Protein name

| | | | | | Locus Name | Acc# |
|---|---|---|---|---|---|---|
| | | | | | sp:AER_ECOLI | P50466 |

Description

AEROTAXIS RECEPTOR

| ORF Name | NTID | AAID | NT Length | AA Length | Score | Probability |
|---|---|---|---|---|---|---|
| 23711013_f1_132 | 2568 | 6740 | 376 | 1131 | 1455 | 5.8e-149 |

Protein name

| | | | | | Locus Name | Acc# |
|---|---|---|---|---|---|---|
| | | | | | sp:AROB_ECOLI | P07639 |

Description

3-DEHYDROQUINATE SYNTHASE,

| ORF Name | NTID | AAID | NT Length | AA Length | Score | Probability |
|---|---|---|---|---|---|---|
| 23714465_f2_180 | 2569 | 6741 | 97 | 294 | 407 | 6.5e-38 |

Protein name

| | | | | | Locus Name | Acc# |
|---|---|---|---|---|---|---|
| | | | | | sp:RPOZ_ECOLI | P08374 |

Description

OMEGA CHAIN) (RNA POLYMERASE OMEGA SUBUNIT)

| ORF Name | NTID | AAID | NT Length | AA Length | Score | Probability |
|---|---|---|---|---|---|---|
| 23850336_c3_689 | 2570 | 6742 | 216 | 651 | 258 | 4.0e-22 |
| Protein name | | | | | Locus Name | Acc# |
| | | | | | sp:YP20_BACLI | P05332 |

Description: HYPOTHETICAL P20 PROTEIN

| ORF Name | NTID | AAID | NT Length | AA Length | Score | Probability |
|---|---|---|---|---|---|---|
| 23879050_f1_72 | 2571 | 6743 | 212 | 639 | 884 | 1.9e-88 |
| Protein name | | | | | Locus Name | Acc# |
| | | | | | sp:YHGI_ECOLI | P46847 |

Description: HYPOTHETICAL 21.0 KD PROTEIN IN BIOH-GNTT INTERGENIC REGION (O191)

| ORF Name | NTID | AAID | NT Length | AA Length | Score | Probability |
|---|---|---|---|---|---|---|
| 23994167_c3_703 | 2572 | 6744 | 621 | 1866 | 2679 | 1.1e-278 |
| Protein name | | | | | Locus Name | Acc# |
| | | | | | sp:TYPA_ECOLI | P32132 |

Description: GTP-BINDING PROTEIN TYPA/BIPA (TYROSINE PHOSPHORYLATED PROTEIN A)

| ORF Name | NTID | AAID | NT Length | AA Length | Score | Probability |
|---|---|---|---|---|---|---|
| 24017192_c3_654 | 2573 | 6745 | 463 | 1392 | 556 | 1.1e-53 |
| Protein name | | | | | Locus Name | Acc# |
| | | | | | sp:PUR8_METJA | Q58339 |

Description: ADENYLOSUCCINATE LYASE, (ADENYLOSUCCINASE) (ASL)

| ORF Name | NTID | AAID | NT Length | AA Length | Score | Probability |
|---|---|---|---|---|---|---|
| 24068931_c3_690 | 2574 | 6746 | 415 | 1248 | 189 | 8.6e-11 |
| Protein name | | | | | Locus Name | Acc# |
| probable polyketide synthase type I | | | | | pir:T17420 | T17420 |

Description

| ORF_Name | NTID | AAID | NT Length | AA Length | Score | Probability |
|---|---|---|---|---|---|---|
| 24095067_f2_161 | 2575 | 6747 | 187 | 564 | 569 | 4.4e-55 |
| Protein name | | | | | Locus Name | Acc# |
| | | | | | sp:MOBB_ECOLI | P32125:P76 |

Description
MOLYBDOPTERIN-GUANINE DINUCLEOTIDE BIOSYNTHESIS PROTEIN B

| ORF_Name | NTID | AAID | NT Length | AA Length | Score | Probability |
|---|---|---|---|---|---|---|
| 24235182_f1_135 | 2576 | 6748 | 120 | 363 | 324 | 4.1e-29 |
| Protein name | | | | | Locus Name | Acc# |
| | | | | | sp:YJCH_ECOLI | P32706 |

Description
HYPOTHETICAL 11.7 KD PROTEIN IN SOXR-ACS INTERGENIC REGION (F104)

| ORF_Name | NTID | AAID | NT Length | AA Length | Score | Probability |
|---|---|---|---|---|---|---|
| 24276415_c1_492 | 2577 | 6749 | 448 | 1347 | 1237 | 7.3e-126 |
| Protein name | | | | | Locus Name | Acc# |
| | | | | | gp:ECOUW82 | L10328 |

Description
E. coli; the region from 81.5 to 84.5 minutes.

| ORF_Name | NTID | AAID | NT Length | AA Length | Score | Probability |
|---|---|---|---|---|---|---|
| 24319415_f2_231 | 2578 | 6750 | 225 | 678 | 568 | 5.7e-55 |
| Protein name | | | | | Locus Name | Acc# |
| dimethylsulfoxide reductase, chain B1, anaerobic | | | | | pir:G64914 | G64914 |

Description

| ORF_Name | NTID | AAID | NT Length | AA Length | Score | Probability |
|---|---|---|---|---|---|---|
| 24333468_c2_595 | 2579 | 6751 | 222 | 669 | | |
| Protein name | | | | | Locus Name | Acc# |

Description
NO-HIT

606

| ORF Name | NTID | AAID | NT Length | AA Length | Score | Probability |
|---|---|---|---|---|---|---|
| 24400306_f1_48 | 2580 | 6752 | 474 | 1425 | 2239 | 4.8e-232 |
| Protein name | | | | | Locus Name | Acc# |
| | | | | | sp:NTRC_PROVU | P28787 |

Description
NITROGEN REGULATION PROTEIN NR(I)

| ORF Name | NTID | AAID | NT Length | AA Length | Score | Probability |
|---|---|---|---|---|---|---|
| 24406635_f3_363 | 2581 | 6753 | 65 | 198 | | |
| Protein name | | | | | Locus Name | Acc# |

Description
NO-HIT

| ORF Name | NTID | AAID | NT Length | AA Length | Score | Probability |
|---|---|---|---|---|---|---|
| 24411578_f1_47 | 2582 | 6754 | 493 | 1482 | 2402 | 2.6e-249 |
| Protein name | | | | | Locus Name | Acc# |
| | | | | | sp:GLNA_PROVU | P28786 |

Description
GLUTAMINE SYNTHETASE, (GLUTAMATE--AMMONIA LIGASE)

| ORF Name | NTID | AAID | NT Length | AA Length | Score | Probability |
|---|---|---|---|---|---|---|
| 24412551_f3_300 | 2583 | 6755 | 195 | 588 | 447 | 3.8e-42 |
| Protein name | | | | | Locus Name | Acc# |
| | | | | | sp:MOBA_ECOLI | P32173 |

Description
FA)

| ORF Name | NTID | AAID | NT Length | AA Length | Score | Probability |
|---|---|---|---|---|---|---|
| 24417302_c2_626 | 2584 | 6756 | 81 | 246 | 232 | 2.3e-19 |
| Protein name | | | | | Locus Name | Acc# |
| | | | | | sp:YHEV_ECOLI | P56622 |

Description
HYPOTHETICAL 7.6 KD PROTEIN IN SLYD-KEFB INTERGENIC REGION

| ORF Name | NTID | AAID | NT Length | AA Length | Score | Probability |
|---|---|---|---|---|---|---|
| 24430302_f2_263 | 2585 | 6757 | 136 | 411 | 372 | 3.3e-34 |
| Protein name | | | | | Locus Name | Acc# |
| | | | | | sp:USPB_ECOLI | P37632 |

Description: UNIVERSAL STRESS PROTEIN B

| ORF Name | NTID | AAID | NT Length | AA Length | Score | Probability |
|---|---|---|---|---|---|---|
| 24430305_f2_175 | 2586 | 6758 | 334 | 1005 | 1552 | 3.0e-159 |
| Protein name | | | | | Locus Name | Acc# |
| | | | | | sp:SYGA_ECOLI | P00960 |

Description: ALPHA CHAIN) (GLYRS)

| ORF Name | NTID | AAID | NT Length | AA Length | Score | Probability |
|---|---|---|---|---|---|---|
| 24430436_f2_143 | 2587 | 6759 | 77 | 234 | 183 | 3.6e-14 |
| Protein name | | | | | Locus Name | Acc# |
| | | | | | sp:SLYX_ECOLI | P30857 |

Description: SLYX PROTEIN

| ORF Name | NTID | AAID | NT Length | AA Length | Score | Probability |
|---|---|---|---|---|---|---|
| 24431550_c1_469 | 2588 | 6760 | 436 | 1311 | 148 | 2.7e-07 |
| Protein name | | | | | Locus Name | Acc# |
| | | | | | sp:YCFW_ECOLI | P75958 |

Description: HYPOTHETICAL 45.3 KD PROTEIN IN MFD-COBB INTERGENIC REGION

| ORF Name | NTID | AAID | NT Length | AA Length | Score | Probability |
|---|---|---|---|---|---|---|
| 24495912_f3_324 | 2589 | 6761 | 567 | 1704 | 767 | 4.6e-76 |
| Protein name | | | | | Locus Name | Acc# |
| | | | | | sp:YICH_ECOLI | P31433:P76 |

Description: HYPOTHETICAL 62.3 KD PROTEIN IN GLTS-SELC INTERGENIC REGION

| ORF Name | NTID | AAID | NT Length | AA Length | Score | Probability |
|---|---|---|---|---|---|---|
| 2459838_c1_464 | 2590 | 6762 | 196 | 591 | 153 | 9.6e-14 |
| Protein name | | | | | Locus Name | Acc# |
| (3R)-hydroxymyristoyl-acyl carrier protein dehydratase | | | | | pir:D75439 | D75439 |

Description

| ORF Name | NTID | AAID | NT Length | AA Length | Score | Probability |
|---|---|---|---|---|---|---|
| 24619002_f1_85 | 2591 | 6763 | 143 | 432 | | |
| Protein name | | | | | Locus Name | Acc# |

Description

NO-HIT

| ORF Name | NTID | AAID | NT Length | AA Length | Score | Probability |
|---|---|---|---|---|---|---|
| 24640887_f2_271 | 2592 | 6764 | 373 | 1122 | 480 | 1.0e-60 |
| Protein name | | | | | Locus Name | Acc# |
| | | | | | sp:HOFQ_ECOLI | P34749 |

Description

PROTEIN TRANSPORT PROTEIN HOFQ PRECURSOR

| ORF Name | NTID | AAID | NT Length | AA Length | Score | Probability |
|---|---|---|---|---|---|---|
| 24648535_c2_619 | 2593 | 6765 | 209 | 630 | 706 | 1.4e-69 |
| Protein name | | | | | Locus Name | Acc# |
| DsbA | | | | | gp:AF155130 | AF155130 |

Description

Yersinia pestis DsbA (dsbA) gene, complete cds.

| ORF Name | NTID | AAID | NT Length | AA Length | Score | Probability |
|---|---|---|---|---|---|---|
| 24651567_c2_575 | 2594 | 6766 | 198 | 597 | | |
| Protein name | | | | | Locus Name | Acc# |

Description

NO-HIT

| ORF Name | NTID | AAID | NT Length | AA Length | Score | Probability |
|---|---|---|---|---|---|---|
| 24740652_f3_351 | 2595 | 6767 | 803 | 2412 | 2866 | 1.7e-298 |
| Protein name | | | | | Locus Name | Acc# |
| | | | | | sp:FEOB_ECOLI | P33650 |

Description: FERROUS IRON TRANSPORT PROTEIN B

| ORF Name | NTID | AAID | NT Length | AA Length | Score | Probability |
|---|---|---|---|---|---|---|
| 24742138_f1_68 | 2596 | 6768 | 465 | 1398 | 1757 | 5.7e-181 |
| Protein name | | | | | Locus Name | Acc# |
| | | | | | sp:YIEG_ECOLI | P31466:P76 |

Description: HYPOTHETICAL 46.9 KD PROTEIN IN TNAB-BGLB INTERGENIC REGION

| ORF Name | NTID | AAID | NT Length | AA Length | Score | Probability |
|---|---|---|---|---|---|---|
| 24854561_f1_134 | 2597 | 6769 | 349 | 1050 | 1455 | 5.8e-149 |
| Protein name | | | | | Locus Name | Acc# |
| tryptophan--tRNA ligase,:tryptophanyl-tRNA synthetase | | | | | pir:YWEC | C65133:A01 |

Description:

| ORF Name | NTID | AAID | NT Length | AA Length | Score | Probability |
|---|---|---|---|---|---|---|
| 25390811_f2_278 | 2598 | 6770 | 666 | 2001 | 2809 | 1.9e-292 |
| Protein name | | | | | Locus Name | Acc# |
| | | | | | sp:ACSA_ECOLI | P27550 |

Description: ACTIVATING ENZYME)

| ORF Name | NTID | AAID | NT Length | AA Length | Score | Probability |
|---|---|---|---|---|---|---|
| 25423952_c3_716 | 2599 | 6771 | 560 | 1683 | 289 | 1.7e-22 |
| Protein name | | | | | Locus Name | Acc# |
| HecB | | | | | gp:ERWHRPN | L39897 |

Description: Erwinia chrysanthemi phospholipase C (plcA) gene, partial cds; HrpF(hrpF), HrpG (hrpG), HrcC (hrcC), HrpT (hrpT), HrpV (hrpV), HrpNharpin (hrpN), ORF1, and HecB (hecB) genes, complete cds; and HecA(hecA) gene, partial cds.

| ORF Name | NTID | AAID | NT Length | AA Length | Score | Probability |
|---|---|---|---|---|---|---|
| 25491028_f3_314 | 2600 | 6772 | 88 | 267 | | |
| Protein name | | | | | Locus Name | Acc# |

Description
NO-HIT

| ORF Name | NTID | AAID | NT Length | AA Length | Score | Probability |
|---|---|---|---|---|---|---|
| 25626_f2_272 | 2601 | 6773 | 325 | 978 | 395 | 1.2e-36 |
| Protein name | | | | | Locus Name | Acc# |
| | | | | | sp:DAMX_SERMA | P45459 |

Description
DAMX PROTEIN (FRAGMENT)

| ORF Name | NTID | AAID | NT Length | AA Length | Score | Probability |
|---|---|---|---|---|---|---|
| 25781580_f2_157 | 2602 | 6774 | 233 | 702 | 783 | 9.4e-78 |
| Protein name | | | | | Locus Name | Acc# |
| | | | | | sp:YIHA_ECOLI | P24253:P76 |

Description
HYPOTHETICAL GTP-BINDING PROTEIN IN POLA-HEMN INTERGENIC REGION

| ORF Name | NTID | AAID | NT Length | AA Length | Score | Probability |
|---|---|---|---|---|---|---|
| 25970437_c3_647 | 2603 | 6775 | 542 | 1629 | 902 | 2.3e-90 |
| Protein name | | | | | Locus Name | Acc# |
| | | | | | sp:YAGW_ECOLI | P77694 |

Description
HYPOTHETICAL 60.0 KD PROTEIN IN INTF-EAEH INTERGENIC REGION

| ORF Name | NTID | AAID | NT Length | AA Length | Score | Probability |
|---|---|---|---|---|---|---|
| 25996062_f2_250 | 2604 | 6776 | 82 | 249 | | |
| Protein name | | | | | Locus Name | Acc# |

Description
NO-HIT

| ORF_Name | NTID | AAID | NT Length | AA Length | Score | Probability |
|---|---|---|---|---|---|---|
| 26174137_c2_601 | 2605 | 6777 | 108 | 327 | 87 | 0.00053 |
| Protein name | | | | | Locus Name | Acc# |
| | | | | | sp:Y659_HAEIN | P44030 |

Description
HYPOTHETICAL PROTEIN HI0659

| ORF_Name | NTID | AAID | NT Length | AA Length | Score | Probability |
|---|---|---|---|---|---|---|
| 26175163_f2_252 | 2606 | 6778 | 93 | 282 | | |
| Protein name | | | | | Locus Name | Acc# |

Description
NO-HIT

| ORF_Name | NTID | AAID | NT Length | AA Length | Score | Probability |
|---|---|---|---|---|---|---|
| 26209841_c1_411 | 2607 | 6779 | 68 | 207 | | |
| Protein name | | | | | Locus Name | Acc# |

Description
NO-HIT

| ORF_Name | NTID | AAID | NT Length | AA Length | Score | Probability |
|---|---|---|---|---|---|---|
| 26212625_f3_349 | 2608 | 6780 | 182 | 549 | 356 | 1.7e-32 |
| Protein name | | | | | Locus Name | Acc# |
| | | | | | sp:YIHI_SALTY | P37130 |

Description
HYPOTHETICAL 19.2 KD PROTEIN IN POLA-HEMN INTERGENIC REGION

| ORF_Name | NTID | AAID | NT Length | AA Length | Score | Probability |
|---|---|---|---|---|---|---|
| 26227327_c3_682 | 2609 | 6781 | 122 | 369 | 296 | 3.8e-26 |
| Protein name | | | | | Locus Name | Acc# |
| | | | | | sp:YEAO_ECOLI | P76243 |

Description
HYPOTHETICAL 14.2 KD PROTEIN IN GAPA-RND INTERGENIC REGION

612

| ORF Name | NTID | AAID | NT Length | AA Length | Score | Probability |
|---|---|---|---|---|---|---|
| 26441053_f3_393 | 2610 | 6782 | 412 | 1239 | 1514 | 3.2e-155 |
| Protein name | | | | | Locus Name | Acc# |
| | | | | | sp:YHIN_ECOLI | P37631:P76 |

Description
HYPOTHETICAL 43.8 KD PROTEIN IN RHSB-PIT INTERGENIC REGION

| ORF Name | NTID | AAID | NT Length | AA Length | Score | Probability |
|---|---|---|---|---|---|---|
| 26464518_c2_573 | 2611 | 6783 | 159 | 480 | | |
| Protein name | | | | | Locus Name | Acc# |

Description
NO-HIT

| ORF Name | NTID | AAID | NT Length | AA Length | Score | Probability |
|---|---|---|---|---|---|---|
| 26585886_c3_734 | 2612 | 6784 | 255 | 768 | 753 | 1.4e-74 |
| Protein name | | | | | Locus Name | Acc# |
| | | | | | sp:FKBA_ECOLI | P45523:P39 |

Description
(EC 5.2.1.8) (PPIASE) (ROTAMASE)

| ORF Name | NTID | AAID | NT Length | AA Length | Score | Probability |
|---|---|---|---|---|---|---|
| 26587763_c2_549 | 2613 | 6785 | 247 | 744 | 194 | 2.4e-15 |
| Protein name | | | | | Locus Name | Acc# |
| | | | | | sp:YNGB_CLOPE | P26833 |

Description
HYPOTHETICAL 31.2 KD PROTEIN IN NAGH 5'REGION (ORFB)

| ORF Name | NTID | AAID | NT Length | AA Length | Score | Probability |
|---|---|---|---|---|---|---|
| 2907965_f3_336 | 2614 | 6786 | 65 | 198 | 71 | 0.026 |
| Protein name | | | | | Locus Name | Acc# |
| reverse transcriptase | | | | | gp:AF112697 | AF112697 |

Description
Caenopedina diomedeae haplotype c(1)16 reverse transcriptase gene, partial cds.

| ORF Name | NTID | AAID | NT Length | AA Length | Score | Probability |
|---|---|---|---|---|---|---|
| 29296943_c1_505 | 2615 | 6787 | 93 | 282 | 358 | 1.0e-32 |
| Protein name | | | | | Locus Name | Acc# |
| YihD | | | | | gp:AF146615 | AF146615 |

Description

Erwinia carotovora subsp. carotovora MobA (mobA) gene, partial cds;and YihD (yihD), YihE (yihE), and DsbA precursor (dsbA) genes,complete cds.

| ORF Name | NTID | AAID | NT Length | AA Length | Score | Probability |
|---|---|---|---|---|---|---|
| 2930312_c2_609 | 2616 | 6788 | 94 | 285 | | |
| Protein name | | | | | Locus Name | Acc# |

Description

NO-HIT

| ORF Name | NTID | AAID | NT Length | AA Length | Score | Probability |
|---|---|---|---|---|---|---|
| 29501461_c2_566 | 2617 | 6789 | 460 | 1383 | 2013 | 4.3e-208 |
| Protein name | | | | | Locus Name | Acc# |
| | | | | | sp:CELF_ECOLI | P17411:P78 |

Description

6-PHOSPHO-BETA-GLUCOSIDASE,

| ORF Name | NTID | AAID | NT Length | AA Length | Score | Probability |
|---|---|---|---|---|---|---|
| 3009556_f2_230 | 2618 | 6790 | 504 | 1515 | 781 | 1.5e-77 |
| Protein name | | | | | Locus Name | Acc# |
| | | | | | sp:SMVA_SALTY | P37594 |

Description

METHYL VIOLOGEN RESISTANCE PROTEIN SMVA

| ORF Name | NTID | AAID | NT Length | AA Length | Score | Probability |
|---|---|---|---|---|---|---|
| 30181515_f1_116 | 2619 | 6791 | 694 | 2085 | 2885 | 1.7e-300 |
| Protein name | | | | | Locus Name | Acc# |
| | | | | | sp:OPDA_SALTY | P27237 |

Description

OLIGOPEPTIDASE A,

| ORF Name | NTID | AAID | NT Length | AA Length | Score | Probability |
|---|---|---|---|---|---|---|
| 30571943_f1_107 | 2620 | 6792 | 345 | 1038 | | |
| Protein name | | | | | Locus Name | Acc# |

Description
NO-HIT

| ORF Name | NTID | AAID | NT Length | AA Length | Score | Probability |
|---|---|---|---|---|---|---|
| 31424182_c1_520 | 2621 | 6793 | 249 | 750 | 818 | 1.8e-81 |
| Protein name | | | | | Locus Name | Acc# |
| | | | | | sp:SLYD_ECOLI | P30856 |

Description
(PPIASE) (ROTAMASE) (HISTIDINE RICH PROTEIN) (WHP)

| ORF Name | NTID | AAID | NT Length | AA Length | Score | Probability |
|---|---|---|---|---|---|---|
| 3157758_c1_510 | 2622 | 6794 | 193 | 582 | 772 | 1.4e-76 |
| Protein name | | | | | Locus Name | Acc# |
| | | | | | sp:PABA_SERMA | P06195 |

Description
(EC 4.1.3.-) (ADC SYNTHASE)

| ORF Name | NTID | AAID | NT Length | AA Length | Score | Probability |
|---|---|---|---|---|---|---|
| 31644136_c3_720 | 2623 | 6795 | 527 | 1584 | 1123 | 8.7e-114 |
| Protein name | | | | | Locus Name | Acc# |
| | | | | | sp:YHJJ_ECOLI | P37648 |

Description
PROTEIN YHJJ PRECURSOR

| ORF Name | NTID | AAID | NT Length | AA Length | Score | Probability |
|---|---|---|---|---|---|---|
| 32134683_c1_517 | 2624 | 6796 | 97 | 294 | 106 | 5.1e-06 |
| Protein name | | | | | Locus Name | Acc# |
| hypothetical protein PH0492 | | | | | pir:G71161 | G71161 |

Description

| ORF Name | NTID | AAID | NT Length | AA Length | Score | Probability |
|---|---|---|---|---|---|---|
| 32140931_f1_1 | 2625 | 6797 | 76 | 231 | | |
| Protein name | | | | | Locus Name | Acc# |

Description
NO-HIT

| ORF Name | NTID | AAID | NT Length | AA Length | Score | Probability |
|---|---|---|---|---|---|---|
| 32595053_f3_329 | 2626 | 6798 | 61 | 186 | | |
| Protein name | | | | | Locus Name | Acc# |

Description
NO-HIT

| ORF Name | NTID | AAID | NT Length | AA Length | Score | Probability |
|---|---|---|---|---|---|---|
| 32629715_f3_340 | 2627 | 6799 | 452 | 1359 | 1266 | 6.1e-129 |
| Protein name | | | | | Locus Name | Acc# |
| | | | | | sp:ENVZ_ECOLI | P02933 |

Description
OSMOLARITY SENSOR PROTEIN ENVZ,

| ORF Name | NTID | AAID | NT Length | AA Length | Score | Probability |
|---|---|---|---|---|---|---|
| 32805_c1_417 | 2628 | 6800 | 442 | 1329 | 1776 | 5.6e-183 |
| Protein name | | | | | Locus Name | Acc# |
| hypothetical protein b1432 | | | | | pir:C64895 | C64895 |

Description

| ORF Name | NTID | AAID | NT Length | AA Length | Score | Probability |
|---|---|---|---|---|---|---|
| 32805_c2_545 | 2629 | 6801 | 442 | 1329 | 1750 | 3.2e-180 |
| Protein name | | | | | Locus Name | Acc# |
| hypothetical protein b1432 | | | | | pir:C64895 | C64895 |

Description

| ORF Name | NTID | AAID | NT Length | AA Length | Score | Probability |
|---|---|---|---|---|---|---|
| 33242152_c2_540 | 2630 | 6802 | 214 | 645 | 462 | 9.7e-44 |
| Protein name | | | | | Locus Name | Acc# |
| | | | | | sp:YAGZ_ECOLI | P77264 |

Description: HYPOTHETICAL 20.1 KD PROTEIN IN INTF-EAEH INTERGENIC REGION PRECURSOR

| ORF Name | NTID | AAID | NT Length | AA Length | Score | Probability |
|---|---|---|---|---|---|---|
| 33359415_c1_463 | 2631 | 6803 | 258 | 777 | 415 | 9.3e-39 |
| Protein name | | | | | Locus Name | Acc# |
| | | | | | sp:FABG_BACSU | P51831:O31 |

Description: (ACYL CARRIER PROTEIN REDUCTASE)

| ORF Name | NTID | AAID | NT Length | AA Length | Score | Probability |
|---|---|---|---|---|---|---|
| 3337557_c1_483 | 2632 | 6804 | 143 | 432 | | |
| Protein name | | | | | Locus Name | Acc# |

Description: NO-HIT

| ORF Name | NTID | AAID | NT Length | AA Length | Score | Probability |
|---|---|---|---|---|---|---|
| 33385461_f2_188 | 2633 | 6805 | 104 | 315 | 91 | 0.00020 |
| Protein name | | | | | Locus Name | Acc# |
| | | | | | gp:AB024946 | AB024946 |

Description: Escherichia coli plasmid pB171 DNA, complete sequence.

| ORF Name | NTID | AAID | NT Length | AA Length | Score | Probability |
|---|---|---|---|---|---|---|
| 33390888_c1_465 | 2634 | 6806 | 110 | 333 | 138 | 2.1e-09 |
| Protein name | | | | | Locus Name | Acc# |
| acyl carrier protein homolog AcpC | | | | | gp:AF093787 | AF093787 |

Description: Streptococcus agalactiae cyl gene cluster, complete sequence.

| ORF Name | NTID | AAID | NT Length | AA Length | Score | Probability |
|---|---|---|---|---|---|---|
| 33397756_f3_375 | 2635 | 6807 | 295 | 888 | 221 | 3.3e-18 |
| Protein name | | | | | Locus Name | Acc# |
| | | | | | sp:PHNP_ECOLI | P16692 |

Description

PHNP PROTEIN

| ORF Name | NTID | AAID | NT Length | AA Length | Score | Probability |
|---|---|---|---|---|---|---|
| 33406876_c3_674 | 2636 | 6808 | 307 | 924 | 636 | 3.5e-62 |
| Protein name | | | | | Locus Name | Acc# |
| oligopeptide transporter putative membrane | | | | | gp:AF076683 | AF076683 |

Description

Staphylococcus aureus oligopeptide transporter putative substratebinding domain (opp-1A), oligopeptide transporter putative membranepermease domain (opp-1B), oligopeptide transporter putativemembrane permease domain (opp-1C), oligopeptide transporterputative ATPase domain (opp-1D), and oligopeptide transporterputative ATPase domain (opp-1F) genes, complete cds; and

| ORF Name | NTID | AAID | NT Length | AA Length | Score | Probability |
|---|---|---|---|---|---|---|
| 33495887_f1_41 | 2637 | 6809 | 714 | 2145 | 3091 | 0.0 |
| Protein name | | | | | Locus Name | Acc# |
| | | | | | sp:SPOT_ECOLI | P17580 |

Description ((PPGPP)ASE) (PENTA-PHOSPHATE GUANOSINE-3'-PYROPHOSPHOHYDROLASE)

| ORF Name | NTID | AAID | NT Length | AA Length | Score | Probability |
|---|---|---|---|---|---|---|
| 33648425_f1_115 | 2638 | 6810 | 85 | 258 | | |
| Protein name | | | | | Locus Name | Acc# |

Description

NO-HIT

| ORF Name | NTID | AAID | NT Length | AA Length | Score | Probability |
|---|---|---|---|---|---|---|
| 33805437_c3_672 | 2639 | 6811 | 257 | 774 | 845 | 2.5e-84 |
| Protein name | | | | | Locus Name | Acc# |
| | | | | | sp:YDJC_ECOLI | P37794:P77 |

Description: HYPOTHETICAL 27.8 KD PROTEIN IN CELF-KATE INTERGENIC REGION

| ORF Name | NTID | AAID | NT Length | AA Length | Score | Probability |
|---|---|---|---|---|---|---|
| 33864035_c2_567 | 2640 | 6812 | 265 | 798 | 230 | 3.7e-19 |
| Protein name | | | | | Locus Name | Acc# |
| hypothetical protein 3 | | | | | pir:S62195 | S62195 |

Description

| ORF Name | NTID | AAID | NT Length | AA Length | Score | Probability |
|---|---|---|---|---|---|---|
| 34006951_f2_207 | 2641 | 6813 | 87 | 264 | 199 | 7.2e-16 |
| Protein name | | | | | Locus Name | Acc# |
| | | | | | sp:YHGG_ECOLI | P46845 |

Description: HYPOTHETICAL 8.7 KD PROTEIN IN FEOB-BIOH INTERGENIC REGION (O78)

| ORF Name | NTID | AAID | NT Length | AA Length | Score | Probability |
|---|---|---|---|---|---|---|
| 34085802_f1_108 | 2642 | 6814 | 60 | 183 | | |
| Protein name | | | | | Locus Name | Acc# |

Description: NO-HIT

| ORF Name | NTID | AAID | NT Length | AA Length | Score | Probability |
|---|---|---|---|---|---|---|
| 34181952_f1_52 | 2643 | 6815 | 359 | 1080 | 1430 | 2.6e-146 |
| Protein name | | | | | Locus Name | Acc# |
| | | | | | sp:PSTS_ECOLI | P06128:P76 |

Description: PHOSPHATE-BINDING PERIPLASMIC PROTEIN PRECURSOR (PBP)

619

| ORF Name | NTID | AAID | NT Length | AA Length | Score | Probability |
|---|---|---|---|---|---|---|
| 34400317_c3_722 | 2644 | 6816 | 281 | 846 | 1120 | 1.8e-113 |
| Protein name | | | | | Locus Name | Acc# |
| | | | | | sp:YHIR_ECOLI | P37634 |

Description
HYPOTHETICAL 31.9 KD PROTEIN IN PRLC-GOR INTERGENIC REGION (O280A)

| ORF Name | NTID | AAID | NT Length | AA Length | Score | Probability |
|---|---|---|---|---|---|---|
| 34415936_c2_570 | 2645 | 6817 | 534 | 1605 | 980 | 1.2e-98 |
| Protein name | | | | | Locus Name | Acc# |
| D-ribulokinase, | | | | | pir:S78598 | S78598:S08 |

Description

| ORF Name | NTID | AAID | NT Length | AA Length | Score | Probability |
|---|---|---|---|---|---|---|
| 34417050_f1_74 | 2646 | 6818 | 192 | 579 | 417 | 5.7e-39 |
| Protein name | | | | | Locus Name | Acc# |
| | | | | | sp:GLPG_ECOLI | P09391:P76 |

Description
GLPG PROTEIN

| ORF Name | NTID | AAID | NT Length | AA Length | Score | Probability |
|---|---|---|---|---|---|---|
| 34425032_f2_141 | 2647 | 6819 | 94 | 285 | 112 | 2.1e-06 |
| Protein name | | | | | Locus Name | Acc# |
| | | | | | sp:HAG2_EIKCO | P35648 |

Description
HEMAGGLUTININ 2

| ORF Name | NTID | AAID | NT Length | AA Length | Score | Probability |
|---|---|---|---|---|---|---|
| 34488332_c3_738 | 2648 | 6820 | 711 | 2136 | 3127 | 0.0 |
| Protein name | | | | | Locus Name | Acc# |
| translation elongation factor EF-G:fusA protein | | | | | pir:EFECG | G65127:A28 |

Description

| ORF Name | NTID | AAID | NT Length | AA Length | Score | Probability |
|---|---|---|---|---|---|---|
| 34492142_c1_484 | 2649 | 6821 | 216 | 651 | 656 | 2.7e-64 |
| Protein name | | | | | Locus Name | Acc# |
| | | | | | sp:YIHX_ECOLI | P32145 |

Description
HYPOTHETICAL 22.7 KD PROTEIN IN GLNA-RBN INTERGENIC REGION

| ORF Name | NTID | AAID | NT Length | AA Length | Score | Probability |
|---|---|---|---|---|---|---|
| 34564716_c2_617 | 2650 | 6822 | 331 | 996 | 1341 | 6.9e-137 |
| Protein name | | | | | Locus Name | Acc# |
| | | | | | sp:DPPD_ECOLI | P37314 |

Description
DIPEPTIDE TRANSPORT ATP-BINDING PROTEIN DPPD

| ORF Name | NTID | AAID | NT Length | AA Length | Score | Probability |
|---|---|---|---|---|---|---|
| 35177217_c3_678 | 2651 | 6823 | 508 | 1527 | 940 | 2.2e-94 |
| Protein name | | | | | Locus Name | Acc# |
| | | | | | sp:YZ2R_AGRVI | P70795 |

Description
HYPOTHETICAL 52.8 KD PROTEIN IN TAR-I TTUC' 3'REGION (ORFZ2)

| ORF Name | NTID | AAID | NT Length | AA Length | Score | Probability |
|---|---|---|---|---|---|---|
| 35187558_c2_596 | 2652 | 6824 | 487 | 1464 | 1807 | 2.9e-186 |
| Protein name | | | | | Locus Name | Acc# |
| | | | | | sp:HEMN_SALTY | P37129 |

Description
(COPROPORPHYRINOGENASE) (COPROGEN OXIDASE)

| ORF Name | NTID | AAID | NT Length | AA Length | Score | Probability |
|---|---|---|---|---|---|---|
| 35360816_c1_455 | 2653 | 6825 | 572 | 1719 | 114 | 4.2e-09 |
| Protein name | | | | | Locus Name | Acc# |
| hypothetical protein TM0307 | | | | | pir:H72393 | H72393 |

Description

621

| ORF Name | NTID | AAID | NT Length | AA Length | Score | Probability |
|---|---|---|---|---|---|---|
| 35740627_c2_631 | 2654 | 6826 | 163 | 492 | 754 | 1.1e-74 |
| Protein name | | | | | Locus Name | Acc# |
| | | | | | sp:RS7_ECOLI | P02359 |

Description
30S RIBOSOMAL PROTEIN S7

| ORF Name | NTID | AAID | NT Length | AA Length | Score | Probability |
|---|---|---|---|---|---|---|
| 35939002_c3_677 | 2655 | 6827 | 359 | 1080 | 91 | 6.8e-06 |
| Protein name | | | | | Locus Name | Acc# |
| hypothetical protein HP0580 | | | | | pir:D64592 | D64592 |

Description

| ORF Name | NTID | AAID | NT Length | AA Length | Score | Probability |
|---|---|---|---|---|---|---|
| 35945308_c2_547 | 2656 | 6828 | 185 | 558 | 704 | 2.2e-69 |
| Protein name | | | | | Locus Name | Acc# |
| hypothetical protein b0354 | | | | | pir:B64763 | B64763 |

Description

| ORF Name | NTID | AAID | NT Length | AA Length | Score | Probability |
|---|---|---|---|---|---|---|
| 35991552_c2_620 | 2657 | 6829 | 138 | 417 | 89 | 0.022 |
| Protein name | | | | | Locus Name | Acc# |
| putative MTN3 protein | | | | | gp:ATAC005770 | AC005770 |

Description
Arabidopsis thaliana chromosome II BAC T7F6 genomic sequence, complete sequence.

| ORF Name | NTID | AAID | NT Length | AA Length | Score | Probability |
|---|---|---|---|---|---|---|
| 36062875_c1_419 | 2658 | 6830 | 73 | 222 | 94 | 0.00021 |
| Protein name | | | | | Locus Name | Acc# |
| hypothetical 18.2K protein | | | | | pir:JQ0138 | JQ0138 |

Description

| ORF_Name | NTID | AAID | NT Length | AA Length | Score | Probability |
|---|---|---|---|---|---|---|
| 36126587_f2_195 | 2659 | 6831 | 75 | 228 | | |
| Protein name | | | | | Locus Name | Acc# |
| | | | | | | |

Description
NO-HIT

| ORF_Name | NTID | AAID | NT Length | AA Length | Score | Probability |
|---|---|---|---|---|---|---|
| 36136068_c3_638 | 2660 | 6832 | 141 | 426 | 462 | 9.7e-44 |
| Protein name | | | | | Locus Name | Acc# |
| | | | | | sp:YRFH_ECOLI | P45802 |

Description
HYPOTHETICAL 15.5 KD PROTEIN IN MRCA-PCKA INTERGENIC REGION (O133)

| ORF_Name | NTID | AAID | NT Length | AA Length | Score | Probability |
|---|---|---|---|---|---|---|
| 36150425_f2_206 | 2661 | 6833 | 84 | 255 | 253 | 1.4e-21 |
| Protein name | | | | | Locus Name | Acc# |
| | | | | | sp:FEOA_ECOLI | P33649 |

Description
FERROUS IRON TRANSPORT PROTEIN A

| ORF_Name | NTID | AAID | NT Length | AA Length | Score | Probability |
|---|---|---|---|---|---|---|
| 36360887_c1_462 | 2662 | 6834 | 124 | 375 | 185 | 2.2e-14 |
| Protein name | | | | | Locus Name | Acc# |
| | | | | | sp:ACPS_ECOLI | P24224 |

Description
SYNTHASE, (HOLO-ACP SYNTHASE)

| ORF_Name | NTID | AAID | NT Length | AA Length | Score | Probability |
|---|---|---|---|---|---|---|
| 36446888_f1_110 | 2663 | 6835 | 313 | 942 | 90 | 0.0015 |
| Protein name | | | | | Locus Name | Acc# |
| vacA protein | | | | | gp:HPY390618 | AJ390618 |

Description
Helicobacter pylori partial vacA gene, isolate HK30.

| ORF_Name | NTID | AAID | NT Length | AA Length | Score | Probability |
|---|---|---|---|---|---|---|
| 36532811_c3_679 | 2664 | 6836 | 345 | 1038 | 336 | 2.2e-30 |//
| Protein name | | | | | Locus Name | Acc# |
| | | | | | sp:SCRR_SALTY | P37077 |

Description
SUCROSE OPERON REPRESSOR (SCR OPERON REGULATORY PROTEIN)

| ORF_Name | NTID | AAID | NT Length | AA Length | Score | Probability |
|---|---|---|---|---|---|---|
| 3907965_c1_516 | 2665 | 6837 | 79 | 240 | | |
| Protein name | | | | | Locus Name | Acc# |

Description
NO-HIT

| ORF_Name | NTID | AAID | NT Length | AA Length | Score | Probability |
|---|---|---|---|---|---|---|
| 3908588_c2_564 | 2666 | 6838 | 111 | 336 | 459 | 2.0e-43 |
| Protein name | | | | | Locus Name | Acc# |
| | | | | | sp:PTCB_ECOLI | P17409 |

Description
(EC 2.7.1.69)

| ORF_Name | NTID | AAID | NT Length | AA Length | Score | Probability |
|---|---|---|---|---|---|---|
| 3911692_f1_53 | 2667 | 6839 | 322 | 969 | 1412 | 2.1e-144 |
| Protein name | | | | | Locus Name | Acc# |
| peripheral membrane protein C | | | | | gp:D89963 | D89963 |

Description
Enterobacter cloacae pstS, pstC, pstA, pstB and phoU genes, complete cds.

| ORF_Name | NTID | AAID | NT Length | AA Length | Score | Probability |
|---|---|---|---|---|---|---|
| 3913457_f3_293 | 2668 | 6840 | 646 | 1941 | 2553 | 2.6e-265 |
| Protein name | | | | | Locus Name | Acc# |
| | | | | | sp:YHES_ECOLI | P45535 |

Description
HYPOTHETICAL ABC TRANSPORTER ATP-BINDING PROTEIN YHES

| ORF Name | NTID | AAID | NT Length | AA Length | Score | Probability |
|---|---|---|---|---|---|---|
| 393760_f3_394 | 2669 | 6841 | 123 | 372 | | |
| Protein name | | | | | Locus Name | Acc# |

Description: NO-HIT

| ORF Name | NTID | AAID | NT Length | AA Length | Score | Probability |
|---|---|---|---|---|---|---|
| 3938588_f2_176 | 2670 | 6842 | 693 | 2082 | 2805 | 5.1e-292 |
| Protein name | | | | | Locus Name | Acc# |
| glycine--tRNA ligase, beta chain:glycyl-tRNA synthetase beta chain | | | | | pir:SYECGB | S47780:I41 |

Description:

| ORF Name | NTID | AAID | NT Length | AA Length | Score | Probability |
|---|---|---|---|---|---|---|
| 3943937_f3_321 | 2671 | 6843 | 242 | 729 | 890 | 4.3e-89 |
| Protein name | | | | | Locus Name | Acc# |
| | | | | | sp:TRMH_ECOLI | P19396 |

Description: (METHYLTRANSFERASE)

| ORF Name | NTID | AAID | NT Length | AA Length | Score | Probability |
|---|---|---|---|---|---|---|
| 3944053_f1_57 | 2672 | 6844 | 248 | 747 | 250 | 3.2e-32 |
| Protein name | | | | | Locus Name | Acc# |
| amino acid ABC transporter, permease protein | | | | | pir:E75446 | E75446 |

Description:

| ORF Name | NTID | AAID | NT Length | AA Length | Score | Probability |
|---|---|---|---|---|---|---|
| 3946068_c1_412 | 2673 | 6845 | 475 | 1428 | 1940 | 2.3e-200 |
| Protein name | | | | | Locus Name | Acc# |
| | | | | | sp:YKGF_ECOLI | P77536 |

Description: HYPOTHETICAL 53.1 KD PROTEIN IN EAEH-BETA INTERGENIC REGION

| ORF Name | NTID | AAID | NT Length | AA Length | Score | Probability |
|---|---|---|---|---|---|---|
| 3948463_c3_639 | 2674 | 6846 | 297 | 894 | 919 | 3.6e-92 |

| Protein name | | | | | Locus Name | Acc# |
|---|---|---|---|---|---|---|
| hypothetical 32.8 kD protein in mrcA-pckA intergenic region | | | | | pir:D65135 | D65135 |

Description

| ORF Name | NTID | AAID | NT Length | AA Length | Score | Probability |
|---|---|---|---|---|---|---|
| 3954838_f1_76 | 2675 | 6847 | 500 | 1503 | 2020 | 7.7e-209 |

| Protein name | | | | | Locus Name | Acc# |
|---|---|---|---|---|---|---|
| | | | | | sp:GLPD_ECOLI | P13035:Q47 |

Description

AEROBIC GLYCEROL-3-PHOSPHATE DEHYDROGENASE,

| ORF Name | NTID | AAID | NT Length | AA Length | Score | Probability |
|---|---|---|---|---|---|---|
| 3957875_f1_73 | 2676 | 6848 | 134 | 405 | 360 | 6.2e-33 |

| Protein name | | | | | Locus Name | Acc# |
|---|---|---|---|---|---|---|
| | | | | | sp:GLPE_ECOLI | P09390 |

Description

GLPE PROTEIN

| ORF Name | NTID | AAID | NT Length | AA Length | Score | Probability |
|---|---|---|---|---|---|---|
| 4015838_c2_602 | 2677 | 6849 | 307 | 924 | 1144 | 5.2e-116 |

| Protein name | | | | | Locus Name | Acc# |
|---|---|---|---|---|---|---|
| | | | | | sp:YIID_ECOLI | P32148 |

Description

HYPOTHETICAL 37.1 KD PROTEIN IN RBN-FDHE INTERGENIC REGION (O329)

| ORF Name | NTID | AAID | NT Length | AA Length | Score | Probability |
|---|---|---|---|---|---|---|
| 4021003_f3_296 | 2678 | 6850 | 310 | 933 | 1242 | 2.1e-126 |

| Protein name | | | | | Locus Name | Acc# |
|---|---|---|---|---|---|---|
| | | | | | sp:KPPR_ECOLI | P37307:P76 |

Description

PROBABLE PHOSPHORIBULOKINASE, (PHOSPHOPENTOKINASE) (PRK)

| ORF Name | NTID | AAID | NT Length | AA Length | Score | Probability |
|---|---|---|---|---|---|---|
| 4022952_c1_523 | 2679 | 6851 | 124 | 375 | 617 | 3.6e-60 |// 
| Protein name | | | | | Locus Name | Acc# |
| ribosomal protein S12:streptomycin resistance protein | | | | | pir:A42939 | B42939;A42 |

Description

HYPOTHETICAL 24.5 KD PROTEIN IN INTF-EAEH INTERGENIC REGION PRECURSOR

| ORF Name | NTID | AAID | NT Length | AA Length | Score | Probability |
|---|---|---|---|---|---|---|
| 4025187_c1_432 | 2680 | 6852 | 231 | 696 | 493 | 5.0e-47 |
| Protein name | | | | | Locus Name | Acc# |
| | | | | | sp:YAGY_ECOLI | P77188 |

Description

HYPOTHETICAL 24.5 KD PROTEIN IN INTF-EAEH INTERGENIC REGION PRECURSOR

| ORF Name | NTID | AAID | NT Length | AA Length | Score | Probability |
|---|---|---|---|---|---|---|
| 4063175_c3_692 | 2681 | 6853 | 343 | 1032 | 177 | 4.2e-11 |
| Protein name | | | | | Locus Name | Acc# |
| | | | | | sp:YCDU_ECOLI | P75910 |

Description

HYPOTHETICAL 38.7 KD PROTEIN IN PHOH-CSGG INTERGENIC REGION

| ORF Name | NTID | AAID | NT Length | AA Length | Score | Probability |
|---|---|---|---|---|---|---|
| 4071067_f2_166 | 2682 | 6854 | 343 | 1032 | 1020 | 7.2e-103 |
| Protein name | | | | | Locus Name | Acc# |
| | | | | | sp:YHJD_ECOLI | P37642 |

Description

HYPOTHETICAL 37.9 KD PROTEIN IN TREF-KDGK INTERGENIC REGION (O337)

| ORF Name | NTID | AAID | NT Length | AA Length | Score | Probability |
|---|---|---|---|---|---|---|
| 4074075_c3_707 | 2683 | 6855 | 303 | 912 | 1066 | 9.6e-108 |
| Protein name | | | | | Locus Name | Acc# |
| | | | | | sp:YJBC_ECOLI | P32684 |

Description

HYPOTHETICAL 32.5 KD PROTEIN IN PEPE-LYSC INTERGENIC REGION

| ORF Name | NTID | AAID | NT Length | AA Length | Score | Probability |
|---|---|---|---|---|---|---|
| 4093762_c2_542 | 2684 | 6856 | 228 | 687 | 295 | 4.8e-26 |

| Protein name | | | | | Locus Name | Acc# |
|---|---|---|---|---|---|---|
| | | | | | sp:YAGV_ECOLI | P77263 |

Description

HYPOTHETICAL 26.6 KD PROTEIN IN INTF-EAEH INTERGENIC REGION PRECURSOR

| ORF Name | NTID | AAID | NT Length | AA Length | Score | Probability |
|---|---|---|---|---|---|---|
| 4101568_c2_550 | 2685 | 6857 | 521 | 1566 | 839 | 1.1e-83 |

| Protein name | | | | | Locus Name | Acc# |
|---|---|---|---|---|---|---|
| | | | | | sp:PTOA_ECOLI | P19642:P77 |

Description

COMPONENT),

| ORF Name | NTID | AAID | NT Length | AA Length | Score | Probability |
|---|---|---|---|---|---|---|
| 4103378_c1_444 | 2686 | 6858 | 310 | 933 | 431 | 2.5e-40 |

| Protein name | | | | | Locus Name | Acc# |
|---|---|---|---|---|---|---|
| WbpC | | | | | gp:PAU50396 | U50396 |

Description

Pseudomonas aeruginosa Wzz (Rol) (wzz (rol)) gene, partial cds,WbpA (wbpB), WbpB (wbpB), WbpC (wbpC), WbpD (wbpD), WbpE (wbpE),Wzy (Rfc) (wzy (rfc)), Wzx (wzx), HisH (hisH), HisF (hisF), WbpG(wbpG), WbpH (wbpH), WbpI (wbpI), WbpJ (wbpJ), WbpK (wbpK), WbpL(wbpL), WbpM (wbpM) and WbpN (wbpN) genes, complete cds, and UvrB(uvrB) gene, partial cds.

| ORF Name | NTID | AAID | NT Length | AA Length | Score | Probability |
|---|---|---|---|---|---|---|
| 4103510_f1_117 | 2687 | 6859 | 249 | 750 | 934 | 9.3e-94 |

| Protein name | | | | | Locus Name | Acc# |
|---|---|---|---|---|---|---|
| | | | | | gp:ECOUW76 | U00039 |

Description

E. coli chromosomal region from 76.0 to 81.5 minutes.

628

| ORF Name | NTID | AAID | NT Length | AA Length | Score | Probability |
|---|---|---|---|---|---|---|
| 4120291_f2_199 | 2688 | 6860 | 254 | 765 | 318 | 1.8e-28 |
| Protein name | | | | Locus Name | | Acc# |
| | | | | sp:GLNP_ECOLI | | P10345 |

Description: GLUTAMINE TRANSPORT SYSTEM PERMEASE PROTEIN GLNP

| ORF Name | NTID | AAID | NT Length | AA Length | Score | Probability |
|---|---|---|---|---|---|---|
| 4178135_c2_612 | 2689 | 6861 | 448 | 1347 | 1662 | 6.7e-171 |
| Protein name | | | | Locus Name | | Acc# |
| | | | | sp:AVTA_ECOLI | | P09053 |

Description: (ALANINE--VALINE TRANSAMINASE)

| ORF Name | NTID | AAID | NT Length | AA Length | Score | Probability |
|---|---|---|---|---|---|---|
| 4187500_f3_368 | 2690 | 6862 | 351 | 1056 | 558 | 6.5e-54 |
| Protein name | | | | Locus Name | | Acc# |
| probable ferrichrome ABC transporter yclQ | | | | pir:E69763 | | E69763 |

Description:

| ORF Name | NTID | AAID | NT Length | AA Length | Score | Probability |
|---|---|---|---|---|---|---|
| 4194018_f3_356 | 2691 | 6863 | 302 | 909 | 1317 | 2.4e-134 |
| Protein name | | | | Locus Name | | Acc# |
| | | | | sp:METF_ERWCA | | P71319 |

Description: 5,10-METHYLENETETRAHYDROFOLATE REDUCTASE,

| ORF Name | NTID | AAID | NT Length | AA Length | Score | Probability |
|---|---|---|---|---|---|---|
| 422193_c1_426 | 2692 | 6864 | 542 | 1629 | 1892 | 2.8e-195 |
| Protein name | | | | Locus Name | | Acc# |
| | | | | sp:PITA_ECOLI | | P37308 |

Description: LOW-AFFINITY INORGANIC PHOSPHATE TRANSPORTER 1

| ORF Name | NTID | AAID | NT Length | AA Length | Score | Probability |
|---|---|---|---|---|---|---|
| 4297318_c1_504 | 2693 | 6865 | 168 | 507 | 145 | 3.8e-10 |

| Protein name | Locus Name | Acc# |
|---|---|---|
| probable translation initiation inhibitor PAB0825 | pir:G75032 | G75032 |

Description

| ORF Name | NTID | AAID | NT Length | AA Length | Score | Probability |
|---|---|---|---|---|---|---|
| 4314212_f2_247 | 2694 | 6866 | 176 | 531 | 775 | 6.6e-77 |

| Protein name | Locus Name | Acc# |
|---|---|---|
| hcp | gp:AF044503 | AF044503 |

Description

Escherichia coli strain ec11 unknown (498), hcp gene, complete cds;and RhsG accessory genetic element VgrG protein, core component anddsORF-g1 genes, complete cds.

| ORF Name | NTID | AAID | NT Length | AA Length | Score | Probability |
|---|---|---|---|---|---|---|
| 4334687_c2_526 | 2695 | 6867 | 309 | 930 | 989 | 1.4e-99 |

| Protein name | Locus Name | Acc# |
|---|---|---|
| | sp:YKGE_ECOLI | P77252 |

Description

HYPOTHETICAL 26.0 KD PROTEIN IN EAEH-BETA INTERGENIC REGION

| ORF Name | NTID | AAID | NT Length | AA Length | Score | Probability |
|---|---|---|---|---|---|---|
| 4337938_c2_555 | 2696 | 6868 | 300 | 903 | 269 | 2.7e-23 |

| Protein name | Locus Name | Acc# |
|---|---|---|
| | sp:NPL_ECOLI | P06995 |

Description

ACID ALDOLASE) (N-ACETYLNEURAMINATE PYRUVATE LYASE) (NALASE)

| ORF Name | NTID | AAID | NT Length | AA Length | Score | Probability |
|---|---|---|---|---|---|---|
| 441537_f1_8 | 2697 | 6869 | 77 | 234 | 101 | 1.7e-05 |

| Protein name | Locus Name | Acc# |
|---|---|---|
| hypothetical 19K protein (slyD region) | pir:B49988 | B49988 |

Description

| ORF Name | NTID | AAID | NT Length | AA Length | Score | Probability |
|---|---|---|---|---|---|---|
| 4431538_c3_724 | 2698 | 6870 | 332 | 999 | 985 | 3.7e-99 |
| Protein name | | | | | Locus Name | Acc# |
| | | | | | sp:YIHE_ECOLI | P32127 |

Description: HYPOTHETICAL 38.1 KD PROTEIN IN MOBA-DSBA INTERGENIC REGION

| ORF Name | NTID | AAID | NT Length | AA Length | Score | Probability |
|---|---|---|---|---|---|---|
| 4469063_f3_323 | 2699 | 6871 | 467 | 1404 | 1903 | 1.9e-196 |
| Protein name | | | | | Locus Name | Acc# |
| | | | | | sp:YICE_ECOLI | P27432 |

Description: HYPOTHETICAL 48.9 KD PROTEIN IN GLTS-SELC INTERGENIC REGION

| ORF Name | NTID | AAID | NT Length | AA Length | Score | Probability |
|---|---|---|---|---|---|---|
| 4490691_c2_588 | 2700 | 6872 | 229 | 690 | | |
| Protein name | | | | | Locus Name | Acc# |

Description: NO-HIT

| ORF Name | NTID | AAID | NT Length | AA Length | Score | Probability |
|---|---|---|---|---|---|---|
| 4494087_c3_723 | 2701 | 6873 | 474 | 1425 | 2423 | 1.5e-251 |
| Protein name | | | | | Locus Name | Acc# |
| amino acid deaminase | | | | | gp:PMU35383 | U35383 |

Description: Proteus mirabilis amino acid deaminase (aad) gene, complete cds.

| ORF Name | NTID | AAID | NT Length | AA Length | Score | Probability |
|---|---|---|---|---|---|---|
| 4687775_f3_295 | 2702 | 6874 | 333 | 1002 | 1193 | 3.3e-121 |
| Protein name | | | | | Locus Name | Acc# |
| | | | | | sp:YHET_ECOLI | P45524 |

Description: HYPOTHETICAL 38.5 KD PROTEIN IN KIFB-PRKB INTERGENIC REGION

| ORF Name | NTID | AAID | NT Length | AA Length | Score | Probability |
|---|---|---|---|---|---|---|
| 4704438_f1_109 | 2703 | 6875 | 315 | 948 | 97 | 0.048 |
| Protein name | | | | | Locus Name | Acc# |
| | | | | | sp:IPNS_FLASS | P16020 |

Description
SYNTHASE)

| ORF Name | NTID | AAID | NT Length | AA Length | Score | Probability |
|---|---|---|---|---|---|---|
| 4720262_c2_551 | 2704 | 6876 | 249 | 750 | 754 | 1.1e-74 |
| Protein name | | | | | Locus Name | Acc# |
| | | | | | sp:YHCJ_ECOLI | P45426 |

Description
HYPOTHETICAL 24.1 KD PROTEIN IN GLTF-NANT INTERGENIC REGION (F229)

| ORF Name | NTID | AAID | NT Length | AA Length | Score | Probability |
|---|---|---|---|---|---|---|
| 4727216_c3_717 | 2705 | 6877 | 539 | 1620 | 2367 | 1.3e-245 |
| Protein name | | | | | Locus Name | Acc# |
| | | | | | sp:DPPA_ECOLI | P23847 |

Description
PROTEIN) (DBP)

| ORF Name | NTID | AAID | NT Length | AA Length | Score | Probability |
|---|---|---|---|---|---|---|
| 4728452_c3_715 | 2706 | 6878 | 169 | 510 | 81 | 0.032 |
| Protein name | | | | | Locus Name | Acc# |
| hypothetical protein E-118 | | | | | pir:A05234 | A05234 |

Description

| ORF Name | NTID | AAID | NT Length | AA Length | Score | Probability |
|---|---|---|---|---|---|---|
| 4745130_c3_726 | 2707 | 6879 | 959 | 2880 | 3359 | 0.0 |
| Protein name | | | | | Locus Name | Acc# |
| | | | | | sp:DPO1_ECOLI | P00582 |

Description
DNA POLYMERASE I, (POL I)

| ORF Name | NTID | AAID | NT Length | AA Length | Score | Probability |
|---|---|---|---|---|---|---|
| 4745260_c2_585 | 2708 | 6880 | 843 | 2532 | 391 | 1.3e-31 |
| Protein name | | | | | Locus Name | Acc# |
| hypothetical protein 2 | | | | | pir:T31105 | T31105 |

Description
NO-HIT (hypothetical protein 2)

| ORF Name | NTID | AAID | NT Length | AA Length | Score | Probability |
|---|---|---|---|---|---|---|
| 4770308_f2_158 | 2709 | 6881 | 64 | 195 | | |
| Protein name | | | | | Locus Name | Acc# |

Description
NO-HIT

| ORF Name | NTID | AAID | NT Length | AA Length | Score | Probability |
|---|---|---|---|---|---|---|
| 4790767_f1_71 | 2710 | 6882 | 251 | 756 | 572 | 2.1e-55 |
| Protein name | | | | | Locus Name | Acc# |
| | | | | | sp:YHGH_ECOLI | P46846 |

Description
HYPOTHETICAL 25.7 KD PROTEIN IN BIOH-GNTT INTERGENIC REGION

| ORF Name | NTID | AAID | NT Length | AA Length | Score | Probability |
|---|---|---|---|---|---|---|
| 4803387_c1_493 | 2711 | 6883 | 207 | 624 | | |
| Protein name | | | | | Locus Name | Acc# |

Description
NO-HIT

| ORF Name | NTID | AAID | NT Length | AA Length | Score | Probability |
|---|---|---|---|---|---|---|
| 4814377_f1_35 | 2712 | 6884 | 587 | 1764 | 1969 | 2.0e-203 |
| Protein name | | | | | Locus Name | Acc# |
| | | | | | sp:YIDE_ECOLI | P29211:P76 |

Description
HYPOTHETICAL 58.9 KD PROTEIN IN GLVC-IBPB INTERGENIC REGION (ORFA)

633

| ORF Name | NTID | AAID | NT Length | AA Length | Score | Probability |
|---|---|---|---|---|---|---|
| 4814762_f3_335 | 2713 | 6885 | 356 | 1071 | 1669 | 1.2e-171 |АААА

| ORF Name | NTID | AAID | NT Length | AA Length | Score | Probability |
|---|---|---|---|---|---|---|
| 4814762_f3_335 | 2713 | 6885 | 356 | 1071 | 1669 | 1.2e-171 |

Protein name | Locus Name | Acc#
| | sp:NTRB_PROVU | P28788

Description: NITROGEN REGULATION PROTEIN NR(II),

| ORF Name | NTID | AAID | NT Length | AA Length | Score | Probability |
|---|---|---|---|---|---|---|
| 4883393_f3_407 | 2714 | 6886 | 554 | 1665 | 2166 | 2.6e-224 |

Protein name | Locus Name | Acc#
| | sp:YJCG_ECOLI | P32705

Description: HYPOTHETICAL 59.2 KD PROTEIN IN SOXR-ACS INTERGENIC REGION (F549)

| ORF Name | NTID | AAID | NT Length | AA Length | Score | Probability |
|---|---|---|---|---|---|---|
| 4892136_f3_382 | 2715 | 6887 | 445 | 1338 | 887 | 8.9e-89 |

Protein name: sodium-dependent transporter homolog yhdH | Locus Name: pir:F69825 | Acc#: F69825

Description:

| ORF Name | NTID | AAID | NT Length | AA Length | Score | Probability |
|---|---|---|---|---|---|---|
| 4894018_f3_404 | 2716 | 6888 | 239 | 720 | 537 | 1.1e-51 |

Protein name | Locus Name | Acc#
| | sp:GPH_ECOLI | P32662

Description: PHOSPHOGLYCOLATE PHOSPHATASE, (PGP)

| ORF Name | NTID | AAID | NT Length | AA Length | Score | Probability |
|---|---|---|---|---|---|---|
| 4954717_f2_165 | 2717 | 6889 | 133 | 402 | 219 | 5.5e-18 |

Protein name | Locus Name | Acc#
| | sp:YQJC_ECOLI | P42616

Description: HYPOTHETICAL 14.5 KD PROTEIN IN EXUR-TDCC INTERGENIC REGION PRECURSOR

| ORF Name | NTID | AAID | NT Length | AA Length | Score | Probability |
|---|---|---|---|---|---|---|
| 4958186_f1_130 | 2718 | 6890 | 243 | 732 | | |
| Protein name | | | | | Locus Name | Acc# |
| | | | | | | |

Description: NO-HIT

| ORF Name | NTID | AAID | NT Length | AA Length | Score | Probability |
|---|---|---|---|---|---|---|
| 5083436_f2_254 | 2719 | 6891 | 98 | 297 | 69 | 0.042 |
| Protein name | | | | | Locus Name | Acc# |
| | | | | | sp:CH10_ACTPL | P94165 |

Description: 10 KD CHAPERONIN (PROTEIN CPN10) (PROTEIN GROES)

| ORF Name | NTID | AAID | NT Length | AA Length | Score | Probability |
|---|---|---|---|---|---|---|
| 5097800_f3_350 | 2720 | 6892 | 499 | 1500 | | |
| Protein name | | | | | Locus Name | Acc# |

Description: NO-HIT

| ORF Name | NTID | AAID | NT Length | AA Length | Score | Probability |
|---|---|---|---|---|---|---|
| 5117943_c3_732 | 2721 | 6893 | 189 | 570 | 560 | 4.0e-54 |
| Protein name | | | | | Locus Name | Acc# |
| | | | | | sp:YHER_ECOLI | P45534 |

Description: PUTATIVE NAD(P)H OXIDOREDUCTASE YHER,

| ORF Name | NTID | AAID | NT Length | AA Length | Score | Probability |
|---|---|---|---|---|---|---|
| 5181502_f3_353 | 2722 | 6894 | 149 | 450 | 126 | 3.9e-08 |
| Protein name | | | | | Locus Name | Acc# |
| hypothetical protein PAB2001 | | | | | pir:C75173 | C75173 |

Description

| ORF Name | NTID | AAID | NT Length | AA Length | Score | Probability |
|---|---|---|---|---|---|---|
| 5189017_c1_522 | 2723 | 6895 | 133 | 402 | 420 | 2.7e-39 |

Protein name | Locus Name | Acc#
sp:YHEN_ECOLI    P45532

Description
HYPOTHETICAL 13.6 KD PROTEIN IN RPSL-FKPA INTERGENIC REGION

| ORF Name | NTID | AAID | NT Length | AA Length | Score | Probability |
|---|---|---|---|---|---|---|
| 5211713_c1_525 | 2724 | 6896 | 229 | 690 | 1086 | 7.3e-110 |

Protein name | Locus Name | Acc#
translation elongation factor EF-Tu.A    pir:S13560    S13560

Description

| ORF Name | NTID | AAID | NT Length | AA Length | Score | Probability |
|---|---|---|---|---|---|---|
| 5321002_c3_705 | 2725 | 6897 | 124 | 375 | | |

Protein name | Locus Name | Acc#

Description
NO-HIT

| ORF Name | NTID | AAID | NT Length | AA Length | Score | Probability |
|---|---|---|---|---|---|---|
| 5360933_f2_225 | 2726 | 6898 | 194 | 585 | 214 | 1.8e-17 |

Protein name | Locus Name | Acc#
putative outer membrane protein    gp:AF114793    AF114793

Description
Vitreoscilla sp. YciB homolog, putative transcriptional activator, putative outer membrane protein, BioA homolog, and glutaminesynthetase homolog genes, complete cds; and unknown genes.

| ORF Name | NTID | AAID | NT Length | AA Length | Score | Probability |
|---|---|---|---|---|---|---|
| 53800_c2_538 | 2727 | 6899 | 87 | 264 | | |

Protein name | Locus Name | Acc#

Description
NO-HIT

636

| ORF Name | NTID | AAID | NT Length | AA Length | Score | Probability |
|---|---|---|---|---|---|---|
| 572305_f2_243 | 2728 | 6900 | 242 | 729 | 523 | 3.3e-50 |
| Protein name | | | | | Locus Name | Acc# |
| hypothetical protein | | | | | gp:YEN132945 | AJ132945 |

Description

Yersinia enterocolitica WA 314 right arm of the high-pathogenicityisland.

| ORF Name | NTID | AAID | NT Length | AA Length | Score | Probability |
|---|---|---|---|---|---|---|
| 578577_f1_137 | 2729 | 6901 | 543 | 1632 | 703 | 2.8e-69 |
| Protein name | | | | | Locus Name | Acc# |
| outer membrane adherence protein-associated | | | | | gp:ECU50906 | U50906 |

Description

Escherichia coli O157:H7 outer membrane adherenceprotein-associated gene, complete cds.

| ORF Name | NTID | AAID | NT Length | AA Length | Score | Probability |
|---|---|---|---|---|---|---|
| 580341_f1_43 | 2730 | 6902 | 700 | 2103 | 2701 | 5.3e-281 |
| Protein name | | | | | Locus Name | Acc# |
| | | | | | sp:RECG_ECOLI | P24230:P76 |

Description

ATP-DEPENDENT DNA HELICASE RECG,

| ORF Name | NTID | AAID | NT Length | AA Length | Score | Probability |
|---|---|---|---|---|---|---|
| 5958505_f1_125 | 2731 | 6903 | 77 | 234 | | |
| Protein name | | | | | Locus Name | Acc# |

Description

NO-HIT

| ORF Name | NTID | AAID | NT Length | AA Length | Score | Probability |
|---|---|---|---|---|---|---|
| 5960343_f1_75 | 2732 | 6904 | 255 | 768 | 1016 | 1.9e-102 |
| Protein name | | | | | Locus Name | Acc# |
| glpR protein | | | | | pir:B65138 | B65138 |

Description

| ORF Name | NTID | AAID | NT Length | AA Length | Score | Probability |
|---|---|---|---|---|---|---|
| 5994032_f2_244 | 2733 | 6905 | 116 | 351 | 600 | 2.3e-58 |
| Protein name | | | | | Locus Name | Acc# |
| yajD protein | | | | | pir:B64770 | B64770:JQ0 |

Description
5994032_f2_244

| ORF Name | NTID | AAID | NT Length | AA Length | Score | Probability |
|---|---|---|---|---|---|---|
| 5994057_c2_565 | 2734 | 6906 | 133 | 402 | 430 | 2.4e-40 |
| Protein name | | | | | Locus Name | Acc# |
| | | | | | sp:PTCA_ECOLI | P17335:Q57 |

Description
(EC 2.7.1.69) (EIII-CEL)

| ORF Name | NTID | AAID | NT Length | AA Length | Score | Probability |
|---|---|---|---|---|---|---|
| 6017328_c1_515 | 2735 | 6907 | 291 | 876 | 586 | 7.0e-57 |
| Protein name | | | | | Locus Name | Acc# |
| | | | | | sp:YFET_ECOLI | P77245 |

Description
HYPOTHETICAL 31.2 KD PROTEIN IN CYSP-AMIA INTERGENIC REGION

| ORF Name | NTID | AAID | NT Length | AA Length | Score | Probability |
|---|---|---|---|---|---|---|
| 6025326_f3_294 | 2736 | 6908 | 595 | 1788 | 858 | 1.1e-85 |
| Protein name | | | | | Locus Name | Acc# |
| | | | | | sp:MCP1_ECOLI | P02942:P76 |

Description
PROTEIN)

| ORF Name | NTID | AAID | NT Length | AA Length | Score | Probability |
|---|---|---|---|---|---|---|
| 6134450_c1_514 | 2737 | 6909 | 68 | 207 | | |
| Protein name | | | | | Locus Name | Acc# |

Description
NO-HIT

| ORF Name | NTID | AAID | NT Length | AA Length | Score | Probability |
|---|---|---|---|---|---|---|
| 6413327_f3_305 | 2738 | 6910 | 68 | 207 | 269 | 2.7e-23 |
| Protein name | | | | | Locus Name | Acc# |
| | | | | | sp:YKDK_ERWCH | P45418 |

Description

HYPOTHETICAL 8.1 KD PROTEIN IN KDGK 5'REGION (K2 ORF)

| ORF Name | NTID | AAID | NT Length | AA Length | Score | Probability |
|---|---|---|---|---|---|---|
| 6442792_f1_91 | 2739 | 6911 | 339 | 1020 | 659 | 1.3e-64 |
| Protein name | | | | | Locus Name | Acc# |
| ferrichrome ABC transporter (permease) homolog yclO | | | | | pir:C69763 | C69763 |

Description

| ORF Name | NTID | AAID | NT Length | AA Length | Score | Probability |
|---|---|---|---|---|---|---|
| 6828382_c1_509 | 2740 | 6912 | 198 | 597 | 714 | 1.9e-70 |
| Protein name | | | | | Locus Name | Acc# |
| | | | | | sp:CYPH_ERWCH | O53021 |

Description

A) (ROTAMASE A) (CYCLOPHILIN A)

| ORF Name | NTID | AAID | NT Length | AA Length | Score | Probability |
|---|---|---|---|---|---|---|
| 6829687_c1_449 | 2741 | 6913 | 289 | 870 | 1109 | 2.7e-112 |
| Protein name | | | | | Locus Name | Acc# |
| | | | | | sp:CELD_ECOLI | P17410 |

Description

CEL OPERON REPRESSOR

| ORF Name | NTID | AAID | NT Length | AA Length | Score | Probability |
|---|---|---|---|---|---|---|
| 6912802_c2_533 | 2742 | 6914 | 279 | 840 | 736 | 8.9e-73 |
| Protein name | | | | | Locus Name | Acc# |
| | | | | | sp:YAEC_ECOLI | P28635 |

Description

PRECURSOR

| ORF_Name | NTID | AAID | NT Length | AA Length | Score | Probability |
|---|---|---|---|---|---|---|
| 7046893_f2_270 | 2743 | 6915 | 202 | 609 | | |
| Protein name | | | | | Locus_Name | Acc# |

Description: NO-HIT

| ORF_Name | NTID | AAID | NT Length | AA Length | Score | Probability |
|---|---|---|---|---|---|---|
| 7214462_c2_571 | 2744 | 6916 | 323 | 972 | 185 | 2.1e-12 |
| Protein name | | | | | Locus_Name | Acc# |
| dihydrodipicolinate synthase | | | | | gp:AF065159 | AF065159 |

Description: Bradyrhizobium japonicum putative arylsulfatase (arsA), putative soluble lytic transglycosylase precursor (sltA), dihydrodipicolinate synthase (dapA), MscL (mscL), SmpB (smpB), BcpB (bcpB), RnpO (rnpO), RelA/SpoT homolog (relA), PdxJ (pdxJ), and acyl carrier protein synthase AcpS (acpS) genes, complete cds; prokaryotic type I signal peptidase SipF (sipF) gene, sipF-sipSallele,

| ORF_Name | NTID | AAID | NT Length | AA Length | Score | Probability |
|---|---|---|---|---|---|---|
| 782580_f3_338 | 2745 | 6917 | 164 | 495 | 591 | 2.1e-57 |
| Protein name | | | | | Locus_Name | Acc# |
| | | | | | sp:GREB_HAEIN | P43882 |

Description: GREB)

| ORF_Name | NTID | AAID | NT Length | AA Length | Score | Probability |
|---|---|---|---|---|---|---|
| 784391_c3_719 | 2746 | 6918 | 581 | 1746 | 237 | 4.5e-18 |
| Protein name | | | | | Locus_Name | Acc# |
| FloA | | | | | gp:PMU82214 | U82214 |

Description: Proteus mirabilis flagella rod protein FlgD (flgD) gene, partial cds, flagella rod proteins FlgC (flgC) and FlgB (flgB), flagella assembly protein FlgA (flgA), anti-sigma factor FlgM (flgM), facilitator of flagella filament assembly FlgN (flgN) and FloA (floA) genes, complete cds.

| ORF Name | NTID | AAID | NT Length | AA Length | Score | Probability |
|---|---|---|---|---|---|---|
| 790880_c2_554 | 2747 | 6919 | 158 | 477 | 346 | 1.9e-31 |
| Protein name | | | | | Locus Name | Acc# |
| | | | | | sp:YHCH_ECOLI | P45424 |
| Description | | | | | | |
| HYPOTHETICAL 17.0 KD PROTEIN IN GLTF-NANT INTERGENIC REGION (F154) | | | | | | |

| ORF Name | NTID | AAID | NT Length | AA Length | Score | Probability |
|---|---|---|---|---|---|---|
| 802187_c3_640 | 2748 | 6920 | 548 | 1647 | 2442 | 1.5e-253 |
| Protein name | | | | | Locus Name | Acc# |
| | | | | | sp:PPCK_ECOLI | P22259 |
| Description | | | | | | |

| ORF Name | NTID | AAID | NT Length | AA Length | Score | Probability |
|---|---|---|---|---|---|---|
| 819657_f1_11 | 2749 | 6921 | 73 | 222 | 116 | 4.5e-07 |
| Protein name | | | | | Locus Name | Acc# |
| hypothetical protein PH0444 | | | | | pir:E71155 | E71155 |
| Description | | | | | | |

| ORF Name | NTID | AAID | NT Length | AA Length | Score | Probability |
|---|---|---|---|---|---|---|
| 839137_f1_19 | 2750 | 6922 | 176 | 531 | 499 | 1.2e-47 |
| Protein name | | | | | Locus Name | Acc# |
| N-formylmethionylaminoacyl-tRNA deformylase, | | | | | pir:S23107 | S23107:S41 |
| Description | | | | | | |

| ORF Name | NTID | AAID | NT Length | AA Length | Score | Probability |
|---|---|---|---|---|---|---|
| 865875_c1_466 | 2751 | 6923 | 392 | 1179 | 239 | 3.4e-18 |
| Protein name | | | | | Locus Name | Acc# |
| aminomethyltransferase | | | | | pir:E72403 | E72403 |
| Description | | | | | | |

641

| ORF_Name | NTID | AAID | NT Length | AA Length | Score | Probability |
|---|---|---|---|---|---|---|
| 892202_c1_441 | 2752 | 6924 | 289 | 870 | 871 | 4.4e-87 |
| Protein name | | | | | Locus Name | Acc# |
| | | | | | sp:YHCI_ECOLI | P45425 |

Description

HYPOTHETICAL 29.6 KD PROTEIN IN GLTF-NANT INTERGENIC REGION

| ORF_Name | NTID | AAID | NT Length | AA Length | Score | Probability |
|---|---|---|---|---|---|---|
| 957257_c2_532 | 2753 | 6925 | 855 | 2568 | 3042 | 0.0 |
| Protein name | | | | | Locus Name | Acc# |
| penicillin-binding protein 1A | | | | | pir:ZPECPA | G65134:A03 |

Description

| ORF_Name | NTID | AAID | NT Length | AA Length | Score | Probability |
|---|---|---|---|---|---|---|
| 962812_c1_442 | 2754 | 6926 | 497 | 1494 | 610 | 2.0e-59 |
| Protein name | | | | | Locus Name | Acc# |
| hypothetical protein | | | | | pir:S75887 | S75887 |

Description

| ORF_Name | NTID | AAID | NT Length | AA Length | Score | Probability |
|---|---|---|---|---|---|---|
| 969087_c1_467 | 2755 | 6927 | 873 | 2622 | 601 | 3.1e-58 |
| Protein name | | | | | Locus Name | Acc# |
| synthase, | | | | | pir:G69842 | G69842 |

Description

| ORF_Name | NTID | AAID | NT Length | AA Length | Score | Probability |
|---|---|---|---|---|---|---|
| 9766968_c1_448 | 2756 | 6928 | 456 | 1371 | 2090 | 3.0e-216 |
| Protein name | | | | | Locus Name | Acc# |
| | | | | | sp:PTCC_ECOLI | P17334:P76 |

Description

PERMEASE IIC COMPONENT) (PHOSPHOTRANSFERASE ENZYME II, C COMPONENT)

| ORF_Name | NTID | AAID | NT Length | AA Length | Score | Probability |
|---|---|---|---|---|---|---|
| 978427_f3_344 | 2757 | 6929 | 280 | 843 | 346 | 1.9e-31 |

| Protein name | | | | | Locus Name | Acc# |
|---|---|---|---|---|---|---|
| glutamine ABC transporter (glutamine-binding protein) glnH | | | | | pir:D69633 | D69633 |

Description

| ORF_Name | NTID | AAID | NT Length | AA Length | Score | Probability |
|---|---|---|---|---|---|---|
| 9948260_f3_405 | 2758 | 6930 | 72 | 219 | | |

| Protein name | | | | | Locus Name | Acc# |
|---|---|---|---|---|---|---|

Description
NO-HIT

| ORF_Name | NTID | AAID | NT Length | AA Length | Score | Probability |
|---|---|---|---|---|---|---|
| 101057_f2_117 | 2759 | 6931 | 146 | 441 | 247 | 1.1e-20 |

| Protein name | | | | | Locus Name | Acc# |
|---|---|---|---|---|---|---|
| | | | | | gp:AB028868 | AB028868 |

Description
Mus musculus P4(21)n mRNA, partial cds.

| ORF_Name | NTID | AAID | NT Length | AA Length | Score | Probability |
|---|---|---|---|---|---|---|
| 10234718_f3_247 | 2760 | 6932 | 564 | 1695 | 1547 | 1.0e-158 |

| Protein name | | | | | Locus Name | Acc# |
|---|---|---|---|---|---|---|
| yabN protein | | | | | pir:E64728 | E64728 |

Description

| ORF_Name | NTID | AAID | NT Length | AA Length | Score | Probability |
|---|---|---|---|---|---|---|
| 10256626_c2_531 | 2761 | 6933 | 255 | 768 | 514 | 3.0e-49 |

| Protein name | | | | | Locus Name | Acc# |
|---|---|---|---|---|---|---|
| | | | | | sp:AGAS_ECOLI | P42907 |

Description
AGAS PROTEIN

| ORF Name | NTID | AAID | NT Length | AA Length | Score | Probability |
|---|---|---|---|---|---|---|
| 10344750_c3_638 | 2762 | 6934 | 444 | 1335 | 1393 | 2.1e-142 |
| Protein name | | | | | Locus Name | Acc# |
| | | | | | sp:AGAZ_ECOLI | P42903 |

Description: PUTATIVE TAGATOSE 6-PHOSPHATE KINASE AGAZ,

| ORF Name | NTID | AAID | NT Length | AA Length | Score | Probability |
|---|---|---|---|---|---|---|
| 10568760_f1_84 | 2763 | 6935 | 63 | 192 | | |
| Protein name | | | | | Locus Name | Acc# |

Description: NO-HIT

| ORF Name | NTID | AAID | NT Length | AA Length | Score | Probability |
|---|---|---|---|---|---|---|
| 10635425_c1_460 | 2764 | 6936 | 94 | 285 | | |
| Protein name | | | | | Locus Name | Acc# |

Description: NO-HIT

| ORF Name | NTID | AAID | NT Length | AA Length | Score | Probability |
|---|---|---|---|---|---|---|
| 10672538_f2_215 | 2765 | 6937 | 98 | 297 | | |
| Protein name | | | | | Locus Name | Acc# |

Description: NO-HIT

| ORF Name | NTID | AAID | NT Length | AA Length | Score | Probability |
|---|---|---|---|---|---|---|
| 10678501_c3_603 | 2766 | 6938 | 442 | 1329 | 1904 | 1.5e-196 |
| Protein name | | | | | Locus Name | Acc# |
| | | | | | sp:INGK_ECOLI | P22937 |

Description: INOSINE-GUANOSINE KINASE,

| ORF Name | NTID | AAID | NT Length | AA Length | Score | Probability |
|---|---|---|---|---|---|---|
| 10681552_f1_39 | 2767 | 6939 | 412 | 1239 | 840 | 8.5e-84 |
| Protein name | | | | | Locus Name | Acc# |
| putative arylsulfatase regulator | | | | | gp:ECOASLAB | M90498 |

Description

Escherichia coli putative arylsulfatase regulator (aslB) and putative arylsulfatase (aslA) genes, complete cds.

| ORF Name | NTID | AAID | NT Length | AA Length | Score | Probability |
|---|---|---|---|---|---|---|
| 11067762_c2_566 | 2768 | 6940 | 135 | 408 | | |
| Protein name | | | | | Locus Name | Acc# |

Description

NO-HIT

| ORF Name | NTID | AAID | NT Length | AA Length | Score | Probability |
|---|---|---|---|---|---|---|
| 11150375_f2_115 | 2769 | 6941 | 178 | 537 | 88 | 0.00072 |
| Protein name | | | | | Locus Name | Acc# |
| | | | | | sp:Y907_HAEIN | P44072 |

Description

HYPOTHETICAL PROTEIN HI0907

| ORF Name | NTID | AAID | NT Length | AA Length | Score | Probability |
|---|---|---|---|---|---|---|
| 11830327_c1_370 | 2770 | 6942 | 225 | 678 | 1015 | 2.4e-102 |
| Protein name | | | | | Locus Name | Acc# |
| SisA | | | | | gp:AF106566 | AF106566 |

Description

Salmonella typhimurium pathogenicity island SPI-3, complete sequence.

| ORF Name | NTID | AAID | NT Length | AA Length | Score | Probability |
|---|---|---|---|---|---|---|
| 1203567_c3_673 | 2771 | 6943 | 904 | 2715 | 3903 | 0.0 |
| Protein name | | | | | Locus Name | Acc# |
| | | | | | sp:SECA_ECOLI | P10408:P75 |

Description

PREPROTEIN TRANSLOCASE SECA SUBUNIT

| ORF Name | NTID | AAID | NT Length | AA Length | Score | Probability |
|---|---|---|---|---|---|---|
| 12275092_f2_179 | 2772 | 6944 | 76 | 231 | | |
| Protein name | | | | | Locus Name | Acc# |
| | | | | | | |

Description
NO-HIT

| ORF Name | NTID | AAID | NT Length | AA Length | Score | Probability |
|---|---|---|---|---|---|---|
| 1270628_c2_565 | 2773 | 6945 | 407 | 1224 | 1589 | 3.6e-163 |
| Protein name | | | | | Locus Name | Acc# |
| | | | | | sp:FTSW_ECOLI | P16457 |

Description
CELL DIVISION PROTEIN FTSW

| ORF Name | NTID | AAID | NT Length | AA Length | Score | Probability |
|---|---|---|---|---|---|---|
| 13063958_c1_414 | 2774 | 6946 | 322 | 969 | 567 | 7.2e-55 |
| Protein name | | | | | Locus Name | Acc# |
| PTS permease for mannose subunit IIBMan | | | | | gp:VFU65015 | U65015 |

Description
Vibrio furnissii PTS permease for mannose subunits IIIMan Cterminal domain (manX), IIPMan (manY), IIBMan (manZ), and IIIManN-terminal domain (manW), GlcNAc-6-P deacetylase (manD) andputative aldolase (manF) genes, complete cds.

| ORF Name | NTID | AAID | NT Length | AA Length | Score | Probability |
|---|---|---|---|---|---|---|
| 13750930_f2_141 | 2775 | 6947 | 883 | 2652 | 2498 | 1.7e-259 |
| Protein name | | | | | Locus Name | Acc# |
| | | | | | sp:YHJO_ECOLI | P37653:P37 |

Description
HYPOTHETICAL 78.6 KD PROTEIN IN DCTA-DPPF INTERGENIC REGION

| ORF Name | NTID | AAID | NT Length | AA Length | Score | Probability |
|---|---|---|---|---|---|---|
| 13769827_f2_174 | 2776 | 6948 | 79 | 240 | 76 | 0.025 |
| Protein name | | | | | Locus Name | Acc# |
| cytochrome b | | | | | gp:AF038884 | AF038884 |

Description: Protobothrops tokarensis cytochrome b (cytb) gene, mitochondrialgene encoding mitochondrial protein, partial cds.

| ORF Name | NTID | AAID | NT Length | AA Length | Score | Probability |
|---|---|---|---|---|---|---|
| 13789762_c2_487 | 2777 | 6949 | 107 | 324 | 216 | 1.9e-16 |
| Protein name | | | | | Locus Name | Acc# |
| | | | | | sp:LPFC_SALTY | P43662 |

Description: OUTER MEMBRANE USHER PROTEIN LPFC PRECURSOR

| ORF Name | NTID | AAID | NT Length | AA Length | Score | Probability |
|---|---|---|---|---|---|---|
| 1382186_c2_503 | 2778 | 6950 | 347 | 1044 | 1126 | 4.2e-114 |
| Protein name | | | | | Locus Name | Acc# |
| | | | | | sp:HEMZ_YEREN | P43413 |

Description: SYNTHETASE)

| ORF Name | NTID | AAID | NT Length | AA Length | Score | Probability |
|---|---|---|---|---|---|---|
| 13869177_c3_671 | 2779 | 6951 | 488 | 1467 | 2039 | 7.5e-211 |
| Protein name | | | | | Locus Name | Acc# |
| | | | | | sp:MURC_ECOLI | P17952:007 |

Description: ACETYLMURANOYL-L-ALANINE SYNTHETASE)

| ORF Name | NTID | AAID | NT Length | AA Length | Score | Probability |
|---|---|---|---|---|---|---|
| 1406277_c3_637 | 2780 | 6952 | 268 | 807 | 602 | 1.4e-58 |
| Protein name | | | | | Locus Name | Acc# |
| | | | | | sp:AGAR_ECOLI | P42902 |

Description: PUTATIVE AGA OPERON TRANSCRIPTIONAL REPRESSOR

| ORF_Name | NTID | AAID | NT Length | AA Length | Score | Probability |
|---|---|---|---|---|---|---|
| 1423885_f1_16 | 2781 | 6953 | 402 | 1209 | 1516 | 2.0e-155 |
| Protein name | | | | | Locus Name | Acc# |
| 3-isopropylmalate dehydrogenase, | | | | | pir:A64729 | A64729:S41 |

Description

| ORF_Name | NTID | AAID | NT Length | AA Length | Score | Probability |
|---|---|---|---|---|---|---|
| 14251578_c2_524 | 2782 | 6954 | 345 | 1038 | 78 | 0.026 |
| Protein name | | | | | Locus Name | Acc# |
| RepH16 | | | | | gp:AF143472 | AF143472 |

Description

Borrelia hermsii plasmid-encoded RepH16 (repH16) and RepH16- (repH16-) genes, complete cds.

| ORF_Name | NTID | AAID | NT Length | AA Length | Score | Probability |
|---|---|---|---|---|---|---|
| 1446887_c2_484 | 2783 | 6955 | 186 | 561 | 317 | 2.2e-28 |
| Protein name | | | | | Locus Name | Acc# |
| papF fimbrial protein precursor:fimbrial protein F11:pyelonephritis-associated pilus F | | | | | pir:JC1295 | JC1295:D27 |

Description

| ORF_Name | NTID | AAID | NT Length | AA Length | Score | Probability |
|---|---|---|---|---|---|---|
| 14492158_f3_324 | 2784 | 6956 | 349 | 1050 | 901 | 2.9e-90 |
| Protein name | | | | | Locus Name | Acc# |
| | | | | | sp:YBBS_ECOLI | P77702 |

Description

HYPOTHETICAL TRANSCRIPTIONAL REGULATOR IN RHSD-GCL INTERGENIC REGION

| ORF_Name | NTID | AAID | NT Length | AA Length | Score | Probability |
|---|---|---|---|---|---|---|
| 14535932_c1_350 | 2785 | 6957 | 323 | 972 | 1353 | 3.7e-138 |
| Protein name | | | | | Locus Name | Acc# |
| sulfate adenylyltransferase, small chain:ATP-sulfurylase:sulfurylase | | | | | pir:D65056 | D65056:JN0 |

Description

| ORF Name | NTID | AAID | NT Length | AA Length | Score | Probability |
|---|---|---|---|---|---|---|
| 14568767_f2_221 | 2786 | 6958 | 874 | 2625 | 3413 | 0.0 |
| Protein name | | | | | Locus Name | Acc# |
| mismatch repair protein | | | | | gp:ECAJ6210 | AJ006210 |

Description

Escherichia coli O157:H7 mutS, o218, yclC, pad1, slyA, rpoS genes.

| ORF Name | NTID | AAID | NT Length | AA Length | Score | Probability |
|---|---|---|---|---|---|---|
| 14572177_c1_450 | 2787 | 6959 | 316 | 951 | 1213 | 2.5e-123 |
| Protein name | | | | | Locus Name | Acc# |
| | | | | | sp:YABC_ECOLI | P18595 |

Description

HYPOTHETICAL 34.9 KD PROTEIN IN FRUR-FTSL INTERGENIC REGION (ORFB)

| ORF Name | NTID | AAID | NT Length | AA Length | Score | Probability |
|---|---|---|---|---|---|---|
| 14646918_f2_220 | 2788 | 6960 | 78 | 237 | | |
| Protein name | | | | | Locus Name | Acc# |

Description

NO-HIT

| ORF Name | NTID | AAID | NT Length | AA Length | Score | Probability |
|---|---|---|---|---|---|---|
| 14649077_f3_257 | 2789 | 6961 | 247 | 744 | 301 | 1.1e-26 |
| Protein name | | | | | Locus Name | Acc# |
| | | | | | sp:YHJQ_ECOLI | P37655 |

Description

HYPOTHETICAL 27.1 KD PROTEIN IN DCTA-DPPF INTERGENIC REGION (F242B)

| ORF Name | NTID | AAID | NT Length | AA Length | Score | Probability |
|---|---|---|---|---|---|---|
| 14665930_f3_300 | 2790 | 6962 | 71 | 216 | 223 | 2.1e-18 |
| Protein name | | | | | Locus Name | Acc# |
| ybcJ protein | | | | | pir:G64784 | G64784 |

Description

| ORF Name | NTID | AAID | NT Length | AA Length | Score | Probability |
|---|---|---|---|---|---|---|
| 14667825_c3_639 | 2791 | 6963 | 167 | 504 | 316 | 2.9e-28 |
| Protein name | | | | | Locus Name | Acc# |
| agaS protein | | | | | pir:T35885 | T35885 |

Description

| ORF Name | NTID | AAID | NT Length | AA Length | Score | Probability |
|---|---|---|---|---|---|---|
| 14881316_c3_626 | 2792 | 6964 | 156 | 471 | 113 | 9.3e-07 |
| Protein name | | | | | Locus Name | Acc# |
| hypothetical protein HI1670 | | | | | pir:G64135 | G64135 |

Description

| ORF Name | NTID | AAID | NT Length | AA Length | Score | Probability |
|---|---|---|---|---|---|---|
| 15032827_c1_363 | 2793 | 6965 | 339 | 1020 | | |
| Protein name | | | | | Locus Name | Acc# |

Description
NO-HIT

| ORF Name | NTID | AAID | NT Length | AA Length | Score | Probability |
|---|---|---|---|---|---|---|
| 157158_f1_68 | 2794 | 6966 | 568 | 1707 | 195 | 6.0e-12 |
| Protein name | | | | | Locus Name | Acc# |
| UspA2 | | | | | gp:AF113609 | AF113609 |

Description
Moraxella catarrhalis strain TTA24 UspA2 (uspA2) gene, complete cds.

| ORF Name | NTID | AAID | NT Length | AA Length | Score | Probability |
|---|---|---|---|---|---|---|
| 15833127_c3_619 | 2795 | 6967 | 81 | 246 | | |
| Protein name | | | | | Locus Name | Acc# |

Description
NO-HIT

650

| ORF Name | NTID | AAID | NT Length | AA Length | Score | Probability |
|---|---|---|---|---|---|---|
| 15836562_c1_415 | 2796 | 6968 | 177 | 534 | 219 | 5.5e-18 |

| Protein name | Locus Name | Acc# |
|---|---|---|
| PTS permease for mannose subunit IIIMan N | gp:VFU65015 | U65015 |

Description

Vibrio furnissii PTS permease for mannose subunits IIIMan Cterminal domain (manX), IIPMan (manY), IIBMan (manZ), and IIIManN-terminal domain (manW), GlcNAc-6-P deacetylase (manD) andputative aldolase (manF) genes, complete cds.

| ORF Name | NTID | AAID | NT Length | AA Length | Score | Probability |
|---|---|---|---|---|---|---|
| 15886_c2_495 | 2797 | 6969 | 63 | 192 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 16036557_c2_517 | 2798 | 6970 | 72 | 219 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 16180413_c3_623 | 2799 | 6971 | 223 | 672 | 127 | 3.4e-06 |

| Protein name | Locus Name | Acc# |
|---|---|---|
| hypothetical protein | gp:BTP901456 | Y14232 |

Description

Bacteriophage TP901-1 ORFs 1-12.

| ORF Name | NTID | AAID | NT Length | AA Length | Score | Probability |
|---|---|---|---|---|---|---|
| 16253385_c2_472 | 2800 | 6972 | 120 | 363 | 333 | 4.5e-30 |

| Protein name | Locus Name | Acc# |
|---|---|---|
| | sp:YGBQ_ECOLI | Q46894 |

Description

HYPOTHETICAL 11.6 KD PROTEIN IN SURE-CYSC INTERGENIC REGION

| ORF Name | NTID | AAID | NT Length | AA Length | Score | Probability |
|---|---|---|---|---|---|---|
| 16407777_f2_156 | 2801 | 6973 | 62 | 189 | 53 | 0.043 |
| Protein name | | | | | Locus Name | Acc# |
| chitinase | | | | | gp:AF098302 | AF098302 |

Description: Brassica juncea chitinase mRNA, complete cds.

| ORF Name | NTID | AAID | NT Length | AA Length | Score | Probability |
|---|---|---|---|---|---|---|
| 16413587_f1_90 | 2802 | 6974 | 62 | 189 | | |
| Protein name | | | | | Locus Name | Acc# |

Description: NO-HIT

| ORF Name | NTID | AAID | NT Length | AA Length | Score | Probability |
|---|---|---|---|---|---|---|
| 16984677_c3_668 | 2803 | 6975 | 603 | 1812 | 2338 | 1.6e-242 |
| Protein name | | | | | Locus Name | Acc# |
| | | | | | sp:PBP3_ECOLI | P04286 |

Description: PENICILLIN-BINDING PROTEIN 3 PRECURSOR (PBP-3)

| ORF Name | NTID | AAID | NT Length | AA Length | Score | Probability |
|---|---|---|---|---|---|---|
| 17007925_c1_448 | 2804 | 6976 | 340 | 1023 | 1459 | 2.2e-149 |
| Protein name | | | | | Locus Name | Acc# |
| | | | | | sp:FRUR_SALTY | P21930 |

Description: FRUCTOSE REPRESSOR (CATABOLITE REPRESSOR/ACTIVATOR)

| ORF Name | NTID | AAID | NT Length | AA Length | Score | Probability |
|---|---|---|---|---|---|---|
| 17009776_f2_163 | 2805 | 6977 | 569 | 1710 | 1031 | 4.9e-104 |
| Protein name | | | | | Locus Name | Acc# |
| arylsulfatase homolog b1498 | | | | | pir:E64903 | E64903 |

Description

| ORF Name | NTID | AAID | NT Length | AA Length | Score | Probability |
|---|---|---|---|---|---|---|
| 19538135_f3_311 | 2806 | 6978 | 320 | 963 | 1229 | 5.1e-125 |
| Protein name | | | | | Locus Name | Acc# |
| | | | | | sp:YBBK_ECOLI | P77367 |

Description

HYPOTHETICAL 33.7 KD PROTEIN IN USHA-TESA INTERGENIC REGION

| ORF Name | NTID | AAID | NT Length | AA Length | Score | Probability |
|---|---|---|---|---|---|---|
| 19692812_f1_43 | 2807 | 6979 | 97 | 294 | 78 | 0.013 |
| Protein name | | | | | Locus Name | Acc# |
| ORF MSV092 hypothetical protein | | | | | gp:AF063866 | AF063866 |

Description

Melanoplus sanguinipes entomopoxvirus, complete genome.

| ORF Name | NTID | AAID | NT Length | AA Length | Score | Probability |
|---|---|---|---|---|---|---|
| 19711502_f1_56 | 2808 | 6980 | 64 | 195 | | |
| Protein name | | | | | Locus Name | Acc# |

Description

NO-HIT

| ORF Name | NTID | AAID | NT Length | AA Length | Score | Probability |
|---|---|---|---|---|---|---|
| 19781256_c3_644 | 2809 | 6981 | 290 | 873 | 995 | 3.2e-100 |
| Protein name | | | | | Locus Name | Acc# |
| | | | | | sp:KDUI_ECOLI | Q46938 |

Description (5-KETO-4-DEOXYURONATE ISOMERASE) (DKI ISOMERASE)

| ORF Name | NTID | AAID | NT Length | AA Length | Score | Probability |
|---|---|---|---|---|---|---|
| 1984462_c2_464 | 2810 | 6982 | 286 | 861 | 843 | 4.1e-84 |
| Protein name | | | | | Locus Name | Acc# |
| | | | | | sp:YGCF_ECOLI | P55139 |

Description

HYPOTHETICAL 25.0 KD PROTEIN IN CYSJ-ENO INTERGENIC REGION (F223)

| ORF Name | NTID | AAID | NT Length | AA Length | Score | Probability |
|---|---|---|---|---|---|---|
| 20181558_f2_175 | 2811 | 6983 | 108 | 327 | | |
| Protein name | | | | | Locus Name | Acc# |
| | | | | | | |

Description: NO-HIT

| ORF Name | NTID | AAID | NT Length | AA Length | Score | Probability |
|---|---|---|---|---|---|---|
| 20202_c2_527 | 2812 | 6984 | 437 | 1314 | 1813 | 6.7e-187 |
| Protein name | | | | | Locus Name | Acc# |
| | | | | | sp:ARB2_ECOLI | P52146 |

Description: ARSENICAL PUMP MEMBRANE PROTEIN

| ORF Name | NTID | AAID | NT Length | AA Length | Score | Probability |
|---|---|---|---|---|---|---|
| 20314050_c1_426 | 2813 | 6985 | 207 | 624 | 732 | 2.4e-72 |
| Protein name | | | | | Locus Name | Acc# |
| | | | | | sp:YCEI_ECOLI | P37904 |

Description: PROTEIN YCEI PRECURSOR

| ORF Name | NTID | AAID | NT Length | AA Length | Score | Probability |
|---|---|---|---|---|---|---|
| 20900333_c2_490 | 2814 | 6986 | 302 | 909 | 409 | 4.0e-38 |
| Protein name | | | | | Locus Name | Acc# |
| hypothetical transcriptional activator | | | | | gp:AF139107 | AF139107 |

Description: Pseudomonas aeruginosa hypothetical multidrug resistance protein(mdr) gene, partial cds; hypothetical transcriptional activator(act) and glutamyl-tRNA synthetase (gltX) genes, complete cds; andtRNA-Ala and tRNA-Glu genes, complete sequence.

| ORF Name | NTID | AAID | NT Length | AA Length | Score | Probability |
|---|---|---|---|---|---|---|
| 20976086_c1_438 | 2815 | 6987 | 648 | 1947 | 2679 | 1.1e-278 |
| Protein name | | | | | Locus Name | Acc# |
| arginine decarboxylase, | | | | | pir:A65079 | A65079:A37 |

Description

| ORF Name | NTID | AAID | NT Length | AA Length | Score | Probability |
|---|---|---|---|---|---|---|
| 212766_c2_544 | 2816 | 6988 | 467 | 1404 | 1159 | 1.3e-117 |
| Protein name | | | | | Locus Name | Acc# |
| | | | | | sp:Y883_HAEIN | P44917 |

Description: HYPOTHETICAL PROTEIN HI0883

| ORF Name | NTID | AAID | NT Length | AA Length | Score | Probability |
|---|---|---|---|---|---|---|
| 21650252_f1_29 | 2817 | 6989 | 467 | 1404 | 1374 | 2.2e-140 |
| Protein name | | | | | Locus Name | Acc# |
| yadQ protein | | | | | pir:C64739 | C64739:S45 |

Description

| ORF Name | NTID | AAID | NT Length | AA Length | Score | Probability |
|---|---|---|---|---|---|---|
| 21651068_f3_313 | 2818 | 6990 | 273 | 822 | 652 | 7.1e-64 |
| Protein name | | | | | Locus Name | Acc# |
| | | | | | sp:YBAP_ECOLI | P77301 |

Description: HYPOTHETICAL 29.9 KD PROTEIN IN USHA-TESA INTERGENIC REGION

| ORF Name | NTID | AAID | NT Length | AA Length | Score | Probability |
|---|---|---|---|---|---|---|
| 21679577_f2_171 | 2819 | 6991 | 295 | 888 | 348 | 1.2e-31 |
| Protein name | | | | | Locus Name | Acc# |
| | | | | | sp:YDDE_ECOLI | P37757:P77 |

Description: HYPOTHETICAL 32.3 KD PROTEIN IN RHSE-NARV INTERGENIC REGION (ORFB)

| ORF Name | NTID | AAID | NT Length | AA Length | Score | Probability |
|---|---|---|---|---|---|---|
| 21681437_c1_437 | 2820 | 6992 | 78 | 237 | | |
| Protein name | | | | | Locus Name | Acc# |

Description: NO-HIT

| ORF Name | NTID | AAID | NT Length | AA Length | Score | Probability |
|---|---|---|---|---|---|---|
| 21698841_c1_368 | 2821 | 6993 | 121 | 366 | 134 | 5.5e-09 |
| Protein name | | | | | Locus Name | Acc# |
| | | | | | gp:PMFIMOPR | Z32686 |

Description: Proteus mirabilis fimbrial operon, strain HI4320.

| ORF Name | NTID | AAID | NT Length | AA Length | Score | Probability |
|---|---|---|---|---|---|---|
| 2189402_f1_34 | 2822 | 6994 | 92 | 279 | | |
| Protein name | | | | | Locus Name | Acc# |

Description: NO-HIT

| ORF Name | NTID | AAID | NT Length | AA Length | Score | Probability |
|---|---|---|---|---|---|---|
| 2189402_f3_275 | 2823 | 6995 | 97 | 294 | | |
| Protein name | | | | | Locus Name | Acc# |

Description: NO-HIT

| ORF Name | NTID | AAID | NT Length | AA Length | Score | Probability |
|---|---|---|---|---|---|---|
| 22054661_f2_130 | 2824 | 6996 | 96 | 291 | 82 | 0.0035 |
| Protein name | | | | | Locus Name | Acc# |
| ORF MSV102 hypothetical protein | | | | | gp:AF063866 | AF063866 |

Description: Melanoplus sanguinipes entomopoxvirus, complete genome.

| ORF Name | NTID | AAID | NT Length | AA Length | Score | Probability |
|---|---|---|---|---|---|---|
| 22454641_f3_310 | 2825 | 6997 | 301 | 906 | 914 | 1.2e-91 |
| Protein name | | | | | Locus Name | Acc# |
| | | | | | sp:YBBN_ECOLI | P77395 |

Description: HYPOTHETICAL 33.1 KD PROTEIN IN USHA-TESA INTERGENIC REGION

| ORF Name | NTID | AAID | NT Length | AA Length | Score | Probability |
|---|---|---|---|---|---|---|
| 22750032_c2_507 | 2826 | 6998 | 144 | 435 | 473 | 6.6e-45 |
| Protein name | | | | | Locus Name | Acc# |
| | | | | | sp:YBBI_ECOLI | P77565 |

Description

HYPOTHETICAL TRANSCRIPTIONAL REGULATOR IN USHA-TESA INTERGENIC REGION

| ORF Name | NTID | AAID | NT Length | AA Length | Score | Probability |
|---|---|---|---|---|---|---|
| 22753408_c2_501 | 2827 | 6999 | 64 | 195 | | |
| Protein name | | | | | Locus Name | Acc# |

Description

NO-HIT

| ORF Name | NTID | AAID | NT Length | AA Length | Score | Probability |
|---|---|---|---|---|---|---|
| 22870637_f3_321 | 2828 | 7000 | 216 | 651 | 246 | 7.5e-21 |
| Protein name | | | | | Locus Name | Acc# |
| response regulator | | | | | gp:PPUY18245 | Y18245 |

Description

Pseudomonas putida todX, todF, todC1, todC2, todB, todA, todD, todE, todG, todI, todH, todS, todT genes.

| ORF Name | NTID | AAID | NT Length | AA Length | Score | Probability |
|---|---|---|---|---|---|---|
| 23475336_c3_645 | 2829 | 7001 | 278 | 837 | 925 | 8.4e-93 |
| Protein name | | | | | Locus Name | Acc# |
| | | | | | sp:KDUD_ECOLI | P37769 |

Description

DEOXYGLUCONATE OXIDOREDUCTASE)

| ORF Name | NTID | AAID | NT Length | AA Length | Score | Probability |
|---|---|---|---|---|---|---|
| 23488842_c3_670 | 2830 | 7002 | 440 | 1323 | 1638 | 2.3e-168 |
| Protein name | | | | | Locus Name | Acc# |
| UDP-N-acetylmuramoylalanine--D-glutamate ligase,:UDP-N-acetylmuramoyl-L-alanyl-D-glutam | | | | | pir:CEECME | S08396:S07 |

Description

| ORF Name | NTID | AAID | NT Length | AA Length | Score | Probability |
|---|---|---|---|---|---|---|
| 23490756_f3_267 | 2831 | 7003 | 93 | 282 | 76 | 0.0077 |
| Protein name | | | | | Locus Name | Acc# |
| | | | | | sp:IMM1_ECOLI | P02985 |

Description: COLICIN E1 IMMUNITY PROTEIN (IMME1) (MICROCIN E1 IMMUNITY PROTEIN)

| ORF Name | NTID | AAID | NT Length | AA Length | Score | Probability |
|---|---|---|---|---|---|---|
| 23553175_f3_270 | 2832 | 7004 | 298 | 897 | 152 | 1.5e-08 |
| Protein name | | | | | Locus Name | Acc# |
| | | | | | sp:YEBK_ECOLI | P46118:P76 |

Description: HYPOTHETICAL 32.0 KD PROTEIN IN PYKA-ZWF INTERGENIC REGION

| ORF Name | NTID | AAID | NT Length | AA Length | Score | Probability |
|---|---|---|---|---|---|---|
| 23616568_c3_575 | 2833 | 7005 | 164 | 495 | 691 | 5.2e-68 |
| Protein name | | | | | Locus Name | Acc# |
| | | | | | sp:YGBB_ECOLI | P36663 |

Description: HYPOTHETICAL 16.9 KD PROTEIN IN SURE-CYSC INTERGENIC REGION (ORF0)

| ORF Name | NTID | AAID | NT Length | AA Length | Score | Probability |
|---|---|---|---|---|---|---|
| 23651387_f2_202 | 2834 | 7006 | 493 | 1482 | 1478 | 2.1e-151 |
| Protein name | | | | | Locus Name | Acc# |
| | | | | | sp:CSCA_ECOLI | P40714 |

Description: SUCROSE-6-PHOSPHATE HYDROLASE, (SUCRASE) (INVERTASE)

| ORF Name | NTID | AAID | NT Length | AA Length | Score | Probability |
|---|---|---|---|---|---|---|
| 23692066_c2_518 | 2835 | 7007 | 126 | 381 | | |
| Protein name | | | | | Locus Name | Acc# |

Description: NO-HIT

| ORF Name | NTID | AAID | NT Length | AA Length | Score | Probability |
|---|---|---|---|---|---|---|
| 2381306_f2_218 | 2836 | 7008 | 90 | 273 | 66 | 0.030 |
| Protein name | | | | | Locus Name | Acc# |
| | | | | | sp:PRTP_HUMAN | P10619 |

Description
(CARBOXYPEPTIDASE C)

| ORF Name | NTID | AAID | NT Length | AA Length | Score | Probability |
|---|---|---|---|---|---|---|
| 23867042_c1_431 | 2837 | 7009 | 65 | 198 | | |
| Protein name | | | | | Locus Name | Acc# |

Description
NO-HIT

| ORF Name | NTID | AAID | NT Length | AA Length | Score | Probability |
|---|---|---|---|---|---|---|
| 23877265_c3_664 | 2838 | 7010 | 77 | 234 | | |
| Protein name | | | | | Locus Name | Acc# |

Description
NO-HIT

| ORF Name | NTID | AAID | NT Length | AA Length | Score | Probability |
|---|---|---|---|---|---|---|
| 23941008_c2_509 | 2839 | 7011 | 254 | 765 | 825 | 3.3e-82 |
| Protein name | | | | | Locus Name | Acc# |
| | | | | | sp:YBBA_ECOLI | P31219:P77 |

Description
HYPOTHETICAL ABC TRANSPORTER ATP-BINDING PROTEIN YBBA

| ORF Name | NTID | AAID | NT Length | AA Length | Score | Probability |
|---|---|---|---|---|---|---|
| 23947187_c3_663 | 2840 | 7012 | 115 | 348 | 122 | 1.0e-07 |
| Protein name | | | | | Locus Name | Acc# |
| unknown | | | | | gp:PAU88088 | U88088:AF0 |

Description
Pseudomonas alcaligenes plasmid pRA2, complete sequence.

| ORF_Name | NTID | AAID | NT Length | AA Length | Score | Probability |
|---|---|---|---|---|---|---|
| 24008462_f1_32 | 2841 | 7013 | 166 | 501 | | |
| Protein name | | | | | Locus Name | Acc# |

Description
NO-HIT

| ORF_Name | NTID | AAID | NT Length | AA Length | Score | Probability |
|---|---|---|---|---|---|---|
| 24017202_c2_521 | 2842 | 7014 | 106 | 321 | | |
| Protein name | | | | | Locus Name | Acc# |

Description
NO-HIT

| ORF_Name | NTID | AAID | NT Length | AA Length | Score | Probability |
|---|---|---|---|---|---|---|
| 24022217_f3_289 | 2843 | 7015 | 197 | 594 | 257 | 5.1e-22 |
| Protein name | | | | | Locus Name | Acc# |
| 4-methyl-5(b-hydroxyethyl)-thiazole monophosphate biosynthesis protein (thiJ) | | | | | pir:D70177 | D70177 |

Description

| ORF_Name | NTID | AAID | NT Length | AA Length | Score | Probability |
|---|---|---|---|---|---|---|
| 24025282_f2_155 | 2844 | 7016 | 295 | 888 | 111 | 0.033 |
| Protein name | | | | | Locus Name | Acc# |
| | | | | | gp:PFMAL3P2 | AL034558:A |

Description
Plasmodium falciparum MAL3P2, complete sequence.

| ORF_Name | NTID | AAID | NT Length | AA Length | Score | Probability |
|---|---|---|---|---|---|---|
| 24038180_c1_458 | 2845 | 7017 | 411 | 1236 | 1740 | 3.6e-179 |
| Protein name | | | | | Locus Name | Acc# |
| cell division protein ftsZ | | | | | pir:CEECZ | G64731:B23 |

Description

| ORF Name | NTID | AAID | NT Length | AA Length | Score | Probability |
|---|---|---|---|---|---|---|
| 24114750_c1_351 | 2846 | 7018 | 65 | 198 | | |
| Protein name | | | | | Locus Name | Acc# |

Description: NO-HIT

| ORF Name | NTID | AAID | NT Length | AA Length | Score | Probability |
|---|---|---|---|---|---|---|
| 24117177_c2_481 | 2847 | 7019 | 634 | 1905 | 1080 | 3.2e-109 |
| Protein name | | | | | Locus Name | Acc# |
| PTS-dependent enzyme II | | | | | gp:CLOABG | L49336 |

Description: Clostridium longisporum methyl-accepting chemotaxis protein (macA), tryptophanyl tRNA synthetase (trsA), abgG, PTS-dependent enzyme II(abgF), phospho-beta-glucosidase (abgA), ORF6 and PII-like protein(glnB) genes, complete cds's.

| ORF Name | NTID | AAID | NT Length | AA Length | Score | Probability |
|---|---|---|---|---|---|---|
| 24220467_c2_485 | 2848 | 7020 | 235 | 708 | 430 | 2.4e-40 |
| Protein name | | | | | Locus Name | Acc# |
| | | | | | sp:FOCC_ECOLI | P46008 |

Description: CHAPERONE PROTEIN FOCC PRECURSOR

| ORF Name | NTID | AAID | NT Length | AA Length | Score | Probability |
|---|---|---|---|---|---|---|
| 24227131_f2_191 | 2849 | 7021 | 271 | 816 | 952 | 1.2e-95 |
| Protein name | | | | | Locus Name | Acc# |
| | | | | | sp:YBBO_ECOLI | P77388 |

Description: (EC 1.-.-.-)

| ORF Name | NTID | AAID | NT Length | AA Length | Score | Probability |
|---|---|---|---|---|---|---|
| 24228437_f1_88 | 2850 | 7022 | 150 | 453 | 416 | 7.3e-39 |
| Protein name | | | | | Locus Name | Acc# |
| | | | | | sp:YJAB_ECOLI | P09163 |

Description: HYPOTHETICAL 16.4 KD PROTEIN IN RRFE-METR INTERGENIC REGION (F147)

661

| ORF Name | NTID | AAID | NT Length | AA Length | Score | Probability |
|---|---|---|---|---|---|---|
| 24276627_c3_600 | 2851 | 7023 | 631 | 1896 | 2659 | 1.5e-276 |
| Protein name | | | | | Locus Name | Acc# |
| | | | | | sp:HTPG_ECOLI | P10413 |

Description: PROTEIN C62.5)

| ORF Name | NTID | AAID | NT Length | AA Length | Score | Probability |
|---|---|---|---|---|---|---|
| 24328900_c2_462 | 2852 | 7024 | 405 | 1218 | 715 | 1.5e-70 |
| Protein name | | | | | Locus Name | Acc# |
| flavoprotein reductase homolog | | | | | pir:E69319 | E69319 |

Description

| ORF Name | NTID | AAID | NT Length | AA Length | Score | Probability |
|---|---|---|---|---|---|---|
| 24410318_c2_548 | 2853 | 7025 | 361 | 1086 | 1279 | 2.6e-130 |
| Protein name | | | | | Locus Name | Acc# |
| | | | | | gp:PSU23806 | U23806 |

Description: Providencia stuartii putative Mg2+ transport protein MgtE (mgtE)gene, complete cds.

| ORF Name | NTID | AAID | NT Length | AA Length | Score | Probability |
|---|---|---|---|---|---|---|
| 24410925_f3_292 | 2854 | 7026 | 73 | 222 | | |
| Protein name | | | | | Locus Name | Acc# |

Description: NO-HIT

| ORF Name | NTID | AAID | NT Length | AA Length | Score | Probability |
|---|---|---|---|---|---|---|
| 24412800_c1_452 | 2855 | 7027 | 502 | 1509 | 1886 | 1.2e-194 |
| Protein name | | | | | Locus Name | Acc# |
| UDP-N-acetylmuramoylalanyl-D-glutamate--2,6-di | | | | | pir:S14384 | S14384:S13 |

Description

| ORF Name | NTID | AAID | NT Length | AA Length | Score | Probability |
|---|---|---|---|---|---|---|
| 24431562_f1_22 | 2856 | 7028 | 64 | 195 | 76 | 0.0077 |
| Protein name | | | | | Locus Name | Acc# |
| | | | | | sp:YHJR_ECOLI | P37656 |

Description
HYPOTHETICAL 7.0 KD PROTEIN IN DCTA-DPPF INTERGENIC REGION (F62)

| ORF Name | NTID | AAID | NT Length | AA Length | Score | Probability |
|---|---|---|---|---|---|---|
| 24648427_c1_427 | 2857 | 7029 | 391 | 1176 | 517 | 1.4e-49 |
| Protein name | | | | | Locus Name | Acc# |
| | | | | | gp:ECU24196 | U24196 |

Description
Escherichia coli ECOR 4 (yciD) gene, partial cds, and (yciC), (yciB), (yciA), membrane protein (tonB), (yciI), putative potassiumchannel (kch), and cardiolipin synthase (cls) genes, complete cds.

| ORF Name | NTID | AAID | NT Length | AA Length | Score | Probability |
|---|---|---|---|---|---|---|
| 24736626_f1_75 | 2858 | 7030 | 63 | 192 | | |
| Protein name | | | | | Locus Name | Acc# |

Description
NO-HIT

| ORF Name | NTID | AAID | NT Length | AA Length | Score | Probability |
|---|---|---|---|---|---|---|
| 24791436_f2_134 | 2859 | 7031 | 487 | 1464 | 2052 | 3.1e-212 |
| Protein name | | | | | Locus Name | Acc# |
| 3-isopropylmalate dehydratase, alpha chain | | | | | pir:H64728 | H64728:S40 |

Description

| ORF Name | NTID | AAID | NT Length | AA Length | Score | Probability |
|---|---|---|---|---|---|---|
| 24798466_c1_401 | 2860 | 7032 | 281 | 846 | 222 | 2.6e-18 |
| Protein name | | | | | Locus Name | Acc# |
| hypothetical protein | | | | | gp:AP000363 | AP000363 |

Description
Bacteriophage VT2-Sa, complete genome sequence.

| ORF Name | NTID | AAID | NT Length | AA Length | Score | Probability |
|---|---|---|---|---|---|---|
| 2532840_f3_327 | 2861 | 7033 | 494 | 1485 | 1169 | 1.2e-118 |
| Protein name | | | | | Locus Name | Acc# |
| 2-oxoglutarate/malate translocator homolog yflS | | | | | pir:F69811 | F69811 |

Description:

| ORF Name | NTID | AAID | NT Length | AA Length | Score | Probability |
|---|---|---|---|---|---|---|
| 25411051_f1_55 | 2862 | 7034 | 89 | 270 | | |
| Protein name | | | | | Locus Name | Acc# |

Description:
NO-HIT

| ORF Name | NTID | AAID | NT Length | AA Length | Score | Probability |
|---|---|---|---|---|---|---|
| 25500702_c1_451 | 2863 | 7035 | 105 | 318 | 390 | 4.1e-36 |
| Protein name | | | | | Locus Name | Acc# |
| | | | | | sp:FTSL_ECOLI | P22187 |

Description:
CELL DIVISION PROTEIN FTSL

| ORF Name | NTID | AAID | NT Length | AA Length | Score | Probability |
|---|---|---|---|---|---|---|
| 25579425_c1_410 | 2864 | 7036 | 486 | 1461 | 1401 | 3.0e-143 |
| Protein name | | | | | Locus Name | Acc# |
| amino acid deaminase | | | | | gp:PMU35383 | U35383 |

Description:
Proteus mirabilis amino acid deaminase (aad) gene, complete cds.

| ORF Name | NTID | AAID | NT Length | AA Length | Score | Probability |
|---|---|---|---|---|---|---|
| 25789212_c2_546 | 2865 | 7037 | 554 | 1665 | 2270 | 2.5e-235 |
| Protein name | | | | | Locus Name | Acc# |
| | | | | | sp:PRIS_ECOLI | P75825 |

Description:
PRISMANE PROTEIN HOMOLOG

| ORF Name | NTID | AAID | NT Length | AA Length | Score | Probability |
|---|---|---|---|---|---|---|
| 25797880_c2_482 | 2866 | 7038 | 198 | 597 | 240 | 3.2e-20 |
| Protein name | | | | | Locus Name | Acc# |
| | | | | | sp:PRSH_ECOLI | P42185 |

Description: PRS FIMBRIAL MINOR PILIN PROTEIN PRECURSOR

| ORF Name | NTID | AAID | NT Length | AA Length | Score | Probability |
|---|---|---|---|---|---|---|
| 25975300_c2_483 | 2867 | 7039 | 244 | 735 | 808 | 2.1e-80 |
| Protein name | | | | | Locus Name | Acc# |
| | | | | | sp:PAPD_ECOLI | P15319 |

Description: CHAPERONE PROTEIN PAPD PRECURSOR

| ORF Name | NTID | AAID | NT Length | AA Length | Score | Probability |
|---|---|---|---|---|---|---|
| 26053_f3_305 | 2868 | 7040 | 244 | 735 | 847 | 1.5e-84 |
| Protein name | | | | | Locus Name | Acc# |
| | | | | | sp:YBBF_ECOLI | P43341:P77 |

Description: HYPOTHETICAL 26.9 KD PROTEIN IN PURE-PPIB INTERGENIC REGION

| ORF Name | NTID | AAID | NT Length | AA Length | Score | Probability |
|---|---|---|---|---|---|---|
| 26229625_c1_362 | 2869 | 7041 | 193 | 582 | 312 | 7.6e-28 |
| Protein name | | | | | Locus Name | Acc# |
| | | | | | sp:PRSK_ECOLI | P42191 |

Description: PROTEIN PRSK PRECURSOR

| ORF Name | NTID | AAID | NT Length | AA Length | Score | Probability |
|---|---|---|---|---|---|---|
| 26297193_c2_492 | 2870 | 7042 | 425 | 1278 | 1657 | 2.3e-170 |
| Protein name | | | | | Locus Name | Acc# |
| | | | | | sp:YLBE_ECOLI | P77129:P75 |

Description: HYPOTHETICAL 45.0 KD PROTEIN IN FDRA-ARCC INTERGENIC REGION (ORF2)

| ORF Name | NTID | AAID | NT Length | AA Length | Score | Probability |
|---|---|---|---|---|---|---|
| 26367077_f3_344 | 2871 | 7043 | 455 | 1368 | 1760 | 2.8e-181 |

| Protein name | Locus Name | Acc# |
|---|---|---|
| Inducible histidine transporter | gp:AF032970 | AF032970 |

Description

Pseudomonas putida inducible histidine transporter (hutT), imidazolone propionate hydrolase (hutI), and N-formylglutamateamidohydrolase (hutG) genes, complete cds; and prolineiminopeptidase (pip1) gene, partial cds.

| ORF Name | NTID | AAID | NT Length | AA Length | Score | Probability |
|---|---|---|---|---|---|---|
| 26367140_c3_597 | 2872 | 7044 | 74 | 225 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26440637_f2_176 | 2873 | 7045 | 70 | 213 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26460765_c3_571 | 2874 | 7046 | 398 | 1197 | 1364 | 2.5e-139 |

| Protein name | Locus Name | Acc# |
|---|---|---|
| L-methionine-alpha-deamino-gamma- | gp:PSEMEGL | L43133 |

Description

Pseudomonas putida methionine gamma-lyase (MEGL-PSEPU) gene, methionine gamma-lyase gene, complete cds.

| ORF Name | NTID | AAID | NT Length | AA Length | Score | Probability |
|---|---|---|---|---|---|---|
| 26461061_f3_316 | 2875 | 7047 | 591 | 1776 | 1998 | 1.7e-206 |

| Protein name | Locus Name | Acc# |
|---|---|---|
| | sp:YBAL_ECOLI | P39830:P52 |

Description

HYPOTHETICAL 59.4 KD PROTEIN IN GSK-FSR INTERGENIC REGION

| ORF Name | NTID | AAID | NT Length | AA Length | Score | Probability |
|---|---|---|---|---|---|---|
| 26681562_c3_665 | 2876 | 7048 | 315 | 948 | 923 | 1.4e-92 |
| Protein name | | | | | Locus Name | Acc# |
| putative transcriptional regulator LeuO | | | | | gp:AF117227 | AF117227 |

Description

Salmonella typhimurium acetohydroxy acid synthase catalytic subunit(ilvI) pseudogene, complete sequence; putative transcriptionalregulator LeuO (leuO) gene, complete cds; and isopropylmalatesynthase (leuA) gene, partial cds.

| ORF Name | NTID | AAID | NT Length | AA Length | Score | Probability |
|---|---|---|---|---|---|---|
| 2820301_f3_294 | 2877 | 7049 | 89 | 270 | | |
| Protein name | | | | | Locus Name | Acc# |

Description

NO-HIT

| ORF Name | NTID | AAID | NT Length | AA Length | Score | Probability |
|---|---|---|---|---|---|---|
| 29343785_c1_447 | 2878 | 7050 | 77 | 234 | | |
| Protein name | | | | | Locus Name | Acc# |

Description

NO-HIT

| ORF Name | NTID | AAID | NT Length | AA Length | Score | Probability |
|---|---|---|---|---|---|---|
| 29350077_c2_564 | 2879 | 7051 | 360 | 1083 | 1671 | 7.4e-172 |
| Protein name | | | | | Locus Name | Acc# |
| | | | | | sp:MRAY_ECOLI | P15876 |

Description (UDP-MURNAC-PENTAPEPTIDE PHOSPHOTRANSFERASE)

| ORF Name | NTID | AAID | NT Length | AA Length | Score | Probability |
|---|---|---|---|---|---|---|
| 29459625_f2_144 | 2880 | 7052 | 189 | 570 | 578 | 4.9e-56 |
| Protein name | | | | | Locus Name | Acc# |
| | | | | | sp:SPRT_ECOLI | P39902 |

Description

SPRT PROTEIN

667

| ORF Name | NTID | AAID | NT Length | AA Length | Score | Probability |
|---|---|---|---|---|---|---|
| 29470655_c3_622 | 2881 | 7053 | 106 | 321 | | |
| Protein name | | | | | Locus Name | Acc# |

Description
NO-HIT

| ORF Name | NTID | AAID | NT Length | AA Length | Score | Probability |
|---|---|---|---|---|---|---|
| 2947127_c1_428 | 2882 | 7054 | 285 | 858 | 698 | 9.5e-69 |
| Protein name | | | | | Locus Name | Acc# |
| | | | | | gp:YP102KB | AL031866 |

Description
Yersinia pestis 102 kbases unstable region: from 1 to 119443.

| ORF Name | NTID | AAID | NT Length | AA Length | Score | Probability |
|---|---|---|---|---|---|---|
| 29484701_c1_384 | 2883 | 7055 | 133 | 402 | 166 | 2.3e-12 |
| Protein name | | | | | Locus Name | Acc# |
| hypothetical protein APE1456 | | | | | pir:H72624 | H72624 |

Description

| ORF Name | NTID | AAID | NT Length | AA Length | Score | Probability |
|---|---|---|---|---|---|---|
| 29729577_c2_512 | 2884 | 7056 | 71 | 216 | 153 | 5.4e-11 |
| Protein name | | | | | Locus Name | Acc# |
| | | | | | gp:ECU82664 | U82664 |

Description
Escherichia coli minutes 9 to 11 genomic sequence.

| ORF Name | NTID | AAID | NT Length | AA Length | Score | Probability |
|---|---|---|---|---|---|---|
| 30265937_c2_502 | 2885 | 7057 | 223 | 672 | 942 | 1.3e-94 |
| Protein name | | | | | Locus Name | Acc# |
| adenylate kinase | | | | | gp:ECU82664 | U82664 |

Description
Escherichia coli minutes 9 to 11 genomic sequence.

| ORF_Name | NTID | AAID | NT Length | AA Length | Score | Probability |
|---|---|---|---|---|---|---|
| 30509628_f2_143 | 2886 | 7058 | 1092 | 3279 | 1847 | 5.9e-214 |
| Protein name | | | | | Locus Name | Acc# |
| hypothetical 126K protein (dctA-dppF intergenic region):hypothetical protein f1165 | | | | pir:E65151 | | E65151:S47 |

Description

| ORF_Name | NTID | AAID | NT Length | AA Length | Score | Probability |
|---|---|---|---|---|---|---|
| 30517200_c1_386 | 2887 | 7059 | 76 | 231 | 129 | 1.9e-08 |
| Protein name | | | | | Locus Name | Acc# |
| hypothetical protein APE1455 | | | | pir:G72624 | | G72624 |

Description

| ORF_Name | NTID | AAID | NT Length | AA Length | Score | Probability |
|---|---|---|---|---|---|---|
| 31334792_f1_1 | 2888 | 7060 | 361 | 1086 | 1794 | 6.9e-185 |
| Protein name | | | | | Locus Name | Acc# |
| | | | | | sp:HLYA_PROMI | P16466 |

Description
HEMOLYSIN PRECURSOR

| ORF_Name | NTID | AAID | NT Length | AA Length | Score | Probability |
|---|---|---|---|---|---|---|
| 31441436_c2_498 | 2889 | 7061 | 338 | 1017 | 1004 | 3.6e-101 |
| Protein name | | | | | Locus Name | Acc# |
| | | | | | sp:CSCR_ECOLI | P40715 |

Description
SUCROSE OPERON REPRESSOR (CSC OPERON REGULATORY PROTEIN)

| ORF_Name | NTID | AAID | NT Length | AA Length | Score | Probability |
|---|---|---|---|---|---|---|
| 31460883_c2_526 | 2890 | 7062 | 119 | 360 | 326 | 2.5e-29 |
| Protein name | | | | | Locus Name | Acc# |
| | | | | | sp:ARSR_ECOLI | P37309 |

Description
ARSENICAL RESISTANCE OPERON REPRESSOR

| ORF Name | NTID | AAID | NT Length | AA Length | Score | Probability |
|---|---|---|---|---|---|---|
| 31539667_c2_475 | 2891 | 7063 | 214 | 645 | 689 | 8.5e-68 |
| Protein name | | | | | Locus Name | Acc# |
| protein-L-isoaspartate(D-aspartate) O-methyltransferase, type II:L-isoaspartyl | | | | | pir:JH0242 | JH0242:PH0 |
| Description | | | | | | |

| ORF Name | NTID | AAID | NT Length | AA Length | Score | Probability |
|---|---|---|---|---|---|---|
| 3156562_c3_655 | 2892 | 7064 | 363 | 1092 | 600 | 2.3e-58 |
| Protein name | | | | | Locus Name | Acc# |
| hypothetical protein slr1772 | | | | | pir:S74628 | S74628 |
| Description | | | | | | |

| ORF Name | NTID | AAID | NT Length | AA Length | Score | Probability |
|---|---|---|---|---|---|---|
| 31757817_f2_131 | 2893 | 7065 | 546 | 1641 | 1982 | 8.2e-205 |
| Protein name | | | | | Locus Name | Acc# |
| 2-isopropylmalate synthase,:alpha-isopropylmalate synthase | | | | | pir:B64729 | B64729:S40 |
| Description | | | | | | |

| ORF Name | NTID | AAID | NT Length | AA Length | Score | Probability |
|---|---|---|---|---|---|---|
| 32050050_c2_563 | 2894 | 7066 | 614 | 1845 | 1677 | 1.7e-172 |
| Protein name | | | | | Locus Name | Acc# |
| | | | | | sp:LCFH_HAEIN | P44446 |
| Description | | | | | | |
| ACYL-COA SYNTHETASE) (LACS) | | | | | | |

| ORF Name | NTID | AAID | NT Length | AA Length | Score | Probability |
|---|---|---|---|---|---|---|
| 32239702_c1_455 | 2895 | 7067 | 360 | 1083 | 1359 | 8.6e-139 |
| Protein name | | | | | Locus Name | Acc# |
| UDP-N-acetylglucosamine--N-acetylmuramyl-(pentapeptide)pyrophosphoryl-undecaprenol | | | | | pir:BVECMG | JQ0544:JH0 |
| Description | | | | | | |

| ORF_Name | NTID | AAID | NT Length | AA Length | Score | Probability |
|---|---|---|---|---|---|---|
| 32245687_c3_617 | 2896 | 7068 | 469 | 1410 | 2033 | 3.2e-210 |
| Protein name | | | | | Locus Name | Acc# |
| | | | | | sp:SYC_ECOLI | P21888 |

Description
(CYSRS)

| ORF_Name | NTID | AAID | NT Length | AA Length | Score | Probability |
|---|---|---|---|---|---|---|
| 32305317_c3_643 | 2897 | 7069 | 394 | 1185 | 712 | 3.1e-70 |
| Protein name | | | | | Locus Name | Acc# |
| | | | | | sp:NAGA_VIBFU | P96166 |

Description
(DEACETYLASE)

| ORF_Name | NTID | AAID | NT Length | AA Length | Score | Probability |
|---|---|---|---|---|---|---|
| 32319200_c3_672 | 2898 | 7070 | 316 | 951 | 1439 | 2.9e-147 |
| Protein name | | | | | Locus Name | Acc# |
| | | | | | sp:LPXC_ECOLI | P07652 |

Description
(EC 3.5.1.-) (ENVA PROTEIN)

| ORF_Name | NTID | AAID | NT Length | AA Length | Score | Probability |
|---|---|---|---|---|---|---|
| 3240877_c1_449 | 2899 | 7071 | 160 | 483 | 599 | 2.9e-58 |
| Protein name | | | | | Locus Name | Acc# |
| | | | | | sp:YABB_ECOLI | P22186 |

Description
HYPOTHETICAL 17.4 KD PROTEIN IN FRUR-FTSL INTERGENIC REGION (ORFC)

| ORF_Name | NTID | AAID | NT Length | AA Length | Score | Probability |
|---|---|---|---|---|---|---|
| 32457937_f3_297 | 2900 | 7072 | 76 | 231 | | |
| Protein name | | | | | Locus Name | Acc# |

Description
NO-HIT

| ORF Name | NTID | AAID | NT Length | AA Length | Score | Probability |
|---|---|---|---|---|---|---|
| 33359437_f2_211 | 2901 | 7073 | 298 | 897 | 373 | 2.6e-34 |

| Protein name | Locus Name | Acc# |
|---|---|---|
| pirin | gp:AF154003 | AF154003 |

Description
Lycopersicon esculentum pirin mRNA, complete cds.

| ORF Name | NTID | AAID | NT Length | AA Length | Score | Probability |
|---|---|---|---|---|---|---|
| 33359625_c2_496 | 2902 | 7074 | 65 | 198 | | |

| Protein name | Locus Name | Acc# |
|---|---|---|
| | | |

Description
NO-HIT

| ORF Name | NTID | AAID | NT Length | AA Length | Score | Probability |
|---|---|---|---|---|---|---|
| 33446955_c1_361 | 2903 | 7075 | 183 | 552 | | |

| Protein name | Locus Name | Acc# |
|---|---|---|
| | | |

Description
NO-HIT

| ORF Name | NTID | AAID | NT Length | AA Length | Score | Probability |
|---|---|---|---|---|---|---|
| 33641261_c1_372 | 2904 | 7076 | 421 | 1266 | 302 | 8.7e-27 |

| Protein name | Locus Name | Acc# |
|---|---|---|
| cis,cis-muconate transport protein MucK | gp:ACU87258 | U87258 |

Description
Acinetobacter sp. ADP1 cis,cis-muconate transport protein MucK(mucK) and electron transfer flavoprotein-ubiquinone oxidoreductasehomolog genes, complete cds.

| ORF Name | NTID | AAID | NT Length | AA Length | Score | Probability |
|---|---|---|---|---|---|---|
| 34022137_c2_532 | 2905 | 7077 | 171 | 516 | 395 | 1.2e-36 |

| Protein name | Locus Name | Acc# |
|---|---|---|
| PTS permease for mannose subunit IIIMan C | gp:VFU65015 | U65015 |

Description
Vibrio furnissii PTS permease for mannose subunits IIIMan Cterminal domain (manX), IIPMan (manY), IIBMan (manZ), and IIIManN-terminal domain (manW), GlcNAc-6-P deacetylase (manD) andputative aldolase (manF) genes, complete cds.

672

| ORF Name | NTID | AAID | NT Length | AA Length | Score | Probability |
|---|---|---|---|---|---|---|
| 34116327_f3_299 | 2906 | 7078 | 290 | 873 | 1261 | 2.1e-128 |
| Protein name | | | | | Locus Name | Acc# |
| methylenetetrahydrofolate dehydrogenase (NADP+), / methenyltetrahydrofolate | | | | | pir:JS0662 | H64784:JS0 |

Description

| ORF Name | NTID | AAID | NT Length | AA Length | Score | Probability |
|---|---|---|---|---|---|---|
| 3417083_f3_330 | 2907 | 7079 | 71 | 216 | | |
| Protein name | | | | | Locus Name | Acc# |

Description

NO-HIT

| ORF Name | NTID | AAID | NT Length | AA Length | Score | Probability |
|---|---|---|---|---|---|---|
| 34180327_c1_365 | 2908 | 7080 | 174 | 525 | 280 | 1.9e-24 |
| Protein name | | | | | Locus Name | Acc# |
| type 1 fimbrial protein pilC precursor:type 1C pilin | | | | | pir:YQEC1C | I76901:A22 |

Description

| ORF Name | NTID | AAID | NT Length | AA Length | Score | Probability |
|---|---|---|---|---|---|---|
| 34563311_c2_525 | 2909 | 7081 | 68 | 207 | | |
| Protein name | | | | | Locus Name | Acc# |

Description

NO-HIT

| ORF Name | NTID | AAID | NT Length | AA Length | Score | Probability |
|---|---|---|---|---|---|---|
| 34643802_c2_557 | 2910 | 7082 | 265 | 798 | 720 | 4.4e-71 |
| Protein name | | | | | Locus Name | Acc# |
| acetoin reductase | | | | | gp:AF098800 | AF098800 |

Description

Klebsiella pneumoniae acetoin reductase (budC) gene, complete cds.

| ORF_Name | NTID | AAID | NT Length | AA Length | Score | Probability |
|---|---|---|---|---|---|---|
| 35339627_c3_621 | 2911 | 7083 | 379 | 1140 | 189 | 3.0e-14 |
| Protein name | | | | | Locus Name | Acc# |
| ash protein:cI protein:cI protein | | | | pir:GABPP4 | | D23878:JW0 |

Description

| ORF_Name | NTID | AAID | NT Length | AA Length | Score | Probability |
|---|---|---|---|---|---|---|
| 35351577_f2_204 | 2912 | 7084 | 226 | 681 | 112 | 3.2e-06 |
| Protein name | | | | | Locus Name | Acc# |
| 2-acylglycerophosphoethanolamine acyltransferase | | | | pir:E70476 | | E70476 |

Description

| ORF_Name | NTID | AAID | NT Length | AA Length | Score | Probability |
|---|---|---|---|---|---|---|
| 35734706_c3_669 | 2913 | 7085 | 472 | 1419 | 1306 | 3.5e-133 |
| Protein name | | | | | Locus Name | Acc# |
| | | | | | sp:MURF_ECOLI | P11880:P77 |

Description (D-ALANYL-D-ALANINE-ADDING ENZYME)

| ORF_Name | NTID | AAID | NT Length | AA Length | Score | Probability |
|---|---|---|---|---|---|---|
| 35937_f2_136 | 2914 | 7086 | 245 | 738 | 872 | 3.5e-87 |
| Protein name | | | | | Locus Name | Acc# |
| | | | | | sp:MUTH_ECOLI | P06722 |

Description

DNA MISMATCH REPAIR PROTEIN MUTH

| ORF_Name | NTID | AAID | NT Length | AA Length | Score | Probability |
|---|---|---|---|---|---|---|
| 36025937_c3_574 | 2915 | 7087 | 496 | 1491 | 1652 | 7.7e-170 |
| Protein name | | | | | Locus Name | Acc# |
| | | | | | sp:CYSN_ECOLI | P23845 |

Description

SULFURYLASE)

| ORF_Name | NTID | AAID | NT Length | AA Length | Score | Probability |
|---|---|---|---|---|---|---|
| 36142286_c1_457 | 2916 | 7088 | 427 | 1284 | 1965 | 5.2e-203 |
| Protein name | | | | | Locus Name | Acc# |
| | | | | | sp:FTSA_ECOLI | P06137:Q47 |

Description

CELL DIVISION PROTEIN FTSA

| ORF_Name | NTID | AAID | NT Length | AA Length | Score | Probability |
|---|---|---|---|---|---|---|
| 36149212_c2_476 | 2917 | 7089 | 379 | 1140 | 897 | 7.8e-90 |
| Protein name | | | | | Locus Name | Acc# |
| | | | | | sp:NLPD_ECOLI | P33648 |

Description

LIPOPROTEIN NLPD PRECURSOR

| ORF_Name | NTID | AAID | NT Length | AA Length | Score | Probability |
|---|---|---|---|---|---|---|
| 36188277_c1_403 | 2918 | 7090 | 76 | 231 | | |
| Protein name | | | | | Locus Name | Acc# |

Description

NO-HIT

| ORF_Name | NTID | AAID | NT Length | AA Length | Score | Probability |
|---|---|---|---|---|---|---|
| 36226017_c1_349 | 2919 | 7091 | 248 | 747 | 952 | 1.2e-95 |
| Protein name | | | | | Locus Name | Acc# |
| 3'-phosphoadenosine 5'-phosphosulfate reductase,:3'-phosphoadenylylsulfate | | | | | pir:C34354 | C34354 |

Description

| ORF_Name | NTID | AAID | NT Length | AA Length | Score | Probability |
|---|---|---|---|---|---|---|
| 36229655_f2_185 | 2920 | 7092 | 360 | 1083 | 1303 | 7.4e-133 |
| Protein name | | | | | Locus Name | Acc# |
| | | | | | sp:PURK_ECOLI | P09029 |

Description (AIR CARBOXYLASE) (AIRC)

| ORF Name | NTID | AAID | NT Length | AA Length | Score | Probability |
|---|---|---|---|---|---|---|
| 36359385_f1_46 | 2921 | 7093 | 210 | 633 | 176 | 6.1e-13 |
| Protein name | | | | | Locus Name | Acc# |
| | | | | | sp:YQKA_BACSU | P54564 |

Description: HYPOTHETICAL 39.0 KD PROTEIN IN GLNQ-ANSR INTERGENIC REGION

| ORF Name | NTID | AAID | NT Length | AA Length | Score | Probability |
|---|---|---|---|---|---|---|
| 36522556_f3_334 | 2922 | 7094 | 266 | 801 | 111 | 0.00054 |
| Protein name | | | | | Locus Name | Acc# |
| | | | | | gp:BPHS1ADNA | Z71579 |

Description: Bacteriophage S2 type A 5.6 kb DNA fragment.

| ORF Name | NTID | AAID | NT Length | AA Length | Score | Probability |
|---|---|---|---|---|---|---|
| 36613760_c2_486 | 2923 | 7095 | 90 | 273 | 201 | 5.0e-16 |
| Protein name | | | | | Locus Name | Acc# |
| Outer membrane USHER protein FimD precursor. | | | | | gp:D90792 | D90792:AB0 |

Description: E.coli genomic DNA, Kohara clone #301(34.0-34.3 min.).

| ORF Name | NTID | AAID | NT Length | AA Length | Score | Probability |
|---|---|---|---|---|---|---|
| 36617277_c2_516 | 2924 | 7096 | 64 | 195 | | |
| Protein name | | | | | Locus Name | Acc# |

Description: NO-HIT

| ORF Name | NTID | AAID | NT Length | AA Length | Score | Probability |
|---|---|---|---|---|---|---|
| 36620343_c3_657 | 2925 | 7097 | 115 | 348 | 87 | 0.0074 |
| Protein name | | | | | Locus Name | Acc# |
| | | | | | sp:YHB0_YEAST | P38748 |

Description: HYPOTHETICAL 67.5 KD PROTEIN IN PRPS4-STE20 INTERGENIC REGION

| ORF Name | NTID | AAID | NT Length | AA Length | Score | Probability |
|---|---|---|---|---|---|---|
| 3914825_c2_480 | 2926 | 7098 | 62 | 189 | | |
| Protein name | | | | | Locus Name | Acc# |

Description
NO-HIT

| ORF Name | NTID | AAID | NT Length | AA Length | Score | Probability |
|---|---|---|---|---|---|---|
| 3938466_f2_178 | 2927 | 7099 | 143 | 432 | | |
| Protein name | | | | | Locus Name | Acc# |

Description
NO-HIT

| ORF Name | NTID | AAID | NT Length | AA Length | Score | Probability |
|---|---|---|---|---|---|---|
| 3945437_c1_371 | 2928 | 7100 | 312 | 939 | 926 | 6.6e-93 |
| Protein name | | | | | Locus Name | Acc# |
| | | | | | sp:ARCC_ECOLI | P37306:P77 |

Description
CARBAMATE KINASE,

| ORF Name | NTID | AAID | NT Length | AA Length | Score | Probability |
|---|---|---|---|---|---|---|
| 3956661_c2_467 | 2929 | 7101 | 586 | 1761 | 2390 | 4.8e-248 |
| Protein name | | | | | Locus Name | Acc# |
| sulfite reductase (NADPH), hemoprotein:sulfite reductase (NADPH) alpha | | | | | pir:RDECSH | G65057:B34 |

Description

| ORF Name | NTID | AAID | NT Length | AA Length | Score | Probability |
|---|---|---|---|---|---|---|
| 4031500_c2_540 | 2930 | 7102 | 81 | 246 | 67 | 0.015 |
| Protein name | | | | | Locus Name | Acc# |
| signal-transducing histidine kinase homolog | | | | | pir:H69275 | H69275 |

Description

| ORF Name | NTID | AAID | NT Length | AA Length | Score | Probability |
|---|---|---|---|---|---|---|
| 4062802_c3_585 | 2931 | 7103 | 75 | 228 | 87 | 0.00076 |
| Protein name | | | | | Locus Name | Acc# |
| focG protein | | | | | pir:I80333 | I80333 |

Description

| ORF Name | NTID | AAID | NT Length | AA Length | Score | Probability |
|---|---|---|---|---|---|---|
| 4063177_c3_587 | 2932 | 7104 | 120 | 363 | 115 | 5.7e-07 |
| Protein name | | | | | Locus Name | Acc# |
| | | | | | gp:PMFIMOPR | Z32686 |

Description

Proteus mirabilis fimbrial operon, strain HI4320.

| ORF Name | NTID | AAID | NT Length | AA Length | Score | Probability |
|---|---|---|---|---|---|---|
| 406581_c1_456 | 2933 | 7105 | 277 | 834 | 851 | 5.8e-85 |
| Protein name | | | | | Locus Name | Acc# |
| | | | | | sp:FTSQ_ECOLI | P06136 |

Description

CELL DIVISION PROTEIN FTSQ

| ORF Name | NTID | AAID | NT Length | AA Length | Score | Probability |
|---|---|---|---|---|---|---|
| 4078207_f1_72 | 2934 | 7106 | 148 | 447 | 470 | 1.4e-44 |
| Protein name | | | | | Locus Name | Acc# |
| transposase homolog A | | | | | gp:HPU95957 | U95957 |

Description

Helicobacter pylori insertion sequence IS606 transposase homologs A(tnpA) and B (tnpB) genes, complete cds.

| ORF Name | NTID | AAID | NT Length | AA Length | Score | Probability |
|---|---|---|---|---|---|---|
| 4084512_c2_514 | 2935 | 7107 | 425 | 1278 | 1340 | 8.8e-137 |
| Protein name | | | | | Locus Name | Acc# |
| CP4-like integrase | | | | | gp:AF071034 | AF071034 |

Description

Escherichia coli L0001 (yicJ) gene, partial cds; tRNA-Sec gene, complete sequence; CP4-like integrase (int), L0004, L0005, L0006, L0007, L0008, L0009, L0010, L0011, L0012, L0013, L0014, L0015, L0016, L0017, L0018 (escF), L0019, L0020 (espB), L0021 (espD), L0022 (espA), L0023 (sepL), L0024 (escD), L0025 (eaeA), L0026 (orfU), L0027 (tir), L0028, L0029, L0030, L0031 (sepQ),

| ORF Name | NTID | AAID | NT Length | AA Length | Score | Probability |
|---|---|---|---|---|---|---|
| 40875_c3_641 | 2936 | 7108 | 256 | 771 | 530 | 6.0e-51 |
| Protein name | | | | | Locus Name | Acc# |
| PTS permease for mannose subunit IIPMan | | | | | gp:VFU65015 | U65015 |

Description

Vibrio furnissii PTS permease for mannose subunits IIIMan Cterminal domain (manX), IIPMan (manY), IIBMan (manZ), and IIIManN-terminal domain (manW), GlcNAc-6-P deacetylase (manD) and putative aldolase (manF) genes, complete cds.

| ORF Name | NTID | AAID | NT Length | AA Length | Score | Probability |
|---|---|---|---|---|---|---|
| 4094378_c3_584 | 2937 | 7109 | 657 | 1974 | 1228 | 6.5e-125 |
| Protein name | | | | | Locus Name | Acc# |
| | | | | | sp:LPFC_SALTY | P43662 |

Description

OUTER MEMBRANE USHER PROTEIN LPFC PRECURSOR

| ORF Name | NTID | AAID | NT Length | AA Length | Score | Probability |
|---|---|---|---|---|---|---|
| 4094630_c1_425 | 2938 | 7110 | 201 | 606 | 630 | 1.5e-61 |
| Protein name | | | | | Locus Name | Acc# |
| probable membrane protein b1057 | | | | | pir:F64848 | F64848 |

Description

| ORF Name | NTID | AAID | NT Length | AA Length | Score | Probability |
|---|---|---|---|---|---|---|
| 4098187_c1_376 | 2939 | 7111 | 331 | 996 | 626 | 4.1e-61 |
| Protein name | | | | | Locus Name | Acc# |
| | | | | | sp:SCRK_SALTY | P26984 |

Description: FRUCTOKINASE,

| ORF Name | NTID | AAID | NT Length | AA Length | Score | Probability |
|---|---|---|---|---|---|---|
| 4101693_f3_273 | 2940 | 7112 | 1025 | 3078 | 674 | 1.1e-65 |
| Protein name | | | | | Locus Name | Acc# |
| lyase 2 | | | | | gp:BNRLYASEII | L42367 |

Description: Bacteroides thetaiotaomicron lyase 2 gene, complete cds.

| ORF Name | NTID | AAID | NT Length | AA Length | Score | Probability |
|---|---|---|---|---|---|---|
| 4103263_f3_304 | 2941 | 7113 | 167 | 504 | 745 | 9.9e-74 |
| Protein name | | | | | Locus Name | Acc# |
| | | | | | sp:CYPB_ECOLI | P23869:P78 |

Description: (ROTAMASE B)

| ORF Name | NTID | AAID | NT Length | AA Length | Score | Probability |
|---|---|---|---|---|---|---|
| 4103376_c2_550 | 2942 | 7114 | 145 | 438 | 244 | 1.2e-20 |
| Protein name | | | | | Locus Name | Acc# |
| hypothetical protein H0549 | | | | | pir:T08261 | T08261:T08 |

Description:

| ORF Name | NTID | AAID | NT Length | AA Length | Score | Probability |
|---|---|---|---|---|---|---|
| 4103428_c3_624 | 2943 | 7115 | 199 | 600 | | |
| Protein name | | | | | Locus Name | Acc# |

Description: NO-HIT

| ORF_Name | NTID | AAID | NT Length | AA Length | Score | Probability |
|---|---|---|---|---|---|---|
| 4119803_c1_377 | 2944 | 7116 | 330 | 993 | 517 | 1.4e-49 |
| Protein name | | | | | Locus_Name | Acc# |
| | | | | | sp:RARD_ECOLI | P27844 |

Description: RARD PROTEIN

| ORF_Name | NTID | AAID | NT Length | AA Length | Score | Probability |
|---|---|---|---|---|---|---|
| 4166513_c2_468 | 2945 | 7117 | 476 | 1431 | 1305 | 4.5e-133 |
| Protein name | | | | | Locus_Name | Acc# |
| sirohaem synthase | | | | | gp:NMCYSG | Y10177 |

Description: N.meningitidis cysG gene.

| ORF_Name | NTID | AAID | NT Length | AA Length | Score | Probability |
|---|---|---|---|---|---|---|
| 4352318_c1_394 | 2946 | 7118 | 816 | 2451 | 2462 | 1.1e-255 |
| Protein name | | | | | Locus_Name | Acc# |
| | | | | | sp:YBBP_ECOLI | P77504 |

Description: HYPOTHETICAL 89.3 KD PROTEIN IN TESA-RHSD INTERGENIC REGION

| ORF_Name | NTID | AAID | NT Length | AA Length | Score | Probability |
|---|---|---|---|---|---|---|
| 4397805_c1_357 | 2947 | 7119 | 63 | 192 | | |
| Protein name | | | | | Locus_Name | Acc# |

Description: NO-HIT

| ORF_Name | NTID | AAID | NT Length | AA Length | Score | Probability |
|---|---|---|---|---|---|---|
| 4428393_c2_523 | 2948 | 7120 | 65 | 198 | | |
| Protein name | | | | | Locus_Name | Acc# |

Description: NO-HIT

| ORF Name | NTID | AAID | NT Length | AA Length | Score | Probability |
|---|---|---|---|---|---|---|
| 4455342_f3_323 | 2949 | 7121 | 315 | 948 | 546 | 1.2e-52 |
| Protein name | | | | | Locus Name | Acc# |
| | | | | | sp:YNBB_ECOLI | P76091:P78 |

Description
HYPOTHETICAL 33.1 KD PROTEIN IN MAOC-ACPD INTERGENIC REGION

| ORF Name | NTID | AAID | NT Length | AA Length | Score | Probability |
|---|---|---|---|---|---|---|
| 4488175_f1_42 | 2950 | 7122 | 236 | 711 | 560 | 4.0e-54 |
| Protein name | | | | | Locus Name | Acc# |
| | | | | | sp:ALKH_HAEIN | P44480 |

Description

| ORF Name | NTID | AAID | NT Length | AA Length | Score | Probability |
|---|---|---|---|---|---|---|
| 4491713_f1_41 | 2951 | 7123 | 287 | 864 | 1053 | 2.3e-106 |
| Protein name | | | | | Locus Name | Acc# |
| putative aldolase | | | | | gp:VFU65015 | U65015 |

Description
Vibrio furnissii PTS permease for mannose subunits IIIMan Cterminal domain (manX), IIPMan (manY), IIBMan (manZ), and IIIManN-terminal domain (manW), GlcNAc-6-P deacetylase (manD) andputative aldolase (manF) genes, complete cds.

| ORF Name | NTID | AAID | NT Length | AA Length | Score | Probability |
|---|---|---|---|---|---|---|
| 4569643_f3_301 | 2952 | 7124 | 316 | 951 | 1257 | 5.5e-128 |
| Protein name | | | | | Locus Name | Acc# |
| | | | | | sp:K1PF_ECOLI | P23539 |

Description
1-PHOSPHOFRUCTOKINASE, (FRUCTOSE 1-PHOSPHATE KINASE)

| ORF Name | NTID | AAID | NT Length | AA Length | Score | Probability |
|---|---|---|---|---|---|---|
| 4687556_f3_328 | 2953 | 7125 | 62 | 189 | | |
| Protein name | | | | | Locus Name | Acc# |

Description
NO-HIT

| ORF Name | NTID | AAID | NT Length | AA Length | Score | Probability |
|---|---|---|---|---|---|---|
| 4692518_c3_569 | 2954 | 7126 | 264 | 795 | 847 | 1.5e-84 |
| Protein name | | | | | Locus Name | Acc# |
| yafD protein | | | | | pir:C64745 | C64745:JS0 |

Description

| ORF Name | NTID | AAID | NT Length | AA Length | Score | Probability |
|---|---|---|---|---|---|---|
| 4695307_f2_153 | 2955 | 7127 | 286 | 861 | 119 | 3.5e-07 |
| Protein name | | | | | Locus Name | Acc# |
| | | | | | sp:YADA_YERPS | P10858 |

Description
INVASIN PRECURSOR (OUTER MEMBRANE ADHESIN)

| ORF Name | NTID | AAID | NT Length | AA Length | Score | Probability |
|---|---|---|---|---|---|---|
| 4699066_c1_461 | 2956 | 7128 | 178 | 537 | 300 | 1.4e-26 |
| Protein name | | | | | Locus Name | Acc# |
| yacA protein | | | | | pir:QQECAA | A64732:B28 |

Description

| ORF Name | NTID | AAID | NT Length | AA Length | Score | Probability |
|---|---|---|---|---|---|---|
| 4720162_f3_272 | 2957 | 7129 | 731 | 2196 | 142 | 1.5e-12 |
| Protein name | | | | | Locus Name | Acc# |
| OmpB | | | | | gp:AF182279 | AF182279 |

Description
Rickettsia felis OmpB (ompB) gene, partial cds.

| ORF Name | NTID | AAID | NT Length | AA Length | Score | Probability |
|---|---|---|---|---|---|---|
| 4720441_f2_139 | 2958 | 7130 | 387 | 1164 | 1836 | 2.4e-189 |
| Protein name | | | | | Locus Name | Acc# |
| | | | | | sp:METK_ECOLI | P04384:P30 |

Description
ADENOSYLTRANSFERASE) (ADOMET SYNTHETASE)

| ORF Name | NTID | AAID | NT Length | AA Length | Score | Probability |
|---|---|---|---|---|---|---|
| 4724143_c1_400 | 2959 | 7131 | 134 | 405 | | |
| Protein name | | | | | Locus Name | Acc# |
| | | | | | | |

Description: NO-HIT

| ORF Name | NTID | AAID | NT Length | AA Length | Score | Probability |
|---|---|---|---|---|---|---|
| 4725651_f1_89 | 2960 | 7132 | 67 | 204 | 48 | 0.027 |
| Protein name | | | | | Locus Name | Acc# |
| | | | | | sp:ARTM_ECOLI | P30862:P77 |

Description: ARGININE TRANSPORT SYSTEM PERMEASE PROTEIN ARTM

| ORF Name | NTID | AAID | NT Length | AA Length | Score | Probability |
|---|---|---|---|---|---|---|
| 4727303_f2_195 | 2961 | 7133 | 163 | 492 | 569 | 4.4e-55 |
| Protein name | | | | | Locus Name | Acc# |
| | | | | | sp:YBAK_SALTY | P37174 |

Description: HYPOTHETICAL 17.0 KD PROTEIN IN USHA 3'REGION

| ORF Name | NTID | AAID | NT Length | AA Length | Score | Probability |
|---|---|---|---|---|---|---|
| 4742268_c1_404 | 2962 | 7134 | 64 | 195 | | |
| Protein name | | | | | Locus Name | Acc# |
| | | | | | | |

Description: NO-HIT

| ORF Name | NTID | AAID | NT Length | AA Length | Score | Probability |
|---|---|---|---|---|---|---|
| 4820463_f2_154 | 2963 | 7135 | 522 | 1569 | 290 | 7.4e-23 |
| Protein name | | | | | Locus Name | Acc# |
| choline sulfatase | | | | | gp:RMU39940 | U39940 |

Description: Sinorhizobium meliloti bet operon, complete sequence.

| ORF_Name | NTID | AAID | NT Length | AA Length | Score | Probability |
|---|---|---|---|---|---|---|
| 4870318_c2_558 | 2964 | 7136 | 116 | 351 | 190 | 6.5e-15 |

| Protein name | Locus Name | Acc# |
|---|---|---|
| | sp:YE19_HAEIN | P44190 |

Description

HYPOTHETICAL PROTEIN HI1419

| ORF_Name | NTID | AAID | NT Length | AA Length | Score | Probability |
|---|---|---|---|---|---|---|
| 4875303_c3_661 | 2965 | 7137 | 572 | 1719 | 1452 | 1.2e-148 |

| Protein name | Locus Name | Acc# |
|---|---|---|
| | sp:YHJU_ECOLI | P37659 |

Description

HYPOTHETICAL 62.0 KD PROTEIN IN DCTA-DPPF INTERGENIC REGION (O559)

| ORF_Name | NTID | AAID | NT Length | AA Length | Score | Probability |
|---|---|---|---|---|---|---|
| 4876593_c2_463 | 2966 | 7138 | 136 | 411 | | |

| Protein name | Locus Name | Acc# |
|---|---|---|
| | | |

Description

NO-HIT

| ORF_Name | NTID | AAID | NT Length | AA Length | Score | Probability |
|---|---|---|---|---|---|---|
| 4877188_c2_488 | 2967 | 7139 | 120 | 363 | 149 | 1.4e-10 |

| Protein name | Locus Name | Acc# |
|---|---|---|
| S fimbrial adhesin minor subunit SfaS | pir:B49233 | B49233 |

Description

| ORF_Name | NTID | AAID | NT Length | AA Length | Score | Probability |
|---|---|---|---|---|---|---|
| 4881553_c2_489 | 2968 | 7140 | 329 | 990 | 207 | 5.9e-15 |

| Protein name | Locus Name | Acc# |
|---|---|---|
| | sp:MRKD_KLEPN | P21648 |

Description

FIMBRIA ADHESIN PROTEIN PRECURSOR

| ORF Name | NTID | AAID | NT Length | AA Length | Score | Probability |
|---|---|---|---|---|---|---|
| 4885068_c1_378 | 2969 | 7141 | 402 | 1209 | 1398 | 6.3e-143 |
| Protein name | | | | | Locus Name | Acc# |
| phosphoribosylglycinamide formyltransferase, 2, purT:GAR transformylase:glycinamide | | | | | pir:A54227 | A54227:A64 |

Description: Streptomyces coelicolor cosmid F91.

| ORF Name | NTID | AAID | NT Length | AA Length | Score | Probability |
|---|---|---|---|---|---|---|
| 4885263_f1_40 | 2970 | 7142 | 494 | 1485 | 355 | 1.1e-30 |
| Protein name | | | | | Locus Name | Acc# |
| hypothetical protein SCF91.24. | | | | | gp:SCF91 | AL132973 |

Description: Streptomyces coelicolor cosmid F91.

| ORF Name | NTID | AAID | NT Length | AA Length | Score | Probability |
|---|---|---|---|---|---|---|
| 4894050_f3_248 | 2971 | 7143 | 61 | 186 | | |
| Protein name | | | | | Locus Name | Acc# |

Description: NO-HIT

| ORF Name | NTID | AAID | NT Length | AA Length | Score | Probability |
|---|---|---|---|---|---|---|
| 4899162_c2_522 | 2972 | 7144 | 355 | 1068 | 115 | 0.00067 |
| Protein name | | | | | Locus Name | Acc# |
| AbiD1 | | | | | gp:AF116286 | AF116286:L |

Description: Lactococcus lactis plasmid pIL105, complete plasmid sequence.

| ORF Name | NTID | AAID | NT Length | AA Length | Score | Probability |
|---|---|---|---|---|---|---|
| 507813_f2_193 | 2973 | 7145 | 1011 | 3036 | 3120 | 0.0 |
| Protein name | | | | | Locus Name | Acc# |
| | | | | | sp:ATCU_ECOLI | Q59385:P78 |

Description: PROBABLE COPPER-TRANSPORTING ATPASE,

686

| ORF Name | NTID | AAID | NT Length | AA Length | Score | Probability |
|---|---|---|---|---|---|---|
| 5084693_c3_576 | 2974 | 7146 | 257 | 774 | 930 | 2.5e-93 |
| Protein name | | | | | Locus Name | Acc# |
| | | | | | gp:ECU29579 | U29579 |

Description: Escherichia coli K-12 genome; approximately 61 to 62 minutes.

| ORF Name | NTID | AAID | NT Length | AA Length | Score | Probability |
|---|---|---|---|---|---|---|
| 5104588_c1_353 | 2975 | 7147 | 332 | 999 | 1361 | 5.3e-139 |
| Protein name | | | | | Locus Name | Acc# |
| RpoS | | | | | gp:AF198628 | AF198628 |

Description: Xenorhabdus nematophilus NlpD (nlpD) gene, partial cds; RpoS (rpoS) gene, complete cds; and MiaE (miaE) gene, partial cds.

| ORF Name | NTID | AAID | NT Length | AA Length | Score | Probability |
|---|---|---|---|---|---|---|
| 5105057_f1_14 | 2976 | 7148 | 92 | 279 | | |
| Protein name | | | | | Locus Name | Acc# |

Description: NO-HIT

| ORF Name | NTID | AAID | NT Length | AA Length | Score | Probability |
|---|---|---|---|---|---|---|
| 5109677_f2_206 | 2977 | 7149 | 275 | 828 | 122 | 5.3e-07 |
| Protein name | | | | | Locus Name | Acc# |
| hypothetical protein | | | | | pir:E72241 | E72241 |

Description:

| ORF Name | NTID | AAID | NT Length | AA Length | Score | Probability |
|---|---|---|---|---|---|---|
| 5129702_c1_380 | 2978 | 7150 | 475 | 1428 | 1724 | 1.8e-177 |
| Protein name | | | | | Locus Name | Acc# |
| hypothetical protein b1432 | | | | | pir:C64895 | C64895 |

Description:

| ORF Name | NTID | AAID | NT Length | AA Length | Score | Probability |
|---|---|---|---|---|---|---|
| 5196887_f2_147 | 2979 | 7151 | 505 | 1518 | 1204 | 2.3e-122 |
| Protein name | | | | | Locus Name | Acc# |
| | | | | | sp:DHAL_VIBCH | P23240 |

Description
ALDEHYDE DEHYDROGENASE,

| ORF Name | NTID | AAID | NT Length | AA Length | Score | Probability |
|---|---|---|---|---|---|---|
| 5255058_c3_581 | 2980 | 7152 | 289 | 870 | 598 | 3.8e-58 |
| Protein name | | | | | Locus Name | Acc# |
| | | | | | sp:LICT_BACSU | P39805 |

Description
TRANSCRIPTION ANTITERMINATOR LICT

| ORF Name | NTID | AAID | NT Length | AA Length | Score | Probability |
|---|---|---|---|---|---|---|
| 5289816_f1_63 | 2981 | 7153 | 347 | 1044 | 1123 | 8.7e-114 |
| Protein name | | | | | Locus Name | Acc# |
| | | | | | sp:YNAI_ECOLI | P77253 |

Description
HYPOTHETICAL 38.8 KD PROTEIN IN MPPA-FNR INTERGENIC REGION

| ORF Name | NTID | AAID | NT Length | AA Length | Score | Probability |
|---|---|---|---|---|---|---|
| 5346932_f2_186 | 2982 | 7154 | 434 | 1305 | 209 | 4.0e-14 |
| Protein name | | | | | Locus Name | Acc# |
| unknown | | | | | gp:AF119621 | AF119621 |

Description
Pseudomonas abietaniphila BKME-9 DitI (ditI), dioxygenase DitAoxygenase component small subunit (ditA2), dioxygenase DitAoxygenase component large subunit (ditA1), DitH (ditH), DitG(ditG), DitF (ditF), DitR (ditR), DitE (ditE), DitD (ditD), aromatic diterpenoid extradiol ring-cleavage dioygenase (ditC), DitB (ditB), and dioxygenase DitA ferredoxin component (ditA3) genes,

| ORF Name | NTID | AAID | NT Length | AA Length | Score | Probability |
|---|---|---|---|---|---|---|
| 558461_c1_358 | 2983 | 7155 | 279 | 840 | 275 | 1.2e-23 |
| Protein name | | | | | Locus Name | Acc# |
| | | | | | gp:ATAC006436 | AC006436 |

Description
Arabidopsis thaliana chromosome II BAC F13J11 genomic sequence, complete sequence.

| ORF Name | NTID | AAID | NT Length | AA Length | Score | Probability |
|---|---|---|---|---|---|---|
| 572510_f1_17 | 2984 | 7156 | 213 | 642 | 803 | 7.1e-80 |
| Protein name | | | | | Locus Name | Acc# |
| | | | | | sp:LEUD_SALTY | P04787 |

Description
(ISOPROPYLMALATE ISOMERASE) (ALPHA-IPM ISOMERASE)

| ORF Name | NTID | AAID | NT Length | AA Length | Score | Probability |
|---|---|---|---|---|---|---|
| 5859385_f3_322 | 2985 | 7157 | 228 | 687 | 147 | 2.3e-10 |
| Protein name | | | | | Locus Name | Acc# |
| | | | | | gp:D85081 | D85081 |

Description
Escherichia coli gene, replication terminus region, partial and complete cds.

| ORF Name | NTID | AAID | NT Length | AA Length | Score | Probability |
|---|---|---|---|---|---|---|
| 5861430_c2_493 | 2986 | 7158 | 286 | 861 | 246 | 2.8e-31 |
| Protein name | | | | | Locus Name | Acc# |
| | | | | | sp:YLBF_ECOLI | P77518 |

Description
HYPOTHETICAL 29.6 KD PROTEIN IN FDRA-ARCC INTERGENIC REGION

| ORF Name | NTID | AAID | NT Length | AA Length | Score | Probability |
|---|---|---|---|---|---|---|
| 5864385_f2_172 | 2987 | 7159 | 244 | 735 | 110 | 0.00016 |
| Protein name | | | | | Locus Name | Acc# |
| | | | | | sp:FM1A_SERMA | P22595 |

Description
TYPE-1 FIMBRIAL PROTEIN SUBUNIT PRECURSOR

| ORF Name | NTID | AAID | NT Length | AA Length | Score | Probability |
|---|---|---|---|---|---|---|
| 587826_f3_309 | 2988 | 7160 | 210 | 633 | 617 | 3.6e-60 |

| Protein name | | | | | Locus Name | Acc# |
|---|---|---|---|---|---|---|
| | | | | | sp:TESA_ECOLI | P29679;P77 |

Description: (LYSOPHOSPHOLIPASE L1), (LECITHINASE B)

| ORF Name | NTID | AAID | NT Length | AA Length | Score | Probability |
|---|---|---|---|---|---|---|
| 5976715_f3_288 | 2989 | 7161 | 326 | 981 | 710 | 5.1e-70 |

| Protein name | | | | | Locus Name | Acc# |
|---|---|---|---|---|---|---|
| | | | | | sp:KDGK_HAEIN | P44482 |

Description: DEOXYGLUCONOKINASE) (3-DEOXY-2-OXO-D-GLUCONATE KINASE) (KDG KINASE)

| ORF Name | NTID | AAID | NT Length | AA Length | Score | Probability |
|---|---|---|---|---|---|---|
| 6063956_f1_112 | 2990 | 7162 | 156 | 471 | 114 | 1.8e-06 |

| Protein name | | | | | Locus Name | Acc# |
|---|---|---|---|---|---|---|
| hypothetical protein PH0221 | | | | | pir:D71245 | D71245 |

Description

| ORF Name | NTID | AAID | NT Length | AA Length | Score | Probability |
|---|---|---|---|---|---|---|
| 6142917_c2_474 | 2991 | 7163 | 362 | 1089 | 1006 | 2.2e-101 |

| Protein name | | | | | Locus Name | Acc# |
|---|---|---|---|---|---|---|
| | | | | | sp:YGBO_ECOLI | Q57261 |

Description: HYPOTHETICAL 39.1 KD PROTEIN IN SURE-CYSC INTERGENIC REGION

| ORF Name | NTID | AAID | NT Length | AA Length | Score | Probability |
|---|---|---|---|---|---|---|
| 6151687_c3_586 | 2992 | 7164 | 169 | 510 | 212 | 3.0e-17 |

| Protein name | | | | | Locus Name | Acc# |
|---|---|---|---|---|---|---|
| fimbrial protein precursor b1503 | | | | | pir:B64904 | B64904 |

Description

| ORF_Name | NTID | AAID | NT Length | AA Length | Score | Probability |
|---|---|---|---|---|---|---|
| 6415665_c1_402 | 2993 | 7165 | 77 | 234 | | |
| Protein name | | | | | Locus Name | Acc# |

Description

NO-HIT

| ORF_Name | NTID | AAID | NT Length | AA Length | Score | Probability |
|---|---|---|---|---|---|---|
| 665907_c3_608 | 2994 | 7166 | 555 | 1668 | 2118 | 3.2e-219 |
| Protein name | | | | | Locus Name | Acc# |
| UDP-sugar hydrolase precursor | | | | | gp:AF068226 | AF068226 |

Description

Enterobacter aerogenes UDP-sugar hydrolase precursor (ushA) gene, complete cds.

| ORF_Name | NTID | AAID | NT Length | AA Length | Score | Probability |
|---|---|---|---|---|---|---|
| 6726382_c2_471 | 2995 | 7167 | 226 | 681 | 671 | 6.9e-66 |
| Protein name | | | | | Locus Name | Acc# |
| adenylylsulfate kinase, precursor | | | | | pir:B65056 | B65056:JN0 |

Description

| ORF_Name | NTID | AAID | NT Length | AA Length | Score | Probability |
|---|---|---|---|---|---|---|
| 6738452_f3_234 | 2996 | 7168 | 89 | 270 | | |
| Protein name | | | | | Locus Name | Acc# |

Description

NO-HIT

| ORF_Name | NTID | AAID | NT Length | AA Length | Score | Probability |
|---|---|---|---|---|---|---|
| 6742167_c1_348 | 2997 | 7169 | 642 | 1929 | 1901 | 3.2e-196 |
| Protein name | | | | | Locus Name | Acc# |
| sulfite reductase (NADPH), flavoprotein beta chain | | | | | pir:H65057 | H65057:B34 |

Description

| ORF Name | NTID | AAID | NT Length | AA Length | Score | Probability |
|---|---|---|---|---|---|---|
| 6767552_c2_491 | 2998 | 7170 | 569 | 1710 | 1659 | 1.4e-170 |
| Protein name | | | | | Locus Name | Acc# |
| | | | | | sp:FDRA_ECOLI | Q47208 |

Description

FDRA PROTEIN

| ORF Name | NTID | AAID | NT Length | AA Length | Score | Probability |
|---|---|---|---|---|---|---|
| 6917153_f1_106 | 2999 | 7171 | 125 | 378 | 568 | 5.7e-55 |
| Protein name | | | | | Locus Name | Acc# |
| | | | | | sp:PTPS_ECOLI | Q46903 |

Description (PTP SYNTHASE)

| ORF Name | NTID | AAID | NT Length | AA Length | Score | Probability |
|---|---|---|---|---|---|---|
| 7038381_c1_430 | 3000 | 7172 | 110 | 333 | 161 | 7.6e-12 |
| Protein name | | | | | Locus Name | Acc# |
| | | | | | gp:ABCARRA | X70360 |

Description

A.brasilense carR gene.

| ORF Name | NTID | AAID | NT Length | AA Length | Score | Probability |
|---|---|---|---|---|---|---|
| 7042590_c2_534 | 3001 | 7173 | 369 | 1110 | 203 | 7.3e-14 |
| Protein name | | | | | Locus Name | Acc# |
| probable di-trans,poly-cis-decaprenylcistransferase, | | | | | pir:A69991 | A69991 |

Description

| ORF Name | NTID | AAID | NT Length | AA Length | Score | Probability |
|---|---|---|---|---|---|---|
| 7086540_c3_662 | 3002 | 7174 | 334 | 1005 | 1353 | 3.7e-138 |
| Protein name | | | | | Locus Name | Acc# |
| | | | | | sp:SPEB_ECOLI | P16936 |

Description

AGMATINASE, (AGMATINE UREOHYDROLASE) (AUH)

| ORF_Name | NTID | AAID | NT Length | AA Length | Score | Probability |
|---|---|---|---|---|---|---|
| 7272013_f2_142 | 3003 | 7175 | 769 | 2310 | 2010 | 8.9e-208 |
| Protein name | | | | | Locus Name | Acc# |
| | | | | | sp:YHJN_ECOLI | P37652 |
| Description | | | | | | |
| (F779) | | | | | | |

| ORF_Name | NTID | AAID | NT Length | AA Length | Score | Probability |
|---|---|---|---|---|---|---|
| 792800_c1_360 | 3004 | 7176 | 843 | 2532 | 2362 | 4.4e-245 |
| Protein name | | | | | Locus Name | Acc# |
| | | | | | sp:PAPC_ECOLI | P07110 |
| Description | | | | | | |
| OUTER MEMBRANE USHER PROTEIN PAPC PRECURSOR | | | | | | |

| ORF_Name | NTID | AAID | NT Length | AA Length | Score | Probability |
|---|---|---|---|---|---|---|
| 796877_c1_359 | 3005 | 7177 | 125 | 378 | 106 | 5.1e-06 |
| Protein name | | | | | Locus Name | Acc# |
| conserved hypothetical protein | | | | | pir:E72348 | E72348 |
| Description | | | | | | |

| ORF_Name | NTID | AAID | NT Length | AA Length | Score | Probability |
|---|---|---|---|---|---|---|
| 814451_c3_658 | 3006 | 7178 | 150 | 453 | 146 | 3.0e-10 |
| Protein name | | | | | Locus Name | Acc# |
| cytochrome b homolog:protein H0554:protein H0554 | | | | | pir:T08263 | T08263:T08 |
| Description | | | | | | |

| ORF_Name | NTID | AAID | NT Length | AA Length | Score | Probability |
|---|---|---|---|---|---|---|
| 817127_c2_549 | 3007 | 7179 | 121 | 366 | 184 | 2.8e-14 |
| Protein name | | | | | Locus Name | Acc# |
| | | | | | sp:HLYU_VIBCH | P52695 |
| Description | | | | | | |
| TRANSCRIPTIONAL ACTIVATOR HLYU | | | | | | |

| ORF_Name | NTID | AAID | NT Length | AA Length | Score | Probability |
|---|---|---|---|---|---|---|
| 891881_c2_515 | 3008 | 7180 | 86 | 261 | 145 | 3.8e-10 |

| Protein name | | | | | Locus Name | Acc# |
|---|---|---|---|---|---|---|
| hypothetical protein | | | | | pir:T17447 | T17447 |

Description
hypothetical protein — pir:T17447

| ORF_Name | NTID | AAID | NT Length | AA Length | Score | Probability |
|---|---|---|---|---|---|---|
| 911592_f3_274 | 3009 | 7181 | 1028 | 3087 | 642 | 3.8e-62 |

| Protein name | | | | | Locus Name | Acc# |
|---|---|---|---|---|---|---|
| lyase 2 | | | | | gp:BNRLYASEII | L42367 |

Description
Bacteroides thetaiotaomicron lyase 2 gene, complete cds.

| ORF_Name | NTID | AAID | NT Length | AA Length | Score | Probability |
|---|---|---|---|---|---|---|
| 953752_c3_627 | 3010 | 7182 | 65 | 198 | | |

| Protein name | | | | | Locus Name | Acc# |
|---|---|---|---|---|---|---|
| | | | | | | |

Description
NO-HIT

| ORF_Name | NTID | AAID | NT Length | AA Length | Score | Probability |
|---|---|---|---|---|---|---|
| 964186_f2_192 | 3011 | 7183 | 178 | 537 | 366 | 1.4e-33 |

| Protein name | | | | | Locus Name | Acc# |
|---|---|---|---|---|---|---|
| | | | | | gp:ECU82664 | U82664 |

Description
Escherichia coli minutes 9 to 11 genomic sequence.

| ORF_Name | NTID | AAID | NT Length | AA Length | Score | Probability |
|---|---|---|---|---|---|---|
| 970637_c3_628 | 3012 | 7184 | 236 | 711 | | |

| Protein name | | | | | Locus Name | Acc# |
|---|---|---|---|---|---|---|
| | | | | | | |

Description
NO-HIT

| ORF Name | NTID | AAID | NT Length | AA Length | Score | Probability | |
|---|---|---|---|---|---|---|---|
| 9770000_c1_407 | 3013 | 7185 | 66 | 201 | | | |
| Protein name | | | | | Locus Name | | Acc# |

Description

NO-HIT

| ORF Name | NTID | AAID | NT Length | AA Length | Score | Probability | |
|---|---|---|---|---|---|---|---|
| 9773433_f2_216 | 3014 | 7186 | 321 | 966 | 787 | 3.5e-78 | |
| Protein name | | | | | Locus Name | | Acc# |
| hypothetical protein | | | | | gp:AF088897 | | AF088897:A |

Description

Zymomonas mobilis cosmid clone 65G3, partial sequence.

| ORF Name | NTID | AAID | NT Length | AA Length | Score | Probability | |
|---|---|---|---|---|---|---|---|
| 9817968_c1_405 | 3015 | 7187 | 919 | 2760 | 417 | 6.2e-35 | |
| Protein name | | | | | Locus Name | | Acc# |
| | | | | | sp:PRIM_BPP4 | | P10277 |

Description

PUTATIVE P4-SPECIFIC DNA PRIMASE,

| ORF Name | NTID | AAID | NT Length | AA Length | Score | Probability | |
|---|---|---|---|---|---|---|---|
| 984750_c2_473 | 3016 | 7188 | 261 | 786 | 642 | 8.2e-63 | |
| Protein name | | | | | Locus Name | | Acc# |
| | | | | | sp:YGBP_ECOLI | | Q46893 |

Description

HYPOTHETICAL 25.7 KD PROTEIN IN SURE-CYSC INTERGENIC REGION

| ORF Name | NTID | AAID | NT Length | AA Length | Score | Probability | |
|---|---|---|---|---|---|---|---|
| 9853428_f3_306 | 3017 | 7189 | 174 | 525 | 644 | 5.0e-63 | |
| Protein name | | | | | Locus Name | | Acc# |
| | | | | | sp:PUR6_ECOLI | | P09028 |

Description (EC 4.1.1.21) (AIR CARBOXYLASE) (AIRC)

| ORF Name | NTID | AAID | NT Length | AA Length | Score | Probability |
|---|---|---|---|---|---|---|
| 9922125_c2_547 | 3018 | 7190 | 353 | 1062 | 941 | 1.7e-94 |//
| Protein name | | | | | Locus Name | Acc# |
| I | | | | | gp:D90724 | D90724:AB0 |

Description

Escherichia coli genomic DNA. (19.4 - 19.8 min).

| ORF Name | NTID | AAID | NT Length | AA Length | Score | Probability |
|---|---|---|---|---|---|---|
| 9928453_c3_602 | 3019 | 7191 | 415 | 1248 | 679 | 9.8e-67 |
| Protein name | | | | | Locus Name | Acc# |
| chain length determinant | | | | | gp:YPU13685 | U13685 |

Description

Yersinia pseudotuberculosis chain length determinant (wzz) gene, complete cds, and guanosine kinase (gsk) gene, partial cds.

| ORF Name | NTID | AAID | NT Length | AA Length | Score | Probability |
|---|---|---|---|---|---|---|
| 9953166_c3_582 | 3020 | 7192 | 195 | 588 | 918 | 4.6e-92 |
| Protein name | | | | | Locus Name | Acc# |
| | | | | | gp:PMPMPA | X77611 |

Description

P.mirabilis (IVB219) PmpA gene.

| ORF Name | NTID | AAID | NT Length | AA Length | Score | Probability |
|---|---|---|---|---|---|---|
| 10426955_c3_111 | 3021 | 7193 | 200 | 603 | 817 | 2.3e-81 |
| Protein name | | | | | Locus Name | Acc# |
| ribosomal protein L6 | | | | | pir:R5EC6 | D65123:A02 |

Description

| ORF Name | NTID | AAID | NT Length | AA Length | Score | Probability |
|---|---|---|---|---|---|---|
| 1063160_f2_22 | 3022 | 7194 | 221 | 666 | 649 | 1.5e-63 |
| Protein name | | | | | Locus Name | Acc# |
| | | | | | sp:YRDA_ECOLI | P45770 |

Description

HYPOTHETICAL 28.4 KD PROTEIN IN RRND-AROE INTERGENIC REGION (O256)

| ORF Name | NTID | AAID | NT Length | AA Length | Score | Probability |
|---|---|---|---|---|---|---|
| 10720327_c1_83 | 3023 | 7195 | 87 | 264 | 187 | 1.3e-14 |ини
| Protein name | | | | | Locus Name | Acc# |
| | | | | | sp:YRDB_ECOLI | P45795 |

Description
HYPOTHETICAL 10.0 KD PROTEIN IN RRND-AROE INTERGENIC REGION (F85)

| ORF Name | NTID | AAID | NT Length | AA Length | Score | Probability |
|---|---|---|---|---|---|---|
| 11728931_f1_1 | 3024 | 7196 | 72 | 219 | | |
| Protein name | | | | | Locus Name | Acc# |

Description
NO-HIT

| ORF Name | NTID | AAID | NT Length | AA Length | Score | Probability |
|---|---|---|---|---|---|---|
| 1281305_c3_103 | 3025 | 7197 | 116 | 351 | 547 | 9.5e-53 |
| Protein name | | | | | Locus Name | Acc# |
| | | | | | sp:RS10_HAEIN | P44378 |

Description
30S RIBOSOMAL PROTEIN S10

| ORF Name | NTID | AAID | NT Length | AA Length | Score | Probability |
|---|---|---|---|---|---|---|
| 14656713_c2_87 | 3026 | 7198 | 213 | 642 | 980 | 1.2e-98 |
| Protein name | | | | | Locus Name | Acc# |
| | | | | | sp:RL3_ECOLI | P02386 |

Description
50S RIBOSOMAL PROTEIN L3

| ORF Name | NTID | AAID | NT Length | AA Length | Score | Probability |
|---|---|---|---|---|---|---|
| 15837790_c3_121 | 3027 | 7199 | 387 | 1164 | 600 | 3.9e-67 |
| Protein name | | | | | Locus Name | Acc# |
| | | | | | sp:SMF_ECOLI | P30852:P76 |

Description
SMF PROTEIN

| ORF Name | NTID | AAID | NT Length | AA Length | Score | Probability |
|---|---|---|---|---|---|---|
| 16510390_c1_82 | 3028 | 7200 | 205 | 618 | 707 | 1.1e-69 |

Protein name | | | | | Locus Name | Acc#
| | | | | | sp:YRDC_ECOLI | P45748 |

Description: HYPOTHETICAL 20.8 KD PROTEIN IN AROE-SMG INTERGENIC REGION

| ORF Name | NTID | AAID | NT Length | AA Length | Score | Probability |
|---|---|---|---|---|---|---|
| 16835317_c3_105 | 3029 | 7201 | 276 | 831 | 1368 | 9.5e-140 |

Protein name: ribosomal protein L2

Locus Name: pir:R5EC2    Acc#: E23129:A02

Description:

| ORF Name | NTID | AAID | NT Length | AA Length | Score | Probability |
|---|---|---|---|---|---|---|
| 20197336_c2_101 | 3030 | 7202 | 285 | 858 | 754 | 1.1e-74 |

Protein name | | | | | Locus Name | Acc#
| | | | | | sp:AROE_ECOLI | P15770 |

Description: SHIKIMATE 5-DEHYDROGENASE,

| ORF Name | NTID | AAID | NT Length | AA Length | Score | Probability |
|---|---|---|---|---|---|---|
| 22068830_c3_104 | 3031 | 7203 | 215 | 648 | 950 | 1.9e-95 |

Protein name | | | | | Locus Name | Acc#
| | | | | | sp:RL4_YERPS | P11253 |

Description: 50S RIBOSOMAL PROTEIN L4

| ORF Name | NTID | AAID | NT Length | AA Length | Score | Probability |
|---|---|---|---|---|---|---|
| 22113442_f3_52 | 3032 | 7204 | 66 | 201 | | |

Protein name | | | | | Locus Name | Acc#

Description: NO-HIT

| ORF Name | NTID | AAID | NT Length | AA Length | Score | Probability |
|---|---|---|---|---|---|---|
| 22893880_c1_73 | 3033 | 7205 | 116 | 351 | 502 | 5.6e-48 |

Protein name: ribosomal protein L24

Locus Name: pir:R5EC24    Acc#: H65123:A02

Description

| ORF Name | NTID | AAID | NT Length | AA Length | Score | Probability |
|---|---|---|---|---|---|---|
| 23552216_c3_109 | 3034 | 7206 | 127 | 384 | 592 | 1.6e-57 |

Protein name

Locus Name: sp:RL14_ECOLI    Acc#: P02411

Description: 50S RIBOSOMAL PROTEIN L14

| ORF Name | NTID | AAID | NT Length | AA Length | Score | Probability |
|---|---|---|---|---|---|---|
| 23572211_c3_114 | 3035 | 7207 | 441 | 1326 | 2101 | 2.0e-217 |

Protein name

Locus Name: sp:SECY_ECOLI    Acc#: P03844

Description: PREPROTEIN TRANSLOCASE SECY SUBUNIT

| ORF Name | NTID | AAID | NT Length | AA Length | Score | Probability |
|---|---|---|---|---|---|---|
| 24353432_c3_115 | 3036 | 7208 | 130 | 393 | 665 | 3.0e-65 |

Protein name: ribosomal protein S11

Locus Name: pir:R3EC11    Acc#: B23807:A02

Description

| ORF Name | NTID | AAID | NT Length | AA Length | Score | Probability |
|---|---|---|---|---|---|---|
| 24414211_f3_50 | 3037 | 7209 | 320 | 963 | 1148 | 2.0e-116 |

Protein name: methionyl-tRNA formyltransferase,

Locus Name: pir:S23108    Acc#: S23108:C65

Description

| ORF_Name | NTID | AAID | NT Length | AA Length | Score | Probability |
|---|---|---|---|---|---|---|
| 24641525_f3_51 | 3038 | 7210 | 424 | 1275 | 1564 | 1.6e-160 |
| Protein name | | | | | Locus Name | Acc# |
| | | | | | sp:SUN_ECOLI | P36929:P23 |

Description

SUN PROTEIN (FMU PROTEIN)

| ORF_Name | NTID | AAID | NT Length | AA Length | Score | Probability |
|---|---|---|---|---|---|---|
| 24848562_c1_68 | 3039 | 7211 | 166 | 501 | 697 | 1.2e-68 |
| Protein name | | | | | Locus Name | Acc# |
| bacterioferritin | | | | | gp:AF058451 | AF058451 |

Description

Serratia marcescens elongation factor EF-Tu (tufA) gene, partialcds; YheAp (yheA) and bacterioferritin (bfr) genes, complete cds;and ribosomal protein S10 (rpsJ) gene, partial cds.

| ORF_Name | NTID | AAID | NT Length | AA Length | Score | Probability |
|---|---|---|---|---|---|---|
| 25500018_c2_100 | 3040 | 7212 | 136 | 411 | 599 | 2.9e-58 |
| Protein name | | | | | Locus Name | Acc# |
| | | | | | sp:RL17_ECOLI | P02416 |

Description

50S RIBOSOMAL PROTEIN L17

| ORF_Name | NTID | AAID | NT Length | AA Length | Score | Probability |
|---|---|---|---|---|---|---|
| 259713_c2_94 | 3041 | 7213 | 145 | 438 | 657 | 2.1e-64 |
| Protein name | | | | | Locus Name | Acc# |
| | | | | | sp:RL15_ACYKS | P46185 |

Description

50S RIBOSOMAL PROTEIN L15

| ORF_Name | NTID | AAID | NT Length | AA Length | Score | Probability |
|---|---|---|---|---|---|---|
| 26304707_f3_53 | 3042 | 7214 | 61 | 186 | | |
| Protein name | | | | | Locus Name | Acc# |

Description

NO-HIT

700

| ORF Name | NTID | AAID | NT Length | AA Length | Score | Probability |
|---|---|---|---|---|---|---|
| 26445161_c1_79 | 3043 | 7215 | 335 | 1008 | 1613 | 1.0e-165 |
| Protein name | | | | | Locus Name | Acc# |
| | | | | | sp:RPOA_ECOLI | P00574 |

Description

ALPHA CHAIN) (RNA POLYMERASE ALPHA SUBUNIT)

| ORF Name | NTID | AAID | NT Length | AA Length | Score | Probability |
|---|---|---|---|---|---|---|
| 30755438_c1_72 | 3044 | 7216 | 89 | 270 | 393 | 2.0e-36 |
| Protein name | | | | | Locus Name | Acc# |
| ribosomal protein S17 | | | | | pir:R3EC17 | A37519:A02 |

Description

| ORF Name | NTID | AAID | NT Length | AA Length | Score | Probability |
|---|---|---|---|---|---|---|
| 31415930_c3_117 | 3045 | 7217 | 138 | 417 | 498 | 1.5e-47 |
| Protein name | | | | | Locus Name | Acc# |
| | | | | | sp:ZNTR_ECOLI | P36676 |

Description

ZN(II)-RESPONSIVE REGULATOR OF ZNTA

| ORF Name | NTID | AAID | NT Length | AA Length | Score | Probability |
|---|---|---|---|---|---|---|
| 31698415_f3_49 | 3046 | 7218 | 67 | 204 | | |
| Protein name | | | | | Locus Name | Acc# |

Description

NO-HIT

| ORF Name | NTID | AAID | NT Length | AA Length | Score | Probability |
|---|---|---|---|---|---|---|
| 32134658_c2_89 | 3047 | 7219 | 93 | 282 | 471 | 1.1e-44 |
| Protein name | | | | | Locus Name | Acc# |
| ribosomal protein S19 | | | | | pir:R3EC19 | F23129:A02 |

Description

| ORF_Name | NTID | AAID | NT Length | AA Length | Score | Probability |
|---|---|---|---|---|---|---|
| 3214193_c3_108 | 3048 | 7220 | 140 | 423 | 664 | 3.8e-65 |
| Protein name | | | | | Locus Name | Acc# |
| | | | | | sp:RL16_ECOLI | P02414 |

Description
50S RIBOSOMAL PROTEIN L16

| ORF_Name | NTID | AAID | NT Length | AA Length | Score | Probability |
|---|---|---|---|---|---|---|
| 34072932_c1_77 | 3049 | 7221 | 60 | 183 | | |
| Protein name | | | | | Locus Name | Acc# |

Description
NO-HIT

| ORF_Name | NTID | AAID | NT Length | AA Length | Score | Probability |
|---|---|---|---|---|---|---|
| 34417067_c1_74 | 3050 | 7222 | 132 | 399 | 621 | 1.4e-60 |
| Protein name | | | | | Locus Name | Acc# |
| ribosomal protein S8 | | | | | pir:R3EC8 | E65123:A02 |

Description

| ORF_Name | NTID | AAID | NT Length | AA Length | Score | Probability |
|---|---|---|---|---|---|---|
| 34611513_c3_116 | 3051 | 7223 | 212 | 639 | 999 | 1.2e-100 |
| Protein name | | | | | Locus Name | Acc# |
| ribosomal protein S4 | | | | | pir:R3EC4 | C23807:A02 |

Description

| ORF_Name | NTID | AAID | NT Length | AA Length | Score | Probability |
|---|---|---|---|---|---|---|
| 35235942_c2_93 | 3052 | 7224 | 66 | 201 | 270 | 2.1e-23 |
| Protein name | | | | | Locus Name | Acc# |
| | | | | | sp:RL30_ACYKS | P46184 |

Description
50S RIBOSOMAL PROTEIN L30

| ORF Name | NTID | AAID | NT Length | AA Length | Score | Probability |
|---|---|---|---|---|---|---|
| 35282943_c2_88 | 3053 | 7225 | 104 | 315 | 472 | 8.5e-45 |
| Protein name | | | | | Locus Name | Acc# |
| | | | | | sp:RL23_ECOLI | P02424 |

Description
50S RIBOSOMAL PROTEIN L23

| ORF Name | NTID | AAID | NT Length | AA Length | Score | Probability |
|---|---|---|---|---|---|---|
| 36113332_f3_64 | 3054 | 7226 | 79 | 240 | 165 | 2.9e-12 |
| Protein name | | | | | Locus Name | Acc# |
| | | | | | sp:YC72_MAIZE | Q37082 |

Description
HYPOTHETICAL 14.9 KD PROTEIN YCF72 (ORF137)

| ORF Name | NTID | AAID | NT Length | AA Length | Score | Probability |
|---|---|---|---|---|---|---|
| 3906713_c3_118 | 3055 | 7227 | 70 | 213 | 243 | 1.6e-20 |
| Protein name | | | | | Locus Name | Acc# |
| | | | | | sp:YHDL_ECOLI | P36675 |

Description
HYPOTHETICAL 8.1 KD PROTEIN IN MSCL-RPLQ INTERGENIC REGION

| ORF Name | NTID | AAID | NT Length | AA Length | Score | Probability |
|---|---|---|---|---|---|---|
| 3962968_f2_28 | 3056 | 7228 | 138 | 417 | 529 | 7.7e-51 |
| Protein name | | | | | Locus Name | Acc# |
| | | | | | sp:MSCL_ERWCA | O68284 |

Description
LARGE-CONDUCTANCE MECHANOSENSITIVE CHANNEL

| ORF Name | NTID | AAID | NT Length | AA Length | Score | Probability |
|---|---|---|---|---|---|---|
| 4020268_c3_112 | 3057 | 7229 | 120 | 363 | 528 | 9.8e-51 |
| Protein name | | | | | Locus Name | Acc# |
| | | | | | sp:RL18_ECOLI | P02419 |

Description
50S RIBOSOMAL PROTEIN L18

| ORF Name | NTID | AAID | NT Length | AA Length | Score | Probability |
|---|---|---|---|---|---|---|
| 477290_c2_86 | 3058 | 7230 | 80 | 243 | 175 | 2.5e-13 |
| Protein name | | | | | Locus Name | Acc# |
| | | | | | sp:BFD_SERMA | O68934 |

Description: BACTERIOFERRITIN-ASSOCIATED FERREDOXIN

| ORF Name | NTID | AAID | NT Length | AA Length | Score | Probability |
|---|---|---|---|---|---|---|
| 480316_c3_107 | 3059 | 7231 | 273 | 822 | 1152 | 7.4e-117 |
| Protein name | | | | | Locus Name | Acc# |
| ribosomal protein S3 | | | | | pir:R3EC3 | H23129:A02 |

Description

| ORF Name | NTID | AAID | NT Length | AA Length | Score | Probability |
|---|---|---|---|---|---|---|
| 4807768_c3_122 | 3060 | 7232 | 188 | 567 | 602 | 1.4e-58 |
| Protein name | | | | | Locus Name | Acc# |
| | | | | | sp:YRDD_ECOLI | P45771 |

Description: HYPOTHETICAL 18.6 KD PROTEIN IN AROE-SMG INTERGENIC REGION (F169)

| ORF Name | NTID | AAID | NT Length | AA Length | Score | Probability |
|---|---|---|---|---|---|---|
| 5197063_f1_6 | 3061 | 7233 | 461 | 1386 | 1969 | 2.0e-203 |
| Protein name | | | | | Locus Name | Acc# |
| | | | | | sp:TRKA_ECOLI | P23868:P77 |

Description: TRK SYSTEM POTASSIUM UPTAKE PROTEIN TRKA

| ORF Name | NTID | AAID | NT Length | AA Length | Score | Probability |
|---|---|---|---|---|---|---|
| 5289213_c1_70 | 3062 | 7234 | 113 | 342 | 508 | 1.3e-48 |
| Protein name | | | | | Locus Name | Acc# |
| | | | | | sp:RL22_ECOLI | P02423 |

Description: 50S RIBOSOMAL PROTEIN L22

| ORF Name | NTID | AAID | NT Length | AA Length | Score | Probability |
|---|---|---|---|---|---|---|
| 6064788_c2_90 | 3063 | 7235 | 67 | 204 | 289 | 2.1e-25 |
| Protein name | | | | | Locus Name | Acc# |
| | | | | | sp:RL29_ECOLI | P02429 |

Description: 50S RIBOSOMAL PROTEIN L29

| ORF Name | NTID | AAID | NT Length | AA Length | Score | Probability |
|---|---|---|---|---|---|---|
| 6136518_c3_113 | 3064 | 7236 | 171 | 516 | 724 | 1.7e-71 |
| Protein name | | | | | Locus Name | Acc# |
| | | | | | sp:RS5_ECOLI | P02356 |

Description: 30S RIBOSOMAL PROTEIN S5

| ORF Name | NTID | AAID | NT Length | AA Length | Score | Probability |
|---|---|---|---|---|---|---|
| 6676963_c2_97 | 3065 | 7237 | 121 | 366 | 524 | 2.6e-50 |
| Protein name | | | | | Locus Name | Acc# |
| ribosomal protein S13 | | | | | pir:R3EC13 | A23807:A02 |

Description

| ORF Name | NTID | AAID | NT Length | AA Length | Score | Probability |
|---|---|---|---|---|---|---|
| 6775252_f1_5 | 3066 | 7238 | 172 | 519 | 725 | 1.3e-71 |
| Protein name | | | | | Locus Name | Acc# |
| N-formylmethionylaminoacyl-tRNA deformylase, | | | | | pir:S23107 | S23107:S41 |

Description

| ORF Name | NTID | AAID | NT Length | AA Length | Score | Probability |
|---|---|---|---|---|---|---|
| 917793_c2_92 | 3067 | 7239 | 105 | 318 | 480 | 1.2e-45 |
| Protein name | | | | | Locus Name | Acc# |
| ribosomal protein S14 | | | | | pir:R3EC14 | F65123:A02 |

Description

| ORF Name | NTID | AAID | NT Length | AA Length | Score | Probability |
|---|---|---|---|---|---|---|
| 9975003_c2_91 | 3068 | 7240 | 205 | 618 | 889 | 5.5e-89 |
| Protein name | | | | | Locus Name | Acc# |
| | | | | | sp:RL5_ACYKS | P46178 |

Description
50S RIBOSOMAL PROTEIN L5

| ORF Name | NTID | AAID | NT Length | AA Length | Score | Probability |
|---|---|---|---|---|---|---|
| 10343752_f1_30 | 3069 | 7241 | 559 | 1680 | 976 | 3.3e-98 |
| Protein name | | | | | Locus Name | Acc# |
| | | | | | sp:ADHE_ECOLI | P17547 |

Description

| ORF Name | NTID | AAID | NT Length | AA Length | Score | Probability |
|---|---|---|---|---|---|---|
| 11040928_c2_215 | 3070 | 7242 | 631 | 1896 | 2444 | 9.1e-254 |
| Protein name | | | | | Locus Name | Acc# |
| | | | | | sp:EDD_ECOLI | P25530 |

Description
DEHYDRATASE)

| ORF Name | NTID | AAID | NT Length | AA Length | Score | Probability |
|---|---|---|---|---|---|---|
| 11796931_f2_81 | 3071 | 7243 | 68 | 207 | | |
| Protein name | | | | | Locus Name | Acc# |

Description
NO-HIT

| ORF Name | NTID | AAID | NT Length | AA Length | Score | Probability |
|---|---|---|---|---|---|---|
| 1195313_c2_172 | 3072 | 7244 | 65 | 198 | | |
| Protein name | | | | | Locus Name | Acc# |

Description
NO-HIT

| ORF Name | NTID | AAID | NT Length | AA Length | Score | Probability |
|---|---|---|---|---|---|---|
| 13947312_f2_54 | 3073 | 7245 | 448 | 1347 | 1892 | 2.8e-195 |
| Protein name | | | | | Locus Name | Acc# |
| | | | | | sp:YHAO_ECOLI | P42628 |

Description

HYPOTHETICAL 46.6 KD PROTEIN IN EXUR-TDCC INTERGENIC REGION (F425)

| ORF Name | NTID | AAID | NT Length | AA Length | Score | Probability |
|---|---|---|---|---|---|---|
| 14495927_f3_119 | 3074 | 7246 | 113 | 342 | 235 | 1.1e-19 |
| Protein name | | | | | Locus Name | Acc# |
| quaternary ammonium compound-resistance protein | | | | | gp:SSY16945 | Y16945 |

Description

Staphylococcus saprophyticus plasmid pST2H6 qacH and rep2H6 genes.

| ORF Name | NTID | AAID | NT Length | AA Length | Score | Probability |
|---|---|---|---|---|---|---|
| 14495957_c3_238 | 3075 | 7247 | 147 | 444 | | |
| Protein name | | | | | Locus Name | Acc# |

Description

NO-HIT

| ORF Name | NTID | AAID | NT Length | AA Length | Score | Probability |
|---|---|---|---|---|---|---|
| 14564092_c3_268 | 3076 | 7248 | 460 | 1383 | 1578 | 5.3e-162 |
| Protein name | | | | | Locus Name | Acc# |
| | | | | | sp:AK3_ECOLI | P08660 |

Description

III)

| ORF Name | NTID | AAID | NT Length | AA Length | Score | Probability |
|---|---|---|---|---|---|---|
| 14648388_f1_12 | 3077 | 7249 | 1249 | 3750 | 5013 | 0.0 |
| Protein name | | | | | Locus Name | Acc# |
| 5-methyltetrahydrofolate--homocysteine S-methyltransferase,:methionine | | | | | pir:XYECMH | B65209:JH0 |

Description

| ORF_Name | NTID | AAID | NT Length | AA Length | Score | Probability |
|---|---|---|---|---|---|---|
| 14651876_c3_253 | 3078 | 7250 | 90 | 273 | 118 | 2.8e-07 |
| Protein name | | | | | Locus Name | Acc# |
| hypothetical protein APE0042 | | | | | pir:E72756 | E72756 |

Description

| ORF_Name | NTID | AAID | NT Length | AA Length | Score | Probability |
|---|---|---|---|---|---|---|
| 15759625_c2_173 | 3079 | 7251 | 85 | 258 | 155 | 3.3e-11 |
| Protein name | | | | | Locus Name | Acc# |
| | | | | | sp:MXIH_SHIFL | Q06079 |

Description

MXIH PROTEIN

| ORF_Name | NTID | AAID | NT Length | AA Length | Score | Probability |
|---|---|---|---|---|---|---|
| 16212802_f2_86 | 3080 | 7252 | 429 | 1290 | 1133 | 7.6e-115 |
| Protein name | | | | | Locus Name | Acc# |
| putative ATPase | | | | | gp:AF005744 | AF005744 |

Description

Yersinia enterocolitica inner membrane transporter homolog (ysaA), Spa15 homolog (ysaK) and putative ATPase (ysaL) genes, complete cds.

| ORF_Name | NTID | AAID | NT Length | AA Length | Score | Probability |
|---|---|---|---|---|---|---|
| 16578428_f1_27 | 3081 | 7253 | 336 | 1011 | 775 | 6.6e-77 |
| Protein name | | | | | Locus Name | Acc# |
| membrane protein yddG | | | | | pir:D64900 | D64900 |

Description

| ORF_Name | NTID | AAID | NT Length | AA Length | Score | Probability |
|---|---|---|---|---|---|---|
| 16984377_c2_198 | 3082 | 7254 | 111 | 336 | 151 | 8.8e-11 |
| Protein name | | | | | Locus Name | Acc# |
| | | | | | gp:PMFIMOPR | Z32686 |

Description

Proteus mirabilis fimbrial operon, strain HI4320.

| ORF Name | NTID | AAID | NT Length | AA Length | Score | Probability |
|---|---|---|---|---|---|---|
| 1959682_c1_137 | 3083 | 7255 | 66 | 201 | | |
| Protein name | | | | | Locus Name | Acc# |
| | | | | | | |

Description
NO-HIT

| ORF Name | NTID | AAID | NT Length | AA Length | Score | Probability |
|---|---|---|---|---|---|---|
| 19688760_c1_158 | 3084 | 7256 | 231 | 696 | 141 | 1.1e-06 |
| Protein name | | | | | Locus Name | Acc# |
| hypothetical protein MAL4P2.17 | | | | | gp:PFMAL4P2 | AL035475 |

Description
Plasmodium falciparum MAL4P2, complete sequence.

| ORF Name | NTID | AAID | NT Length | AA Length | Score | Probability |
|---|---|---|---|---|---|---|
| 20093937_c2_176 | 3085 | 7257 | 377 | 1134 | 392 | 2.5e-36 |
| Protein name | | | | | Locus Name | Acc# |
| | | | | | sp:Y894_HAEIN | Q57500 |

Description
HYPOTHETICAL PROTEIN HI0894

| ORF Name | NTID | AAID | NT Length | AA Length | Score | Probability |
|---|---|---|---|---|---|---|
| 20329383_c2_209 | 3086 | 7258 | 64 | 195 | | |
| Protein name | | | | | Locus Name | Acc# |

Description
NO-HIT

| ORF Name | NTID | AAID | NT Length | AA Length | Score | Probability |
|---|---|---|---|---|---|---|
| 20883510_c3_270 | 3087 | 7259 | 287 | 864 | 959 | 2.1e-96 |
| Protein name | | | | | Locus Name | Acc# |
| acetate operon repressor | | | | | pir:RPECIR | A65209:A35 |

Description

| ORF Name | NTID | AAID | NT Length | AA Length | Score | Probability |
|---|---|---|---|---|---|---|
| 22150252_f3_102 | 3088 | 7260 | 450 | 1353 | 692 | 4.1e-68 |
| Protein name | | | | | Locus Name | Acc# |
| | | | | | sp:YHAM_ECOLI | P42626 |

Description: HYPOTHETICAL 19.4 KD PROTEIN IN EXUR-TDCC INTERGENIC REGION (F188)

| ORF Name | NTID | AAID | NT Length | AA Length | Score | Probability |
|---|---|---|---|---|---|---|
| 22362717_f3_101 | 3089 | 7261 | 82 | 249 | | |
| Protein name | | | | | Locus Name | Acc# |

Description: NO-HIT

| ORF Name | NTID | AAID | NT Length | AA Length | Score | Probability |
|---|---|---|---|---|---|---|
| 2242037_f2_68 | 3090 | 7262 | 120 | 363 | 293 | 7.9e-26 |
| Protein name | | | | | Locus Name | Acc# |
| PduJ | | | | | gp:AF026270 | AF026270:L |

Description: Salmonella enterica serovar Typhimurium PocR (pocR) gene, partial cds; PduF (pudF) gene, complete cds and pdu operon, complete sequence.

| ORF Name | NTID | AAID | NT Length | AA Length | Score | Probability |
|---|---|---|---|---|---|---|
| 22454451_f3_99 | 3091 | 7263 | 211 | 636 | 923 | 1.4e-92 |
| Protein name | | | | | Locus Name | Acc# |
| | | | | | sp:LEXA_PRORE | Q07267 |

Description: LEXA REPRESSOR,

| ORF Name | NTID | AAID | NT Length | AA Length | Score | Probability |
|---|---|---|---|---|---|---|
| 22664026_f3_120 | 3092 | 7264 | 608 | 1827 | 972 | 8.8e-98 |
| Protein name | | | | | Locus Name | Acc# |
| | | | | | sp:MXID_SHIFL | Q04641 |

Description: OUTER MEMBRANE PROTEIN MXID PRECURSOR

| ORF Name | NTID | AAID | NT Length | AA Length | Score | Probability |
|---|---|---|---|---|---|---|
| 22922700_c3_278 | 3093 | 7265 | 67 | 204 | | |
| Protein name | | | | | Locus Name | Acc# |

Description
NO-HIT

| ORF Name | NTID | AAID | NT Length | AA Length | Score | Probability |
|---|---|---|---|---|---|---|
| 23540910_c2_175 | 3094 | 7266 | 141 | 426 | 111 | 1.5e-06 |
| Protein name | | | | | Locus Name | Acc# |
| | | | | | sp:YPHA_ECOLI | P77751:O08 |

Description
HYPOTHETICAL 17.9 KD PROTEIN IN CSIE-GLYA INTERGENIC REGION

| ORF Name | NTID | AAID | NT Length | AA Length | Score | Probability |
|---|---|---|---|---|---|---|
| 23570313_c2_189 | 3095 | 7267 | 67 | 204 | | |
| Protein name | | | | | Locus Name | Acc# |

Description
NO-HIT

| ORF Name | NTID | AAID | NT Length | AA Length | Score | Probability |
|---|---|---|---|---|---|---|
| 23712811_f2_79 | 3096 | 7268 | 150 | 453 | 436 | 5.5e-41 |
| Protein name | | | | | Locus Name | Acc# |
| | | | | | sp:SOXR_ECOLI | P22538 |

Description
SOXR PROTEIN

| ORF Name | NTID | AAID | NT Length | AA Length | Score | Probability |
|---|---|---|---|---|---|---|
| 2384657_f3_117 | 3097 | 7269 | 88 | 267 | 129 | 1.9e-08 |
| Protein name | | | | | Locus Name | Acc# |
| | | | | | sp:CCML_SYNY3 | P72759 |

Description
CARBON DIOXIDE CONCENTRATING MECHANISM PROTEIN CCML

| ORF Name | NTID | AAID | NT Length | AA Length | Score | Probability |
|---|---|---|---|---|---|---|
| 23853431_f1_23 | 3098 | 7270 | 446 | 1341 | 190 | 4.4e-12 |
| Protein name | | | | | Locus Name | Acc# |
| SprD | | | | | gp:BSU39230 | U39230 |

Description
Bacillus sp. SprA gene, partial cds and SprB, SprC, and SprD genes, complete cds.

| ORF Name | NTID | AAID | NT Length | AA Length | Score | Probability |
|---|---|---|---|---|---|---|
| 24111312_c1_128 | 3099 | 7271 | 207 | 624 | 541 | 3.7e-51 |
| Protein name | | | | | Locus Name | Acc# |
| | | | | | sp:Y895_HAEIN | Q57124:005 |

Description
HYPOTHETICAL PROTEIN HI0895

| ORF Name | NTID | AAID | NT Length | AA Length | Score | Probability |
|---|---|---|---|---|---|---|
| 24245468_f2_52 | 3100 | 7272 | 292 | 879 | 1151 | 9.4e-117 |
| Protein name | | | | | Locus Name | Acc# |
| | | | | | sp:UBIA_PROST | O52366 |

Description
POLYPRENYLTRANSFERASE)

| ORF Name | NTID | AAID | NT Length | AA Length | Score | Probability |
|---|---|---|---|---|---|---|
| 24257051_c2_224 | 3101 | 7273 | 60 | 183 | | |
| Protein name | | | | | Locus Name | Acc# |

Description
NO-HIT

| ORF Name | NTID | AAID | NT Length | AA Length | Score | Probability |
|---|---|---|---|---|---|---|
| 24353175_f3_121 | 3102 | 7274 | 704 | 2115 | 1819 | 1.5e-187 |
| Protein name | | | | | Locus Name | Acc# |
| inner membrane transporter homolog | | | | | gp:AF005744 | AF005744 |

Description
Yersinia enterocolitica inner membrane transporter homolog (ysaA), SpaI5 homolog (ysaK) and putative ATPase (ysaL) genes, complete cds.

| ORF_Name | NTID | AAID | NT Length | AA Length | Score | Probability |
|---|---|---|---|---|---|---|
| 24398261_f1_29 | 3103 | 7275 | 112 | 339 | 286 | 4.3e-25 |

| Protein name | | | | Locus Name | Acc# |
|---|---|---|---|---|---|
| PduJ | | | | gp:AF026270 | AF026270:L |

Description

Salmonella enterica serovar Typhimurium PocR (pocR) gene, partialcds; PduF (pudF) gene, complete cds and pdu operon, completesequence.

| ORF_Name | NTID | AAID | NT Length | AA Length | Score | Probability |
|---|---|---|---|---|---|---|
| 24486688_f3_109 | 3104 | 7276 | 264 | 795 | 1150 | 1.2e-116 |

| Protein name | | | | Locus Name | Acc# |
|---|---|---|---|---|---|
| | | | | sp:POTC_ECOLI | P23859 |

Description

SPERMIDINE/PUTRESCINE TRANSPORT SYSTEM PERMEASE PROTEIN POTC

| ORF_Name | NTID | AAID | NT Length | AA Length | Score | Probability |
|---|---|---|---|---|---|---|
| 245461_c2_177 | 3105 | 7277 | 851 | 2556 | 1671 | 7.4e-172 |

| Protein name | | | | Locus Name | Acc# |
|---|---|---|---|---|---|
| | | | | sp:Y895_HAEIN | Q57124:005 |

Description

HYPOTHETICAL PROTEIN HI0895

| ORF_Name | NTID | AAID | NT Length | AA Length | Score | Probability |
|---|---|---|---|---|---|---|
| 24813452_f3_108 | 3106 | 7278 | 371 | 1116 | 1533 | 3.1e-157 |

| Protein name | | | | Locus Name | Acc# |
|---|---|---|---|---|---|
| | | | | sp:POTA_ECOLI | P23858 |

Description

SPERMIDINE/PUTRESCINE TRANSPORT ATP-BINDING PROTEIN POTA

| ORF_Name | NTID | AAID | NT Length | AA Length | Score | Probability |
|---|---|---|---|---|---|---|
| 24820906_c1_132 | 3107 | 7279 | 60 | 183 | | |

| Protein name | | | | Locus Name | Acc# |
|---|---|---|---|---|---|

Description

NO-HIT

| ORF Name | NTID | AAID | NT Length | AA Length | Score | Probability |
|---|---|---|---|---|---|---|
| 25625032_c1_139 | 3108 | 7280 | 183 | 552 | 276 | 5.0e-24 |
| Protein name | | | | | Locus Name | Acc# |
| | | | | | sp:FIMF_ECOLI | P08189 |

Description
FIMF PROTEIN PRECURSOR

| ORF Name | NTID | AAID | NT Length | AA Length | Score | Probability |
|---|---|---|---|---|---|---|
| 26760302_f3_116 | 3109 | 7281 | 98 | 297 | 285 | 5.5e-25 |
| Protein name | | | | | Locus Name | Acc# |
| PduJ | | | | | gp:AF026270 | AF026270:L |

Description
Salmonella enterica serovar Typhimurium PocR (pocR) gene, partial cds; PduF (pudF) gene, complete cds and pdu operon, complete sequence.

| ORF Name | NTID | AAID | NT Length | AA Length | Score | Probability |
|---|---|---|---|---|---|---|
| 2734550_f1_28 | 3110 | 7282 | 181 | 546 | | |
| Protein name | | | | | Locus Name | Acc# |

Description
NO-HIT

| ORF Name | NTID | AAID | NT Length | AA Length | Score | Probability |
|---|---|---|---|---|---|---|
| 2771880_c2_201 | 3111 | 7283 | 385 | 1158 | 1418 | 4.8e-145 |
| Protein name | | | | | Locus Name | Acc# |
| hypothetical 38.4 kD protein in dinF-qor intergenic region | | | | | pir:H65212 | H65212 |

Description

| ORF Name | NTID | AAID | NT Length | AA Length | Score | Probability |
|---|---|---|---|---|---|---|
| 29572143_c3_267 | 3112 | 7284 | 60 | 183 | | |
| Protein name | | | | | Locus Name | Acc# |

Description
NO-HIT

| ORF Name | NTID | AAID | NT Length | AA Length | Score | Probability |
|---|---|---|---|---|---|---|
| 30664077_f2_61 | 3113 | 7285 | 347 | 1044 | 1484 | 4.9e-152 |
| Protein name | | | | | Locus Name | Acc# |
| | | | | | sp:POTD_ECOLI | P23861 |

Description: SPERMIDINE/PUTRESCINE-BINDING PERIPLASMIC PROTEIN PRECURSOR (SPBP)

| ORF Name | NTID | AAID | NT Length | AA Length | Score | Probability |
|---|---|---|---|---|---|---|
| 3140942_f1_3 | 3114 | 7286 | 72 | 219 | | |
| Protein name | | | | | Locus Name | Acc# |

Description: NO-HIT

| ORF Name | NTID | AAID | NT Length | AA Length | Score | Probability |
|---|---|---|---|---|---|---|
| 31432680_c2_195 | 3115 | 7287 | 855 | 2568 | 4430 | 0.0 |
| Protein name | | | | | Locus Name | Acc# |
| outer membrane usher protein | | | | | gp:PMATFGC | Z78535 |

Description: P.mirabilis atf gene cluster.

| ORF Name | NTID | AAID | NT Length | AA Length | Score | Probability |
|---|---|---|---|---|---|---|
| 31463938_f1_16 | 3116 | 7288 | 994 | 2985 | 4349 | 0.0 |
| Protein name | | | | | Locus Name | Acc# |
| | | | | | sp:UVRA_ECOLI | P07671:P76 |

Description: EXCINUCLEASE ABC SUBUNIT A

| ORF Name | NTID | AAID | NT Length | AA Length | Score | Probability |
|---|---|---|---|---|---|---|
| 31804068_f3_115 | 3117 | 7289 | 208 | 627 | 217 | 8.9e-18 |
| Protein name | | | | | Locus Name | Acc# |
| hypothetical protein | | | | | gp:SYCSLLE | D64003:AB0 |

Description: Synechocystis sp. PCC6803 complete genome, 22/27, 2755703-2868766.

| ORF Name | NTID | AAID | NT Length | AA Length | Score | Probability |
|---|---|---|---|---|---|---|
| 31923177_f2_67 | 3118 | 7290 | 304 | 915 | 124 | 3.0e-05 |

| Protein name | Locus Name | Acc# |
|---|---|---|
| putative transcriptional regulator MarT | gp:AF106566 | AF106566 |

Description
Salmonella typhimurium pathogenicity island SPI-3, completesequence.

| ORF Name | NTID | AAID | NT Length | AA Length | Score | Probability |
|---|---|---|---|---|---|---|
| 32033385_f2_53 | 3119 | 7291 | 174 | 525 | 430 | 2.4e-40 |

| Protein name | Locus Name | Acc# |
|---|---|---|
| probable diacylglycerol kinase,:diglyceride kinase | pir:KIECDG | A00667:A65 |

Description

| ORF Name | NTID | AAID | NT Length | AA Length | Score | Probability |
|---|---|---|---|---|---|---|
| 32056502_c2_174 | 3120 | 7292 | 231 | 696 | 78 | 0.018 |

| Protein name | Locus Name | Acc# |
|---|---|---|
| envelope protein | gp:HIVCSF027 | Z37748 |

Description
HIV-1 DNA V3 region (patient 02, sample CSF, clone 07).

| ORF Name | NTID | AAID | NT Length | AA Length | Score | Probability |
|---|---|---|---|---|---|---|
| 33209501_f2_66 | 3121 | 7293 | 439 | 1320 | 1227 | 8.3e-125 |

| Protein name | Locus Name | Acc# |
|---|---|---|
| O-acetylhomoserine sulfhydrylase | pir:D72324 | D72324 |

Description

| ORF Name | NTID | AAID | NT Length | AA Length | Score | Probability |
|---|---|---|---|---|---|---|
| 33376388_f1_14 | 3122 | 7294 | 178 | 537 | 401 | 2.8e-37 |

| Protein name | Locus Name | Acc# |
|---|---|---|
|  | sp:UBIC_ECOLI | P26602:P76 |

Description
CHORISMATE--PYRUVATE LYASE,

| ORF Name | NTID | AAID | NT Length | AA Length | Score | Probability |
|---|---|---|---|---|---|---|
| 33395332_c1_146 | 3123 | 7295 | 419 | 1260 | 1364 | 2.5e-139 |
| Protein name | | | | | Locus Name | Acc# |
| | | | | | sp:TYRB_ECOLI | P04693 |

Description: AROMATIC-AMINO-ACID AMINOTRANSFERASE, (AROAT) (ARAT)

| ORF Name | NTID | AAID | NT Length | AA Length | Score | Probability |
|---|---|---|---|---|---|---|
| 33626908_f2_49 | 3124 | 7296 | 201 | 606 | | |
| Protein name | | | | | Locus Name | Acc# |

Description: NO-HIT

| ORF Name | NTID | AAID | NT Length | AA Length | Score | Probability |
|---|---|---|---|---|---|---|
| 33994010_f2_75 | 3125 | 7297 | 379 | 1140 | 118 | 1.1e-09 |
| Protein name | | | | | Locus Name | Acc# |
| | | | | | sp:YOPH_YEREN | P15273 |

Description: PROTEIN-TYROSINE PHOSPHATASE YOPH, (VIRULENCE PROTEIN)

| ORF Name | NTID | AAID | NT Length | AA Length | Score | Probability |
|---|---|---|---|---|---|---|
| 34386626_f1_25 | 3126 | 7298 | 297 | 894 | 1208 | 8.6e-123 |
| Protein name | | | | | Locus Name | Acc# |
| | | | | | sp:POTB_ECOLI | P23860 |

Description: SPERMIDINE/PUTRESCINE TRANSPORT SYSTEM PERMEASE PROTEIN POTB

| ORF Name | NTID | AAID | NT Length | AA Length | Score | Probability |
|---|---|---|---|---|---|---|
| 34392680_c3_262 | 3127 | 7299 | 184 | 555 | 566 | 9.2e-55 |
| Protein name | | | | | Locus Name | Acc# |
| | | | | | sp:ZUR_ECOLI | P32692:P76 |

Description: ZINC UPTAKE REGULATION PROTEIN (ZINC UPTAKE REGULATOR)

| ORF Name | NTID | AAID | NT Length | AA Length | Score | Probability |
|---|---|---|---|---|---|---|
| 34414708_c1_127 | 3128 | 7300 | 192 | 579 | 102 | 0.0010 |
| Protein name | | | | | Locus Name | Acc# |
| orgA protein | | | | | pir:S69789 | S69789 |

Description

| ORF Name | NTID | AAID | NT Length | AA Length | Score | Probability |
|---|---|---|---|---|---|---|
| 34631253_c1_126 | 3129 | 7301 | 98 | 297 | 108 | 3.2e-06 |
| Protein name | | | | | Locus Name | Acc# |
| | | | | | sp:MXII_SHIFL | Q06080 |

Description

MXII PROTEIN

| ORF Name | NTID | AAID | NT Length | AA Length | Score | Probability |
|---|---|---|---|---|---|---|
| 34640687_f2_74 | 3130 | 7302 | 144 | 435 | 241 | 2.5e-20 |
| Protein name | | | | | Locus Name | Acc# |
| small multidrug export protein qacE:multidrug importer | | | | | pir:A48905 | A48905:S32 |

Description

| ORF Name | NTID | AAID | NT Length | AA Length | Score | Probability |
|---|---|---|---|---|---|---|
| 35156502_f2_65 | 3131 | 7303 | 60 | 183 | | |
| Protein name | | | | | Locus Name | Acc# |

Description

NO-HIT

| ORF Name | NTID | AAID | NT Length | AA Length | Score | Probability |
|---|---|---|---|---|---|---|
| 35164665_f2_72 | 3132 | 7304 | 323 | 972 | 558 | 6.5e-54 |
| Protein name | | | | | Locus Name | Acc# |
| probable pyruvate formate-lyase activating enzyme, pflC homolog | | | | | pir:A69431 | A69431 |

Description

| ORF Name | NTID | AAID | NT Length | AA Length | Score | Probability |
|---|---|---|---|---|---|---|
| 35937837_f1_5 | 3133 | 7305 | 537 | 1614 | 2063 | 2.1e-213 |
| Protein name | | | | | Locus Name | Acc# |
| | | | | | sp:MASY_ECOLI | P08997 |

Description

MALATE SYNTHASE A, (MSA)

| ORF Name | NTID | AAID | NT Length | AA Length | Score | Probability |
|---|---|---|---|---|---|---|
| 36022817_f1_32 | 3134 | 7306 | 1149 | 3450 | 1097 | 1.0e-118 |
| Protein name | | | | | Locus Name | Acc# |
| probable formate C-acetyltransferase,:pyruvate formate-lyase 2 | | | | | pir:H69430 | H69430 |

Description

| ORF Name | NTID | AAID | NT Length | AA Length | Score | Probability |
|---|---|---|---|---|---|---|
| 36058141_c1_168 | 3135 | 7307 | 81 | 246 | 125 | 5.0e-08 |
| Protein name | | | | | Locus Name | Acc# |
| hypothetical protein | | | | | pir:D75542 | D75542 |

Description

| ORF Name | NTID | AAID | NT Length | AA Length | Score | Probability |
|---|---|---|---|---|---|---|
| 3906901_c3_274 | 3136 | 7308 | 188 | 567 | 318 | 1.8e-28 |
| Protein name | | | | | Locus Name | Acc# |
| probable IPP isomerase | | | | | pir:T35275 | T35275 |

Description

| ORF Name | NTID | AAID | NT Length | AA Length | Score | Probability |
|---|---|---|---|---|---|---|
| 3937552_c2_194 | 3137 | 7309 | 228 | 687 | 1139 | 1.8e-115 |
| Protein name | | | | | Locus Name | Acc# |
| type 1 fimbrial chaperone | | | | | gp:PMATFGC | Z78535 |

Description

P.mirabilis atf gene cluster.

| ORF Name | NTID | AAID | NT Length | AA Length | Score | Probability |
|---|---|---|---|---|---|---|
| 3939143_f1_41 | 3138 | 7310 | 361 | 1086 | 328 | 1.5e-29 |
| Protein name | | | | | Locus Name | Acc# |
| invasion protein | | | | | gp:SEU43259 | U43259 |

Description

Salmonella enterica invasion protein (invE) gene, complete cds.

| ORF Name | NTID | AAID | NT Length | AA Length | Score | Probability |
|---|---|---|---|---|---|---|
| 4101007_f1_6 | 3139 | 7311 | 451 | 1356 | 1918 | 5.0e-198 |
| Protein name | | | | | Locus Name | Acc# |
| | | | | | sp:ACEA_ECOLI | P05313 |

Description

ISOCITRATE LYASE, (ISOCITRASE) (ISOCITRATASE) (ICL)

| ORF Name | NTID | AAID | NT Length | AA Length | Score | Probability |
|---|---|---|---|---|---|---|
| 4485942_c3_255 | 3140 | 7312 | 366 | 1101 | 1317 | 2.4e-134 |
| Protein name | | | | | Locus Name | Acc# |
| | | | | | sp:ALR1_ECOLI | P29743:P78 |

Description

ALANINE RACEMASE, BIOSYNTHETIC,

| ORF Name | NTID | AAID | NT Length | AA Length | Score | Probability |
|---|---|---|---|---|---|---|
| 4688938_c3_247 | 3141 | 7313 | 189 | 570 | 912 | 2.0e-91 |
| Protein name | | | | | Locus Name | Acc# |
| major subunit of type 1 fimbria | | | | | gp:PMATFGC | Z78535 |

Description

P.mirabilis atf gene cluster.

| ORF Name | NTID | AAID | NT Length | AA Length | Score | Probability |
|---|---|---|---|---|---|---|
| 4695386_c1_125 | 3142 | 7314 | 369 | 1110 | 100 | 0.015 |
| Protein name | | | | | Locus Name | Acc# |
| vsaE1 protein | | | | | pir:S70797 | S70797 |

Description

720

| ORF Name | NTID | AAID | NT Length | AA Length | Score | Probability |
|---|---|---|---|---|---|---|
| 4722925_c1_152 | 3143 | 7315 | 873 | 2622 | 3040 | 0.0 |
| Protein name | | | | | Locus Name | Acc# |
| glycerol-3-phosphate O-acyltransferase, | | | | | pir:XUECAG | A00565:C42 |

Description

| ORF Name | NTID | AAID | NT Length | AA Length | Score | Probability |
|---|---|---|---|---|---|---|
| 4745393_f1_33 | 3144 | 7316 | 237 | 714 | | |
| Protein name | | | | | Locus Name | Acc# |

Description
NO-HIT

| ORF Name | NTID | AAID | NT Length | AA Length | Score | Probability |
|---|---|---|---|---|---|---|
| 4797140_f2_85 | 3145 | 7317 | 146 | 441 | 130 | 1.5e-08 |
| Protein name | | | | | Locus Name | Acc# |
| Spa15 homolog | | | | | gp:AF005744 | AF005744 |

Description
Yersinia enterocolitica inner membrane transporter homolog (ysaA),Spa15 homolog (ysaK) and putative ATPase (ysaL) genes, completecds.

| ORF Name | NTID | AAID | NT Length | AA Length | Score | Probability |
|---|---|---|---|---|---|---|
| 4813285_c3_250 | 3146 | 7318 | 389 | 1170 | 256 | 8.1e-22 |
| Protein name | | | | | Locus Name | Acc# |
| fimbrial lectin, N-acetyl-D-glucosamine specific | | | | | pir:I55123 | I55123 |

Description

| ORF Name | NTID | AAID | NT Length | AA Length | Score | Probability |
|---|---|---|---|---|---|---|
| 4876538_c1_150 | 3147 | 7319 | 216 | 651 | 922 | 1.7e-92 |
| Protein name | | | | | Locus Name | Acc# |
| single-stranded DNA-binding protein:helix-destabilizing protein | | | | | pir:S19955 | S19955 |

Description

| ORF Name | NTID | AAID | NT Length | AA Length | Score | Probability |
|---|---|---|---|---|---|---|
| 5088893_f3_89 | 3148 | 7320 | 575 | 1728 | 2002 | 6.3e-207 |
| Protein name | | | | | Locus Name | Acc# |
| isocitrate dehydrogenase kinase/phosphatase | | | | | gp:SEU43356 | U43356 |

Description

Salmonella enterica isocitrate lyase (aceA) gene, partial cds, isocitrate dehydrogenase kinase/phosphatase (aceK) gene, completecds.

| ORF Name | NTID | AAID | NT Length | AA Length | Score | Probability |
|---|---|---|---|---|---|---|
| 5115937_f2_73 | 3149 | 7321 | 216 | 651 | 543 | 2.5e-52 |
| Protein name | | | | | Locus Name | Acc# |
| hypothetical protein TM0375 | | | | | pir:E72385 | E72385 |

Description

| ORF Name | NTID | AAID | NT Length | AA Length | Score | Probability |
|---|---|---|---|---|---|---|
| 517842_f3_87 | 3150 | 7322 | 89 | 270 | | |
| Protein name | | | | | Locus Name | Acc# |

Description

NO-HIT

| ORF Name | NTID | AAID | NT Length | AA Length | Score | Probability |
|---|---|---|---|---|---|---|
| 523427_c1_124 | 3151 | 7323 | 73 | 222 | 55 | 0.0027 |
| Protein name | | | | | Locus Name | Acc# |
| ABC transporter, permease | | | | | pir:G71800 | G71800 |

Description

| ORF Name | NTID | AAID | NT Length | AA Length | Score | Probability |
|---|---|---|---|---|---|---|
| 5274088_f3_118 | 3152 | 7324 | 171 | 516 | 189 | 8.2e-15 |
| Protein name | | | | | Locus Name | Acc# |
| PduJ | | | | | gp:AF026270 | AF026270:L |

Description

Salmonella enterica serovar Typhimurium PocR (pocR) gene, partialcds; PduF (pudF) gene, complete cds and pdu operon, completesequence.

| ORF Name | NTID | AAID | NT Length | AA Length | Score | Probability |
|---|---|---|---|---|---|---|
| 5274175_c2_216 | 3153 | 7325 | 218 | 657 | 904 | 1.4e-90 |
| Protein name | | | | | Locus Name | Acc# |
| | | | | | sp:ALKH_ECOLI | P10177 |

Description

| ORF Name | NTID | AAID | NT Length | AA Length | Score | Probability |
|---|---|---|---|---|---|---|
| 5866316_f2_59 | 3154 | 7326 | 356 | 1071 | 1092 | 1.7e-110 |
| Protein name | | | | | Locus Name | Acc# |
| | | | | | sp:QOR_ECOLI | P28304 |

Description
CRYSTALLIN HOMOLOG PROTEIN)

| ORF Name | NTID | AAID | NT Length | AA Length | Score | Probability |
|---|---|---|---|---|---|---|
| 6054702_f2_51 | 3155 | 7327 | 548 | 1647 | 2439 | 3.1e-253 |
| Protein name | | | | | Locus Name | Acc# |
| glucose-6-phosphate isomerase,:phosphoglucose isomerase:phosphohexose isomerase | | | | | pir:NUEC | H65209:JS0 |

Description

| ORF Name | NTID | AAID | NT Length | AA Length | Score | Probability |
|---|---|---|---|---|---|---|
| 6063956_c1_167 | 3156 | 7328 | 156 | 471 | 114 | 1.8e-06 |
| Protein name | | | | | Locus Name | Acc# |
| hypothetical protein PH0221 | | | | | pir:D71245 | D71245 |

Description

| ORF Name | NTID | AAID | NT Length | AA Length | Score | Probability |
|---|---|---|---|---|---|---|
| 6292177_f1_31 | 3157 | 7329 | 408 | 1227 | 700 | 5.8e-69 |
| Protein name | | | | | Locus Name | Acc# |
| PduQ | | | | | gp:AF026270 | AF026270:L |

Description
Salmonella enterica serovar Typhimurium PocR (pocR) gene, partial cds; PduF (pudF) gene, complete cds and pdu operon, complete sequence.

| ORF Name | NTID | AAID | NT Length | AA Length | Score | Probability |
|---|---|---|---|---|---|---|
| 6334468_f1_15 | 3158 | 7330 | 84 | 255 | | |
| Protein name | | | | | Locus Name | Acc# |

Description
NO-HIT

| ORF Name | NTID | AAID | NT Length | AA Length | Score | Probability |
|---|---|---|---|---|---|---|
| 6575_c2_202 | 3159 | 7331 | 479 | 1440 | 2064 | 1.7e-213 |
| Protein name | | | | | Locus Name | Acc# |
| | | | | | sp:DNAB_SALTY | P10338 |

Description
REPLICATIVE DNA HELICASE,

| ORF Name | NTID | AAID | NT Length | AA Length | Score | Probability |
|---|---|---|---|---|---|---|
| 6642217_f1_4 | 3160 | 7332 | 371 | 1116 | 895 | 1.3e-89 |
| Protein name | | | | | Locus Name | Acc# |
| | | | | | sp:GLDA_PSEPU | P50173 |

Description
GLYCEROL DEHYDROGENASE, (GLDH)

| ORF Name | NTID | AAID | NT Length | AA Length | Score | Probability |
|---|---|---|---|---|---|---|
| 6678793_c3_237 | 3161 | 7333 | 254 | 765 | 414 | 1.2e-38 |
| Protein name | | | | | Locus Name | Acc# |
| | | | | | sp:PRGK_SALTY | P41786 |

Description
PRGK PROTEIN PRECURSOR

| ORF Name | NTID | AAID | NT Length | AA Length | Score | Probability |
|---|---|---|---|---|---|---|
| 839133_f2_83 | 3162 | 7334 | 256 | 771 | 288 | 2.7e-25 |
| Protein name | | | | | Locus Name | Acc# |
| | | | | | sp:INVF_SALTY | P39437 |

Description
INVASION PROTEIN INVF

| ORF Name | NTID | AAID | NT Length | AA Length | Score | Probability |
|---|---|---|---|---|---|---|
| 9822538_c1_169 | 3163 | 7335 | 173 | 522 | | |
| Protein name | | | | | Locus Name | Acc# |

Description
NO-HIT

| ORF Name | NTID | AAID | NT Length | AA Length | Score | Probability |
|---|---|---|---|---|---|---|
| 9901377_c1_164 | 3164 | 7336 | 324 | 975 | 1226 | 1.1e-124 |
| Protein name | | | | | Locus Name | Acc# |
| homoserine O-succinyltransferase,:homoserine O-transsuccinylase | | | | | pir:XYECM | D65208:A93 |

Description

| ORF Name | NTID | AAID | NT Length | AA Length | Score | Probability |
|---|---|---|---|---|---|---|
| 9929691_c1_122 | 3165 | 7337 | 170 | 513 | 155 | 3.3e-11 |
| Protein name | | | | | Locus Name | Acc# |
| hypothetical protein 12 flaA operon | | | | | pir:S14505 | S14505 |

Description

| ORF Name | NTID | AAID | NT Length | AA Length | Score | Probability |
|---|---|---|---|---|---|---|
| 11728931_c1_44 | 3166 | 7338 | 72 | 219 | | |
| Protein name | | | | | Locus Name | Acc# |

Description
NO-HIT

| ORF Name | NTID | AAID | NT Length | AA Length | Score | Probability |
|---|---|---|---|---|---|---|
| 1209555_f3_30 | 3167 | 7339 | 198 | 597 | 820 | 1.1e-81 |
| Protein name | | | | | Locus Name | Acc# |
| | | | | | sp:YJAG_ECOLI | P32680 |

Description
HYPOTHETICAL 22.6 KD PROTEIN IN NFI-HUPA INTERGENIC REGION

| ORF_Name | NTID | AAID | NT Length | AA Length | Score | Probability |
|---|---|---|---|---|---|---|
| 12297156_c3_93 | 3168 | 7340 | 382 | 1149 | 1504 | 3.7e-154 |
| Protein name | | | | | Locus Name | Acc# |
| ThiH | | | | | gp:AF154064 | AF154064 |

Description: Salmonella typhimurium ThiH (thiH) gene, complete cds.

| ORF_Name | NTID | AAID | NT Length | AA Length | Score | Probability |
|---|---|---|---|---|---|---|
| 14074052_c3_89 | 3169 | 7341 | 231 | 696 | 167 | 1.3e-11 |
| Protein name | | | | | Locus Name | Acc# |
| hypothetical protein Rv3661 | | | | | pir:F70788 | F70788 |

Description

| ORF_Name | NTID | AAID | NT Length | AA Length | Score | Probability |
|---|---|---|---|---|---|---|
| 1410801_f2_16 | 3170 | 7342 | 1433 | 4302 | 6590 | 0.0 |
| Protein name | | | | | Locus Name | Acc# |
| | | | | | sp:RPOC_ECOLI | P00577:P00 |

Description: BETA' CHAIN) (RNA POLYMERASE BETA' SUBUNIT)

| ORF_Name | NTID | AAID | NT Length | AA Length | Score | Probability |
|---|---|---|---|---|---|---|
| 14740627_f2_15 | 3171 | 7343 | 127 | 384 | 516 | 1.8e-49 |
| Protein name | | | | | Locus Name | Acc# |
| ribosomal protein L7/L12 | | | | | pir:R5EC7 | S12575:A02 |

Description

| ORF_Name | NTID | AAID | NT Length | AA Length | Score | Probability |
|---|---|---|---|---|---|---|
| 16797951_f1_10 | 3172 | 7344 | 265 | 798 | 721 | 3.5e-71 |
| Protein name | | | | | Locus Name | Acc# |
| hypothetical 24.9 kD protein in heme-hupa intergenic region | | | | | pir:A65207 | A65207 |

Description

| ORF Name | NTID | AAID | NT Length | AA Length | Score | Probability |
|---|---|---|---|---|---|---|
| 20314675_f2_17 | 3173 | 7345 | 363 | 1092 | 596 | 6.1e-58 |
| Protein name | | | | | Locus Name | Acc# |
| probable transposase | | | | | pir:T14989 | T14989 |
| Description | | | | | | |

| ORF Name | NTID | AAID | NT Length | AA Length | Score | Probability |
|---|---|---|---|---|---|---|
| 22710442_c3_83 | 3174 | 7346 | 115 | 348 | 85 | 0.013 |
| Protein name | | | | | Locus Name | Acc# |
| SpaA | | | | | gp:AB012763 | AB012763 |
| Description | | | | | | |
| Erysipelothrix rhusiopathiae gene for SpaA, complete cds. | | | | | | |

| ORF Name | NTID | AAID | NT Length | AA Length | Score | Probability |
|---|---|---|---|---|---|---|
| 23558465_f2_13 | 3175 | 7347 | 238 | 717 | 1080 | 3.2e-109 |
| Protein name | | | | | Locus Name | Acc# |
| ribosomal protein L1 | | | | | pir:R5EBPV | S01970 |
| Description | | | | | | |

| ORF Name | NTID | AAID | NT Length | AA Length | Score | Probability |
|---|---|---|---|---|---|---|
| 23572175_f1_1 | 3176 | 7348 | 143 | 432 | 680 | 7.7e-67 |
| Protein name | | | | | Locus Name | Acc# |
| ribosomal protein L11 | | | | | pir:R5EB1P | S01969 |
| Description | | | | | | |

| ORF Name | NTID | AAID | NT Length | AA Length | Score | Probability |
|---|---|---|---|---|---|---|
| 23714000_f3_26 | 3177 | 7349 | 1388 | 4167 | 6447 | 0.0 |
| Protein name | | | | | Locus Name | Acc# |
| Salmonella typhimurium DNA-directed RNA | | | | | gp:STYSTMF1 | AF170176 |
| Description | | | | | | |
| Salmonella typhimurium fragment STMF1. | | | | | | |

| ORF Name | NTID | AAID | NT Length | AA Length | Score | Probability |
|---|---|---|---|---|---|---|
| 24105280_f2_14 | 3178 | 7350 | 171 | 516 | 703 | 2.8e-69 |//
| Protein name | | | | | Locus Name | Acc# |
| ribosomal protein L10 | | | | | pir:R5EC10 | S12574:S13 |

Description

| ORF Name | NTID | AAID | NT Length | AA Length | Score | Probability |
|---|---|---|---|---|---|---|
| 24406901_f1_11 | 3179 | 7351 | 115 | 348 | 361 | 4.9e-33 |
| Protein name | | | | | Locus Name | Acc# |
| | | | | | sp:DBHA_ECOLI | P02342 |

Description
DNA-BINDING PROTEIN HU-ALPHA (NS2) (HU-2)

| ORF Name | NTID | AAID | NT Length | AA Length | Score | Probability |
|---|---|---|---|---|---|---|
| 24647201_c2_70 | 3180 | 7352 | 217 | 654 | 678 | 1.3e-66 |
| Protein name | | | | | Locus Name | Acc# |
| 90% identity over 211 amino acids with E. coli | | | | | gp:STYSTMF1 | AF170176 |

Description
Salmonella typhimurium fragment STMF1.

| ORF Name | NTID | AAID | NT Length | AA Length | Score | Probability |
|---|---|---|---|---|---|---|
| 2580092_f3_29 | 3181 | 7353 | 385 | 1158 | 1634 | 6.2e-168 |
| Protein name | | | | | Locus Name | Acc# |
| | | | | | sp:DCUP_ECOLI | P29680:P78 |

Description
UROPORPHYRINOGEN DECARBOXYLASE, (UPD)

| ORF Name | NTID | AAID | NT Length | AA Length | Score | Probability |
|---|---|---|---|---|---|---|
| 31698415_c3_82 | 3182 | 7354 | 67 | 204 | | |
| Protein name | | | | | Locus Name | Acc# |

Description
NO-HIT

| ORF Name | NTID | AAID | NT Length | AA Length | Score | Probability |
|---|---|---|---|---|---|---|
| 32538431_c1_62 | 3183 | 7355 | 141 | 426 | 127 | 3.1e-08 |
| Protein name | | | | | Locus Name | Acc# |
| hypothetical protein PH2001 | | | | | pir:A71217 | A71217 |

Description

| ORF Name | NTID | AAID | NT Length | AA Length | Score | Probability |
|---|---|---|---|---|---|---|
| 34188417_f3_31 | 3184 | 7356 | 243 | 732 | 369 | 6.9e-34 |
| Protein name | | | | | Locus Name | Acc# |
| | | | | | sp:YJAH_ECOLI | P32681 |

Description
HYPOTHETICAL 26.3 KD PROTEIN IN HUPA-HYDH INTERGENIC REGION (O231)

| ORF Name | NTID | AAID | NT Length | AA Length | Score | Probability |
|---|---|---|---|---|---|---|
| 35736412_f3_24 | 3185 | 7357 | 130 | 393 | 645 | 3.9e-63 |
| Protein name | | | | | Locus Name | Acc# |
| | | | | | sp:NUSG_ECOLI | P16921 |

Description
TRANSCRIPTION ANTITERMINATION PROTEIN NUSG

| ORF Name | NTID | AAID | NT Length | AA Length | Score | Probability |
|---|---|---|---|---|---|---|
| 35943760_c1_50 | 3186 | 7358 | 656 | 1971 | 2819 | 1.7e-293 |
| Protein name | | | | | Locus Name | Acc# |
| | | | | | sp:THIC_ECOLI | P30136 |

Description
THIAMINE BIOSYNTHESIS PROTEIN THIC

| ORF Name | NTID | AAID | NT Length | AA Length | Score | Probability |
|---|---|---|---|---|---|---|
| 36058141_c2_65 | 3187 | 7359 | 81 | 246 | 119 | 2.2e-07 |
| Protein name | | | | | Locus Name | Acc# |
| hypothetical protein | | | | | pir:D75542 | D75542 |

Description

| ORF Name | NTID | AAID | NT Length | AA Length | Score | Probability |
|---|---|---|---|---|---|---|
| 3945888_f2_22 | 3188 | 7360 | 266 | 801 | 848 | 1.2e-84 |
| Protein name | | | | | Locus Name | Acc# |
| | | | | | gp:STYSTMF1 | AF170176 |

Description

Salmonella typhimurium fragment STMF1.

| ORF Name | NTID | AAID | NT Length | AA Length | Score | Probability |
|---|---|---|---|---|---|---|
| 4031593_c3_85 | 3189 | 7361 | 432 | 1299 | 1648 | 2.0e-169 |
| Protein name | | | | | Locus Name | Acc# |
| | | | | | sp:PUR2_SALTY | P26977 |

Description

RIBONUCLEOTIDE SYNTHETASE) (PHOSPHORIBOSYLGLYCINAMIDE SYNTHETASE)

| ORF Name | NTID | AAID | NT Length | AA Length | Score | Probability |
|---|---|---|---|---|---|---|
| 4953377_c1_51 | 3190 | 7362 | 259 | 780 | 808 | 2.1e-80 |
| Protein name | | | | | Locus Name | Acc# |
| | | | | | sp:THIF_ECOLI | P30138:P76 |

Description

THIF PROTEIN

| ORF Name | NTID | AAID | NT Length | AA Length | Score | Probability |
|---|---|---|---|---|---|---|
| 5086578_c3_84 | 3191 | 7363 | 569 | 1710 | 2258 | 4.7e-234 |
| Protein name | | | | | Locus Name | Acc# |
| | | | | | sp:PUR9_ECOLI | P15639 |

Description

| ORF Name | NTID | AAID | NT Length | AA Length | Score | Probability |
|---|---|---|---|---|---|---|
| 517842_f3_38 | 3192 | 7364 | 89 | 270 | 67 | 0.0021 |
| Protein name | | | | | Locus Name | Acc# |
| envelope glycoprotein | | | | | gp:AF105451 | AF105451 |

Description

HIV-1 isolate A-DII-07 from Italy, envelope glycoprotein, C2-V5region (env) gene, partial cds.

| ORF Name | NTID | AAID | NT Length | AA Length | Score | Probability |
|---|---|---|---|---|---|---|
| 6063956_c1_40 | 3193 | 7365 | 151 | 456 | 114 | 1.8e-06 |
| Protein name | | | | | Locus Name | Acc# |
| hypothetical protein PH0221 | | | | | pir:D71245 | D71245 |

Description

| ORF Name | NTID | AAID | NT Length | AA Length | Score | Probability |
|---|---|---|---|---|---|---|
| 7306555_c1_52 | 3194 | 7366 | 276 | 831 | 938 | 3.5e-94 |
| Protein name | | | | | Locus Name | Acc# |
| | | | | | sp:THIG_ECOLI | P30139:P76 |

Description

THIG PROTEIN

| ORF Name | NTID | AAID | NT Length | AA Length | Score | Probability |
|---|---|---|---|---|---|---|
| 975937_c3_92 | 3195 | 7367 | 88 | 267 | 160 | 9.7e-12 |
| Protein name | | | | | Locus Name | Acc# |
| | | | | | gp:STYSTMF1 | AF170176 |

Description

Salmonella typhimurium fragment STMF1.

| ORF Name | NTID | AAID | NT Length | AA Length | Score | Probability |
|---|---|---|---|---|---|---|
| 9822538_c2_66 | 3196 | 7368 | 115 | 348 | | |
| Protein name | | | | | Locus Name | Acc# |

Description

NO-HIT

| ORF Name | NTID | AAID | NT Length | AA Length | Score | Probability |
|---|---|---|---|---|---|---|
| 10053562_c1_346 | 3197 | 7369 | 84 | 255 | | |
| Protein name | | | | | Locus Name | Acc# |

Description

NO-HIT

| ORF Name | NTID | AAID | NT Length | AA Length | Score | Probability |
|---|---|---|---|---|---|---|
| 10211015_f2_112 | 3198 | 7370 | 384 | 1155 | 1572 | 2.3e-161 |
| Protein name | | | | | Locus Name | Acc# |
| | | | | | sp:DHAS_ECOLI | P00353 |

Description: DEHYDROGENASE)

| ORF Name | NTID | AAID | NT Length | AA Length | Score | Probability |
|---|---|---|---|---|---|---|
| 10566256_f1_61 | 3199 | 7371 | 91 | 276 | 74 | 0.017 |
| Protein name | | | | | Locus Name | Acc# |
| NADH-ubiquinone oxidoreductase subunit 6 | | | | | gp:GPA249395 | AJ249395 |

Description: Globodera pallida mitochondrial COII, ND4, COIII, ND6, ND1, ND3 andcytb genes.

| ORF Name | NTID | AAID | NT Length | AA Length | Score | Probability |
|---|---|---|---|---|---|---|
| 11026937_f3_213 | 3200 | 7372 | 148 | 447 | 614 | 7.6e-60 |
| Protein name | | | | | Locus Name | Acc# |
| | | | | | sp:RNPA_PROMI | P22835 |

Description: RIBONUCLEASE P PROTEIN COMPONENT, (PROTEIN C5) (RNASE P)

| ORF Name | NTID | AAID | NT Length | AA Length | Score | Probability |
|---|---|---|---|---|---|---|
| 11072127_f2_121 | 3201 | 7373 | 87 | 264 | 464 | 6.0e-44 |
| Protein name | | | | | Locus Name | Acc# |
| | | | | | sp:YIDD_PROMI | P22834 |

Description: HYPOTHETICAL 9.6 KD PROTEIN IN RNPA 3'REGION

| ORF Name | NTID | AAID | NT Length | AA Length | Score | Probability |
|---|---|---|---|---|---|---|
| 11739127_f2_148 | 3202 | 7374 | 170 | 513 | 161 | 7.6e-12 |
| Protein name | | | | | Locus Name | Acc# |
| unknown | | | | | gp:AF067954 | AF067954 |

Description

Salmonella typhimurium plasmid pMG101 silver binding proteinprecursor SilE (silE), silRS operon, silC(ORF96)BA(ORF105)P operon,complete sequence; and ORF191 gene, partial cds.

| ORF Name | NTID | AAID | NT Length | AA Length | Score | Probability |
|---|---|---|---|---|---|---|
| 119052_f3_220 | 3203 | 7375 | 61 | 186 | | |
| Protein name | | | | | Locus Name | Acc# |

Description

NO-HIT

| ORF Name | NTID | AAID | NT Length | AA Length | Score | Probability |
|---|---|---|---|---|---|---|
| 12687577_f1_55 | 3204 | 7376 | 143 | 432 | 334 | 3.6e-30 |
| Protein name | | | | | Locus Name | Acc# |
| | | | | | sp:YGIW_ECOLI | P52083 |

Description

PROTEIN YGIW PRECURSOR

| ORF Name | NTID | AAID | NT Length | AA Length | Score | Probability |
|---|---|---|---|---|---|---|
| 12939836_f1_5 | 3205 | 7377 | 110 | 333 | | |
| Protein name | | | | | Locus Name | Acc# |

Description

NO-HIT

| ORF Name | NTID | AAID | NT Length | AA Length | Score | Probability |
|---|---|---|---|---|---|---|
| 13005062_c1_323 | 3206 | 7378 | 418 | 1257 | 229 | 1.0e-16 |
| Protein name | | | | | Locus Name | Acc# |
| LPS glycosyltransferase icsA:protein sll1724:protein sll1724 | | | | | pir:S77338 | S77338 |

Description

| ORF Name | NTID | AAID | NT Length | AA Length | Score | Probability |
|---|---|---|---|---|---|---|
| 1351512_f3_224 | 3207 | 7379 | 296 | 891 | 512 | 4.9e-49 |
| Protein name | | | | | Locus Name | Acc# |
| | | | | | gp:BCY11138 | Y11138 |

Description

B.cereus DNA for ORF1, ORF2 and ORF3 (2402 bp).

| ORF Name | NTID | AAID | NT Length | AA Length | Score | Probability |
|---|---|---|---|---|---|---|
| 1380300_f3_214 | 3208 | 7380 | 459 | 1380 | 1900 | 4.0e-196 |
| Protein name | | | | | Locus Name | Acc# |
| | | | | | sp:THDF_ECOLI | P25522 |

Description

THIOPHENE AND FURAN OXIDATION PROTEIN THDF

| ORF Name | NTID | AAID | NT Length | AA Length | Score | Probability |
|---|---|---|---|---|---|---|
| 13884677_c1_304 | 3209 | 7381 | 296 | 891 | 300 | 1.4e-26 |
| Protein name | | | | | Locus Name | Acc# |
| LysR-type transcriptional activator | | | | | gp:AF009224 | AF009224:M |

Description

Acinetobacter sp. ADP1 ben operon and cat operon, completesequence.

| ORF Name | NTID | AAID | NT Length | AA Length | Score | Probability |
|---|---|---|---|---|---|---|
| 14095437_f3_203 | 3210 | 7382 | 101 | 306 | | |
| Protein name | | | | | Locus Name | Acc# |

Description

NO-HIT

| ORF Name | NTID | AAID | NT Length | AA Length | Score | Probability |
|---|---|---|---|---|---|---|
| 14252303_c3_431 | 3211 | 7383 | 1021 | 3066 | 154 | 1.8e-16 |
| Protein name | | | | | Locus Name | Acc# |
| | | | | | sp:YC17_HAEIN | P45114 |

Description

PROBABLE TONB-DEPENDENT RECEPTOR HI1217 PRECURSOR

| ORF Name | NTID | AAID | NT Length | AA Length | Score | Probability |
|---|---|---|---|---|---|---|
| 14454465_c3_471 | 3212 | 7384 | 188 | 567 | 261 | 1.9e-22 |
| Protein name | | | | | Locus Name | Acc# |
| | | | | | gp:AB024946 | AB024946 |

Description: Escherichia coli plasmid pB171 DNA, complete sequence.

| ORF Name | NTID | AAID | NT Length | AA Length | Score | Probability |
|---|---|---|---|---|---|---|
| 14555411_f2_130 | 3213 | 7385 | 819 | 2460 | 3796 | 0.0 |
| Protein name | | | | | Locus Name | Acc# |
| | | | | | sp:FDOG_ECOLI | P32176:P78 |

Description: DEHYDROGENASE MAJOR SUBUNIT)

| ORF Name | NTID | AAID | NT Length | AA Length | Score | Probability |
|---|---|---|---|---|---|---|
| 14646887_f3_240 | 3214 | 7386 | 112 | 339 | 116 | 8.5e-06 |
| Protein name | | | | | Locus Name | Acc# |
| | | | | | sp:YHCD_ECOLI | P45420 |

Description: REGION PRECURSOR

| ORF Name | NTID | AAID | NT Length | AA Length | Score | Probability |
|---|---|---|---|---|---|---|
| 14704438_f3_200 | 3215 | 7387 | 132 | 399 | 70 | 0.037 |
| Protein name | | | | | Locus Name | Acc# |
| | | | | | sp:YD28_METTH | O27383 |

Description: HYPOTHETICAL TRANSCRIPTIONAL REGULATOR MTH1328

| ORF Name | NTID | AAID | NT Length | AA Length | Score | Probability |
|---|---|---|---|---|---|---|
| 15801642_c2_348 | 3216 | 7388 | 489 | 1470 | 1270 | 2.3e-129 |
| Protein name | | | | | Locus Name | Acc# |
| | | | | | sp:YIEM_ECOLI | P03818:P31 |

Description: HYPOTHETICAL 49.6 KD PROTEIN IN ASNA-KUP INTERGENIC REGION

| ORF Name | NTID | AAID | NT Length | AA Length | Score | Probability |
|---|---|---|---|---|---|---|
| 15818765_c3_452 | 3217 | 7389 | 235 | 708 | 585 | 9.0e-57 |
| Protein name | | | | | Locus Name | Acc# |
| | | | | | sp:RADC_ECOLI | P25531 |

Description: DNA REPAIR PROTEIN RADC

| ORF Name | NTID | AAID | NT Length | AA Length | Score | Probability |
|---|---|---|---|---|---|---|
| 15829760_f1_24 | 3218 | 7390 | 143 | 432 | 312 | 7.6e-28 |
| Protein name | | | | | Locus Name | Acc# |
| | | | | | sp:DOC_BPP1 | Q06259 |

Description: DEATH ON CURING PROTEIN

| ORF Name | NTID | AAID | NT Length | AA Length | Score | Probability |
|---|---|---|---|---|---|---|
| 16048125_f1_58 | 3219 | 7391 | 228 | 687 | 95 | 0.0041 |
| Protein name | | | | | Locus Name | Acc# |
| | | | | | sp:GLTF_ECOLI | P28721 |

Description: PROTEIN GLTF PRECURSOR

| ORF Name | NTID | AAID | NT Length | AA Length | Score | Probability |
|---|---|---|---|---|---|---|
| 16050042_f2_155 | 3220 | 7392 | 77 | 234 | | |
| Protein name | | | | | Locus Name | Acc# |

Description: NO-HIT

| ORF Name | NTID | AAID | NT Length | AA Length | Score | Probability |
|---|---|---|---|---|---|---|
| 16104838_c3_439 | 3221 | 7393 | 470 | 1413 | 2382 | 3.4e-247 |
| Protein name | | | | | Locus Name | Acc# |
| | | | | | sp:DNAA_PROMI | P22837 |

Description: CHROMOSOMAL REPLICATION INITIATOR PROTEIN DNAA

| ORF Name | NTID | AAID | NT Length | AA Length | Score | Probability |
|---|---|---|---|---|---|---|
| 161687_f2_111 | 3222 | 7394 | 427 | 1284 | 713 | 2.4e-70 |

| Protein name | | | | | Locus Name | Acc# |
|---|---|---|---|---|---|---|
| | | | | | sp:MOCR_RHIME | P49309 |

Description: PROBABLE RHIZOPINE CATABOLISM REGULATORY PROTEIN MOCR

| ORF Name | NTID | AAID | NT Length | AA Length | Score | Probability |
|---|---|---|---|---|---|---|
| 16657191_f3_188 | 3223 | 7395 | 331 | 996 | 1143 | 6.6e-116 |

| Protein name | | | | | Locus Name | Acc# |
|---|---|---|---|---|---|---|
| | | | | | sp:RFAC_ECOLI | P24173:P27 |

Description: LIPOPOLYSACCHARIDE HEPTOSYLTRANSFERASE-1

| ORF Name | NTID | AAID | NT Length | AA Length | Score | Probability |
|---|---|---|---|---|---|---|
| 183135_f3_192 | 3224 | 7396 | 187 | 564 | 563 | 1.9e-54 |

| Protein name | | | | | Locus Name | Acc# |
|---|---|---|---|---|---|---|
| | | | | | sp:KDTB_ECOLI | P23875 |

Description: LIPOPOLYSACCHARIDE CORE BIOSYNTHESIS PROTEIN KDTB

| ORF Name | NTID | AAID | NT Length | AA Length | Score | Probability |
|---|---|---|---|---|---|---|
| 195267_c2_385 | 3225 | 7397 | 89 | 270 | 65 | 0.0013 |

| Protein name | | | | | Locus Name | Acc# |
|---|---|---|---|---|---|---|
| hypothetical protein b0502 | | | | | pir:E64781 | E64781 |

Description

| ORF Name | NTID | AAID | NT Length | AA Length | Score | Probability |
|---|---|---|---|---|---|---|
| 19537500_c3_445 | 3226 | 7398 | 200 | 603 | 398 | 5.9e-37 |

| Protein name | | | | | Locus Name | Acc# |
|---|---|---|---|---|---|---|
| hypothetical protein | | | | | gp:KPN011907 | AJ011907 |

Description: Klebsiella pneumoniae DNA sequence for transposon Tn5711, partial.

| ORF_Name | NTID | AAID | NT Length | AA Length | Score | Probability |
|---|---|---|---|---|---|---|
| 19709763_f2_108 | 3227 | 7399 | 81 | 246 | 159 | 1.2e-11 |
| Protein name | | | | | Locus Name | Acc# |
| | | | | | sp:YHHV_SALTY | P40819 |

Description: HYPOTHETICAL PROTEIN IN LIVF 5'REGION (FRAGMENT)

| ORF_Name | NTID | AAID | NT Length | AA Length | Score | Probability |
|---|---|---|---|---|---|---|
| 19711055_c1_310 | 3228 | 7400 | 375 | 1128 | 1845 | 2.7e-190 |
| Protein name | | | | | Locus Name | Acc# |
| | | | | | sp:DP3B_PROMI | P22838 |

Description: DNA POLYMERASE III, BETA CHAIN,

| ORF_Name | NTID | AAID | NT Length | AA Length | Score | Probability |
|---|---|---|---|---|---|---|
| 19790907_c1_306 | 3229 | 7401 | 451 | 1356 | 132 | 1.4e-05 |
| Protein name | | | | | Locus Name | Acc# |
| | | | | | sp:Y974_HAEIN | P44087 |

Description: HYPOTHETICAL PROTEIN HI0974

| ORF_Name | NTID | AAID | NT Length | AA Length | Score | Probability |
|---|---|---|---|---|---|---|
| 19803438_f3_206 | 3230 | 7402 | 239 | 720 | | |
| Protein name | | | | | Locus Name | Acc# |

Description: NO-HIT

| ORF_Name | NTID | AAID | NT Length | AA Length | Score | Probability |
|---|---|---|---|---|---|---|
| 19944207_f2_110 | 3231 | 7403 | 249 | 750 | 258 | 4.0e-22 |
| Protein name | | | | | Locus Name | Acc# |
| | | | | | sp:YJCO_ECOLI | P32713 |

Description: (F229)

| ORF Name | NTID | AAID | NT Length | AA Length | Score | Probability |
|---|---|---|---|---|---|---|
| 2037526_c1_333 | 3232 | 7404 | 411 | 1236 | 1679 | 1.1e-172 |
| Protein name | | | | | Locus Name | Acc# |
| | | | | | sp:KBL_ECOLI | P07912 |

Description
(GLYCINE ACETYLTRANSFERASE)

| ORF Name | NTID | AAID | NT Length | AA Length | Score | Probability |
|---|---|---|---|---|---|---|
| 20564652_f3_178 | 3233 | 7405 | 64 | 195 | | |
| Protein name | | | | | Locus Name | Acc# |

Description
NO-HIT

| ORF Name | NTID | AAID | NT Length | AA Length | Score | Probability |
|---|---|---|---|---|---|---|
| 20890641_c3_437 | 3234 | 7406 | 66 | 201 | | |
| Protein name | | | | | Locus Name | Acc# |

Description
NO-HIT

| ORF Name | NTID | AAID | NT Length | AA Length | Score | Probability |
|---|---|---|---|---|---|---|
| 213925_c2_369 | 3235 | 7407 | 60 | 183 | | |
| Protein name | | | | | Locus Name | Acc# |

Description
NO-HIT

| ORF Name | NTID | AAID | NT Length | AA Length | Score | Probability |
|---|---|---|---|---|---|---|
| 21542013_c2_378 | 3236 | 7408 | 304 | 915 | 913 | 1.6e-91 |
| Protein name | | | | | Locus Name | Acc# |
| | | | | | sp:FDHD_ECOLI | P32177 |

Description
FDHD PROTEIN

| ORF Name | NTID | AAID | NT Length | AA Length | Score | Probability |
|---|---|---|---|---|---|---|
| 21648453_c3_419 | 3237 | 7409 | 1242 | 3729 | 647 | 3.9e-87 |
| Protein name | | | | Locus Name | | Acc# |
| | | | | gp:AB015803 | | AB015803 |

Description

Acetobacter xylinus ORF200, ORF569, bcsABII-A, bcsX, bcxY, bcsCII and ORF569 genes, complete cds.

| ORF Name | NTID | AAID | NT Length | AA Length | Score | Probability |
|---|---|---|---|---|---|---|
| 2187625_c3_446 | 3238 | 7410 | 314 | 945 | 898 | 6.1e-90 |
| Protein name | | | | Locus Name | | Acc# |
| | | | | sp:YFEU_ECOLI | | P76535:P76 |

Description

HYPOTHETICAL 31.2 KD PROTEIN IN CYSP-AMIA INTERGENIC REGION

| ORF Name | NTID | AAID | NT Length | AA Length | Score | Probability |
|---|---|---|---|---|---|---|
| 21925008_f3_191 | 3239 | 7411 | 435 | 1308 | 1771 | 1.9e-182 |
| Protein name | | | | Locus Name | | Acc# |
| 3-deoxy-manno-octulosonic acid transferase | | | | gp:SMU52844 | | U52844 |

Description

Serratia marcescens putative glycosyltransferase, putativeglycosyltransferase, putative heptosylIII transferase (waaQ),3-deoxy-manno-octulosonic acid transferase (waaA), glucosyltransferase (waaE), and KdtB (kdtB) genes, complete cds; and Fpg(fpg) gene, partial cds.

| ORF Name | NTID | AAID | NT Length | AA Length | Score | Probability |
|---|---|---|---|---|---|---|
| 22072178_c3_420 | 3240 | 7412 | 157 | 474 | 145 | 3.8e-10 |
| Protein name | | | | Locus Name | | Acc# |
| | | | | sp:BCSD_ACEXY | | P37719 |

Description

CELLULOSE SYNTHASE OPERON D PROTEIN

| ORF_Name | NTID | AAID | NT Length | AA Length | Score | Probability |
|---|---|---|---|---|---|---|
| 22110767_c1_267 | 3241 | 7413 | 253 | 762 | 688 | 1.1e-67 |
| Protein name | | | | | Locus_Name | Acc# |
| | | | | | sp:GIDB_ECOLI | P17113 |

Description: GLUCOSE INHIBITED DIVISION PROTEIN B

| ORF_Name | NTID | AAID | NT Length | AA Length | Score | Probability |
|---|---|---|---|---|---|---|
| 22142967_f1_6 | 3242 | 7414 | 316 | 951 | 1392 | 2.7e-142 |
| Protein name | | | | | Locus_Name | Acc# |
| | | | | | sp:RFAD_ECOLI | P17963 |

Description: GLYCEROMANNO-HEPTOSE 6-EPIMERASE)

| ORF_Name | NTID | AAID | NT Length | AA Length | Score | Probability |
|---|---|---|---|---|---|---|
| 22143808_f2_135 | 3243 | 7415 | 573 | 1722 | 785 | 5.7e-78 |
| Protein name | | | | | Locus_Name | Acc# |
| | | | | | sp:Y275_HAEIN | P43975 |

Description: HYPOTHETICAL PROTEIN HI0275

| ORF_Name | NTID | AAID | NT Length | AA Length | Score | Probability |
|---|---|---|---|---|---|---|
| 22281638_f2_153 | 3244 | 7416 | 290 | 873 | 798 | 2.4e-79 |
| Protein name | | | | | Locus_Name | Acc# |
| PhnX | | | | | gp:STU69493 | U69493 |

Description: Salmonella typhimurium ThiJ and Orf1 genes, partial cds, and PhnX, PhnW, PhnR, PhnS, PhnT, PhnU and PhnV genes, complete cds.

| ORF_Name | NTID | AAID | NT Length | AA Length | Score | Probability |
|---|---|---|---|---|---|---|
| 2229202_f1_33 | 3245 | 7417 | 437 | 1314 | 1159 | 1.3e-117 |
| Protein name | | | | | Locus_Name | Acc# |
| hipA protein | | | | | pir:F64904 | F64904:B38 |

Description

| ORF Name | NTID | AAID | NT Length | AA Length | Score | Probability |
|---|---|---|---|---|---|---|
| 2243806_f3_246 | 3246 | 7418 | 160 | 483 | 472 | 8.5e-45 |
| Protein name | | | | | Locus Name | Acc# |
| transposase homolog A | | | | | gp:HPU95957 | U95957 |

Description

Helicobacter pylori insertion sequence IS606 transposase homologs A(tnpA) and B (tnpB) genes, complete cds.

| ORF Name | NTID | AAID | NT Length | AA Length | Score | Probability |
|---|---|---|---|---|---|---|
| 22689428_f3_241 | 3247 | 7419 | 64 | 195 | | |
| Protein name | | | | | Locus Name | Acc# |

Description

NO-HIT

| ORF Name | NTID | AAID | NT Length | AA Length | Score | Probability |
|---|---|---|---|---|---|---|
| 22852135_c1_262 | 3248 | 7420 | 240 | 723 | 444 | 7.8e-42 |
| Protein name | | | | | Locus Name | Acc# |
| | | | | | sp:YIEP_ECOLI | P31475 |

Description

HYPOTHETICAL 20.8 KD PROTEIN IN RBSR-RRSC INTERGENIC REGION

| ORF Name | NTID | AAID | NT Length | AA Length | Score | Probability |
|---|---|---|---|---|---|---|
| 23438793_f3_180 | 3249 | 7421 | 370 | 1113 | 1059 | 5.3e-107 |
| Protein name | | | | | Locus Name | Acc# |
| WbjC | | | | | gp:AF147795 | AF147795:U |

Description

Pseudomonas aeruginosa integration host factor beta-subunit (himD),complete cds; O-antigen biosynthesis locus, tRNA-Asn gene, completesequence; and aromatic-amino-acid aminotransferase (tyrB) gene,complete cds.

| ORF Name | NTID | AAID | NT Length | AA Length | Score | Probability |
|---|---|---|---|---|---|---|
| 23440678_f3_244 | 3250 | 7422 | 99 | 300 | 95 | 7.5e-05 |
| Protein name | | | | | Locus Name | Acc# |
| | | | | | sp:YJEO_ECOLI | P39284 |

Description

HYPOTHETICAL 12.6 KD PROTEIN IN GENX-PSD INTERGENIC REGION (O104B)

| ORF Name | NTID | AAID | NT Length | AA Length | Score | Probability |
|---|---|---|---|---|---|---|
| 23442177_c2_366 | 3251 | 7423 | 67 | 204 | 84 | 0.021 |
| Protein name | | | | | Locus Name | Acc# |
| ATP-dependent Clp proteinase, homolog | | | | | pir:S72278 | S72278:S78 |

Description

Pseudomonas aeruginosa integration host factor beta-subunit (himD), complete cds; O-antigen biosynthesis locus, tRNA-Asn gene, complete sequence; and aromatic-amino-acid aminotransferase (tyrB) gene, complete cds.

| ORF Name | NTID | AAID | NT Length | AA Length | Score | Probability |
|---|---|---|---|---|---|---|
| 23467_f3_179 | 3252 | 7424 | 345 | 1038 | 1354 | 2.9e-138 |
| Protein name | | | | | Locus Name | Acc# |
| WbjB | | | | | gp:AF147795 | AF147795:U |

Description

Pseudomonas aeruginosa integration host factor beta-subunit (himD), complete cds; O-antigen biosynthesis locus, tRNA-Asn gene, complete sequence; and aromatic-amino-acid aminotransferase (tyrB) gene, complete cds.

| ORF Name | NTID | AAID | NT Length | AA Length | Score | Probability |
|---|---|---|---|---|---|---|
| 23470253_f3_182 | 3253 | 7425 | 395 | 1188 | 1604 | 9.4e-165 |
| Protein name | | | | | Locus Name | Acc# |
| putative UDP-glucose dehydrogenase | | | | | gp:ECU90519 | U90519 |

Description

Escherichia coli putative UDP-glucose dehydrogenase (ugd) gene, complete cds, and IS1 transposable element InsA (insA) and transposase (insB) genes, complete cds.

| ORF Name | NTID | AAID | NT Length | AA Length | Score | Probability |
|---|---|---|---|---|---|---|
| 23470457_f3_190 | 3254 | 7426 | 372 | 1119 | 877 | 1.0e-87 |
| Protein name | | | | | Locus Name | Acc# |
| putative glycosyltransferase | | | | | gp:AF146532 | AF146532 |

Description

Klebsiella pneumoniae waa gene cluster.

| ORF_Name | NTID | AAID | NT Length | AA Length | Score | Probability |
|---|---|---|---|---|---|---|
| 23471050_f3_230 | 3255 | 7427 | 467 | 1404 | 1546 | 1.3e-158 |
| Protein name | | | | | Locus Name | Acc# |
| seryl-tRNA(Ser) selenium transferase,:cysteinyl-tRNA(Ser) selenium | | | | pir:A65159 | | A65159:A38 |

Description

| ORF_Name | NTID | AAID | NT Length | AA Length | Score | Probability |
|---|---|---|---|---|---|---|
| 23473812_f2_134 | 3256 | 7428 | 629 | 1890 | 1805 | 4.7e-186 |
| Protein name | | | | | Locus Name | Acc# |
| | | | | | sp:SELB_ECOLI | P14081 |

Description

SELENOCYSTEINE-SPECIFIC ELONGATION FACTOR (SELB TRANSLATION FACTOR)

| ORF_Name | NTID | AAID | NT Length | AA Length | Score | Probability |
|---|---|---|---|---|---|---|
| 23476633_f2_146 | 3257 | 7429 | 703 | 2112 | 642 | 8.2e-63 |
| Protein name | | | | | Locus Name | Acc# |
| | | | | | sp:YHCD_ECOLI | P45420 |

Description

REGION PRECURSOR

| ORF_Name | NTID | AAID | NT Length | AA Length | Score | Probability |
|---|---|---|---|---|---|---|
| 23651535_c3_432 | 3258 | 7430 | 276 | 831 | 261 | 1.9e-22 |
| Protein name | | | | | Locus Name | Acc# |
| TonB | | | | | gp:AF070473 | AF070473 |

Description

Pasteurella multocida ExbD (exbD) gene, partial cds; and TonB(tonB) gene, complete cds.

| ORF_Name | NTID | AAID | NT Length | AA Length | Score | Probability |
|---|---|---|---|---|---|---|
| 23724062_f2_124 | 3259 | 7431 | 364 | 1095 | 147 | 1.0e-07 |
| Protein name | | | | | Locus Name | Acc# |
| hypothetical protein C41G11.1 | | | | | pir:T29511 | T29511 |

Description

744

| ORF Name | NTID | AAID | NT Length | AA Length | Score | Probability |
|---|---|---|---|---|---|---|
| 24111313_c3_440 | 3260 | 7432 | 383 | 1152 | 1859 | 8.9e-192 |
| Protein name | | | | | Locus Name | Acc# |
| | | | | | sp:RECF_PROMI | P22839 |

Description: RECF PROTEIN

| ORF Name | NTID | AAID | NT Length | AA Length | Score | Probability |
|---|---|---|---|---|---|---|
| 24226017_f1_57 | 3261 | 7433 | 239 | 720 | | |
| Protein name | | | | | Locus Name | Acc# |

Description: NO-HIT

| ORF Name | NTID | AAID | NT Length | AA Length | Score | Probability |
|---|---|---|---|---|---|---|
| 24228427_f2_115 | 3262 | 7434 | 156 | 471 | 137 | 2.7e-09 |
| Protein name | | | | | Locus Name | Acc# |
| hypothetical protein jhp1332 | | | | | pir:B71820 | B71820 |

Description:

| ORF Name | NTID | AAID | NT Length | AA Length | Score | Probability |
|---|---|---|---|---|---|---|
| 24275376_f3_197 | 3263 | 7435 | 418 | 1257 | 1449 | 2.5e-148 |
| Protein name | | | | | Locus Name | Acc# |
| | | | | | sp:DFP_ECOLI | P24285:P76 |

Description: DNA/PANTOTHENATE METABOLISM FLAVOPROTEIN

| ORF Name | NTID | AAID | NT Length | AA Length | Score | Probability |
|---|---|---|---|---|---|---|
| 24352318_f3_228 | 3264 | 7436 | 222 | 669 | 763 | 1.2e-75 |
| Protein name | | | | | Locus Name | Acc# |
| | | | | | sp:FDOI_ECOLI | P32174 |

Description: DEHYDROGENASE CYTOCHROME B556 SUBUNIT)

| ORF Name | NTID | AAID | NT Length | AA Length | Score | Probability |
|---|---|---|---|---|---|---|
| 24408301_f1_1 | 3265 | 7437 | 414 | 1245 | 966 | 3.8e-97 |
| Protein name | | | | | Locus Name | Acc# |
| unknown | | | | | gp:AF144879 | AF144879 |

Description: Leptospira interrogans rfb locus, complete sequence.

| ORF Name | NTID | AAID | NT Length | AA Length | Score | Probability |
|---|---|---|---|---|---|---|
| 24411540_f1_10 | 3266 | 7438 | 385 | 1158 | 1354 | 2.9e-138 |
| Protein name | | | | | Locus Name | Acc# |
| putative glycosyltransferase | | | | | gp:SMU52844 | U52844 |

Description: Serratia marcescens putative glycosyltransferase, putativeglycosyltransferase, putative heptosylIII transferase (waaQ),3-deoxy-manno-octulosonic acid transferase (waaA), glucosyltransferase (waaE), and KdtB (kdtB) genes, complete cds; and Fpg(fpg) gene, partial cds.

| ORF Name | NTID | AAID | NT Length | AA Length | Score | Probability |
|---|---|---|---|---|---|---|
| 24431562_f3_257 | 3267 | 7439 | 331 | 996 | 1276 | 5.4e-130 |
| Protein name | | | | | Locus Name | Acc# |
| | | | | | sp:ASNA_ECOLI | P00963 |

Description: ASPARTATE--AMMONIA LIGASE, (ASPARAGINE SYNTHETASE A)

| ORF Name | NTID | AAID | NT Length | AA Length | Score | Probability |
|---|---|---|---|---|---|---|
| 24640706_c3_430 | 3268 | 7440 | 325 | 978 | 347 | 1.5e-31 |
| Protein name | | | | | Locus Name | Acc# |
| unknown | | | | | gp:PMU66821 | U66821 |

Description: Proteus mirabilis UmoA (umoA) gene, complete cds; and unknown gene.

| ORF Name | NTID | AAID | NT Length | AA Length | Score | Probability |
|---|---|---|---|---|---|---|
| 24640878_f3_239 | 3269 | 7441 | 214 | 645 | | |
| Protein name | | | | | Locus Name | Acc# |

Description: NO-HIT

| ORF Name | NTID | AAID | NT Length | AA Length | Score | Probability |
|---|---|---|---|---|---|---|
| 24642926_c2_371 | 3270 | 7442 | 784 | 2355 | 649 | 1.5e-63 |
| Protein name | | | | | Locus Name | Acc# |
| | | | | | sp:ACSB_ACEXY | P37716 |

Description: PROTEIN B)

| ORF Name | NTID | AAID | NT Length | AA Length | Score | Probability |
|---|---|---|---|---|---|---|
| 24797133_f3_185 | 3271 | 7443 | 485 | 1458 | 2038 | 9.6e-211 |
| Protein name | | | | | Locus Name | Acc# |
| | | | | | sp:YLIG_ECOLI | P75802 |

Description: HYPOTHETICAL 49.6 KD PROTEIN IN MOEA-DACC INTERGENIC REGION

| ORF Name | NTID | AAID | NT Length | AA Length | Score | Probability |
|---|---|---|---|---|---|---|
| 24882082_f2_89 | 3272 | 7444 | 337 | 1014 | 646 | 3.1e-63 |
| Protein name | | | | | Locus Name | Acc# |
| | | | | | sp:YIBQ_ECOLI | P37691 |

Description: HYPOTHETICAL 30.7 KD PROTEIN IN SECB-TDH INTERGENIC REGION

| ORF Name | NTID | AAID | NT Length | AA Length | Score | Probability |
|---|---|---|---|---|---|---|
| 251000_c3_411 | 3273 | 7445 | 158 | 477 | 274 | 8.1e-24 |
| Protein name | | | | | Locus Name | Acc# |
| unknown protein | | | | | gp:ECOHATP | M25464 |

Description: E.coli H+ ATPase alpha, beta, gamma, delta and epsilon, and integral membrane proton channel a, b, and c subunit genes, complete cds.

| ORF Name | NTID | AAID | NT Length | AA Length | Score | Probability |
|---|---|---|---|---|---|---|
| 25448591_c2_354 | 3274 | 7446 | 142 | 429 | 535 | 1.8e-51 |
| Protein name | | | | | Locus Name | Acc# |
| H+-transporting ATP synthase, epsilon chain:hydrogen ion-transporting ATPase epsilon | | | | | pir:PWECE | B90106:B93 |

Description

| ORF Name | NTID | AAID | NT Length | AA Length | Score | Probability |
|---|---|---|---|---|---|---|
| 26213942_f2_76 | 3275 | 7447 | 72 | 219 | | |
| Protein name | | | | | Locus Name | Acc# |

Description
NO-HIT

| ORF Name | NTID | AAID | NT Length | AA Length | Score | Probability |
|---|---|---|---|---|---|---|
| 26275376_c3_455 | 3276 | 7448 | 275 | 828 | 1029 | 8.0e-104 |
| Protein name | | | | | Locus Name | Acc# |
| | | | | | sp:FPG_ECOLI | P05523 |

Description
(GLYCOSYLASE)

| ORF Name | NTID | AAID | NT Length | AA Length | Score | Probability |
|---|---|---|---|---|---|---|
| 26304818_c1_271 | 3277 | 7449 | 291 | 876 | 1281 | 1.6e-130 |
| Protein name | | | | | Locus Name | Acc# |
| | | | | | sp:ATPG_ECOLI | P00837:P00 |

Description
ATP SYNTHASE GAMMA CHAIN,

| ORF Name | NTID | AAID | NT Length | AA Length | Score | Probability |
|---|---|---|---|---|---|---|
| 26585912_c1_269 | 3278 | 7450 | 85 | 258 | 379 | 6.1e-35 |
| Protein name | | | | | Locus Name | Acc# |
| | | | | | sp:ATPL_ECOLI | P00844 |

Description
(DICYCLOHEXYLCARBODIIMIDE-BINDING PROTEIN)

| ORF Name | NTID | AAID | NT Length | AA Length | Score | Probability |
|---|---|---|---|---|---|---|
| 26765675_c1_292 | 3279 | 7451 | 326 | 981 | 992 | 6.7e-100 |
| Protein name | | | | | Locus Name | Acc# |
| | | | | | sp:GALU_ECOLI | P25520 |

Description
(URIDYLYLTRANSFERASE) (URIDINE DIPHOSPHOGLUCOSE PYROPHOSPHORYLASE)

| ORF_Name | NTID | AAID | NT Length | AA Length | Score | Probability |
|---|---|---|---|---|---|---|
| 26773410_f2_147 | 3280 | 7452 | 197 | 594 | 237 | 6.8e-20 |
| Protein name | | | | | Locus Name | Acc# |
| | | | | | sp:YHCA_ECOLI | P28722 |

Description: PRECURSOR

| ORF_Name | NTID | AAID | NT Length | AA Length | Score | Probability |
|---|---|---|---|---|---|---|
| 26848503_c3_462 | 3281 | 7453 | 325 | 978 | | |
| Protein name | | | | | Locus Name | Acc# |

Description: NO-HIT

| ORF_Name | NTID | AAID | NT Length | AA Length | Score | Probability |
|---|---|---|---|---|---|---|
| 26854562_c3_410 | 3282 | 7454 | 158 | 477 | 617 | 3.6e-60 |
| Protein name | | | | | Locus Name | Acc# |
| | | | | | sp:ASNC_ECOLI | P03809 |

Description: REGULATORY PROTEIN ASNC

| ORF_Name | NTID | AAID | NT Length | AA Length | Score | Probability |
|---|---|---|---|---|---|---|
| 2751436_f2_77 | 3283 | 7455 | 437 | 1314 | 191 | 2.6e-13 |
| Protein name | | | | | Locus Name | Acc# |
| hypothetical protein | | | | | pir:B72353 | B72353 |

Description

| ORF_Name | NTID | AAID | NT Length | AA Length | Score | Probability |
|---|---|---|---|---|---|---|
| 2822127_f1_41 | 3284 | 7456 | 313 | 942 | 1425 | 8.7e-146 |
| Protein name | | | | | Locus Name | Acc# |
| | | | | | sp:FDOH_ECOLI | P32175 |

Description: IRON-SULFUR SUBUNIT)

| ORF Name | NTID | AAID | NT Length | AA Length | Score | Probability |
|---|---|---|---|---|---|---|
| 29298550_c1_322 | 3285 | 7457 | 85 | 258 | 388 | 6.7e-36 |
| Protein name | | | | | Locus Name | Acc# |
| ribosomal protein L28 | | | | | pir:R5EC28 | S42443:A02 |

Description

| ORF Name | NTID | AAID | NT Length | AA Length | Score | Probability |
|---|---|---|---|---|---|---|
| 29740890_c2_398 | 3286 | 7458 | 349 | 1050 | 144 | 5.1e-16 |
| Protein name | | | | | Locus Name | Acc# |
| putative heptosyl III transferase WaaQ | | | | | gp:AF146532 | AF146532 |

Description
Klebsiella pneumoniae waa gene cluster.

| ORF Name | NTID | AAID | NT Length | AA Length | Score | Probability |
|---|---|---|---|---|---|---|
| 30131680_c2_374 | 3287 | 7459 | 361 | 1086 | 840 | 8.5e-84 |
| Protein name | | | | | Locus Name | Acc# |
| | | | | | sp:GUNY_ERWCH | P27032 |

Description
Y) (CELLULASE Y) (EGY)

| ORF Name | NTID | AAID | NT Length | AA Length | Score | Probability |
|---|---|---|---|---|---|---|
| 3125375_f3_198 | 3288 | 7460 | 212 | 639 | 816 | 3.0e-81 |
| Protein name | | | | | Locus Name | Acc# |
| | | | | | sp:TTK_ECOLI | P06969 |

Description
TTK PROTEIN

| ORF Name | NTID | AAID | NT Length | AA Length | Score | Probability |
|---|---|---|---|---|---|---|
| 32236425_c1_284 | 3289 | 7461 | 72 | 219 | | |
| Protein name | | | | | Locus Name | Acc# |

Description
NO-HIT

750

| ORF Name | NTID | AAID | NT Length | AA Length | Score | Probability |
|---|---|---|---|---|---|---|
| 32805_c3_416 | 3290 | 7462 | 425 | 1278 | 1710 | 5.5e-176 |
| Protein name | | | | | Locus Name | Acc# |
| hypothetical protein b1432 | | | | | pir:C64895 | C64895 |

Description

| ORF Name | NTID | AAID | NT Length | AA Length | Score | Probability |
|---|---|---|---|---|---|---|
| 33204375_f3_245 | 3291 | 7463 | 70 | 213 | | |
| Protein name | | | | | Locus Name | Acc# |

Description
NO-HIT

| ORF Name | NTID | AAID | NT Length | AA Length | Score | Probability |
|---|---|---|---|---|---|---|
| 33228758_c1_280 | 3292 | 7464 | 373 | 1122 | 336 | 2.2e-30 |
| Protein name | | | | | Locus Name | Acc# |
| multidrug resistance protein A (emrA) RP243 | | | | | pir:G71678 | G71678 |

Description

| ORF Name | NTID | AAID | NT Length | AA Length | Score | Probability |
|---|---|---|---|---|---|---|
| 33236686_c3_417 | 3293 | 7465 | 143 | 432 | 71 | 0.036 |
| Protein name | | | | | Locus Name | Acc# |
| | | | | | sp:Y029_NPVAC | P41433 |

Description
HYPOTHETICAL 8.6 KD PROTEIN IN IAP1-SOD INTERGENIC REGION

| ORF Name | NTID | AAID | NT Length | AA Length | Score | Probability |
|---|---|---|---|---|---|---|
| 33412800_c2_358 | 3294 | 7466 | 390 | 1173 | 181 | 2.1e-12 |
| Protein name | | | | | Locus Name | Acc# |
| AgaE | | | | | gp:AF035413 | AF035413 |

Description
Agrobacterium tumefaciens AgaA, AgaC, AgaB, AgaD, AgaE, AgaF, AgaG, MoaR, MoaB, MoaC, MoaD, and MoaA genes, complete cds.

| ORF Name | NTID | AAID | NT Length | AA Length | Score | Probability |
|---|---|---|---|---|---|---|
| 33645035_f3_217 | 3295 | 7467 | 662 | 1989 | 112 | 0.0096 |

| Protein name | Locus Name | Acc# |
|---|---|---|
| insecticidal protein | gp:D88381 | D88381 |

Description

Bacillus thuringiensis gene for insecticidal protein, complete cds.

| ORF Name | NTID | AAID | NT Length | AA Length | Score | Probability |
|---|---|---|---|---|---|---|
| 33672817_f2_79 | 3296 | 7468 | 387 | 1164 | 1471 | 1.2e-150 |

| Protein name | Locus Name | Acc# |
|---|---|---|
| WbjD | gp:AF147795 | AF147795:U |

Description

Pseudomonas aeruginosa integration host factor beta-subunit (himD),complete cds; O-antigen biosynthesis locus, tRNA-Asn gene, completesequence; and aromatic-amino-acid aminotransferase (tyrB) gene,complete cds.

| ORF Name | NTID | AAID | NT Length | AA Length | Score | Probability |
|---|---|---|---|---|---|---|
| 33712778_f3_255 | 3297 | 7469 | 78 | 237 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 34181437_f2_154 | 3298 | 7470 | 143 | 432 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 34401886_c1_329 | 3299 | 7471 | 372 | 1119 | 254 | 3.5e-21 |

| Protein name | Locus Name | Acc# |
|---|---|---|
| ADP-heptose-lps heptosyltransferase II | pir:G64668 | G64668 |

Description

| ORF Name | NTID | AAID | NT Length | AA Length | Score | Probability |
|---|---|---|---|---|---|---|
| 34406662_f3_229 | 3300 | 7472 | 308 | 927 | 1056 | 1.1e-106 |
| Protein name | | | | | Locus Name | Acc# |
| | | | | | sp:FDHE_ECOLI | P13024 |

Description
FDHE PROTEIN

| ORF Name | NTID | AAID | NT Length | AA Length | Score | Probability |
|---|---|---|---|---|---|---|
| 34417075_c2_397 | 3301 | 7473 | 377 | 1134 | 295 | 4.8e-26 |
| Protein name | | | | | Locus Name | Acc# |
| hypothetical protein TM0622 | | | | | pir:E72354 | E72354 |

Description

| ORF Name | NTID | AAID | NT Length | AA Length | Score | Probability |
|---|---|---|---|---|---|---|
| 34565937_f2_114 | 3302 | 7474 | 204 | 615 | | |
| Protein name | | | | | Locus Name | Acc# |

Description
NO-HIT

| ORF Name | NTID | AAID | NT Length | AA Length | Score | Probability |
|---|---|---|---|---|---|---|
| 34570931_c2_350 | 3303 | 7475 | 163 | 492 | 669 | 1.1e-65 |
| Protein name | | | | | Locus Name | Acc# |
| | | | | | gp:ECOUNCF | M10422 |

Description
E.coli uncF gene encoding the b subunit of the proton-translocatingATPase (F-1F-0).

| ORF Name | NTID | AAID | NT Length | AA Length | Score | Probability |
|---|---|---|---|---|---|---|
| 34667842_c2_362 | 3304 | 7476 | 511 | 1536 | 253 | 1.2e-18 |
| Protein name | | | | | Locus Name | Acc# |
| VceB | | | | | gp:AF012101 | AF012101 |

Description
Vibrio cholerae efflux gene A (vceA) and efflux gene B (vceB)multidrug resistance pump genes, complete cds.

| ORF Name | NTID | AAID | NT Length | AA Length | Score | Probability |
|---|---|---|---|---|---|---|
| 35160717_f3_186 | 3305 | 7477 | 435 | 1308 | 1221 | 3.6e-124 |

| Protein name | | | | | Locus Name | Acc# |
|---|---|---|---|---|---|---|
| hypothetical 47.5K protein (secb-tdh intergenic region):hypothetical protein o427 | | | | | pir:S47834 | S47834:G65 |

Description

Klebsiella pneumoniae waa gene cluster.

| ORF Name | NTID | AAID | NT Length | AA Length | Score | Probability |
|---|---|---|---|---|---|---|
| 35317203_f1_39 | 3306 | 7478 | 269 | 810 | | |

| Protein name | | | | | Locus Name | Acc# |

Description

NO-HIT

| ORF Name | NTID | AAID | NT Length | AA Length | Score | Probability |
|---|---|---|---|---|---|---|
| 35324057_f2_97 | 3307 | 7479 | 378 | 1137 | 1005 | 2.8e-101 |

| Protein name | | | | | Locus Name | Acc# |
|---|---|---|---|---|---|---|
| putative heptosyl III transferase WaaQ | | | | | gp:AF146532 | AF146532 |

Description

Klebsiella pneumoniae waa gene cluster.

| ORF Name | NTID | AAID | NT Length | AA Length | Score | Probability |
|---|---|---|---|---|---|---|
| 35757837_c3_407 | 3308 | 7480 | 472 | 1419 | 1661 | 8.5e-171 |

| Protein name | | | | | Locus Name | Acc# |
|---|---|---|---|---|---|---|
| | | | | | sp:YIEO_ECOLI | P31474 |

Description

HYPOTHETICAL 51.5 KD PROTEIN IN RBSR-RRSC INTERGENIC REGION

| ORF Name | NTID | AAID | NT Length | AA Length | Score | Probability |
|---|---|---|---|---|---|---|
| 35937908_c1_320 | 3309 | 7481 | 257 | 774 | 994 | 4.1e-100 |

| Protein name | | | | | Locus Name | Acc# |
|---|---|---|---|---|---|---|
| | | | | | sp:RNPH_ECOLI | P03842 |

Description

NUCLEOTIDYLTRANSFERASE)

| ORF Name | NTID | AAID | NT Length | AA Length | Score | Probability |
|---|---|---|---|---|---|---|
| 36600688_f2_99 | 3310 | 7482 | 281 | 846 | 885 | 1.5e-88 |
| Protein name | | | | | Locus Name | Acc# |
| glucosyl transferase | | | | | gp:SMU52844 | U52844 |

Description

Serratia marcescens putative glycosyltransferase, putativeglycosyltransferase, putative heptosylIII transferase (waaQ),3-deoxy-manno-octulosonic acid transferase (waaA), glucosyltransferase (waaE), and KdtB (kdtB) genes, complete cds; and Fpg(fpg) gene, partial cds.

| ORF Name | NTID | AAID | NT Length | AA Length | Score | Probability |
|---|---|---|---|---|---|---|
| 36605443_c2_351 | 3311 | 7483 | 181 | 546 | 658 | 1.6e-64 |
| Protein name | | | | | Locus Name | Acc# |
| | | | | | sp:ATPD_ECOLI | P00831 |

Description

ATP SYNTHASE DELTA CHAIN,

| ORF Name | NTID | AAID | NT Length | AA Length | Score | Probability |
|---|---|---|---|---|---|---|
| 3906302_f1_56 | 3312 | 7484 | 248 | 747 | 86 | 0.0027 |
| Protein name | | | | | Locus Name | Acc# |
| | | | | | sp:YEHE_ECOLI | P33344 |

Description

HYPOTHETICAL 10.1 KD PROTEIN IN GATY-MRP INTERGENIC REGION PRECURSOR

| ORF Name | NTID | AAID | NT Length | AA Length | Score | Probability |
|---|---|---|---|---|---|---|
| 3912563_f2_150 | 3313 | 7485 | 215 | 648 | 293 | 7.9e-26 |
| Protein name | | | | | Locus Name | Acc# |
| probable transcription regulator | | | | | pir:T37165 | T37165 |

Description

| ORF Name | NTID | AAID | NT Length | AA Length | Score | Probability |
|---|---|---|---|---|---|---|
| 3917705_f1_7 | 3314 | 7486 | 353 | 1062 | 1355 | 2.3e-138 |
| Protein name | | | | | Locus Name | Acc# |
| | | | | | sp:RFAF_ECOLI | P37692 |

Description

ADP-HEPTOSE--LPS HEPTOSYLTRANSFERASE II

| ORF Name | NTID | AAID | NT Length | AA Length | Score | Probability |
|---|---|---|---|---|---|---|
| 3928125_f2_113 | 3315 | 7487 | 181 | 546 | | |
| Protein name | | | | | Locus Name | Acc# |

Description: NO-HIT

| ORF Name | NTID | AAID | NT Length | AA Length | Score | Probability |
|---|---|---|---|---|---|---|
| 3938288_f1_23 | 3316 | 7488 | 290 | 873 | 1155 | 3.6e-117 |
| Protein name | | | | | Locus Name | Acc# |
| | | | | | sp:YICC_ECOLI | P23839 |

Description: 33.2 KD PROTEIN IN DIND-RPH INTERGENIC REGION (ORF X)

| ORF Name | NTID | AAID | NT Length | AA Length | Score | Probability |
|---|---|---|---|---|---|---|
| 3942181_f1_19 | 3317 | 7489 | 155 | 468 | 666 | 2.3e-65 |
| Protein name | | | | | Locus Name | Acc# |
| | | | | | sp:DUT_ECOLI | P06968 |

Description: (DUTPASE) (DUTP PYROPHOSPHATASE)

| ORF Name | NTID | AAID | NT Length | AA Length | Score | Probability |
|---|---|---|---|---|---|---|
| 3964002_f3_181 | 3318 | 7490 | 138 | 417 | | |
| Protein name | | | | | Locus Name | Acc# |

Description: NO-HIT

| ORF Name | NTID | AAID | NT Length | AA Length | Score | Probability |
|---|---|---|---|---|---|---|
| 4001450_c1_340 | 3319 | 7491 | 148 | 447 | 475 | 4.1e-45 |
| Protein name | | | | | Locus Name | Acc# |
| | | | | | sp:YIBN_ECOLI | P37688 |

Description: HYPOTHETICAL 15.6 KD PROTEIN IN SECB-TDH INTERGENIC REGION

| ORF Name | NTID | AAID | NT Length | AA Length | Score | Probability |
|---|---|---|---|---|---|---|
| 4093758_f2_80 | 3320 | 7492 | 422 | 1269 | 1043 | 2.6e-105 |

Protein name: repeat unit exporter Wzx

Locus Name: gp:AF104912    Acc#: AF104912

Description: Escherichia coli K30 capsule biosynthesis cluster, partial sequence.

| ORF Name | NTID | AAID | NT Length | AA Length | Score | Probability |
|---|---|---|---|---|---|---|
| 4094393_c1_334 | 3321 | 7493 | 344 | 1035 | 1688 | 1.2e-173 |

Protein name:

Locus Name: sp:TDH_ECOLI    Acc#: P07913

Description: THREONINE 3-DEHYDROGENASE,

| ORF Name | NTID | AAID | NT Length | AA Length | Score | Probability |
|---|---|---|---|---|---|---|
| 4110338_f2_143 | 3322 | 7494 | 306 | 921 | 875 | 1.7e-87 |

Protein name:

Locus Name: sp:YCFX_ECOLI    Acc#: P75959

Description: HYPOTHETICAL 33.0 KD PROTEIN IN MFD-COBB INTERGENIC REGION

| ORF Name | NTID | AAID | NT Length | AA Length | Score | Probability |
|---|---|---|---|---|---|---|
| 4148337_f2_129 | 3323 | 7495 | 204 | 615 | 914 | 1.2e-91 |

Protein name:

Locus Name: sp:FDOG_ECOLI    Acc#: P32176:P78

Description: DEHYDROGENASE MAJOR SUBUNIT)

| ORF Name | NTID | AAID | NT Length | AA Length | Score | Probability |
|---|---|---|---|---|---|---|
| 4148438_f1_27 | 3324 | 7496 | 389 | 1170 | | |

Protein name:

Locus Name:    Acc#:

Description: NO-HIT

| ORF Name | NTID | AAID | NT Length | AA Length | Score | Probability |
|---|---|---|---|---|---|---|
| 4148518_c1_279 | 3325 | 7497 | 471 | 1416 | 750 | 2.9e-74 |
| Protein name | | | | | Locus Name | Acc# |
| | | | | | sp:YCGA_BACSU | P55908 |

Description: HYPOTHETICAL 41.5 KD PROTEIN IN AMHX-AMYE INTERGENIC REGION

| ORF Name | NTID | AAID | NT Length | AA Length | Score | Probability |
|---|---|---|---|---|---|---|
| 4329693_f2_175 | 3326 | 7498 | 311 | 936 | 1034 | 2.4e-104 |
| Protein name | | | | | Locus Name | Acc# |
| | | | | | sp:RBSK_ECOLI | P05054 |

Description: RIBOKINASE,

| ORF Name | NTID | AAID | NT Length | AA Length | Score | Probability |
|---|---|---|---|---|---|---|
| 4475643_c2_349 | 3327 | 7499 | 635 | 1908 | 2803 | 8.2e-292 |
| Protein name | | | | | Locus Name | Acc# |
| | | | | | sp:GIDA_ECOLI | P17112:P03 |

Description: GLUCOSE INHIBITED DIVISION PROTEIN A

| ORF Name | NTID | AAID | NT Length | AA Length | Score | Probability |
|---|---|---|---|---|---|---|
| 4506641_f3_236 | 3328 | 7500 | 89 | 270 | | |
| Protein name | | | | | Locus Name | Acc# |

Description: NO-HIT

| ORF Name | NTID | AAID | NT Length | AA Length | Score | Probability |
|---|---|---|---|---|---|---|
| 4548438_c1_275 | 3329 | 7501 | 339 | 1020 | 448 | 3.0e-42 |
| Protein name | | | | | Locus Name | Acc# |
| | | | | | gp:APU04954 | U04954 |

Description: Actinobacillus pleuropneumoniae afuA, afuB, afuC, apxIC and RTX-1toxin determinant (apxIA) genes, complete cds.

| ORF Name | NTID | AAID | NT Length | AA Length | Score | Probability |
|---|---|---|---|---|---|---|
| 4688801_f2_81 | 3330 | 7502 | 175 | 528 | 665 | 3.0e-65 |

| Protein name | Locus Name | Acc# |
|---|---|---|
| | sp:YIBK_ECOLI | P33899 |

Description

HYPOTHETICAL TRNA/RRNA METHYLTRANSFERASE YIBK,

| ORF Name | NTID | AAID | NT Length | AA Length | Score | Probability |
|---|---|---|---|---|---|---|
| 4692817_c1_341 | 3331 | 7503 | 340 | 1023 | 1424 | 1.1e-145 |

| Protein name | Locus Name | Acc# |
|---|---|---|
| | sp:GPDA_ECOLI | P37606 |

Description

,

| ORF Name | NTID | AAID | NT Length | AA Length | Score | Probability |
|---|---|---|---|---|---|---|
| 4735630_c1_305 | 3332 | 7504 | 280 | 843 | 105 | 0.0039 |

| Protein name | Locus Name | Acc# |
|---|---|---|
| | sp:Y973_HAEIN | Q57133:O05 |

Description

HYPOTHETICAL PROTEIN HI0973

| ORF Name | NTID | AAID | NT Length | AA Length | Score | Probability |
|---|---|---|---|---|---|---|
| 4802202_c1_317 | 3333 | 7505 | 152 | 459 | 453 | 8.7e-43 |

| Protein name | Locus Name | Acc# |
|---|---|---|
| unknown | gp:AF009672 | AF009672 |

Description

Acinetobacter sp. ADP1 VanR (vanR), vanillate demethylase (vanB), vanillate demethylase (vanA), and VanK (vanK) genes, complete cds; and unknown genes.

| ORF Name | NTID | AAID | NT Length | AA Length | Score | Probability |
|---|---|---|---|---|---|---|
| 4876260_f2_78 | 3334 | 7506 | 366 | 1101 | 186 | 7.7e-12 |

| Protein name | Locus Name | Acc# |
|---|---|---|
| hypothetical protein slr1077 | pir:S74778 | S74778 |

Description

| ORF_Name | NTID | AAID | NT Length | AA Length | Score | Probability |
|---|---|---|---|---|---|---|
| 4882963_c2_372 | 3335 | 7507 | 304 | 915 | 327 | 2.3e-28 |
| Protein name | | | | | Locus Name | Acc# |
| nitrogen fixation positive activator protein:protein slr1305:protein slr1305 | | | | pir:S74707 | | S74707 |

Description: (none listed beyond protein name)

| ORF_Name | NTID | AAID | NT Length | AA Length | Score | Probability |
|---|---|---|---|---|---|---|
| 4897558_f1_38 | 3336 | 7508 | 75 | 228 | | |
| Protein name | | | | | Locus Name | Acc# |

Description: NO-HIT

| ORF_Name | NTID | AAID | NT Length | AA Length | Score | Probability |
|---|---|---|---|---|---|---|
| 4975282_c2_384 | 3337 | 7509 | 813 | 2442 | 3419 | 0.0 |
| Protein name | | | | | Locus Name | Acc# |
| | | | | | gp:ECGYRBF | X04341:X00 |

Description: E. coli genes dnaN (3'region), recF and gyrB.

| ORF_Name | NTID | AAID | NT Length | AA Length | Score | Probability |
|---|---|---|---|---|---|---|
| 5109626_f3_193 | 3338 | 7510 | 424 | 1275 | 756 | 6.8e-75 |
| Protein name | | | | | Locus Name | Acc# |
| | | | | | sp:RFAL_SALTY | P26471 |

Description: O-ANTIGEN LIGASE

| ORF_Name | NTID | AAID | NT Length | AA Length | Score | Probability |
|---|---|---|---|---|---|---|
| 5119087_f1_32 | 3339 | 7511 | 87 | 264 | 156 | 2.6e-11 |
| Protein name | | | | | Locus Name | Acc# |
| | | | | | sp:HIPB_ECOLI | P23873 |

Description: HIPB PROTEIN

| ORF Name | NTID | AAID | NT Length | AA Length | Score | Probability |
|---|---|---|---|---|---|---|
| 524175_c1_264 | 3340 | 7512 | 503 | 1512 | 1337 | 1.8e-136 |
| Protein name | | | | | Locus Name | Acc# |
| | | | | | sp:YIEN_ECOLI | P31473 |

Description: HYPOTHETICAL 56.4 KD PROTEIN IN ASNA-KUP INTERGENIC REGION

| ORF Name | NTID | AAID | NT Length | AA Length | Score | Probability |
|---|---|---|---|---|---|---|
| 5267937_c2_406 | 3341 | 7513 | 162 | 489 | 667 | 1.8e-65 |
| Protein name | | | | | Locus Name | Acc# |
| | | | | | sp:SECB_ECOLI | P15040 |

Description: PROTEIN-EXPORT PROTEIN SECB

| ORF Name | NTID | AAID | NT Length | AA Length | Score | Probability |
|---|---|---|---|---|---|---|
| 5275276_c2_399 | 3342 | 7514 | 369 | 1110 | 305 | 4.0e-32 |
| Protein name | | | | | Locus Name | Acc# |
| hypothetical protein PH1844 | | | | | pir:F71196 | F71196 |

Description:

| ORF Name | NTID | AAID | NT Length | AA Length | Score | Probability |
|---|---|---|---|---|---|---|
| 5286518_c1_274 | 3343 | 7515 | 567 | 1704 | 512 | 4.9e-49 |
| Protein name | | | | | Locus Name | Acc# |
| | | | | | gp:APU04954 | U04954 |

Description: Actinobacillus pleuropneumoniae afuA, afuB, afuC, apxIC and RTX-Itoxin determinant (apxIA) genes, complete cds.

| ORF Name | NTID | AAID | NT Length | AA Length | Score | Probability |
|---|---|---|---|---|---|---|
| 6054681_c2_394 | 3344 | 7516 | 201 | 606 | 803 | 7.1e-80 |
| Protein name | | | | | Locus Name | Acc# |
| | | | | | sp:PYRE_ECOLI | P00495 |

Description: OROTATE PHOSPHORIBOSYLTRANSFERASE, (OPRT) (OPRTASE)

| ORF Name | NTID | AAID | NT Length | AA Length | Score | Probability |
|---|---|---|---|---|---|---|
| 6281467_f3_238 | 3345 | 7517 | 198 | 597 | 321 | 8.5e-29 |
| Protein name | | | | | Locus Name | Acc# |
| hypothetical protein | | | | | pir:S76748 | S76748 |

Description:

| ORF Name | NTID | AAID | NT Length | AA Length | Score | Probability |
|---|---|---|---|---|---|---|
| 6281963_f1_34 | 3346 | 7518 | 157 | 474 | 488 | 1.7e-46 |
| Protein name | | | | | Locus Name | Acc# |
| | | | | | sp:YCDZ_ECOLI | P75916 |

Description: HYPOTHETICAL 18.8 KD PROTEIN IN PHOH-CSGG INTERGENIC REGION

| ORF Name | NTID | AAID | NT Length | AA Length | Score | Probability |
|---|---|---|---|---|---|---|
| 6516082_c1_268 | 3347 | 7519 | 287 | 864 | 1165 | 3.1e-118 |
| Protein name | | | | | Locus Name | Acc# |
| | | | | | sp:ATP6_ECOLI | P00855:Q47 |

Description: ATP SYNTHASE A CHAIN, (PROTEIN 6)

| ORF Name | NTID | AAID | NT Length | AA Length | Score | Probability |
|---|---|---|---|---|---|---|
| 672801_c2_355 | 3348 | 7520 | 493 | 1482 | 1839 | 1.2e-189 |
| Protein name | | | | | Locus Name | Acc# |
| | | | | | sp:GLMU_ECOLI | P17114:P76 |

Description: ACETYLGLUCOSAMINE-1-PHOSPHATE URIDYLTRANSFERASE)

| ORF Name | NTID | AAID | NT Length | AA Length | Score | Probability |
|---|---|---|---|---|---|---|
| 6765766_c1_270 | 3349 | 7521 | 523 | 1572 | 2383 | 2.6e-247 |
| Protein name | | | | | Locus Name | Acc# |
| | | | | | sp:ATPA_ECOLI | P00822 |

Description: ATP SYNTHASE ALPHA CHAIN,

| ORF Name | NTID | AAID | NT Length | AA Length | Score | Probability |
|---|---|---|---|---|---|---|
| 6813942_c3_415 | 3350 | 7522 | 622 | 1869 | 2512 | 5.7e-261 |
| Protein name | | | | | Locus Name | Acc# |
| glutamine--fructose-6-phosphate transaminase (isomerizing),:glucosamine-6-phosphate | | | | pir:XNECGM | | B65176:A30 |
| Description | | | | | | |

| ORF Name | NTID | AAID | NT Length | AA Length | Score | Probability |
|---|---|---|---|---|---|---|
| 6835952_c1_266 | 3351 | 7523 | 146 | 441 | 482 | 7.4e-46 |
| Protein name | | | | | Locus Name | Acc# |
| mioC protein:hypothetical protein b2790 | | | | pir:QQEC16 | | G65177:A04 |
| Description | | | | | | |

| ORF Name | NTID | AAID | NT Length | AA Length | Score | Probability |
|---|---|---|---|---|---|---|
| 6915937_c1_342 | 3352 | 7524 | 278 | 837 | 1185 | 2.4e-120 |
| Protein name | | | | | Locus Name | Acc# |
| | | | | | sp:CYSE_ECOLI | P05796 |
| Description | | | | | | |
| SERINE ACETYLTRANSFERASE, (SAT) | | | | | | |

| ORF Name | NTID | AAID | NT Length | AA Length | Score | Probability |
|---|---|---|---|---|---|---|
| 7083502_c1_273 | 3353 | 7525 | 364 | 1095 | 651 | 9.1e-64 |
| Protein name | | | | | Locus Name | Acc# |
| abc-transporter ATP-binding protein PAB0545 | | | | pir:G75124 | | G75124 |
| Description | | | | | | |

| ORF Name | NTID | AAID | NT Length | AA Length | Score | Probability |
|---|---|---|---|---|---|---|
| 7242050_c1_278 | 3354 | 7526 | 383 | 1152 | 524 | 2.6e-50 |
| Protein name | | | | | Locus Name | Acc# |
| carboxypeptidase G2 | | | | pir:C75268 | | C75268 |
| Description | | | | | | |

| ORF Name | NTID | AAID | NT Length | AA Length | Score | Probability |
|---|---|---|---|---|---|---|
| 836687_f3_223 | 3355 | 7527 | 184 | 555 | 984 | 4.7e-99 |
| Protein name | | | | | Locus Name | Acc# |
| UmoA | | | | | gp:PMU66821 | U66821 |

Description: Proteus mirabilis UmoA (umoA) gene, complete cds; and unknown gene.

| ORF Name | NTID | AAID | NT Length | AA Length | Score | Probability |
|---|---|---|---|---|---|---|
| 837551_c3_418 | 3356 | 7528 | 738 | 2217 | 1712 | 3.4e-176 |
| Protein name | | | | | Locus Name | Acc# |
| | | | | | sp:YHJO_ECOLI | P37653:P37 |

Description: HYPOTHETICAL 78.6 KD PROTEIN IN DCTA-DPPF INTERGENIC REGION

| ORF Name | NTID | AAID | NT Length | AA Length | Score | Probability |
|---|---|---|---|---|---|---|
| 8438_f2_177 | 3357 | 7529 | 89 | 267 | | |
| Protein name | | | | | Locus Name | Acc# |

Description: NO-HIT

| ORF Name | NTID | AAID | NT Length | AA Length | Score | Probability |
|---|---|---|---|---|---|---|
| 865630_f3_222 | 3358 | 7530 | 71 | 216 | | |
| Protein name | | | | | Locus Name | Acc# |

Description: NO-HIT

| ORF Name | NTID | AAID | NT Length | AA Length | Score | Probability |
|---|---|---|---|---|---|---|
| 976635_f3_237 | 3359 | 7531 | 65 | 198 | | |
| Protein name | | | | | Locus Name | Acc# |

Description: NO-HIT

| ORF_Name | NTID | AAID | NT Length | AA Length | Score | Probability |
|---|---|---|---|---|---|---|
| 977211_f1_31 | 3360 | 7532 | 551 | 1656 | 2009 | 1.1e-207 |
| Protein name | | | | | Locus Name | Acc# |
| | | | | | sp:60IM_ECOLI | P25714 |
| Description | | | | | | |
| 60 KD INNER-MEMBRANE PROTEIN | | | | | | |

| ORF_Name | NTID | AAID | NT Length | AA Length | Score | Probability |
|---|---|---|---|---|---|---|
| 988753_c2_353 | 3361 | 7533 | 469 | 1410 | 2202 | 4.0e-228 |
| Protein name | | | | | Locus Name | Acc# |
| H+-transporting ATP synthase, beta chain:ATPase F(1) subunit beta chain:hydrogen | | | | | pir:PWECB | A93742:A90 |
| Description | | | | | | |

| ORF_Name | NTID | AAID | NT Length | AA Length | Score | Probability |
|---|---|---|---|---|---|---|
| 22922700_c3_18 | 3362 | 7534 | 67 | 204 | | |
| Protein name | | | | | Locus Name | Acc# |
| Description | | | | | | |
| NO-HIT | | | | | | |

| ORF_Name | NTID | AAID | NT Length | AA Length | Score | Probability |
|---|---|---|---|---|---|---|
| 31698415_c2_14 | 3363 | 7535 | 70 | 210 | | |
| Protein name | | | | | Locus Name | Acc# |
| Description | | | | | | |
| NO-HIT | | | | | | |

| ORF_Name | NTID | AAID | NT Length | AA Length | Score | Probability |
|---|---|---|---|---|---|---|
| 36058141_c1_6 | 3364 | 7536 | 81 | 246 | 119 | 2.2e-07 |
| Protein name | | | | | Locus Name | Acc# |
| hypothetical protein | | | | | pir:D75542 | D75542 |
| Description | | | | | | |

| ORF Name | NTID | AAID | NT Length | AA Length | Score | Probability |
|---|---|---|---|---|---|---|
| 517842_f1_1 | 3365 | 7537 | 89 | 270 | | |
| Protein name | | | | | Locus_Name | Acc# |

Description
NO-HIT

| ORF Name | NTID | AAID | NT Length | AA Length | Score | Probability |
|---|---|---|---|---|---|---|
| 9822538_c1_7 | 3366 | 7538 | 115 | 348 | | |
| Protein name | | | | | Locus_Name | Acc# |

Description
NO-HIT

| ORF Name | NTID | AAID | NT Length | AA Length | Score | Probability |
|---|---|---|---|---|---|---|
| 10584715_f3_49 | 3367 | 7539 | 620 | 1863 | 1043 | 2.6e-105 |
| Protein name | | | | | Locus_Name | Acc# |
| | | | | | sp:PEFC_SALTY | P37868 |

Description
OUTER MEMBRANE USHER PROTEIN PEFC PRECURSOR

| ORF Name | NTID | AAID | NT Length | AA Length | Score | Probability |
|---|---|---|---|---|---|---|
| 10740627_f3_47 | 3368 | 7540 | 175 | 528 | 526 | 1.6e-50 |
| Protein name | | | | | Locus_Name | Acc# |
| | | | | | sp:NLPC_ECOLI | P23898 |

Description
PROBABLE LIPOPROTEIN NLPC PRECURSOR (ORF-17)

| ORF Name | NTID | AAID | NT Length | AA Length | Score | Probability |
|---|---|---|---|---|---|---|
| 12766593_f2_21 | 3369 | 7541 | 102 | 309 | 468 | 2.2e-44 |
| Protein name | | | | | Locus_Name | Acc# |
| | | | | | sp:IHFA_SERMA | P23302 |

Description
INTEGRATION HOST FACTOR ALPHA-SUBUNIT (IHF-ALPHA)

| ORF Name | NTID | AAID | NT Length | AA Length | Score | Probability |
|---|---|---|---|---|---|---|
| 14464202_f3_52 | 3370 | 7542 | 181 | 546 | 111 | 3.8e-05 |

Protein name: type 1 fimbrial subunit
Locus Name: gp:SFU89135
Acc#: U89135

Description: Shigella flexneri type 1 fimbrial subunit (fimA) gene, completecds.

| ORF Name | NTID | AAID | NT Length | AA Length | Score | Probability |
|---|---|---|---|---|---|---|
| 15820181_c3_102 | 3371 | 7543 | 429 | 1290 | 1057 | 8.6e-107 |

Protein name: hypothetical protein
Locus Name: pir:S76786
Acc#: S76786

Description:

| ORF Name | NTID | AAID | NT Length | AA Length | Score | Probability |
|---|---|---|---|---|---|---|
| 16412517_f3_50 | 3372 | 7544 | 106 | 321 | 231 | 4.3e-18 |

Protein name: usher protein precursor
Locus Name: gp:AF050217
Acc#: AF050217:L

Description: Escherichia coli undesignated plasmid AF/R1 pilus operon, completesequence.

| ORF Name | NTID | AAID | NT Length | AA Length | Score | Probability |
|---|---|---|---|---|---|---|
| 19568961_c3_106 | 3373 | 7545 | 69 | 210 | | |

Protein name:
Locus Name:
Acc#:

Description: NO-HIT

| ORF Name | NTID | AAID | NT Length | AA Length | Score | Probability |
|---|---|---|---|---|---|---|
| 20212750_f3_42 | 3374 | 7546 | 345 | 1038 | 906 | 8.6e-91 |

Protein name: cytoplasmic membrane protein
Locus Name: gp:ECOBTUCED
Acc#: M14031

Description: E.coli btuCED genes encoding vitamin B12 transport mechanisms,complete cds, ORF17 encoding a protein of unknown function, andhimA gene encoding integration host factor (IHF) alpha-subunit,partial cds.

| ORF Name | NTID | AAID | NT Length | AA Length | Score | Probability |
|---|---|---|---|---|---|---|
| 205387_f1_10 | 3375 | 7547 | 70 | 213 | 126 | 7.4e-07 |
| Protein name | | | | | Locus Name | Acc# |
| usher protein precursor | | | | | gp:AF050217 | AF050217:L |

Description

Escherichia coli undesignated plasmid AF/R1 pilus operon, complete sequence.

| ORF Name | NTID | AAID | NT Length | AA Length | Score | Probability |
|---|---|---|---|---|---|---|
| 22274012_c1_67 | 3376 | 7548 | 147 | 444 | 595 | 7.8e-58 |
| Protein name | | | | | Locus Name | Acc# |
| | | | | | sp:PQRA_PROVU | Q52620 |

Description

REGULATORY PROTEIN PQRA

| ORF Name | NTID | AAID | NT Length | AA Length | Score | Probability |
|---|---|---|---|---|---|---|
| 22441562_f1_4 | 3377 | 7549 | 670 | 2013 | 2494 | 4.6e-259 |
| Protein name | | | | | Locus Name | Acc# |
| | | | | | sp:YFBG_ECOLI | P77398 |

Description

HYPOTHETICAL 74.3 KD PROTEIN IN AIS-PMRD INTERGENIC REGION

| ORF Name | NTID | AAID | NT Length | AA Length | Score | Probability |
|---|---|---|---|---|---|---|
| 23556503_c1_65 | 3378 | 7550 | 656 | 1971 | 883 | 1.5e-90 |
| Protein name | | | | | Locus Name | Acc# |
| conserved hypothetical protein AF0636 | | | | | pir:D69329 | D69329 |

Description

| ORF Name | NTID | AAID | NT Length | AA Length | Score | Probability |
|---|---|---|---|---|---|---|
| 23922188_f2_30 | 3379 | 7551 | 73 | 222 | 181 | 5.8e-14 |
| Protein name | | | | | Locus Name | Acc# |
| hypothetical protein APE2134 | | | | | pir:A72520 | A72520 |

Description

| ORF Name | NTID | AAID | NT Length | AA Length | Score | Probability |
|---|---|---|---|---|---|---|
| 24019768_f1_5 | 3380 | 7552 | 562 | 1689 | 1416 | 7.8e-145 |
| Protein name | | | | | Locus Name | Acc# |
| hypothetical protein b2257 | | | | | pir:G64996 | G64996 |
| Description | | | | | | |

| ORF Name | NTID | AAID | NT Length | AA Length | Score | Probability |
|---|---|---|---|---|---|---|
| 24412827_c1_66 | 3381 | 7553 | 237 | 714 | 255 | 8.4e-22 |
| Protein name | | | | | Locus Name | Acc# |
| | | | | | sp:GLCC_ECOLI | P52072 |
| Description | | | | | | |
| GLC OPERON TRANSCRIPTIONAL ACTIVATOR | | | | | | |

| ORF Name | NTID | AAID | NT Length | AA Length | Score | Probability |
|---|---|---|---|---|---|---|
| 24647800_f2_17 | 3382 | 7554 | 112 | 339 | 474 | 5.2e-45 |
| Protein name | | | | | Locus Name | Acc# |
| ribosomal protein L20 | | | | | gp:AF055586 | AF055586 |
| Description | | | | | | |
| Vibrio cholerae initiation factor IF3 (infC), ribosomal protein L35(rpmI), ribosomal protein L20 (rplT), and integron InVchsite-specific recombinase IntI4 (intI4) genes, complete cds;unknown protein pseudogene, complete sequence; and unknown genes. | | | | | | |

| ORF Name | NTID | AAID | NT Length | AA Length | Score | Probability |
|---|---|---|---|---|---|---|
| 24806553_f3_44 | 3383 | 7555 | 298 | 897 | 995 | 3.2e-100 |
| Protein name | | | | | Locus Name | Acc# |
| hypothetical protein b2256 | | | | | pir:F64996 | F64996 |
| Description | | | | | | |

| ORF Name | NTID | AAID | NT Length | AA Length | Score | Probability |
|---|---|---|---|---|---|---|
| 25475262_f3_53 | 3384 | 7556 | 186 | 561 | 112 | 1.8e-05 |
| Protein name | | | | | Locus Name | Acc# |
| F-minor fimbrial protein | | | | | pir:I41202 | I41202 |
| Description | | | | | | |

| ORF Name | NTID | AAID | NT Length | AA Length | Score | Probability |
|---|---|---|---|---|---|---|
| 25579702_c3_92 | 3385 | 7557 | 143 | 432 | | |
| Protein name | | | | | Locus Name | Acc# |

Description
NO-HIT

| ORF Name | NTID | AAID | NT Length | AA Length | Score | Probability |
|---|---|---|---|---|---|---|
| 26209561_f2_18 | 3386 | 7558 | 340 | 1023 | 1557 | 8.9e-160 |
| Protein name | | | | | Locus Name | Acc# |
| Phenylalanine--tRNA ligase (EC 6.1.1.20) a | | | | | gp:D90813 | D90813:AB0 |

Description
E.coli genomic DNA, Kohara clone #322(38.4-38.8 min.).

| ORF Name | NTID | AAID | NT Length | AA Length | Score | Probability |
|---|---|---|---|---|---|---|
| 26285160_c3_98 | 3387 | 7559 | 94 | 285 | | |
| Protein name | | | | | Locus Name | Acc# |

Description
NO-HIT

| ORF Name | NTID | AAID | NT Length | AA Length | Score | Probability |
|---|---|---|---|---|---|---|
| 26600910_c2_74 | 3388 | 7560 | 1439 | 4320 | 567 | 1.1e-72 |
| Protein name | | | | | Locus Name | Acc# |
| | | | | | sp:RHSD_ECOLI | P16919:P77 |

Description
RHSD PROTEIN PRECURSOR

| ORF Name | NTID | AAID | NT Length | AA Length | Score | Probability |
|---|---|---|---|---|---|---|
| 26808427_f1_1 | 3389 | 7561 | 801 | 2406 | 3106 | 0.0 |
| Protein name | | | | | Locus Name | Acc# |
| | | | | | sp:SYFB_ECOLI | P07395:Q59 |

Description
TRNA LIGASE BETA CHAIN) (PHERS)

| ORF Name | NTID | AAID | NT Length | AA Length | Score | Probability |
|---|---|---|---|---|---|---|
| 29694467_c1_62 | 3390 | 7562 | 575 | 1728 | 1754 | 1.2e-180 |
| Protein name | | | | | Locus Name | Acc# |
| | | | | | sp:ILVB_KLEPN | P27696 |

Description (ALS)

| ORF Name | NTID | AAID | NT Length | AA Length | Score | Probability |
|---|---|---|---|---|---|---|
| 29730302_c3_100 | 3391 | 7563 | 284 | 855 | 805 | 4.4e-80 |
| Protein name | | | | | Locus Name | Acc# |
| | | | | | sp:ALDC_ENTAE | P05361 |

Description

ALPHA-ACETOLACTATE DECARBOXYLASE,

| ORF Name | NTID | AAID | NT Length | AA Length | Score | Probability |
|---|---|---|---|---|---|---|
| 30500968_f1_13 | 3392 | 7564 | 124 | 375 | | |
| Protein name | | | | | Locus Name | Acc# |

Description

NO-HIT

| ORF Name | NTID | AAID | NT Length | AA Length | Score | Probability |
|---|---|---|---|---|---|---|
| 3321956_f3_51 | 3393 | 7565 | 331 | 996 | | |
| Protein name | | | | | Locus Name | Acc# |

Description

NO-HIT

| ORF Name | NTID | AAID | NT Length | AA Length | Score | Probability |
|---|---|---|---|---|---|---|
| 33787681_f1_2 | 3394 | 7566 | 258 | 777 | 381 | 3.7e-35 |
| Protein name | | | | | Locus Name | Acc# |
| | | | | | sp:BTUD_ECOLI | P06611 |

Description

VITAMIN B12 TRANSPORT ATP-BINDING PROTEIN BTUD

| ORF Name | NTID | AAID | NT Length | AA Length | Score | Probability |
|---|---|---|---|---|---|---|
| 34070432_c3_99 | 3395 | 7567 | 83 | 252 | 79 | 0.021 |
| Protein name | | | | | Locus Name | Acc# |
| hypothetical protein T05G11.4 | | | | | pir:T24549 | T24549 |

Description

| ORF Name | NTID | AAID | NT Length | AA Length | Score | Probability |
|---|---|---|---|---|---|---|
| 35547512_f2_22 | 3396 | 7568 | 333 | 1002 | 1261 | 2.1e-128 |
| Protein name | | | | | Locus Name | Acc# |
| | | | | | sp:YFBF_ECOLI | P77757:P78 |

Description

HYPOTHETICAL 36.3 KD PROTEIN IN AIS-PMRD INTERGENIC REGION

| ORF Name | NTID | AAID | NT Length | AA Length | Score | Probability |
|---|---|---|---|---|---|---|
| 3923193_f2_24 | 3397 | 7569 | 342 | 1029 | 1342 | 5.4e-137 |
| Protein name | | | | | Locus Name | Acc# |
| | | | | | sp:LPLA_ECOLI | P32099 |

Description

LIPOATE-PROTEIN LIGASE A,

| ORF Name | NTID | AAID | NT Length | AA Length | Score | Probability |
|---|---|---|---|---|---|---|
| 3937587_f1_14 | 3398 | 7570 | 121 | 366 | | |
| Protein name | | | | | Locus Name | Acc# |

Description

NO-HIT

| ORF Name | NTID | AAID | NT Length | AA Length | Score | Probability |
|---|---|---|---|---|---|---|
| 428937_c1_58 | 3399 | 7571 | 174 | 525 | | |
| Protein name | | | | | Locus Name | Acc# |

Description

NO-HIT

| ORF Name | NTID | AAID | NT Length | AA Length | Score | Probability |
|---|---|---|---|---|---|---|
| 4458550_f3_43 | 3400 | 7572 | 386 | 1161 | 1352 | 4.7e-138 |
| Protein name | | | | | Locus Name | Acc# |
| | | | | | sp:YFBE_ECOLI | P77690 |

Description
HYPOTHETICAL 42.9 KD PROTEIN IN AIS-PMRD INTERGENIC REGION

| ORF Name | NTID | AAID | NT Length | AA Length | Score | Probability |
|---|---|---|---|---|---|---|
| 4880467_c1_63 | 3401 | 7573 | 180 | 543 | 131 | 1.2e-08 |
| Protein name | | | | | Locus Name | Acc# |
| alkaline phosphatase homolog ybfM | | | | | pir:G69749 | G69749 |

Description

| ORF Name | NTID | AAID | NT Length | AA Length | Score | Probability |
|---|---|---|---|---|---|---|
| 4976563_f1_8 | 3402 | 7574 | 94 | 285 | 109 | 2.5e-06 |
| Protein name | | | | | Locus Name | Acc# |
| | | | | | gp:PMFIMOPR | Z32686 |

Description
Proteus mirabilis fimbrial operon, strain H14320.

| ORF Name | NTID | AAID | NT Length | AA Length | Score | Probability |
|---|---|---|---|---|---|---|
| 5115762_f2_38 | 3403 | 7575 | 234 | 705 | 538 | 8.6e-52 |
| Protein name | | | | | Locus Name | Acc# |
| | | | | | gp:STYPEFABCD | L08613 |

Description
Salmonella typhimurium ORF1, partial cds; pefB, pefA, pefC, pefD, ORF5, ORF6, pefI, ORF7, ORF8, ORF9, rck, ORF11, complete cds's; 13900 base-pairs.

| ORF Name | NTID | AAID | NT Length | AA Length | Score | Probability |
|---|---|---|---|---|---|---|
| 525303_f3_46 | 3404 | 7576 | 114 | 345 | 222 | 2.6e-18 |
| Protein name | | | | | Locus Name | Acc# |
| unknown | | | | | gp:AF071082 | AF071082 |

Description
Salmonella typhi melittin resistance protein PqaB (pqaB) gene, complete cds; and unknown genes.

| ORF Name | NTID | AAID | NT Length | AA Length | Score | Probability |
|---|---|---|---|---|---|---|
| 6698806_f2_39 | 3405 | 7577 | 83 | 252 | | |
| Protein name | | | | | Locus Name | Acc# |

Description
NO-HIT

| ORF Name | NTID | AAID | NT Length | AA Length | Score | Probability |
|---|---|---|---|---|---|---|
| 820390_c1_64 | 3406 | 7578 | 358 | 1077 | 408 | 5.1e-38 |
| Protein name | | | | | Locus Name | Acc# |
| immunogenic protein (bcsp31-2) homolog | | | | | pir:C69329 | C69329 |

Description

| ORF Name | NTID | AAID | NT Length | AA Length | Score | Probability |
|---|---|---|---|---|---|---|
| 898515_f2_23 | 3407 | 7579 | 154 | 465 | 241 | 2.5e-20 |
| Protein name | | | | | Locus Name | Acc# |
| hypothetical protein b2258 | | | | | pir:H64996 | H64996 |

Description

| ORF Name | NTID | AAID | NT Length | AA Length | Score | Probability |
|---|---|---|---|---|---|---|
| 976577_f2_37 | 3408 | 7580 | 172 | 519 | 209 | 6.3e-17 |
| Protein name | | | | | Locus Name | Acc# |
| AF/R1 pilin major subunit precursor | | | | | gp:AF050217 | AF050217:L |

Description
Escherichia coli undesignated plasmid AF/R1 pilus operon, completesequence.

| ORF Name | NTID | AAID | NT Length | AA Length | Score | Probability |
|---|---|---|---|---|---|---|
| 9766050_c1_59 | 3409 | 7581 | 160 | 483 | 97 | 0.032 |
| Protein name | | | | | Locus Name | Acc# |
| DNA-directed RNA polymerase, beta'-2 chain:RNA polymerase rpoC2 | | | | | pir:S72284 | S72284 |

Description

| ORF Name | NTID | AAID | NT Length | AA Length | Score | Probability |
|---|---|---|---|---|---|---|
| 9975055_c2_78 | 3410 | 7582 | 72 | 219 | | |
| Protein name | | | | | Locus Name | Acc# |

Description

NO-HIT

| ORF Name | NTID | AAID | NT Length | AA Length | Score | Probability |
|---|---|---|---|---|---|---|
| 10425002_f3_197 | 3411 | 7583 | 195 | 588 | 915 | 9.6e-92 |
| Protein name | | | | | Locus Name | Acc# |
| | | | | | sp:PMFF_PROMI | P53521 |

Description

PUTATIVE MINOR FIMBRIAL SUBUNIT PMFF PRECURSOR

| ORF Name | NTID | AAID | NT Length | AA Length | Score | Probability |
|---|---|---|---|---|---|---|
| 11214092_c3_436 | 3412 | 7584 | 62 | 186 | | |
| Protein name | | | | | Locus Name | Acc# |

Description

NO-HIT

| ORF Name | NTID | AAID | NT Length | AA Length | Score | Probability |
|---|---|---|---|---|---|---|
| 11907961_c1_270 | 3413 | 7585 | 116 | 351 | 515 | 2.3e-49 |
| Protein name | | | | | Locus Name | Acc# |
| | | | | | sp:GLNB_KLEPN | P11671 |

Description

NITROGEN REGULATORY PROTEIN P-II

| ORF Name | NTID | AAID | NT Length | AA Length | Score | Probability |
|---|---|---|---|---|---|---|
| 11953430_c2_372 | 3414 | 7586 | 115 | 348 | | |
| Protein name | | | | | Locus Name | Acc# |

Description

NO-HIT

| ORF Name | NTID | AAID | NT Length | AA Length | Score | Probability |
|---|---|---|---|---|---|---|
| 1210062_c3_410 | 3415 | 7587 | 244 | 735 | 900 | 3.7e-90 |
| Protein name | | | | | Locus Name | Acc# |
| hypothetical protein b2532 | | | | | pir:C65030 | C65030 |

Description

| ORF Name | NTID | AAID | NT Length | AA Length | Score | Probability |
|---|---|---|---|---|---|---|
| 12273407_c2_334 | 3416 | 7588 | 148 | 447 | 533 | 2.9e-51 |
| Protein name | | | | | Locus Name | Acc# |
| | | | | | sp:YFID_ECOLI | P33633 |

Description
14.3 KD PROTEIN IN SRMB-UNG INTERGENIC REGION

| ORF Name | NTID | AAID | NT Length | AA Length | Score | Probability |
|---|---|---|---|---|---|---|
| 12300681_f2_106 | 3417 | 7589 | 68 | 207 | | |
| Protein name | | | | | Locus Name | Acc# |

Description
NO-HIT

| ORF Name | NTID | AAID | NT Length | AA Length | Score | Probability |
|---|---|---|---|---|---|---|
| 1288437_f1_40 | 3418 | 7590 | 498 | 1497 | 2077 | 7.1e-215 |
| Protein name | | | | | Locus Name | Acc# |
| ORF404 | | | | | gp:PMPMFFIM | Z35428 |

Description
P.mirabilis (HI4320) PMF fimbrial operon DNA.

| ORF Name | NTID | AAID | NT Length | AA Length | Score | Probability |
|---|---|---|---|---|---|---|
| 13708261_c1_268 | 3419 | 7591 | 491 | 1476 | 1469 | 1.9e-150 |
| Protein name | | | | | Locus Name | Acc# |
| | | | | | sp:YFHK_ECOLI | P52101:P76 |

Description
PROBABLE SENSOR PROTEIN YFHK,

| ORF_Name | NTID | AAID | NT Length | AA Length | Score | Probability |
|---|---|---|---|---|---|---|
| 13929678_f2_81 | 3420 | 7592 | 480 | 1443 | 2151 | 1.0e-222 |
| Protein name | | | | | Locus_Name | Acc# |
| | | | | | sp:SYE_ECOLI | P04805 |

Description (GLURS)

| ORF_Name | NTID | AAID | NT Length | AA Length | Score | Probability |
|---|---|---|---|---|---|---|
| 14314135_c3_396 | 3421 | 7593 | 156 | 471 | 542 | 3.2e-52 |
| Protein name | | | | | Locus_Name | Acc# |
| | | | | | sp:YFJG_ECOLI | P52121 |

Description

HYPOTHETICAL 17.8 KD PROTEIN IN SMPA-SMPB INTERGENIC REGION (F158)

| ORF_Name | NTID | AAID | NT Length | AA Length | Score | Probability |
|---|---|---|---|---|---|---|
| 1433517_c3_435 | 3422 | 7594 | 115 | 348 | | |
| Protein name | | | | | Locus_Name | Acc# |

Description

NO-HIT

| ORF_Name | NTID | AAID | NT Length | AA Length | Score | Probability |
|---|---|---|---|---|---|---|
| 14507127_c2_340 | 3423 | 7595 | 95 | 288 | | |
| Protein name | | | | | Locus_Name | Acc# |

Description

NO-HIT

| ORF_Name | NTID | AAID | NT Length | AA Length | Score | Probability |
|---|---|---|---|---|---|---|
| 14657817_c2_339 | 3424 | 7596 | 138 | 417 | 453 | 8.7e-43 |
| Protein name | | | | | Locus_Name | Acc# |
| synthase,:dpj protein | | | | | pir:B42294 | B42294:B42 |

Description

777

| ORF Name | NTID | AAID | NT Length | AA Length | Score | Probability |
|---|---|---|---|---|---|---|
| 14845286_c3_411 | 3425 | 7597 | 176 | 531 | 598 | 3.8e-58 |
| Protein name | | | | | Locus Name | Acc# |
| | | | | | sp:YFHP_ECOLI | P77484 |

Description: HYPOTHETICAL 17.3 KD PROTEIN IN HSCA-SUHB INTERGENIC REGION

| ORF Name | NTID | AAID | NT Length | AA Length | Score | Probability |
|---|---|---|---|---|---|---|
| 14901930_f1_7 | 3426 | 7598 | 63 | 192 | 139 | 1.6e-09 |
| Protein name | | | | | Locus Name | Acc# |
| hypothetical protein APE2061 | | | | | pir:G72510 | G72510 |

Description

| ORF Name | NTID | AAID | NT Length | AA Length | Score | Probability |
|---|---|---|---|---|---|---|
| 15047691_f2_149 | 3427 | 7599 | 63 | 192 | | |
| Protein name | | | | | Locus Name | Acc# |

Description: NO-HIT

| ORF Name | NTID | AAID | NT Length | AA Length | Score | Probability |
|---|---|---|---|---|---|---|
| 15860625_f1_59 | 3428 | 7600 | 65 | 198 | 76 | 0.0077 |
| Protein name | | | | | Locus Name | Acc# |
| | | | | | sp:HOLE_ECOLI | P28689 |

Description: DNA POLYMERASE III, THETA SUBUNIT,

| ORF Name | NTID | AAID | NT Length | AA Length | Score | Probability |
|---|---|---|---|---|---|---|
| 15870953_c1_277 | 3429 | 7601 | 111 | 336 | 437 | 4.3e-41 |
| Protein name | | | | | Locus Name | Acc# |
| | | | | | sp:YFHF_ECOLI | P36539:P77 |

Description: HYPOTHETICAL 11.5 KD PROTEIN IN HSCA-SUHB INTERGENIC REGION

| ORF Name | NTID | AAID | NT Length | AA Length | Score | Probability |
|---|---|---|---|---|---|---|
| 159655_f3_181 | 3430 | 7602 | 300 | 903 | 1160 | 1.0e-117 |
| Protein name | | | | | Locus Name | Acc# |
| | | | | | sp:SUHB_ECOLI | P22783:P77 |

Description: EXTRAGENIC SUPPRESSOR PROTEIN SUHB

| ORF Name | NTID | AAID | NT Length | AA Length | Score | Probability |
|---|---|---|---|---|---|---|
| 161263_f2_130 | 3431 | 7603 | 715 | 2148 | 3579 | 0.0 |
| Protein name | | | | | Locus Name | Acc# |
| | | | | | sp:HLYB_PROVU | P11599 |

Description: HEMOLYSIN SECRETION ATP-BINDING PROTEIN

| ORF Name | NTID | AAID | NT Length | AA Length | Score | Probability |
|---|---|---|---|---|---|---|
| 164132_f3_186 | 3432 | 7604 | 404 | 1215 | 1273 | 1.1e-129 |
| Protein name | | | | | Locus Name | Acc# |
| | | | | | sp:HMPA_ECOLI | P24232 |

Description: B) (NITRIC OXIDE DIOXYGENASE) (NOD)

| ORF Name | NTID | AAID | NT Length | AA Length | Score | Probability |
|---|---|---|---|---|---|---|
| 1650_f1_52 | 3433 | 7605 | 255 | 768 | 852 | 4.6e-85 |
| Protein name | | | | | Locus Name | Acc# |
| uracil-DNA glycosylase, | | | | | pir:DGECU | A28175:C65 |

Description:

| ORF Name | NTID | AAID | NT Length | AA Length | Score | Probability |
|---|---|---|---|---|---|---|
| 165812_c2_356 | 3434 | 7606 | 341 | 1026 | 648 | 1.9e-63 |
| Protein name | | | | | Locus Name | Acc# |
| | | | | | sp:YFGA_ECOLI | P27434:P76 |

Description: HYPOTHETICAL 36.2 KD PROTEIN IN NDK-GCPE INTERGENIC REGION

| ORF Name | NTID | AAID | NT Length | AA Length | Score | Probability |
|---|---|---|---|---|---|---|
| 16828193_c2_306 | 3435 | 7607 | 735 | 2208 | 619 | 2.2e-60 |
| Protein name | | | | | Locus Name | Acc# |
| hypothetical protein jhp1070 | | | | | pir:D71853 | D71853 |

Description

| ORF Name | NTID | AAID | NT Length | AA Length | Score | Probability |
|---|---|---|---|---|---|---|
| 19665902_c1_276 | 3436 | 7608 | 129 | 390 | 607 | 4.2e-59 |
| Protein name | | | | | Locus Name | Acc# |
| hypothetical protein b2529 | | | | | pir:H65029 | H65029 |

Description

| ORF Name | NTID | AAID | NT Length | AA Length | Score | Probability |
|---|---|---|---|---|---|---|
| 19699003_c3_416 | 3437 | 7609 | 1716 | 5151 | 4695 | 0.0 |
| Protein name | | | | | Locus Name | Acc# |
| hypothetical protein b2520 | | | | | pir:G65028 | G65028 |

Description

| ORF Name | NTID | AAID | NT Length | AA Length | Score | Probability |
|---|---|---|---|---|---|---|
| 19807785_c2_335 | 3438 | 7610 | 224 | 675 | 562 | 2.5e-54 |
| Protein name | | | | | Locus Name | Acc# |
| | | | | | sp:RSEA_ECOLI | P38106 |

Description
SIGMA-E FACTOR NEGATIVE REGULATORY PROTEIN

| ORF Name | NTID | AAID | NT Length | AA Length | Score | Probability |
|---|---|---|---|---|---|---|
| 1985077_c2_319 | 3439 | 7611 | 198 | 597 | | |
| Protein name | | | | | Locus Name | Acc# |

Description
NO-HIT

| ORF Name | NTID | AAID | NT Length | AA Length | Score | Probability |
|---|---|---|---|---|---|---|
| 2001692_c1_263 | 3440 | 7612 | 180 | 543 | 541 | 4.1e-52 |
| Protein name | | | | | Locus Name | Acc# |
| | | | | | sp:YFHC_ECOLI | P30134 |

Description
HYPOTHETICAL 20.0 KD PROTEIN IN PURL-DPJ INTERGENIC REGION (ORF178)

| ORF Name | NTID | AAID | NT Length | AA Length | Score | Probability |
|---|---|---|---|---|---|---|
| 20334385_c1_289 | 3441 | 7613 | 69 | 210 | | |
| Protein name | | | | | Locus Name | Acc# |

Description
NO-HIT

| ORF Name | NTID | AAID | NT Length | AA Length | Score | Probability |
|---|---|---|---|---|---|---|
| 20415882_c2_312 | 3442 | 7614 | 532 | 1599 | 164 | 2.6e-09 |
| Protein name | | | | | Locus Name | Acc# |
| gp33 | | | | | gp:BPH6589 | AJ006589 |

Description
Bacteriophage phi-C31 complete genome.

| ORF Name | NTID | AAID | NT Length | AA Length | Score | Probability |
|---|---|---|---|---|---|---|
| 20501550_f2_116 | 3443 | 7615 | 848 | 2547 | 4369 | 0.0 |
| Protein name | | | | | Locus Name | Acc# |
| | | | | | sp:PMFC_PROMI | P53514 |

Description
OUTER MEMBRANE USHER PROTEIN PMFC PRECURSOR

| ORF Name | NTID | AAID | NT Length | AA Length | Score | Probability |
|---|---|---|---|---|---|---|
| 207778_f1_2 | 3444 | 7616 | 63 | 192 | | |
| Protein name | | | | | Locus Name | Acc# |

Description
NO-HIT

| ORF Name | NTID | AAID | NT Length | AA Length | Score | Probability |
|---|---|---|---|---|---|---|
| 20946930_c2_336 | 3445 | 7617 | 339 | 1020 | 746 | 7.8e-74 |
| Protein name | | | | | Locus Name | Acc# |
| | | | | | sp:RSEB_ECOLI | P46186 |

Description: SIGMA-E FACTOR REGULATORY PROTEIN RSEB PRECURSOR

| ORF Name | NTID | AAID | NT Length | AA Length | Score | Probability |
|---|---|---|---|---|---|---|
| 21522031_c2_317 | 3446 | 7618 | 159 | 480 | 75 | 0.017 |
| Protein name | | | | | Locus Name | Acc# |
| | | | | | sp:NU4M_PISOC | P24998 |

Description: NADH-UBIQUINONE OXIDOREDUCTASE CHAIN 4, (FRAGMENTS)

| ORF Name | NTID | AAID | NT Length | AA Length | Score | Probability |
|---|---|---|---|---|---|---|
| 21697177_c2_300 | 3447 | 7619 | 80 | 243 | 259 | 3.1e-22 |
| Protein name | | | | | Locus Name | Acc# |
| | | | | | sp:YDAS_ECOLI | P76063 |

Description: HYPOTHETICAL 11.0 KD PROTEIN IN SIEB-TRKG INTERGENIC REGION PRECURSOR

| ORF Name | NTID | AAID | NT Length | AA Length | Score | Probability |
|---|---|---|---|---|---|---|
| 22040901_c1_236 | 3448 | 7620 | 177 | 534 | 194 | 2.4e-15 |
| Protein name | | | | | Locus Name | Acc# |
| | | | | | sp:ENPP_ECOLI | P75719 |

Description: PUTATIVE ENDOPEPTIDASE,

| ORF Name | NTID | AAID | NT Length | AA Length | Score | Probability |
|---|---|---|---|---|---|---|
| 22067127_c3_375 | 3449 | 7621 | 234 | 705 | 512 | 4.9e-49 |
| Protein name | | | | | Locus Name | Acc# |
| hypothetical protein b1560 | | | | | pir:C64911 | C64911 |

Description

| ORF Name | NTID | AAID | NT Length | AA Length | Score | Probability |
|---|---|---|---|---|---|---|
| 22272591_c3_398 | 3450 | 7622 | 83 | 252 | 77 | 0.0043 |
| Protein name | | | | | Locus Name | Acc# |
| probable lipopolysaccharide O-side chain biosynthesis protein (O-antigen transpoter) | | | | pir:F71152 | | F71152 |

Description: probable lipopolysaccharide O-side chain biosynthesis protein (O-antigen transpoter)

| ORF Name | NTID | AAID | NT Length | AA Length | Score | Probability |
|---|---|---|---|---|---|---|
| 22454702_c3_414 | 3451 | 7623 | 431 | 1296 | 1601 | 1.9e-164 |
| Protein name | | | | | Locus Name | Acc# |
| peptidase B | | | | gp:AF201078 | | AF201078 |

Description: Salmonella typhimurium peptidase B (pepB) gene, complete cds.

| ORF Name | NTID | AAID | NT Length | AA Length | Score | Probability |
|---|---|---|---|---|---|---|
| 22742758_c3_381 | 3452 | 7624 | 103 | 312 | 115 | 5.7e-07 |
| Protein name | | | | | Locus Name | Acc# |
| DNAse | | | | gp:APHIC31C | | X91149 |

Description: Bacteriophage phi-C31 DNA cos region.

| ORF Name | NTID | AAID | NT Length | AA Length | Score | Probability |
|---|---|---|---|---|---|---|
| 22832337_c2_305 | 3453 | 7625 | 60 | 183 | | |
| Protein name | | | | | Locus Name | Acc# |

Description: NO-HIT

| ORF Name | NTID | AAID | NT Length | AA Length | Score | Probability |
|---|---|---|---|---|---|---|
| 23444407_f1_34 | 3454 | 7626 | 69 | 210 | | |
| Protein name | | | | | Locus Name | Acc# |

Description: NO-HIT

| ORF Name | NTID | AAID | NT Length | AA Length | Score | Probability |
|---|---|---|---|---|---|---|
| 23462758_f1_80 | 3455 | 7627 | 161 | 486 | 450 | 1.8e-42 |
| Protein name | | | | | Locus Name | Acc# |
| | | | | | sp:RACR_ECOLI | P76062 |

Description: RAC PROPHAGE REPRESSOR

| ORF Name | NTID | AAID | NT Length | AA Length | Score | Probability |
|---|---|---|---|---|---|---|
| 23473437_f3_207 | 3456 | 7628 | 202 | 609 | 860 | 6.5e-86 |
| Protein name | | | | | Locus Name | Acc# |
| | | | | | sp:HLC1_ECOLI | P09984 |

Description: TOXIN-ACTIVATING PROTEIN C, CHROMOSOMAL FROM STRAIN J96 (HEMOLYSIN C)

| ORF Name | NTID | AAID | NT Length | AA Length | Score | Probability |
|---|---|---|---|---|---|---|
| 23475338_f3_196 | 3457 | 7629 | 258 | 777 | 1311 | 1.0e-133 |
| Protein name | | | | | Locus Name | Acc# |
| | | | | | sp:PMFD_PROMI | P53520 |

Description: CHAPERONE PROTEIN PMFD PRECURSOR

| ORF Name | NTID | AAID | NT Length | AA Length | Score | Probability |
|---|---|---|---|---|---|---|
| 23494003_c2_337 | 3458 | 7630 | 155 | 468 | 406 | 8.3e-38 |
| Protein name | | | | | Locus Name | Acc# |
| | | | | | sp:RSEC_ECOLI | P46187 |

Description: SIGMA-E FACTOR REGULATORY PROTEIN RSEC

| ORF Name | NTID | AAID | NT Length | AA Length | Score | Probability |
|---|---|---|---|---|---|---|
| 23619055_c1_282 | 3459 | 7631 | 374 | 1125 | 1684 | 3.1e-173 |
| Protein name | | | | | Locus Name | Acc# |
| AarC | | | | | gp:PSU67933 | U67933 |

Description: Providencia stuartii AarC (aarC) gene, complete cds.

| ORF Name | NTID | AAID | NT Length | AA Length | Score | Probability |
|---|---|---|---|---|---|---|
| 23625156_c3_377 | 3460 | 7632 | 60 | 183 | | |
| Protein name | | | | | Locus Name | Acc# |

Description
NO-HIT

| ORF Name | NTID | AAID | NT Length | AA Length | Score | Probability |
|---|---|---|---|---|---|---|
| 23626316_c2_350 | 3461 | 7633 | 412 | 1239 | 1269 | 3.0e-129 |
| Protein name | | | | | Locus Name | Acc# |
| putative transporter of 3-phenylpropionic acid | | | | | gp:ECHCAT | Y11071 |

Description
E.coli hcaT gene.

| ORF Name | NTID | AAID | NT Length | AA Length | Score | Probability |
|---|---|---|---|---|---|---|
| 23688930_c3_433 | 3462 | 7634 | 418 | 1257 | 1521 | 5.8e-156 |
| Protein name | | | | | Locus Name | Acc# |
| | | | | | sp:NUPC_ECOLI | P33031;P77 |

Description
NUCLEOSIDE PERMEASE NUPC (NUCLEOSIDE-TRANSPORT SYSTEM PROTEIN NUPC)

| ORF Name | NTID | AAID | NT Length | AA Length | Score | Probability |
|---|---|---|---|---|---|---|
| 23828587_f1_56 | 3463 | 7635 | 142 | 429 | 378 | 7.7e-35 |
| Protein name | | | | | Locus Name | Acc# |
| | | | | | sp:SMPA_ECOLI | P23089 |

Description
SMALL PROTEIN A

| ORF Name | NTID | AAID | NT Length | AA Length | Score | Probability |
|---|---|---|---|---|---|---|
| 24034386_c3_374 | 3464 | 7636 | 68 | 207 | | |
| Protein name | | | | | Locus Name | Acc# |

Description
NO-HIT

| ORF Name | NTID | AAID | NT Length | AA Length | Score | Probability |
|---|---|---|---|---|---|---|
| 24095312_f1_11 | 3465 | 7637 | 81 | 246 | 84 | 0.040 |
| Protein name | | | | | Locus Name | Acc# |
| hypothetical protein PFB0470w | | | | | pir:G71613 | G71613 |

Description

| ORF Name | NTID | AAID | NT Length | AA Length | Score | Probability |
|---|---|---|---|---|---|---|
| 24097287_c2_361 | 3466 | 7638 | 373 | 1122 | 1231 | 3.1e-125 |
| Protein name | | | | | Locus Name | Acc# |
| | | | | | sp:CYSA_ECOLI | P16676:P77 |

Description

SULFATE TRANSPORT ATP-BINDING PROTEIN CYSA

| ORF Name | NTID | AAID | NT Length | AA Length | Score | Probability |
|---|---|---|---|---|---|---|
| 24117686_c1_281 | 3467 | 7639 | 398 | 1197 | 1720 | 4.8e-177 |
| Protein name | | | | | Locus Name | Acc# |
| | | | | | sp:YFGB_ECOLI | P36979 |

Description

HYPOTHETICAL 43.1 KD PROTEIN IN NDK-GCPE INTERGENIC REGION

| ORF Name | NTID | AAID | NT Length | AA Length | Score | Probability |
|---|---|---|---|---|---|---|
| 2425292_c2_371 | 3468 | 7640 | 69 | 210 | | |
| Protein name | | | | | Locus Name | Acc# |

Description

NO-HIT

| ORF Name | NTID | AAID | NT Length | AA Length | Score | Probability |
|---|---|---|---|---|---|---|
| 24277207_f1_55 | 3469 | 7641 | 304 | 915 | 1150 | 1.2e-116 |
| Protein name | | | | | Locus Name | Acc# |
| ytjB protein | | | | | pir:B65040 | B65040 |

Description

| ORF Name | NTID | AAID | NT Length | AA Length | Score | Probability |
|---|---|---|---|---|---|---|
| 24328465_c1_288 | 3470 | 7642 | 294 | 885 | 1066 | 9.6e-108 |
| Protein name | | | | | Locus Name | Acc# |
| | | | | | sp:CYSW_ECOLI | P16702:P76 |

Description
SULFATE TRANSPORT SYSTEM PERMEASE PROTEIN CYSW

| ORF Name | NTID | AAID | NT Length | AA Length | Score | Probability |
|---|---|---|---|---|---|---|
| 24392878_f2_126 | 3471 | 7643 | 589 | 1770 | 1980 | 1.3e-204 |
| Protein name | | | | | Locus Name | Acc# |
| recN protein | | | | | pir:RQECN | C65040:A27 |

Description

| ORF Name | NTID | AAID | NT Length | AA Length | Score | Probability |
|---|---|---|---|---|---|---|
| 24507752_c1_232 | 3472 | 7644 | 75 | 228 | 288 | 2.7e-25 |
| Protein name | | | | | Locus Name | Acc# |
| major cold shock protein CSPA2 | | | | | gp:YEU82821 | U82821 |

Description
Yersinia enterocolitica major cold shock proteins CSPA1 (cspA1) andCSPA2 (cspA2) genes, complete cds.

| ORF Name | NTID | AAID | NT Length | AA Length | Score | Probability |
|---|---|---|---|---|---|---|
| 24643910_c2_367 | 3473 | 7645 | 233 | 702 | 930 | 2.5e-93 |
| Protein name | | | | | Locus Name | Acc# |
| | | | | | sp:DNLJ_ECOLI | P15042 |

Description
)

| ORF Name | NTID | AAID | NT Length | AA Length | Score | Probability |
|---|---|---|---|---|---|---|
| 24645205_c1_261 | 3474 | 7646 | 228 | 687 | 1018 | 1.2e-102 |
| Protein name | | | | | Locus Name | Acc# |
| | | | | | sp:RNC_ECOLI | P05797:P06 |

Description
RIBONUCLEASE III, (RNASE III)

| ORF Name | NTID | AAID | NT Length | AA Length | Score | Probability |
|---|---|---|---|---|---|---|
| 24646888_c1_230 | 3475 | 7647 | 150 | 453 | 195 | 4.8e-15 |
| Protein name | | | | | Locus Name | Acc# |
| | | | | | gp:D90798 | D90798:AB0 |

Description: E.coli genomic DNA, Kohara clone #307(35.1-35.5 min.).

| ORF Name | NTID | AAID | NT Length | AA Length | Score | Probability |
|---|---|---|---|---|---|---|
| 24667257_c3_434 | 3476 | 7648 | 254 | 765 | 475 | 4.1e-45 |
| Protein name | | | | | Locus Name | Acc# |
| | | | | | gp:AB017438 | AB017438 |

Description: Streptomyces coelicolor orf1, orf2, orf3, orf4, orf5 genes, complete cds.

| ORF Name | NTID | AAID | NT Length | AA Length | Score | Probability |
|---|---|---|---|---|---|---|
| 24667311_f1_58 | 3477 | 7649 | 217 | 654 | 581 | 2.4e-56 |
| Protein name | | | | | Locus Name | Acc# |
| | | | | | sp:YBDM_ECOLI | P77174 |

Description: HYPOTHETICAL 23.9 KD PROTEIN IN CSTA-DSBG INTERGENIC REGION

| ORF Name | NTID | AAID | NT Length | AA Length | Score | Probability |
|---|---|---|---|---|---|---|
| 24739015_f3_156 | 3478 | 7650 | 76 | 231 | | |
| Protein name | | | | | Locus Name | Acc# |

Description: NO-HIT

| ORF Name | NTID | AAID | NT Length | AA Length | Score | Probability |
|---|---|---|---|---|---|---|
| 24807937_f2_131 | 3479 | 7651 | 72 | 219 | 312 | 1.3e-27 |
| Protein name | | | | | Locus Name | Acc# |
| | | | | | sp:HLY4_ECOLI | P09986 |

Description: HEMOLYSIN SECRETION PROTEIN D, CHROMOSOMAL

| ORF Name | NTID | AAID | NT Length | AA Length | Score | Probability |
|---|---|---|---|---|---|---|
| 25631307_c3_415 | 3480 | 7652 | 149 | 450 | 217 | 8.9e-18 |
| Protein name | | | | | Locus Name | Acc# |
| | | | | | sp:SSEB_ECOLI | P31143:P76 |

Description: SSEB PROTEIN

| ORF Name | NTID | AAID | NT Length | AA Length | Score | Probability |
|---|---|---|---|---|---|---|
| 25673377_c3_380 | 3481 | 7653 | 166 | 501 | 438 | 3.4e-41 |
| Protein name | | | | | Locus Name | Acc# |
| gp19 | | | | | gp:BPS011581 | AJ011581 |

Description: Bacteriophage PS119 lysis genes 13, 19, 15, and packaging gene 3, complete cds.

| ORF Name | NTID | AAID | NT Length | AA Length | Score | Probability |
|---|---|---|---|---|---|---|
| 25814212_f3_206 | 3482 | 7654 | 141 | 426 | 470 | 1.4e-44 |
| Protein name | | | | | Locus Name | Acc# |
| | | | | | sp:YEDX_ECOLI | P76341 |

Description: HYPOTHETICAL TRANSTHYRETIN-LIKE PROTEIN PRECURSOR

| ORF Name | NTID | AAID | NT Length | AA Length | Score | Probability |
|---|---|---|---|---|---|---|
| 26380327_c3_400 | 3483 | 7655 | 302 | 909 | 1305 | 4.5e-133 |
| Protein name | | | | | Locus Name | Acc# |
| | | | | | sp:ERA_ECOLI | P06616 |

Description: GTP-BINDING PROTEIN ERA

| ORF Name | NTID | AAID | NT Length | AA Length | Score | Probability |
|---|---|---|---|---|---|---|
| 26600178_f2_82 | 3484 | 7656 | 148 | 447 | 127 | 3.1e-08 |
| Protein name | | | | | Locus Name | Acc# |
| hypothetical protein | | | | | gp:TA4HCOAR | AJ001830 |

Description: Thauera aromatica genes for 4 hydroxybenzoyl-CoA reductase and flanking regions.

| ORF Name | NTID | AAID | NT Length | AA Length | Score | Probability |
|---|---|---|---|---|---|---|
| 26691912_c3_397 | 3485 | 7657 | 209 | 630 | 493 | 5.0e-47 |
| Protein name | | | | | Locus Name | Acc# |
| | | | | | sp:GRPE_ECOLI | P09372 |

Description
HEAT SHOCK PROTEIN GRPE (HEAT SHOCK PROTEIN B25.3) (HSP24)

| ORF Name | NTID | AAID | NT Length | AA Length | Score | Probability |
|---|---|---|---|---|---|---|
| 26853452_c3_384 | 3486 | 7658 | 157 | 474 | | |
| Protein name | | | | | Locus Name | Acc# |

Description
NO-HIT

| ORF Name | NTID | AAID | NT Length | AA Length | Score | Probability |
|---|---|---|---|---|---|---|
| 2734562_f2_89 | 3487 | 7659 | 196 | 591 | 734 | 1.5e-72 |
| Protein name | | | | | Locus Name | Acc# |
| phosphotransferase system enzyme II,, glucose-specific, factor | | | | | pir:WQECP3 | C29785:C32 |

Description

| ORF Name | NTID | AAID | NT Length | AA Length | Score | Probability |
|---|---|---|---|---|---|---|
| 29431303_c1_297 | 3488 | 7660 | 65 | 198 | | |
| Protein name | | | | | Locus Name | Acc# |

Description
NO-HIT

| ORF Name | NTID | AAID | NT Length | AA Length | Score | Probability |
|---|---|---|---|---|---|---|
| 2945962_c1_266 | 3489 | 7661 | 1302 | 3909 | 5265 | 0.0 |
| Protein name | | | | | Locus Name | Acc# |
| | | | | | sp:PURL_ECOLI | P15254:P78 |

Description
SYNTHASE) (FORMYLGLYCINAMIDE RIBOTIDE AMIDOTRANSFERASE) (FGARAT)

| ORF Name | NTID | AAID | NT Length | AA Length | Score | Probability |
|---|---|---|---|---|---|---|
| 29572188_c2_301 | 3490 | 7662 | 153 | 462 | 169 | 1.1e-12 |
| Protein name | | | | | Locus Name | Acc# |
| orf33 | | | | | gp:AB008550 | AB008550 |

Description: Pseudomonas aeruginosa phage phi CTX, complete genome sequence.

| ORF Name | NTID | AAID | NT Length | AA Length | Score | Probability |
|---|---|---|---|---|---|---|
| 3011076_c1_269 | 3491 | 7663 | 544 | 1635 | 749 | 2.1e-120 |
| Protein name | | | | | Locus Name | Acc# |
| | | | | | sp:NADE_AQUAE | O67091 |

Description: NH(3)-DEPENDENT NAD(+) SYNTHETASE,

| ORF Name | NTID | AAID | NT Length | AA Length | Score | Probability |
|---|---|---|---|---|---|---|
| 30115936_c1_252 | 3492 | 7664 | 113 | 342 | 347 | 1.5e-31 |
| Protein name | | | | | Locus Name | Acc# |
| hypothetical protein b2618 | | | | | pir:T08631 | T08631:E65 |

Description:

| ORF Name | NTID | AAID | NT Length | AA Length | Score | Probability |
|---|---|---|---|---|---|---|
| 32225077_c3_408 | 3493 | 7665 | 417 | 1254 | 2012 | 5.5e-208 |
| Protein name | | | | | Locus Name | Acc# |
| | | | | | sp:GLYA_SALTY | P06192 |

Description: (SHMT)

| ORF Name | NTID | AAID | NT Length | AA Length | Score | Probability |
|---|---|---|---|---|---|---|
| 33234627_c2_360 | 3494 | 7666 | 285 | 858 | 1150 | 1.2e-116 |
| Protein name | | | | | Locus Name | Acc# |
| | | | | | sp:CYST_ECOLI | P16701 |

Description: SULFATE TRANSPORT SYSTEM PERMEASE PROTEIN CYST

| ORF Name | NTID | AAID | NT Length | AA Length | Score | Probability |
|---|---|---|---|---|---|---|
| 33242317_c1_229 | 3495 | 7667 | 73 | 222 | | |
| Protein name | | | | | Locus Name | Acc# |

Description
NO-HIT

| ORF Name | NTID | AAID | NT Length | AA Length | Score | Probability |
|---|---|---|---|---|---|---|
| 33751583_c3_379 | 3496 | 7668 | 139 | 420 | | |
| Protein name | | | | | Locus Name | Acc# |

Description
NO-HIT

| ORF Name | NTID | AAID | NT Length | AA Length | Score | Probability |
|---|---|---|---|---|---|---|
| 33789187_f2_127 | 3497 | 7669 | 180 | 543 | 732 | 2.4e-72 |
| Protein name | | | | | Locus Name | Acc# |
| small protein B, smpB | | | | | pir:JS0701 | JS0701:G65 |

Description

| ORF Name | NTID | AAID | NT Length | AA Length | Score | Probability |
|---|---|---|---|---|---|---|
| 3382840_f3_162 | 3498 | 7670 | 95 | 288 | | |
| Protein name | | | | | Locus Name | Acc# |

Description
NO-HIT

| ORF Name | NTID | AAID | NT Length | AA Length | Score | Probability |
|---|---|---|---|---|---|---|
| 33870280_c1_278 | 3499 | 7671 | 178 | 537 | 520 | 6.9e-50 |
| Protein name | | | | | Locus Name | Acc# |
| | | | | | sp:HSCB_ECOLI | P36540 |

Description
CHAPERONE PROTEIN HSCB (HSC20)

| ORF Name | NTID | AAID | NT Length | AA Length | Score | Probability |
|---|---|---|---|---|---|---|
| 3396052_c2_302 | 3500 | 7672 | 76 | 231 | 100 | 2.2e-05 |
| Protein name | | | | | Locus Name | Acc# |
| | | | | | gp:D90749 | D90749:AB0 |

Description: Escherichia coli genomic DNA. (25.7 - 26.1 min).

| ORF Name | NTID | AAID | NT Length | AA Length | Score | Probability |
|---|---|---|---|---|---|---|
| 33984465_c3_412 | 3501 | 7673 | 623 | 1872 | 2294 | 7.1e-238 |
| Protein name | | | | | Locus Name | Acc# |
| | | | | | sp:HSCA_ECOLI | P36541:P77 |

Description: CHAPERONE PROTEIN HSCA (HSC66)

| ORF Name | NTID | AAID | NT Length | AA Length | Score | Probability |
|---|---|---|---|---|---|---|
| 33985877_c2_355 | 3502 | 7674 | 151 | 456 | 99 | 0.00086 |
| Protein name | | | | | Locus Name | Acc# |
| PilF protein | | | | | pir:JC5302 | JC5302 |

Description:

| ORF Name | NTID | AAID | NT Length | AA Length | Score | Probability |
|---|---|---|---|---|---|---|
| 34009691_c2_310 | 3503 | 7675 | 66 | 201 | 171 | 6.7e-13 |
| Protein name | | | | | Locus Name | Acc# |
| lipoprotein Rz1 precursor | | | | | pir:JN0750 | JN0750 |

Description:

| ORF Name | NTID | AAID | NT Length | AA Length | Score | Probability |
|---|---|---|---|---|---|---|
| 34022802_c2_308 | 3504 | 7676 | 89 | 270 | 93 | 0.0020 |
| Protein name | | | | | Locus Name | Acc# |
| solute symporter family transporter | | | | | pir:T39114 | T39114 |

Description:

| ORF Name | NTID | AAID | NT Length | AA Length | Score | Probability |
|---|---|---|---|---|---|---|
| 34157781_c1_245 | 3505 | 7677 | 1037 | 3114 | 290 | 6.0e-31 |
| Protein name | | | | | Locus Name | Acc# |
| | | | | | sp:VHSJ_LAMBD | P03749 |

Description
HOST SPECIFICITY PROTEIN J

| ORF Name | NTID | AAID | NT Length | AA Length | Score | Probability |
|---|---|---|---|---|---|---|
| 34397766_f3_205 | 3506 | 7678 | 66 | 201 | 74 | 0.013 |
| Protein name | | | | | Locus Name | Acc# |
| intimin | | | | | gp:ECU32312 | U32312 |

Description
Escherichia coli O157:H7 intimin (eaeA) gene, partial cds, andupstream ORF gene, complete cds.

| ORF Name | NTID | AAID | NT Length | AA Length | Score | Probability |
|---|---|---|---|---|---|---|
| 34406503_f3_163 | 3507 | 7679 | 304 | 915 | 1276 | 5.4e-130 |
| Protein name | | | | | Locus Name | Acc# |
| | | | | | sp:HEM6_SALTY | P33771 |

Description
(COPROPORPHYRINOGENASE) (COPROGEN OXIDASE)

| ORF Name | NTID | AAID | NT Length | AA Length | Score | Probability |
|---|---|---|---|---|---|---|
| 34587912_c2_304 | 3508 | 7680 | 170 | 513 | 274 | 8.1e-24 |
| Protein name | | | | | Locus Name | Acc# |
| Roi | | | | | gp:BHU47336 | U47336 |

Description
Bacteriophage HK022 DNA-binding protein (roi) gene, complete cds.

| ORF Name | NTID | AAID | NT Length | AA Length | Score | Probability |
|---|---|---|---|---|---|---|
| 34589003_c1_283 | 3509 | 7681 | 211 | 636 | 412 | 1.9e-38 |
| Protein name | | | | | Locus Name | Acc# |
| | | | | | sp:YFGM_ECOLI | P76576:P76 |

Description
HYPOTHETICAL 22.2 KD PROTEIN IN XSEA-HISS INTERGENIC REGION

| ORF Name | NTID | AAID | NT Length | AA Length | Score | Probability |
|---|---|---|---|---|---|---|
| 34589501_c1_259 | 3510 | 7682 | 199 | 600 | 861 | 5.1e-86 |
| Protein name | | | | | Locus Name | Acc# |
| | | | | | sp:RPOE_ECOLI | P34086 |

Description
RNA POLYMERASE SIGMA-E FACTOR (SIGMA-24)

| ORF Name | NTID | AAID | NT Length | AA Length | Score | Probability |
|---|---|---|---|---|---|---|
| 35179687_c1_240 | 3511 | 7683 | 102 | 309 | | |
| Protein name | | | | | Locus Name | Acc# |

Description
NO-HIT

| ORF Name | NTID | AAID | NT Length | AA Length | Score | Probability |
|---|---|---|---|---|---|---|
| 35203427_c3_386 | 3512 | 7684 | 190 | 573 | 553 | 2.2e-53 |
| Protein name | | | | | Locus Name | Acc# |
| | | | | | sp:AIL_YEREN | P16454 |

Description
ATTACHMENT INVASION LOCUS PROTEIN PRECURSOR

| ORF Name | NTID | AAID | NT Length | AA Length | Score | Probability |
|---|---|---|---|---|---|---|
| 35322125_c1_246 | 3513 | 7685 | 334 | 1005 | | |
| Protein name | | | | | Locus Name | Acc# |

Description
NO-HIT

| ORF Name | NTID | AAID | NT Length | AA Length | Score | Probability |
|---|---|---|---|---|---|---|
| 35709766_c3_376 | 3514 | 7686 | 141 | 426 | 293 | 7.9e-26 |
| Protein name | | | | | Locus Name | Acc# |
| | | | | | sp:YBCQ_ECOLI | Q47274 |

Description
HYPOTHETICAL 14.2 KD PROTEIN IN RUS-NMPC INTERGENIC REGION

| ORF Name | NTID | AAID | NT Length | AA Length | Score | Probability |
|---|---|---|---|---|---|---|
| 35938756_c2_311 | 3515 | 7687 | 207 | 624 | 119 | 2.9e-07 |

| Protein name | Locus Name | Acc# |
|---|---|---|
| hypothetical protein jhp0953 | pir:B71866 | B71866 |

Description

| ORF Name | NTID | AAID | NT Length | AA Length | Score | Probability |
|---|---|---|---|---|---|---|
| 35960952_c3_417 | 3516 | 7688 | 773 | 2322 | 2509 | 1.2e-260 |

| Protein name | Locus Name | Acc# |
|---|---|---|
| | sp:PBPC_ECOLI | P76577 |

Description
BIFUNCTIONAL PENICILLIN-BINDING PROTEIN 1C PRECURSOR (PBP-1C)

| ORF Name | NTID | AAID | NT Length | AA Length | Score | Probability |
|---|---|---|---|---|---|---|
| 35977213_f3_158 | 3517 | 7689 | 268 | 807 | 898 | 6.1e-90 |

| Protein name | Locus Name | Acc# |
|---|---|---|
| | sp:CYSZ_ECOLI | P12610:P76 |

Description
CYSZ PROTEIN

| ORF Name | NTID | AAID | NT Length | AA Length | Score | Probability |
|---|---|---|---|---|---|---|
| 36053462_c3_421 | 3518 | 7690 | 151 | 456 | 534 | 2.3e-51 |

| Protein name | Locus Name | Acc# |
|---|---|---|
| hypothetical protein b2434 | pir:A65018 | A65018 |

Description

| ORF Name | NTID | AAID | NT Length | AA Length | Score | Probability |
|---|---|---|---|---|---|---|
| 36113907_c1_239 | 3519 | 7691 | 136 | 411 | | |

| Protein name | Locus Name | Acc# |
|---|---|---|

Description
NO-HIT

| ORF Name | NTID | AAID | NT Length | AA Length | Score | Probability |
|---|---|---|---|---|---|---|
| 36131503_f2_88 | 3520 | 7692 | 92 | 279 | 364 | 2.4e-33 |
| Protein name | | | | | Locus Name | Acc# |
| | | | | | sp:PTHP_ECOLI | P07006:P05 |

Description: PHOSPHOCARRIER PROTEIN HPR (HISTIDINE-CONTAINING PROTEIN)

| ORF Name | NTID | AAID | NT Length | AA Length | Score | Probability |
|---|---|---|---|---|---|---|
| 36148552_c3_409 | 3521 | 7693 | 428 | 1287 | 134 | 1.3e-07 |
| Protein name | | | | | Locus Name | Acc# |
| | | | | | sp:YY29_MYCTU | Q10698 |

Description: PROBABLE DIPEPTIDASE CY49.29C,

| ORF Name | NTID | AAID | NT Length | AA Length | Score | Probability |
|---|---|---|---|---|---|---|
| 36211442_f1_16 | 3522 | 7694 | 68 | 207 | | |
| Protein name | | | | | Locus Name | Acc# |

Description: NO-HIT

| ORF Name | NTID | AAID | NT Length | AA Length | Score | Probability |
|---|---|---|---|---|---|---|
| 36213205_c2_309 | 3523 | 7695 | 60 | 183 | 69 | 0.042 |
| Protein name | | | | | Locus Name | Acc# |
| | | | | | sp:VA14_VARV | P33839 |

Description: PROTEIN A14

| ORF Name | NTID | AAID | NT Length | AA Length | Score | Probability |
|---|---|---|---|---|---|---|
| 3906693_c2_318 | 3524 | 7696 | 1086 | 3261 | 337 | 1.3e-26 |
| Protein name | | | | | Locus Name | Acc# |
| | | | | | sp:VMTH_LAMBD | P03736 |

Description: MINOR TAIL PROTEIN PRECURSOR H

| ORF_Name | NTID | AAID | NT Length | AA Length | Score | Probability |
|---|---|---|---|---|---|---|
| 3906693_c3_388 | 3525 | 7697 | 275 | 828 | 838 | 1.4e-83 |
| Protein name | | | | | Locus Name | Acc# |
| | | | | | sp:HEL_HAEIN | P26093 |

Description
LIPOPROTEIN E PRECURSOR (OUTER MEMBRANE PROTEIN P4) (OMP P4)

| ORF_Name | NTID | AAID | NT Length | AA Length | Score | Probability |
|---|---|---|---|---|---|---|
| 3937932_c3_407 | 3526 | 7698 | 225 | 678 | | |
| Protein name | | | | | Locus Name | Acc# |

Description
NO-HIT

| ORF_Name | NTID | AAID | NT Length | AA Length | Score | Probability |
|---|---|---|---|---|---|---|
| 3957785_c3_402 | 3527 | 7699 | 252 | 759 | 930 | 2.5e-93 |
| Protein name | | | | | Locus Name | Acc# |
| pyridoxal phosphate biosynthetic protein pdxJ | | | | | pir:A42293 | A42293:A42 |

Description

| ORF_Name | NTID | AAID | NT Length | AA Length | Score | Probability |
|---|---|---|---|---|---|---|
| 3961462_c2_313 | 3528 | 7700 | 453 | 1362 | | |
| Protein name | | | | | Locus Name | Acc# |

Description
NO-HIT

| ORF_Name | NTID | AAID | NT Length | AA Length | Score | Probability |
|---|---|---|---|---|---|---|
| 4002141_c2_326 | 3529 | 7701 | 71 | 216 | | |
| Protein name | | | | | Locus Name | Acc# |

Description
NO-HIT

| ORF Name | NTID | AAID | NT Length | AA Length | Score | Probability |
|---|---|---|---|---|---|---|
| 4015951_c1_284 | 3530 | 7702 | 133 | 402 | | |
| Protein name | | | | | Locus Name | Acc# |

Description
NO-HIT

| ORF Name | NTID | AAID | NT Length | AA Length | Score | Probability |
|---|---|---|---|---|---|---|
| 4022138_c2_352 | 3531 | 7703 | 114 | 345 | 518 | 1.1e-49 |
| Protein name | | | | | Locus Name | Acc# |
| | | | | | pir:JC1110 | JC1110:PC1 |

Description

| ORF Name | NTID | AAID | NT Length | AA Length | Score | Probability |
|---|---|---|---|---|---|---|
| 4025468_c1_235 | 3532 | 7704 | 92 | 279 | 75 | 0.0099 |
| Protein name | | | | | Locus Name | Acc# |
| gp13 | | | | | gp:BPS011580 | AJ011580 |

Description
Bacteriophage PS34 lysis genes 13, 19, 15, antiterminator gene 23, and packaging gene 3, complete cds.

| ORF Name | NTID | AAID | NT Length | AA Length | Score | Probability |
|---|---|---|---|---|---|---|
| 4040778_f2_132 | 3533 | 7705 | 410 | 1233 | 1749 | 4.0e-180 |
| Protein name | | | | | Locus Name | Acc# |
| | | | | | sp:HLY4_ECOLI | P09986 |

Description
HEMOLYSIN SECRETION PROTEIN D, CHROMOSOMAL

| ORF Name | NTID | AAID | NT Length | AA Length | Score | Probability |
|---|---|---|---|---|---|---|
| 4040910_c1_280 | 3534 | 7706 | 142 | 429 | 592 | 1.6e-57 |
| Protein name | | | | | Locus Name | Acc# |
| nucleoside-diphosphate kinase, | | | | | pir:JH0495 | JH0495:S61 |

Description

| ORF Name | NTID | AAID | NT Length | AA Length | Score | Probability |
|---|---|---|---|---|---|---|
| 4087802_c3_406 | 3535 | 7707 | 337 | 1014 | 312 | 7.6e-28 |
| Protein name | | | | Locus Name | | Acc# |
| | | | | sp:YFHG_ECOLI | | P37328 |

Description: (F239)

| ORF Name | NTID | AAID | NT Length | AA Length | Score | Probability |
|---|---|---|---|---|---|---|
| 4099068_c1_286 | 3536 | 7708 | 301 | 906 | 952 | 1.2e-95 |
| Protein name | | | | Locus Name | | Acc# |
| hypothetical protein b2431 | | | | pir:F65017 | | F65017 |

Description

| ORF Name | NTID | AAID | NT Length | AA Length | Score | Probability |
|---|---|---|---|---|---|---|
| 4101693_c1_260 | 3537 | 7709 | 326 | 981 | 989 | 1.4e-99 |
| Protein name | | | | Locus Name | | Acc# |
| | | | | sp:LEP_ECOLI | | P00803:P78 |

Description: SIGNAL PEPTIDASE I, (SPASE I) (LEADER PEPTIDASE I)

| ORF Name | NTID | AAID | NT Length | AA Length | Score | Probability |
|---|---|---|---|---|---|---|
| 4104807_c2_321 | 3538 | 7710 | 151 | 456 | | |
| Protein name | | | | Locus Name | | Acc# |

Description: NO-HIT

| ORF Name | NTID | AAID | NT Length | AA Length | Score | Probability |
|---|---|---|---|---|---|---|
| 4110328_f1_44 | 3539 | 7711 | 89 | 270 | 404 | 1.4e-37 |
| Protein name | | | | Locus Name | | Acc# |
| | | | | sp:YFHL_ECOLI | | P52102 |

Description: PUTATIVE FERREDOXIN-LIKE PROTEIN IN PURL-DPJ INTERGENIC REGION

800

| ORF Name | NTID | AAID | NT Length | AA Length | Score | Probability |
|---|---|---|---|---|---|---|
| 4119068_c2_316 | 3540 | 7712 | 224 | 675 | | |
| Protein name | | | | | Locus Name | Acc# |

Description
NO-HIT

| ORF Name | NTID | AAID | NT Length | AA Length | Score | Probability |
|---|---|---|---|---|---|---|
| 4314627_c3_378 | 3541 | 7713 | 311 | 936 | 354 | 2.7e-32 |
| Protein name | | | | | Locus Name | Acc# |
| | | | | | sp:YA52_HAEIN | P45008 |

Description
HYPOTHETICAL TRANSCRIPTIONAL REGULATOR HI1052

| ORF Name | NTID | AAID | NT Length | AA Length | Score | Probability |
|---|---|---|---|---|---|---|
| 4534818_c3_382 | 3542 | 7714 | 650 | 1953 | 122 | 0.00023 |
| Protein name | | | | | Locus Name | Acc# |
| | | | | | sp:VG17_BPMD2 | O64210 |

Description
MAJOR HEAD PROTEIN GP17

| ORF Name | NTID | AAID | NT Length | AA Length | Score | Probability |
|---|---|---|---|---|---|---|
| 4725305_f2_115 | 3543 | 7715 | 197 | 594 | 905 | 1.1e-90 |
| Protein name | | | | | Locus Name | Acc# |
| | | | | | sp:PMFA_PROMI | Q04681 |

Description
MAJOR FIMBRIAL SUBUNIT PRECURSOR

| ORF Name | NTID | AAID | NT Length | AA Length | Score | Probability |
|---|---|---|---|---|---|---|
| 4767292_c1_258 | 3544 | 7716 | 255 | 768 | 624 | 6.6e-61 |
| Protein name | | | | | Locus Name | Acc# |
| hypothetical protein in nadB-srmB intergenic region | | | | | pir:F65035 | F65035 |

Description

| ORF Name | NTID | AAID | NT Length | AA Length | Score | Probability |
|---|---|---|---|---|---|---|
| 4798217_f2_124 | 3545 | 7717 | 454 | 1365 | 1690 | 7.2e-174 |
| Protein name | | | | | Locus Name | Acc# |
| | | | | | sp:SRMB_ECOLI | P21507 |

Description: ATP-DEPENDENT RNA HELICASE SRMB

| ORF Name | NTID | AAID | NT Length | AA Length | Score | Probability |
|---|---|---|---|---|---|---|
| 4820292_c2_338 | 3546 | 7718 | 608 | 1827 | 2781 | 1.8e-289 |
| Protein name | | | | | Locus Name | Acc# |
| | | | | | sp:LEPA_ECOLI | P07682:P76 |

Description: GTP-BINDING PROTEIN LEPA

| ORF Name | NTID | AAID | NT Length | AA Length | Score | Probability |
|---|---|---|---|---|---|---|
| 4860675_c3_424 | 3547 | 7719 | 369 | 1110 | 1185 | 2.4e-120 |
| Protein name | | | | | Locus Name | Acc# |
| | | | | | sp:CYSP_ECOLI | P16700 |

Description: THIOSULFATE-BINDING PROTEIN PRECURSOR

| ORF Name | NTID | AAID | NT Length | AA Length | Score | Probability |
|---|---|---|---|---|---|---|
| 4867160_c3_427 | 3548 | 7720 | 303 | 912 | 1165 | 3.1e-118 |
| Protein name | | | | | Locus Name | Acc# |
| | | | | | sp:CYSM_ECOLI | P16703 |

Description: (O-ACETYLSERINE (THIOL)-LYASE B) (CSASE B)

| ORF Name | NTID | AAID | NT Length | AA Length | Score | Probability |
|---|---|---|---|---|---|---|
| 4875088_c2_353 | 3549 | 7721 | 67 | 204 | 310 | 1.2e-27 |
| Protein name | | | | | Locus Name | Acc# |
| | | | | | sp:YFHJ_ECOLI | P37096 |

Description: HYPOTHETICAL 7.7 KD PROTEIN IN PPEB-FDX INTERGENIC REGION

| ORF Name | NTID | AAID | NT Length | AA Length | Score | Probability |
|---|---|---|---|---|---|---|
| 4964677_c2_348 | 3550 | 7722 | 450 | 1353 | 1905 | 1.2e-196 |
| Protein name | | | | | Locus Name | Acc# |
| | | | | | sp:YFHA_ECOLI | P21712:P77 |

Description
(ORF-2)

| ORF Name | NTID | AAID | NT Length | AA Length | Score | Probability |
|---|---|---|---|---|---|---|
| 5261665_c1_273 | 3551 | 7723 | 238 | 717 | 251 | 2.2e-21 |
| Protein name | | | | | Locus Name | Acc# |
| | | | | | sp:YBIH_ECOLI | P41037:P78 |

Description
HYPOTHETICAL TRANSCRIPTIONAL REGULATOR IN MOAE-RHLE INTERGENIC REGION

| ORF Name | NTID | AAID | NT Length | AA Length | Score | Probability |
|---|---|---|---|---|---|---|
| 5271018_c2_303 | 3552 | 7724 | 366 | 1101 | 345 | 2.4e-31 |
| Protein name | | | | | Locus Name | Acc# |
| | | | | | sp:VG15_BPPH8 | P14815 |

Description
REPLICATION PROTEIN 15

| ORF Name | NTID | AAID | NT Length | AA Length | Score | Probability |
|---|---|---|---|---|---|---|
| 5272031_f1_41 | 3553 | 7725 | 375 | 1128 | 1876 | 1.4e-193 |
| Protein name | | | | | Locus Name | Acc# |
| | | | | | sp:PMFE_PROMI | P53522 |

Description
PUTATIVE MINOR FIMBRIAL SUBUNIT PMFE PRECURSOR

| ORF Name | NTID | AAID | NT Length | AA Length | Score | Probability |
|---|---|---|---|---|---|---|
| 5365963_c2_314 | 3554 | 7726 | 152 | 459 | 142 | 7.9e-10 |
| Protein name | | | | | Locus Name | Acc# |
| unknown | | | | | gp:AF147978 | AF147978 |

Description
Bacteriophage D3 putative terminase, putative portal protein, putative ClpP protease, and major head protein genes, complete cds; and unknown genes.

| ORF Name | NTID | AAID | NT Length | AA Length | Score | Probability |
|---|---|---|---|---|---|---|
| 5908568_c1_244 | 3555 | 7727 | 198 | 597 | | |
| Protein name | | | | | Locus Name | Acc# |

Description: NO-HIT

| ORF Name | NTID | AAID | NT Length | AA Length | Score | Probability |
|---|---|---|---|---|---|---|
| 6037510_c2_357 | 3556 | 7728 | 515 | 1548 | 2047 | 1.1e-211 |
| Protein name | | | | | Locus Name | Acc# |
| | | | | | sp:YFGK_ECOLI | P77254 |

Description: HYPOTHETICAL GTP-BINDING PROTEIN IN XSEA-HISS INTERGENIC REGION

| ORF Name | NTID | AAID | NT Length | AA Length | Score | Probability |
|---|---|---|---|---|---|---|
| 6526556_f2_151 | 3557 | 7729 | 63 | 192 | | |
| Protein name | | | | | Locus Name | Acc# |

Description: NO-HIT

| ORF Name | NTID | AAID | NT Length | AA Length | Score | Probability |
|---|---|---|---|---|---|---|
| 6835942_c3_419 | 3558 | 7730 | 430 | 1293 | 1754 | 1.2e-180 |
| Protein name | | | | | Locus Name | Acc# |
| histidyl-tRNA synthetase | | | | | gp:AF047040 | AF047040 |

Description: Salmonella typhimurium histidyl-tRNA synthetase (hisS) gene, complete cds.

| ORF Name | NTID | AAID | NT Length | AA Length | Score | Probability |
|---|---|---|---|---|---|---|
| 6844628_c3_401 | 3559 | 7731 | 249 | 750 | 906 | 8.6e-91 |
| Protein name | | | | | Locus Name | Acc# |
| | | | | | sp:RECO_ECOLI | P15027:P76 |

Description: DNA REPAIR PROTEIN RECO (RECOMBINATION PROTEIN O)

| ORF Name | NTID | AAID | NT Length | AA Length | Score | Probability |
|---|---|---|---|---|---|---|
| 7031505_f1_57 | 3560 | 7732 | 414 | 1245 | 1245 | 1.0e-126 |
| Protein name | | | | | Locus Name | Acc# |
| | | | | | sp:YBDN_ECOLI | P77216 |

Description: HYPOTHETICAL 47.8 KD PROTEIN IN CSTA-DSBG INTERGENIC REGION

| ORF Name | NTID | AAID | NT Length | AA Length | Score | Probability |
|---|---|---|---|---|---|---|
| 7064590_f2_87 | 3561 | 7733 | 335 | 1008 | 1326 | 2.7e-135 |
| Protein name | | | | | Locus Name | Acc# |
| cysteine synthase, A:O-acetylserine (thiol)-lyase A:O-acetylserine sulfhydrolase | | | | | pir:SYECAC | E65015:F28 |

Description

| ORF Name | NTID | AAID | NT Length | AA Length | Score | Probability |
|---|---|---|---|---|---|---|
| 7220276_f3_224 | 3562 | 7734 | 117 | 354 | 284 | 7.1e-25 |
| Protein name | | | | | Locus Name | Acc# |
| | | | | | sp:YA53_HAEIN | Q57498 |

Description: HYPOTHETICAL PROTEIN HI1053

| ORF Name | NTID | AAID | NT Length | AA Length | Score | Probability |
|---|---|---|---|---|---|---|
| 7224062_c2_315 | 3563 | 7735 | 119 | 360 | | |
| Protein name | | | | | Locus Name | Acc# |

Description: NO-HIT

| ORF Name | NTID | AAID | NT Length | AA Length | Score | Probability |
|---|---|---|---|---|---|---|
| 7753_f1_60 | 3564 | 7736 | 1036 | 3111 | 4524 | 0.0 |
| Protein name | | | | | Locus Name | Acc# |
| | | | | | sp:HLY1_ECOLI | P09983 |

Description: HEMOLYSIN, CHROMOSOMAL

| ORF_Name | NTID | AAID | NT Length | AA Length | Score | Probability |
|---|---|---|---|---|---|---|
| 78281_c3_383 | 3565 | 7737 | 448 | 1347 | 255 | 1.8e-19 |
| Protein name | | | | | Locus Name | Acc# |
| hypothetical protein 25 | | | | | pir:T13514 | T13514 |

Description

| ORF_Name | NTID | AAID | NT Length | AA Length | Score | Probability |
|---|---|---|---|---|---|---|
| 831402_c3_432 | 3566 | 7738 | 464 | 1395 | 1737 | 7.5e-179 |
| Protein name | | | | | Locus Name | Acc# |
| | | | | | sp:DNLJ_ECOLI | P15042 |

Description

)

| ORF_Name | NTID | AAID | NT Length | AA Length | Score | Probability |
|---|---|---|---|---|---|---|
| 832792_c2_324 | 3567 | 7739 | 73 | 222 | | |
| Protein name | | | | | Locus Name | Acc# |

Description

NO-HIT

| ORF_Name | NTID | AAID | NT Length | AA Length | Score | Probability |
|---|---|---|---|---|---|---|
| 836637_c3_422 | 3568 | 7740 | 201 | 606 | 421 | 2.1e-39 |
| Protein name | | | | | Locus Name | Acc# |
| hypothetical protein b2432 | | | | | pir:G65017 | G65017 |

Description

| ORF_Name | NTID | AAID | NT Length | AA Length | Score | Probability |
|---|---|---|---|---|---|---|
| 865655_c1_298 | 3569 | 7741 | 85 | 258 | 261 | 1.9e-22 |
| Protein name | | | | | Locus Name | Acc# |
| | | | | | sp:YPEB_ECOLI | P56604 |

Description

HYPOTHETICAL 8.4 KD PROTEIN IN XAPB-LIG INTERGENIC REGION

806

| ORF Name | NTID | AAID | NT Length | AA Length | Score | Probability |
|---|---|---|---|---|---|---|
| 885010_c2_366 | 3570 | 7742 | 366 | 1101 | 478 | 2.2e-64 |
| Protein name | | | | | Locus Name | Acc# |
| hypothetical protein b2412 | | | | pir:C65015 | | C65015 |

Description

| ORF Name | NTID | AAID | NT Length | AA Length | Score | Probability |
|---|---|---|---|---|---|---|
| 956500_c3_420 | 3571 | 7743 | 399 | 1200 | 1297 | 3.2e-132 |
| Protein name | | | | | Locus Name | Acc# |
| | | | | sp:YFGL_ECOLI | | P77774 |

Description
HYPOTHETICAL 41.9 KD PROTEIN IN XSEA-HISS INTERGENIC REGION

| ORF Name | NTID | AAID | NT Length | AA Length | Score | Probability |
|---|---|---|---|---|---|---|
| 970463_c1_238 | 3572 | 7744 | 77 | 234 | 87 | 0.00088 |
| Protein name | | | | | Locus Name | Acc# |
| | | | | sp:VG10_BPT4 | | P10928 |

Description
BASEPLATE STRUCTURAL PROTEIN GP10

| ORF Name | NTID | AAID | NT Length | AA Length | Score | Probability |
|---|---|---|---|---|---|---|
| 9766887_f2_121 | 3573 | 7745 | 77 | 234 | | |
| Protein name | | | | | Locus Name | Acc# |

Description
NO-HIT

| ORF Name | NTID | AAID | NT Length | AA Length | Score | Probability |
|---|---|---|---|---|---|---|
| 978433_c1_275 | 3574 | 7746 | 405 | 1218 | 1882 | 3.3e-194 |
| Protein name | | | | | Locus Name | Acc# |
| probable iron-sulfur cofactor synthesis protein b2530 | | | | pir:A65030 | | A65030 |

Description

| ORF Name | NTID | AAID | NT Length | AA Length | Score | Probability |
|---|---|---|---|---|---|---|
| 9806502_f1_6 | 3575 | 7747 | 576 | 1731 | 2300 | 1.7e-238 |
| Protein name | | | | | Locus Name | Acc# |
| | | | | | sp:PT1_SALTY | P12654 |

Description: (PHOSPHOTRANSFERASE SYSTEM, ENZYME I)

| ORF Name | NTID | AAID | NT Length | AA Length | Score | Probability |
|---|---|---|---|---|---|---|
| 9866516_f3_222 | 3576 | 7748 | 73 | 222 | | |
| Protein name | | | | | Locus Name | Acc# |

Description: NO-HIT

| ORF Name | NTID | AAID | NT Length | AA Length | Score | Probability |
|---|---|---|---|---|---|---|
| 10441557_f2_178 | 3577 | 7749 | 71 | 216 | | |
| Protein name | | | | | Locus Name | Acc# |

Description: NO-HIT

| ORF Name | NTID | AAID | NT Length | AA Length | Score | Probability |
|---|---|---|---|---|---|---|
| 10570258_f2_127 | 3578 | 7750 | 131 | 396 | | |
| Protein name | | | | | Locus Name | Acc# |

Description: NO-HIT

| ORF Name | NTID | AAID | NT Length | AA Length | Score | Probability |
|---|---|---|---|---|---|---|
| 1058432_f3_211 | 3579 | 7751 | 308 | 927 | 1156 | 2.8e-117 |
| Protein name | | | | | Locus Name | Acc# |
| | | | | | sp:YFEC_YERPE | Q56954 |

Description: CHELATED IRON TRANSPORT SYSTEM MEMBRANE PROTEIN YFEC

| ORF Name | NTID | AAID | NT Length | AA Length | Score | Probability |
|---|---|---|---|---|---|---|
| 10941568_f1_43 | 3580 | 7752 | 478 | 1437 | 1707 | 1.1e-175 |
| Protein name | | | | | Locus Name | Acc# |
| | | | | | sp:EX1_ECOLI | P04995 |

Description: DEOXYRIBOPHOSPHODIESTERASE) (DRPASE)

| ORF Name | NTID | AAID | NT Length | AA Length | Score | Probability |
|---|---|---|---|---|---|---|
| 10970016_c2_467 | 3581 | 7753 | 437 | 1314 | 1749 | 4.0e-180 |
| Protein name | | | | | Locus Name | Acc# |
| | | | | | sp:DHNA_ECOLI | P00393 |

Description: NADH DEHYDROGENASE,

| ORF Name | NTID | AAID | NT Length | AA Length | Score | Probability |
|---|---|---|---|---|---|---|
| 11148428_f3_293 | 3582 | 7754 | 356 | 1071 | 414 | 1.2e-38 |
| Protein name | | | | | Locus Name | Acc# |
| | | | | | sp:YHCG_ECOLI | P45423 |

Description: HYPOTHETICAL 43.3 KD PROTEIN IN GLTF-NANT INTERGENIC REGION (O375)

| ORF Name | NTID | AAID | NT Length | AA Length | Score | Probability |
|---|---|---|---|---|---|---|
| 11209818_c3_554 | 3583 | 7755 | 60 | 183 | 258 | 4.0e-22 |
| Protein name | | | | | Locus Name | Acc# |
| ribosomal protein L32 | | | | | pir:R5EC32 | JV0048:A02 |

Description:

| ORF Name | NTID | AAID | NT Length | AA Length | Score | Probability |
|---|---|---|---|---|---|---|
| 1207687_f1_69 | 3584 | 7756 | 111 | 336 | 444 | 7.8e-42 |
| Protein name | | | | | Locus Name | Acc# |
| | | | | | sp:YCCK_ECOLI | P45572:P75 |

Description: HYPOTHETICAL 12.4 KD PROTEIN IN HELD-SERT INTERGENIC REGION

| ORF_Name | NTID | AAID | NT Length | AA Length | Score | Probability |
|---|---|---|---|---|---|---|
| 12929000_c2_419 | 3585 | 7757 | 645 | 1938 | 2439 | 3.1e-253 |
| Protein name | | | | | Locus Name | Acc# |
| | | | | | sp:UUP_ECOLI | P43672:P43 |

Description
ABC TRANSPORTER ATP-BINDING PROTEIN UUP

| ORF_Name | NTID | AAID | NT Length | AA Length | Score | Probability |
|---|---|---|---|---|---|---|
| 1301077_f2_145 | 3586 | 7758 | 66 | 201 | 94 | 0.00050 |
| Protein name | | | | | Locus Name | Acc# |
| | | | | | gp:PHTIPIB1A | L24206 |

Description
Phytophthora infestans ipiB1 gene, complete cds.

| ORF_Name | NTID | AAID | NT Length | AA Length | Score | Probability |
|---|---|---|---|---|---|---|
| 13027217_c1_336 | 3587 | 7759 | 338 | 1017 | 1324 | 4.4e-135 |
| Protein name | | | | | Locus Name | Acc# |
| hypothetical 37.8 kD protein in rplY-proL intergenic region | | | | | pir:A64988 | A64988 |

Description

| ORF_Name | NTID | AAID | NT Length | AA Length | Score | Probability |
|---|---|---|---|---|---|---|
| 1303386_f2_179 | 3588 | 7760 | 88 | 267 | 287 | 3.4e-25 |
| Protein name | | | | | Locus Name | Acc# |
| | | | | | sp:YEJL_ECOLI | P33921 |

Description
HYPOTHETICAL 8.3 KD PROTEIN IN RPLY-PROL INTERGENIC REGION

| ORF_Name | NTID | AAID | NT Length | AA Length | Score | Probability |
|---|---|---|---|---|---|---|
| 13083262_f1_50 | 3589 | 7761 | 154 | 465 | 177 | 1.5e-13 |
| Protein name | | | | | Locus Name | Acc# |
| putative mutT protein | | | | | gp:ATAC011914 | AC011914 |

Description
Arabidopsis thaliana chromosome I BAC F14K14 genomic sequence, complete sequence.

| ORF Name | NTID | AAID | NT Length | AA Length | Score | Probability |
|---|---|---|---|---|---|---|
| 134566_c1_339 | 3590 | 7762 | 63 | 192 | | |
| Protein name | | | | | Locus Name | Acc# |

Description
NO-HIT

| ORF Name | NTID | AAID | NT Length | AA Length | Score | Probability |
|---|---|---|---|---|---|---|
| 13839160_c2_409 | 3591 | 7763 | 188 | 567 | 143 | 1.6e-12 |
| Protein name | | | | | Locus Name | Acc# |
| hypothetical protein b0499 | | | | | pir:B64781 | B64781 |

Description

| ORF Name | NTID | AAID | NT Length | AA Length | Score | Probability |
|---|---|---|---|---|---|---|
| 13839160_c3_508 | 3592 | 7764 | 174 | 525 | 159 | 1.2e-11 |
| Protein name | | | | | Locus Name | Acc# |
| hypothetical protein b0499 | | | | | pir:B64781 | B64781 |

Description

| ORF Name | NTID | AAID | NT Length | AA Length | Score | Probability |
|---|---|---|---|---|---|---|
| 13875401_c3_555 | 3593 | 7765 | 349 | 1050 | 1248 | 5.0e-127 |
| Protein name | | | | | Locus Name | Acc# |
| PlsX | | | | | gp:AF044668 | AF044668 |

Description
Salmonella typhimurium (g30k) gene, partial cds; and 50S ribosomalprotein L32 (rpmF), PlsX (plsX), 3-oxoacyl-acyl carrier proteinsynthase III (fabH), malonyl CoA-acyl carrier protein transacylase(fabD), and 3-oxoacyl-acyl carrier protein reductase (fabG) genes, complete cds.

| ORF Name | NTID | AAID | NT Length | AA Length | Score | Probability |
|---|---|---|---|---|---|---|
| 13875642_c2_490 | 3594 | 7766 | 695 | 2088 | 2338 | 1.6e-242 |
| Protein name | | | | | Locus Name | Acc# |
| | | | | | sp:PRC_ECOLI | P23865 |

Description
PROTEIN)

| ORF_Name | NTID | AAID | NT Length | AA Length | Score | Probability |
|---|---|---|---|---|---|---|
| 13877302_f3_268 | 3595 | 7767 | 108 | 327 | 78 | 0.035 |„
| Protein name | | | | | Locus Name | Acc# |
| endonuclease homologue protein | | | | | gp:HASMT | D31785 |

Description
Hansenula wingei mitochondrial DNA, complete sequence.

| ORF_Name | NTID | AAID | NT Length | AA Length | Score | Probability |
|---|---|---|---|---|---|---|
| 14190937_c1_349 | 3596 | 7768 | 321 | 966 | 1300 | 1.5e-132 |
| Protein name | | | | | Locus Name | Acc# |
| | | | | | sp:RLUC_ECOLI | P23851 |

Description
(PSEUDOURIDYLATE SYNTHASE) (URACIL HYDROLYASE)

| ORF_Name | NTID | AAID | NT Length | AA Length | Score | Probability |
|---|---|---|---|---|---|---|
| 14314542_c2_463 | 3597 | 7769 | 227 | 684 | 805 | 4.4e-80 |
| Protein name | | | | | Locus Name | Acc# |
| | | | | | sp:KTHY_YERPE | O69169 |

Description
THYMIDYLATE KINASE, (DTMP KINASE)

| ORF_Name | NTID | AAID | NT Length | AA Length | Score | Probability |
|---|---|---|---|---|---|---|
| 1442175_f2_185 | 3598 | 7770 | 88 | 267 | | |
| Protein name | | | | | Locus Name | Acc# |

Description
NO-HIT

| ORF_Name | NTID | AAID | NT Length | AA Length | Score | Probability |
|---|---|---|---|---|---|---|
| 14453203_c2_482 | 3599 | 7771 | 296 | 891 | 1223 | 2.2e-124 |
| Protein name | | | | | Locus Name | Acc# |
| alkaline lipase | | | | | gp:PVU33845 | U33845 |

Description
Proteus vulgaris alkaline lipase gene, complete cds.

812

| ORF Name | NTID | AAID | NT Length | AA Length | Score | Probability |
|---|---|---|---|---|---|---|
| 14464177_c3_548 | 3600 | 7772 | 438 | 1317 | 865 | 1.9e-86 |

| Protein name | | Locus Name | Acc# |
|---|---|---|---|
| MelY | | gp:AB000622 | AB000622 |

Description

Enterobacter cloacae DNA for MelY, complete cds.

| ORF Name | NTID | AAID | NT Length | AA Length | Score | Probability |
|---|---|---|---|---|---|---|
| 14492303_f2_120 | 3601 | 7773 | 90 | 273 | 78 | 0.0035 |

| Protein name | | Locus Name | Acc# |
|---|---|---|---|
| | | sp:YC18_HAEIN | Q57251 |

Description

PUTATIVE L-LACTATE PERMEASE

| ORF Name | NTID | AAID | NT Length | AA Length | Score | Probability |
|---|---|---|---|---|---|---|
| 1459637_c1_323 | 3602 | 7774 | 707 | 2124 | 2387 | 1.0e-247 |

| Protein name | | Locus Name | Acc# |
|---|---|---|---|
| | | sp:HELD_ECOLI | P15038:P77 |

Description

HELICASE IV, (75 KD HELICASE)

| ORF Name | NTID | AAID | NT Length | AA Length | Score | Probability |
|---|---|---|---|---|---|---|
| 14642206_f2_143 | 3603 | 7775 | 62 | 189 | | |

| Protein name | | Locus Name | Acc# |
|---|---|---|---|

Description

NO-HIT

| ORF Name | NTID | AAID | NT Length | AA Length | Score | Probability |
|---|---|---|---|---|---|---|
| 14642758_c2_426 | 3604 | 7776 | 60 | 183 | | |

| Protein name | | Locus Name | Acc# |
|---|---|---|---|

Description

NO-HIT

| ORF Name | NTID | AAID | NT Length | AA Length | Score | Probability |
|---|---|---|---|---|---|---|
| 15034437_c1_380 | 3605 | 7777 | 111 | 336 | 121 | 1.3e-07 |
| Protein name | | | | | Locus Name | Acc# |
| | | | | | sp:Y310_HAEIN | P43982 |

Description: HYPOTHETICAL PROTEIN HI0310 PRECURSOR

| ORF Name | NTID | AAID | NT Length | AA Length | Score | Probability |
|---|---|---|---|---|---|---|
| 15041016_c3_591 | 3606 | 7778 | 234 | 705 | 448 | 3.9e-45 |
| Protein name | | | | | Locus Name | Acc# |
| | | | | | sp:MLTE_ECOLI | P76009:P94 |

Description: HYDROLASE E)

| ORF Name | NTID | AAID | NT Length | AA Length | Score | Probability |
|---|---|---|---|---|---|---|
| 15098513_c3_575 | 3607 | 7779 | 122 | 369 | 263 | 1.2e-22 |
| Protein name | | | | | Locus Name | Acc# |
| | | | | | sp:YYAQ_BACSU | P37507 |

Description: HYPOTHETICAL 13.9 KD PROTEIN IN COTF-TETB INTERGENIC REGION

| ORF Name | NTID | AAID | NT Length | AA Length | Score | Probability |
|---|---|---|---|---|---|---|
| 15914702_c1_315 | 3608 | 7780 | 434 | 1305 | 1383 | 2.5e-141 |
| Protein name | | | | | Locus Name | Acc# |
| | | | | | sp:PQIA_ECOLI | P43670:P77 |

Description: PARAQUAT-INDUCIBLE PROTEIN A

| ORF Name | NTID | AAID | NT Length | AA Length | Score | Probability |
|---|---|---|---|---|---|---|
| 16056577_f1_70 | 3609 | 7781 | 106 | 321 | 410 | 3.1e-38 |
| Protein name | | | | | Locus Name | Acc# |
| | | | | | sp:YCCV_ECOLI | P75875 |

Description: HYPOTHETICAL 13.8 KD PROTEIN IN MGSA-HYAA INTERGENIC REGION

| ORF Name | NTID | AAID | NT Length | AA Length | Score | Probability |
|---|---|---|---|---|---|---|
| 163202_c2_444 | 3610 | 7782 | 136 | 411 | 89 | 0.00033 |
| Protein name | | | | | Locus Name | Acc# |
| | | | | | sp:YMDA_ECOLI | P75917 |

Description: HYPOTHETICAL 11.2 KD PROTEIN IN CSGC-MDOG INTERGENIC REGION PRECURSOR

| ORF Name | NTID | AAID | NT Length | AA Length | Score | Probability |
|---|---|---|---|---|---|---|
| 16406650_f3_239 | 3611 | 7783 | 172 | 519 | 550 | 4.6e-53 |
| Protein name | | | | | Locus Name | Acc# |
| | | | | | sp:YMFB_ECOLI | P75965 |

Description: HYPOTHETICAL 17.4 KD PROTEIN IN TRMU-ICD INTERGENIC REGION

| ORF Name | NTID | AAID | NT Length | AA Length | Score | Probability |
|---|---|---|---|---|---|---|
| 16407505_f3_254 | 3612 | 7784 | 140 | 423 | | |
| Protein name | | | | | Locus Name | Acc# |

Description: NO-HIT

| ORF Name | NTID | AAID | NT Length | AA Length | Score | Probability |
|---|---|---|---|---|---|---|
| 16414010_f2_166 | 3613 | 7785 | 987 | 2964 | 1300 | 1.8e-134 |
| Protein name | | | | | Locus Name | Acc# |
| serine proteinase h2, precursor | | | | | pir:JC5569 | JC5569 |

Description:

| ORF Name | NTID | AAID | NT Length | AA Length | Score | Probability |
|---|---|---|---|---|---|---|
| 16444451_f3_290 | 3614 | 7786 | 611 | 1836 | 1330 | 1.0e-135 |
| Protein name | | | | | Locus Name | Acc# |
| probable ATP-dependent proteinase b0955 | | | | | pir:B64836 | B64836 |

Description:

| ORF Name | NTID | AAID | NT Length | AA Length | Score | Probability |
|---|---|---|---|---|---|---|
| 16445311_f2_128 | 3615 | 7787 | 213 | 642 | 707 | 1.1e-69 |
| Protein name | | | | Locus Name | | Acc# |
| | | | | sp:YMFC_ECOLI | | P75966 |

Description: HYPOTHETICAL 24.9 KD PROTEIN IN TRMU-ICDA INTERGENIC REGION

| ORF Name | NTID | AAID | NT Length | AA Length | Score | Probability |
|---|---|---|---|---|---|---|
| 16525318_f3_214 | 3616 | 7788 | 189 | 570 | 453 | 8.7e-43 |
| Protein name | | | | Locus Name | | Acc# |
| probable membrane protein b1728 | | | | pir:H64931 | | H64931 |

Description

| ORF Name | NTID | AAID | NT Length | AA Length | Score | Probability |
|---|---|---|---|---|---|---|
| 16992187_c1_386 | 3617 | 7789 | 263 | 792 | 846 | 2.0e-84 |
| Protein name | | | | Locus Name | | Acc# |
| | | | | sp:YCDX_ECOLI | | P75914 |

Description: HYPOTHETICAL 26.9 KD PROTEIN IN PHOH-CSGG INTERGENIC REGION PRECURSOR

| ORF Name | NTID | AAID | NT Length | AA Length | Score | Probability |
|---|---|---|---|---|---|---|
| 173375_c1_389 | 3618 | 7790 | 62 | 189 | 76 | 0.010 |
| Protein name | | | | Locus Name | | Acc# |
| probable NADH dehydrogenase (ubiquinone), chain 3, kinetoplast:CR5 | | | | pir:S43955 | | S43955 |

Description

| ORF Name | NTID | AAID | NT Length | AA Length | Score | Probability |
|---|---|---|---|---|---|---|
| 19531528_f2_172 | 3619 | 7791 | 421 | 1266 | 1224 | 1.7e-124 |
| Protein name | | | | Locus Name | | Acc# |
| | | | | sp:MTR_HAEIN | | P44614 |

Description: TRYPTOPHAN-SPECIFIC TRANSPORT PROTEIN (TRYPTOPHAN PERMEASE)

| ORF_Name | NTID | AAID | NT Length | AA Length | Score | Probability |
|---|---|---|---|---|---|---|
| 196055_c1_395 | 3620 | 7792 | 234 | 705 | 773 | 1.1e-76 |
| Protein name | | | | | Locus Name | Acc# |
| | | | | | sp:PROQ_ECOLI | P45577:P56 |

Description: PROP EFFECTOR

| ORF_Name | NTID | AAID | NT Length | AA Length | Score | Probability |
|---|---|---|---|---|---|---|
| 19609427_c2_429 | 3621 | 7793 | 88 | 267 | 78 | 0.0026 |
| Protein name | | | | | Locus Name | Acc# |
| 2-isoproylmalate synthase | | | | | gp:BAP6878 | AJ006878 |

Description: Buchnera aphidicola plasmid pBAp1, repA1 gene, repA2 gene, leuA gene, leuB gene, leuC gene, leuD gene and ORF1.

| ORF_Name | NTID | AAID | NT Length | AA Length | Score | Probability |
|---|---|---|---|---|---|---|
| 19692000_c2_469 | 3622 | 7794 | 257 | 774 | 825 | 3.3e-82 |
| Protein name | | | | | Locus Name | Acc# |
| Heterocyst maturation protein (devA) homolog | | | | | gp:D90747 | D90747:AB0 |

Description: Escherichia coli genomic DNA. (25.2 - 25.6 min).

| ORF_Name | NTID | AAID | NT Length | AA Length | Score | Probability |
|---|---|---|---|---|---|---|
| 19698302_c1_351 | 3623 | 7795 | 327 | 984 | 1261 | 2.1e-128 |
| Protein name | | | | | Locus Name | Acc# |
| 3-oxoacyl-acyl carrier protein synthase III | | | | | gp:AF044668 | AF044668 |

Description: Salmonella typhimurium (g30k) gene, partial cds; and 50S ribosomal protein L32 (rpmF), PlsX (plsX), 3-oxoacyl-acyl carrier protein synthase III (fabH), malonyl CoA-acyl carrier protein transacylase (fabD), and 3-oxoacyl-acyl carrier protein reductase (fabG) genes, complete cds.

| ORF Name | NTID | AAID | NT Length | AA Length | Score | Probability |
|---|---|---|---|---|---|---|
| 19719051_f1_24 | 3624 | 7796 | 108 | 327 | 77 | 0.014 |

| Protein name | Locus Name | Acc# |
|---|---|---|
| ORF MSV112 hypothetical protein | gp:AF063866 | AF063866 |

Description

Melanoplus sanguinipes entomopoxvirus, complete genome.

| ORF Name | NTID | AAID | NT Length | AA Length | Score | Probability |
|---|---|---|---|---|---|---|
| 19720062_f3_229 | 3625 | 7797 | 72 | 219 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 19725260_f3_222 | 3626 | 7798 | 78 | 237 | 73 | 0.027 |

| Protein name | Locus Name | Acc# |
|---|---|---|
| NADH dehydrogenase 1 | gp:AF069170 | AF069170 |

Description

Dyscritulus planiceps NADH dehydrogenase 1 gene, mitochondrial gene encoding mitochondrial protein, partial cds.

| ORF Name | NTID | AAID | NT Length | AA Length | Score | Probability |
|---|---|---|---|---|---|---|
| 19730342_c2_476 | 3627 | 7799 | 156 | 471 | 328 | 1.5e-29 |

| Protein name | Locus Name | Acc# |
|---|---|---|
| heat inducible protein Ibp | gp:AF108665 | AF108665 |

Description

Buchnera aphidicola heat shock protein HslU (hslU) gene, partial cds; and heat inducible protein Ibp (ibp), ferridoxin NADP+reductase (fpr), lysyl-tRNA synthetase homolog (yjeA), and putative lipopolysaccharide biosynthesis enzyme (kdtB) genes, complete cds.

| ORF Name | NTID | AAID | NT Length | AA Length | Score | Probability |
|---|---|---|---|---|---|---|
| 19772078_c1_374 | 3628 | 7800 | 297 | 894 | 1074 | 1.4e-108 |

| Protein name | Locus Name | Acc# |
|---|---|---|
| | sp:YTFG_ECOLI | P39315 |

Description

HYPOTHETICAL 29.7 KD PROTEIN IN RPLI-CPDB INTERGENIC REGION (F286)

818

| ORF_Name | NTID | AAID | NT Length | AA Length | Score | Probability |
|---|---|---|---|---|---|---|
| 197805_f1_53 | 3629 | 7801 | 248 | 747 | 643 | 6.4e-63 |
| Protein name | | | | | Locus Name | Acc# |
| | | | | | sp:YEIU_ECOLI | P76445 |

Description: HYPOTHETICAL 26.8 KD PROTEIN IN FRUB-SPR INTERGENIC REGION

| ORF_Name | NTID | AAID | NT Length | AA Length | Score | Probability |
|---|---|---|---|---|---|---|
| 20078313_f1_45 | 3630 | 7802 | 566 | 1701 | 959 | 2.1e-96 |
| Protein name | | | | | Locus Name | Acc# |
| | | | | | sp:DCIP_ENTCL | P23234 |

Description: DECARBOXYLASE)

| ORF_Name | NTID | AAID | NT Length | AA Length | Score | Probability |
|---|---|---|---|---|---|---|
| 20082025_f3_276 | 3631 | 7803 | 279 | 840 | 1138 | 2.3e-115 |
| Protein name | | | | | Locus Name | Acc# |
| probable aldehyde reductase, yafB | | | | | pir:A64745 | A64745:I58 |

Description:

| ORF_Name | NTID | AAID | NT Length | AA Length | Score | Probability |
|---|---|---|---|---|---|---|
| 20085887_f1_5 | 3632 | 7804 | 77 | 234 | 70 | 0.033 |
| Protein name | | | | | Locus Name | Acc# |
| hypothetical protein PH1203 | | | | | pir:E71063 | E71063 |

Description:

| ORF_Name | NTID | AAID | NT Length | AA Length | Score | Probability |
|---|---|---|---|---|---|---|
| 20117327_c3_510 | 3633 | 7805 | 192 | 579 | 95 | 0.011 |
| Protein name | | | | | Locus Name | Acc# |
| | | | | | sp:YC29_CYAPA | P48359 |

Description: PROBABLE TRANSCRIPTIONAL REGULATOR YCF29

| ORF_Name | NTID | AAID | NT Length | AA Length | Score | Probability |
|---|---|---|---|---|---|---|
| 20198756_f1_15 | 3634 | 7806 | 85 | 258 | 177 | 1.5e-13 |
| Protein name | | | | | Locus Name | Acc# |
| hypothetical protein b1836 | | | | | pir:D64945 | D64945 |

Description

| ORF_Name | NTID | AAID | NT Length | AA Length | Score | Probability |
|---|---|---|---|---|---|---|
| 20352302_c1_305 | 3635 | 7807 | 209 | 630 | | |
| Protein name | | | | | Locus Name | Acc# |

Description

NO-HIT

| ORF_Name | NTID | AAID | NT Length | AA Length | Score | Probability |
|---|---|---|---|---|---|---|
| 20503433_c1_334 | 3636 | 7808 | 173 | 522 | | |
| Protein name | | | | | Locus Name | Acc# |

Description

NO-HIT

| ORF_Name | NTID | AAID | NT Length | AA Length | Score | Probability |
|---|---|---|---|---|---|---|
| 20507763_c3_524 | 3637 | 7809 | 215 | 648 | 296 | 3.8e-26 |
| Protein name | | | | | Locus Name | Acc# |
| | | | | | sp:YCCR_ECOLI | P75869 |

Description

HYPOTHETICAL 24.1 KD PROTEIN IN SULA-HELD INTERGENIC REGION

| ORF_Name | NTID | AAID | NT Length | AA Length | Score | Probability |
|---|---|---|---|---|---|---|
| 20509686_c2_408 | 3638 | 7810 | 106 | 321 | 82 | 0.025 |
| Protein name | | | | | Locus Name | Acc# |
| hypothetical protein YLL058w:hypothetical protein L0569 | | | | | pir:S50962 | S50962:S64 |

Description

| ORF Name | NTID | AAID | NT Length | AA Length | Score | Probability |
|---|---|---|---|---|---|---|
| 20516938_c3_544 | 3639 | 7811 | 504 | 1515 | 2176 | 2.3e-225 |
| Protein name | | | | | Locus Name | Acc# |
| lysine-specific permease:lysine transport protein | | | | | pir:C64984 | C64984:A41 |

Description

| ORF Name | NTID | AAID | NT Length | AA Length | Score | Probability |
|---|---|---|---|---|---|---|
| 208452_f1_14 | 3640 | 7812 | 418 | 1257 | 1107 | 2.2e-114 |
| Protein name | | | | | Locus Name | Acc# |
| | | | | | sp:YEBS_ECOLI | P76271:O07 |

Description
HYPOTHETICAL 48.3 KD PROTEIN IN PRC-PPHA INTERGENIC REGION

| ORF Name | NTID | AAID | NT Length | AA Length | Score | Probability |
|---|---|---|---|---|---|---|
| 20938405_f2_206 | 3641 | 7813 | 150 | 453 | 172 | 1.7e-12 |
| Protein name | | | | | Locus Name | Acc# |
| probable transposase a | | | | | pir:T14972 | T14972:T15 |

Description

| ORF Name | NTID | AAID | NT Length | AA Length | Score | Probability |
|---|---|---|---|---|---|---|
| 21515878_c3_530 | 3642 | 7814 | 308 | 927 | 1067 | 7.5e-108 |
| Protein name | | | | | Locus Name | Acc# |
| | | | | | sp:YAFC_ECOLI | P30864 |

Description
(ORF304)

| ORF Name | NTID | AAID | NT Length | AA Length | Score | Probability |
|---|---|---|---|---|---|---|
| 21600318_c2_430 | 3643 | 7815 | 168 | 507 | 377 | 9.9e-35 |
| Protein name | | | | | Locus Name | Acc# |
| CigR | | | | | gp:AF106566 | AF106566 |

Description
Salmonella typhimurium pathogenicity island SPI-3, completesequence.

| ORF Name | NTID | AAID | NT Length | AA Length | Score | Probability |
|---|---|---|---|---|---|---|
| 21614438_f2_183 | 3644 | 7816 | 151 | 456 | 232 | 2.3e-19 |
| Protein name | | | | | Locus Name | Acc# |
| | | | | | sp:YO14_BPHP1 | P51716 |

Description

HYPOTHETICAL 14.9 KD PROTEIN IN REP-HOL INTERGENIC REGION (ORF14)

| ORF Name | NTID | AAID | NT Length | AA Length | Score | Probability |
|---|---|---|---|---|---|---|
| 21642193_c2_434 | 3645 | 7817 | 125 | 378 | | |
| Protein name | | | | | Locus Name | Acc# |

Description

NO-HIT

| ORF Name | NTID | AAID | NT Length | AA Length | Score | Probability |
|---|---|---|---|---|---|---|
| 2167826_c1_352 | 3646 | 7818 | 248 | 747 | 1046 | 1.3e-105 |
| Protein name | | | | | Locus Name | Acc# |
| 3-oxoacyl-acyl carrier protein reductase | | | | | gp:AF044668 | AF044668 |

Description

Salmonella typhimurium (g30k) gene, partial cds; and 50S ribosomalprotein L32 (rpmF), PlsX (plsX), 3-oxoacyl-acyl carrier proteinsynthase III (fabH), malonyl CoA-acyl carrier protein transacylase(fabD), and 3-oxoacyl-acyl carrier protein reductase (fabG) genes,complete cds.

| ORF Name | NTID | AAID | NT Length | AA Length | Score | Probability |
|---|---|---|---|---|---|---|
| 21756691_f1_40 | 3647 | 7819 | 1178 | 3537 | 2731 | 3.5e-284 |
| Protein name | | | | | Locus Name | Acc# |
| | | | | | gp:ECGAMS | X67470:S50 |

Description

E.coli AMS gene.

| ORF Name | NTID | AAID | NT Length | AA Length | Score | Probability |
|---|---|---|---|---|---|---|
| 22160125_f1_81 | 3648 | 7820 | 115 | 348 | 166 | 2.3e-12 |
| Protein name | | | | | Locus Name | Acc# |
| nifS protein homolog HI1343 | | | | | pir:G64117 | G64117 |

Description

| ORF Name | NTID | AAID | NT Length | AA Length | Score | Probability |
|---|---|---|---|---|---|---|
| 22266463_f3_210 | 3649 | 7821 | 249 | 750 | 706 | 1.4e-69 |
| Protein name | | | | | Locus Name | Acc# |
| | | | | | sp:MARC_ECOLI | P31123:P31 |

Description: MULTIPLE ANTIBIOTIC RESISTANCE PROTEIN MARC

| ORF Name | NTID | AAID | NT Length | AA Length | Score | Probability |
|---|---|---|---|---|---|---|
| 22275262_c2_485 | 3650 | 7822 | 168 | 507 | 568 | 5.7e-55 |
| Protein name | | | | | Locus Name | Acc# |
| | | | | | sp:FTNA_ECOLI | P23887 |

Description: FERRITIN 1

| ORF Name | NTID | AAID | NT Length | AA Length | Score | Probability |
|---|---|---|---|---|---|---|
| 22400302_c3_529 | 3651 | 7823 | 102 | 309 | 304 | 5.4e-27 |
| Protein name | | | | | Locus Name | Acc# |
| | | | | | sp:YCCD_ECOLI | P36660 |

Description: HYPOTHETICAL 11.5 PROTEIN IN TORD-CBPA INTERGENIC REGION (ORF-2)

| ORF Name | NTID | AAID | NT Length | AA Length | Score | Probability |
|---|---|---|---|---|---|---|
| 2243806_f3_221 | 3652 | 7824 | 160 | 483 | 469 | 1.8e-44 |
| Protein name | | | | | Locus Name | Acc# |
| transposase homolog A | | | | | gp:HPU95957 | U95957 |

Description: Helicobacter pylori insertion sequence IS606 transposase homologs A(tnpA) and B (tnpB) genes, complete cds.

| ORF Name | NTID | AAID | NT Length | AA Length | Score | Probability |
|---|---|---|---|---|---|---|
| 22438762_f1_21 | 3653 | 7825 | 84 | 255 | | |
| Protein name | | | | | Locus Name | Acc# |

Description: NO-HIT

| ORF Name | NTID | AAID | NT Length | AA Length | Score | Probability |
|---|---|---|---|---|---|---|
| 22454812_c1_384 | 3654 | 7826 | 134 | 405 | 266 | 5.7e-23 |
| Protein name | | | | | Locus Name | Acc# |
| antitermination protein Q | | | | | gp:AF125520 | AF125520 |

Description: Bacteriophage 933W, complete genome.

| ORF Name | NTID | AAID | NT Length | AA Length | Score | Probability |
|---|---|---|---|---|---|---|
| 22478436_f3_283 | 3655 | 7827 | 153 | 462 | 548 | 7.5e-53 |
| Protein name | | | | | Locus Name | Acc# |
| | | | | | sp:MGSA_ECOLI | P37066:P75 |

Description: METHYLGLYOXAL SYNTHASE, (MGS)

| ORF Name | NTID | AAID | NT Length | AA Length | Score | Probability |
|---|---|---|---|---|---|---|
| 22688285_f2_122 | 3656 | 7828 | 192 | 579 | 134 | 1.6e-10 |
| Protein name | | | | | Locus Name | Acc# |
| | | | | | sp:URK_HAEIN | P44533 |

Description: RIBONUCLEOSIDE KINASE)

| ORF Name | NTID | AAID | NT Length | AA Length | Score | Probability |
|---|---|---|---|---|---|---|
| 22756510_c1_376 | 3657 | 7829 | 63 | 192 | 75 | 0.040 |
| Protein name | | | | | Locus Name | Acc# |
| ribosomal protein S5 | | | | | pir:S72297 | S72297 |

Description:

| ORF Name | NTID | AAID | NT Length | AA Length | Score | Probability |
|---|---|---|---|---|---|---|
| 22851513_f1_68 | 3658 | 7830 | 124 | 375 | 384 | 1.8e-35 |
| Protein name | | | | | Locus Name | Acc# |
| | | | | | sp:YEAR_ECOLI | P76248 |

Description: HYPOTHETICAL 13.6 KD PROTEIN IN GAPA-RND INTERGENIC REGION

| ORF Name | NTID | AAID | NT Length | AA Length | Score | Probability |
|---|---|---|---|---|---|---|
| 22866055_c2_416 | 3659 | 7831 | 65 | 198 | | |
| Protein name | | | | | Locus Name | Acc# |

Description
NO-HIT

| ORF Name | NTID | AAID | NT Length | AA Length | Score | Probability |
|---|---|---|---|---|---|---|
| 22900255_f2_107 | 3660 | 7832 | 291 | 876 | 817 | 2.3e-81 |
| Protein name | | | | | Locus Name | Acc# |
| hypothetical protein b1725 | | | | | pir:E64931 | E64931 |

Description

| ORF Name | NTID | AAID | NT Length | AA Length | Score | Probability |
|---|---|---|---|---|---|---|
| 22941012_f1_38 | 3661 | 7833 | 212 | 639 | 561 | 3.1e-54 |
| Protein name | | | | | Locus Name | Acc# |
| | | | | | sp:YCEF_ECOLI | P27244 |

Description
HYPOTHETICAL 23.2 KD PROTEIN IN RNE-RPMF INTERGENIC REGION (ORFY)

| ORF Name | NTID | AAID | NT Length | AA Length | Score | Probability |
|---|---|---|---|---|---|---|
| 23438875_f2_109 | 3662 | 7834 | 80 | 243 | 69 | 0.0079 |
| Protein name | | | | | Locus Name | Acc# |
| | | | | | sp:NU4M_CERCA | Q34048:Q34 |

Description
NADH-UBIQUINONE OXIDOREDUCTASE CHAIN 4,

| ORF Name | NTID | AAID | NT Length | AA Length | Score | Probability |
|---|---|---|---|---|---|---|
| 23464001_c3_533 | 3663 | 7835 | 67 | 204 | 110 | 9.1e-06 |
| Protein name | | | | | Locus Name | Acc# |
| | | | | | sp:DDG_ECOLI | P76522:P76 |

Description
DDG PROTEIN

| ORF Name | NTID | AAID | NT Length | AA Length | Score | Probability |
|---|---|---|---|---|---|---|
| 23469177_c3_585 | 3664 | 7836 | 459 | 1380 | 181 | 7.9e-11 |
| Protein name | | | | | Locus Name | Acc# |
| porin E1 | | | | | pir:S34969 | S34969 |

Description

| ORF Name | NTID | AAID | NT Length | AA Length | Score | Probability |
|---|---|---|---|---|---|---|
| 23626562_f1_85 | 3665 | 7837 | 390 | 1173 | 1091 | 2.2e-110 |
| Protein name | | | | | Locus Name | Acc# |
| probable iron-sulfur-binding protein b0947 | | | | | pir:B64835 | B64835 |

Description

| ORF Name | NTID | AAID | NT Length | AA Length | Score | Probability |
|---|---|---|---|---|---|---|
| 23631502_c1_326 | 3666 | 7838 | 358 | 1077 | 922 | 1.7e-92 |
| Protein name | | | | | Locus Name | Acc# |
| dipeptidase homolog | | | | | gp:AF060858 | AF060858 |

Description

Salmonella dublin regulatory protein CopR (copR), histidine kinase(copS), SPI-4 pathogenicity island containing dipeptidase homolog(pipD), SopB (sopB), PipC (pipC), PipB (pipB), and PipA (pipA)genes, complete cds; and tRNA-Ser gene, complete sequence; andunknown genes.

| ORF Name | NTID | AAID | NT Length | AA Length | Score | Probability |
|---|---|---|---|---|---|---|
| 23645812_f2_140 | 3667 | 7839 | 103 | 312 | | |
| Protein name | | | | | Locus Name | Acc# |

Description

NO-HIT

| ORF Name | NTID | AAID | NT Length | AA Length | Score | Probability |
|---|---|---|---|---|---|---|
| 23650313_c2_455 | 3668 | 7840 | 113 | 342 | 427 | 5.0e-40 |
| Protein name | | | | | Locus Name | Acc# |
| | | | | | sp:YBEX_ECOLI | P76367:007 |

Description

HYPOTHETICAL 15.1 KD PROTEIN IN COBU-SBMC INTERGENIC REGION

826

| ORF Name | NTID | AAID | NT Length | AA Length | Score | Probability |
|---|---|---|---|---|---|---|
| 23984593_c1_324 | 3669 | 7841 | 80 | 243 | 118 | 2.8e-07 |
| Protein name | | | | | Locus Name | Acc# |
| | | | | | gp:D90734 | D90734:AB0 |

Description
Escherichia coli genomic DNA. (22.0 - 22.3 min).

| ORF Name | NTID | AAID | NT Length | AA Length | Score | Probability |
|---|---|---|---|---|---|---|
| 24032501_c2_418 | 3670 | 7842 | 726 | 2181 | 2646 | 3.6e-275 |
| Protein name | | | | | Locus Name | Acc# |
| | | | | | sp:YCBY_ECOLI | P75864 |

Description
HYPOTHETICAL 78.9 KD PROTEIN IN PYRD-PQIA INTERGENIC REGION

| ORF Name | NTID | AAID | NT Length | AA Length | Score | Probability |
|---|---|---|---|---|---|---|
| 240631_c3_579 | 3671 | 7843 | 87 | 264 | | |
| Protein name | | | | | Locus Name | Acc# |

Description
NO-HIT

| ORF Name | NTID | AAID | NT Length | AA Length | Score | Probability |
|---|---|---|---|---|---|---|
| 24095192_c2_502 | 3672 | 7844 | 127 | 384 | 240 | 3.2e-20 |
| Protein name | | | | | Locus Name | Acc# |
| | | | | | sp:CSAA_BACSU | P37584 |

Description
CSAA PROTEIN

| ORF Name | NTID | AAID | NT Length | AA Length | Score | Probability |
|---|---|---|---|---|---|---|
| 24101702_c3_567 | 3673 | 7845 | 417 | 1254 | 1995 | 3.5e-206 |
| Protein name | | | | | Locus Name | Acc# |
| | | | | | sp:IDH_ECOLI | P08200 |

Description
DECARBOXYLASE) (IDH) (NADP+-SPECIFIC ICDH) (IDP)

| ORF Name | NTID | AAID | NT Length | AA Length | Score | Probability |
|---|---|---|---|---|---|---|
| 24117203_c2_431 | 3674 | 7846 | 192 | 579 | 313 | 6.0e-28 |
| Protein name | | | | | Locus Name | Acc# |
| hypothetical protein ydeN | | | | pir:H69778 | | H69778 |

Description

| ORF Name | NTID | AAID | NT Length | AA Length | Score | Probability |
|---|---|---|---|---|---|---|
| 24251553_c1_383 | 3675 | 7847 | 265 | 798 | 701 | 4.6e-69 |
| Protein name | | | | | Locus Name | Acc# |
| | | | | | sp:AMPM_ECOLI | P07906 |

Description
METHIONINE AMINOPEPTIDASE, (MAP) (PEPTIDASE M)

| ORF Name | NTID | AAID | NT Length | AA Length | Score | Probability |
|---|---|---|---|---|---|---|
| 24254377_f3_287 | 3676 | 7848 | 218 | 657 | 373 | 2.6e-34 |
| Protein name | | | | | Locus Name | Acc# |
| | | | | | sp:SULA_SERMA | P08845 |

Description
CELL DIVISION INHIBITOR

| ORF Name | NTID | AAID | NT Length | AA Length | Score | Probability |
|---|---|---|---|---|---|---|
| 24259757_c1_347 | 3677 | 7849 | 605 | 1818 | 2052 | 3.1e-212 |
| Protein name | | | | | Locus Name | Acc# |
| D-lactate dehydrogenase, | | | | pir:DEECDL | | A21893:I41 |

Description

| ORF Name | NTID | AAID | NT Length | AA Length | Score | Probability |
|---|---|---|---|---|---|---|
| 24260952_c3_557 | 3678 | 7850 | 340 | 1023 | 811 | 1.0e-80 |
| Protein name | | | | | Locus Name | Acc# |
| | | | | | sp:YCEG_HAEIN | P44720 |

Description
HYPOTHETICAL PROTEIN HI0457

| ORF Name | NTID | AAID | NT Length | AA Length | Score | Probability |
|---|---|---|---|---|---|---|
| 2428430_f3_272 | 3679 | 7851 | 68 | 207 | | |
| Protein name | | | | | Locus Name | Acc# |

Description: NO-HIT

| ORF Name | NTID | AAID | NT Length | AA Length | Score | Probability |
|---|---|---|---|---|---|---|
| 24306257_f1_97 | 3680 | 7852 | 202 | 609 | 391 | 3.2e-36 |
| Protein name | | | | | Locus Name | Acc# |
| | | | | | gp:AB024946 | AB024946 |

Description: Escherichia coli plasmid pB171 DNA, complete sequence.

| ORF Name | NTID | AAID | NT Length | AA Length | Score | Probability |
|---|---|---|---|---|---|---|
| 24417316_c1_317 | 3681 | 7853 | 139 | 420 | 123 | 8.1e-08 |
| Protein name | | | | | Locus Name | Acc# |
| hypothetical protein SC6G4.19c SC6G4.19c | | | | | pir:T35570 | T35570 |

Description:

| ORF Name | NTID | AAID | NT Length | AA Length | Score | Probability |
|---|---|---|---|---|---|---|
| 24431330_c3_559 | 3682 | 7854 | 201 | 606 | 711 | 4.0e-70 |
| Protein name | | | | | Locus Name | Acc# |
| | | | | | sp:YCFP_ECOLI | P75950 |

Description: HYPOTHETICAL 23.3 KD PROTEIN IN FHUE-NDH INTERGENIC REGION

| ORF Name | NTID | AAID | NT Length | AA Length | Score | Probability |
|---|---|---|---|---|---|---|
| 24431625_c2_441 | 3683 | 7855 | 116 | 351 | 268 | 3.5e-23 |
| Protein name | | | | | Locus Name | Acc# |
| | | | | | sp:YEJG_ECOLI | P33917 |

Description: HYPOTHETICAL 12.5 KD PROTEIN IN RTN-BCR INTERGENIC REGION

| ORF_Name | NTID | AAID | NT Length | AA Length | Score | Probability |
|---|---|---|---|---|---|---|
| 24433562_c1_360 | 3684 | 7856 | 170 | 513 | 877 | 1.0e-87 |

Protein name: UmoD

Locus Name: gp:PMU66824    Acc#: U66824

Description: Proteus mirabilis UmoD (umoD) gene, complete cds; and strand-specific repair protein MFD (mfd) gene, partial cds.

| ORF_Name | NTID | AAID | NT Length | AA Length | Score | Probability |
|---|---|---|---|---|---|---|
| 24507752_c3_569 | 3685 | 7857 | 75 | 228 | 300 | 1.4e-26 |

Protein name: hypothetical protein

Locus Name: gp:YPZ97978    Acc#: Z97978

Description: Yersinia pestis gene encoding hypothetical protein (clone M0960).

| ORF_Name | NTID | AAID | NT Length | AA Length | Score | Probability |
|---|---|---|---|---|---|---|
| 245927_c1_354 | 3686 | 7858 | 279 | 840 | 627 | 3.2e-61 |

Protein name:

Locus Name: sp:PABC_ECOLI    Acc#: P28305

Description: 4-AMINO-4-DEOXYCHORISMATE LYASE, (ADC LYASE)

| ORF_Name | NTID | AAID | NT Length | AA Length | Score | Probability |
|---|---|---|---|---|---|---|
| 2459692_c1_304 | 3687 | 7859 | 73 | 222 | | |

Protein name:

Locus Name:    Acc#:

Description: NO-HIT

| ORF_Name | NTID | AAID | NT Length | AA Length | Score | Probability |
|---|---|---|---|---|---|---|
| 24640916_c1_356 | 3688 | 7860 | 330 | 993 | 781 | 1.5e-77 |

Protein name:

Locus Name: sp:HOLB_ECOLI    Acc#: P28631

Description: DNA POLYMERASE III, DELTA' SUBUNIT,

| ORF Name | NTID | AAID | NT Length | AA Length | Score | Probability |
|---|---|---|---|---|---|---|
| 24647187_c1_316 | 3689 | 7861 | 192 | 579 | 389 | 5.3e-36 |
| Protein name | | | | | Locus Name | Acc# |
| | | | | | gp:D90733 | D90733:AB0 |

Description: Escherichia coli genomic DNA. (21.7 - 22.1 min).

| ORF Name | NTID | AAID | NT Length | AA Length | Score | Probability |
|---|---|---|---|---|---|---|
| 24658561_f3_228 | 3690 | 7862 | 217 | 654 | 592 | 1.6e-57 |
| Protein name | | | | | Locus Name | Acc# |
| | | | | | sp:YBDM_ECOLI | P77174 |

Description: HYPOTHETICAL 23.9 KD PROTEIN IN CSTA-DSBG INTERGENIC REGION

| ORF Name | NTID | AAID | NT Length | AA Length | Score | Probability |
|---|---|---|---|---|---|---|
| 24664562_f2_188 | 3691 | 7863 | 63 | 192 | | |
| Protein name | | | | | Locus Name | Acc# |

Description: NO-HIT

| ORF Name | NTID | AAID | NT Length | AA Length | Score | Probability |
|---|---|---|---|---|---|---|
| 24800886_f2_170 | 3692 | 7864 | 404 | 1215 | 1071 | 2.8e-108 |
| Protein name | | | | | Locus Name | Acc# |
| | | | | | sp:YEIH_ECOLI | P33019 |

Description: HYPOTHETICAL 36.9 KD PROTEIN IN LYSP-NFO INTERGENIC REGION

| ORF Name | NTID | AAID | NT Length | AA Length | Score | Probability |
|---|---|---|---|---|---|---|
| 24847090_c3_556 | 3693 | 7865 | 61 | 186 | 60 | 0.0057 |
| Protein name | | | | | Locus Name | Acc# |
| hypothetical protein sll1912 | | | | | pir:S75364 | S75364 |

Description

| ORF Name | NTID | AAID | NT Length | AA Length | Score | Probability |
|---|---|---|---|---|---|---|
| 24884391_c2_407 | 3694 | 7866 | 224 | 675 | 111 | 0.00096 |
| Protein name | | | | | Locus Name | Acc# |
| ORF MSV250 hypothetical protein | | | | | gp:AF063866 | AF063866 |

Description: Melanoplus sanguinipes entomopoxvirus, complete genome.

| ORF Name | NTID | AAID | NT Length | AA Length | Score | Probability |
|---|---|---|---|---|---|---|
| 2504692_f1_61 | 3695 | 7867 | 178 | 537 | 119 | 0.00011 |
| Protein name | | | | | Locus Name | Acc# |
| | | | | | sp:EVGS_ECOLI | P30855:P77 |

Description: PUTATIVE SENSOR PROTEIN EVGS PRECURSOR,

| ORF Name | NTID | AAID | NT Length | AA Length | Score | Probability |
|---|---|---|---|---|---|---|
| 25423512_f2_104 | 3696 | 7868 | 322 | 969 | 1162 | 6.4e-118 |
| Protein name | | | | | Locus Name | Acc# |
| YfeA | | | | | gp:YPU50597 | U50597 |

Description: Yersinia pestis ABC transporter system, periplasmic-binding protein (yfeA), ATP-binding protein (yfeB), integral membrane protein (yfeC), and integral membrane protein (yfeD) genes, complete cds.

| ORF Name | NTID | AAID | NT Length | AA Length | Score | Probability |
|---|---|---|---|---|---|---|
| 25447182_f2_193 | 3697 | 7869 | 173 | 522 | 778 | 3.2e-77 |
| Protein name | | | | | Locus Name | Acc# |
| dehydratase,:beta-hydroxydecanoyl thiolester dehydrase | | | | | pir:DWECHD | A64836:A28 |

Description:

| ORF Name | NTID | AAID | NT Length | AA Length | Score | Probability |
|---|---|---|---|---|---|---|
| 254676_c3_514 | 3698 | 7870 | 896 | 2691 | 3419 | 0.0 |
| Protein name | | | | | Locus Name | Acc# |
| membrane alanyl aminopeptidase,:alpha-aminoacylpeptide | | | | | pir:DPECN | C64833:A27 |

Description:

| ORF Name | NTID | AAID | NT Length | AA Length | Score | Probability |
|---|---|---|---|---|---|---|
| 25526687_c3_577 | 3699 | 7871 | 62 | 189 | 71 | 0.026 |
| Protein name | | | | | Locus Name | Acc# |
| MbeCy | | | | | gp:PMU57647 | U57647 |

Description: Pasteurella multocida plasmid pIG1, complete sequence.

| ORF Name | NTID | AAID | NT Length | AA Length | Score | Probability |
|---|---|---|---|---|---|---|
| 25556340_c3_518 | 3700 | 7872 | 77 | 234 | 202 | 3.5e-16 |
| Protein name | | | | | Locus Name | Acc# |
| ribosome modulation factor | | | | | gp:ECRMF | X70111:S55 |

Description: E.coli rmf gene for ribosome modulation factor.

| ORF Name | NTID | AAID | NT Length | AA Length | Score | Probability |
|---|---|---|---|---|---|---|
| 25585917_f1_66 | 3701 | 7873 | 173 | 522 | 190 | 6.5e-15 |
| Protein name | | | | | Locus Name | Acc# |
| | | | | | sp:ROB_ECOLI | P27292 |

Description: RIGHT ORIGIN-BINDING PROTEIN

| ORF Name | NTID | AAID | NT Length | AA Length | Score | Probability |
|---|---|---|---|---|---|---|
| 25594005_c3_568 | 3702 | 7874 | 452 | 1359 | | |
| Protein name | | | | | Locus Name | Acc# |

Description: NO-HIT

| ORF Name | NTID | AAID | NT Length | AA Length | Score | Probability |
|---|---|---|---|---|---|---|
| 25603567_f2_167 | 3703 | 7875 | 67 | 204 | | |
| Protein name | | | | | Locus Name | Acc# |

Description: NO-HIT

| ORF Name | NTID | AAID | NT Length | AA Length | Score | Probability |
|---|---|---|---|---|---|---|
| 25985327_c2_473 | 3704 | 7876 | 111 | 336 | 80 | 0.014 |
| Protein name | | | | | Locus Name | Acc# |
| conserved hypothetical integral membrane protein BB0580 | | | | pir:C70172 | | C70172 |

Description

| ORF Name | NTID | AAID | NT Length | AA Length | Score | Probability |
|---|---|---|---|---|---|---|
| 2604135_c1_350 | 3705 | 7877 | 181 | 546 | 650 | 1.2e-63 |
| Protein name | | | | | Locus Name | Acc# |
| | | | | | sp:YCED_ECOLI | P14189 |

Description

HYPOTHETICAL 19.3 KD PROTEIN IN RNE-RPMF INTERGENIC REGION (G30K)

| ORF Name | NTID | AAID | NT Length | AA Length | Score | Probability |
|---|---|---|---|---|---|---|
| 2620925_c2_420 | 3706 | 7878 | 555 | 1668 | 1841 | 7.2e-190 |
| Protein name | | | | | Locus Name | Acc# |
| | | | | | sp:PQIB_ECOLI | P43671:P77 |

Description

PARAQUAT-INDUCIBLE PROTEIN B

| ORF Name | NTID | AAID | NT Length | AA Length | Score | Probability |
|---|---|---|---|---|---|---|
| 26222277_c1_313 | 3707 | 7879 | 353 | 1062 | 1412 | 2.1e-144 |
| Protein name | | | | | Locus Name | Acc# |
| | | | | | sp:PYRD_ECOLI | P05021 |

Description (DHODEHASE)

| ORF Name | NTID | AAID | NT Length | AA Length | Score | Probability |
|---|---|---|---|---|---|---|
| 26229715_c2_480 | 3708 | 7880 | 78 | 237 | 148 | 1.8e-10 |
| Protein name | | | | | Locus Name | Acc# |
| conserved hypothetical protein HP1242 | | | | pir:B64675 | | B64675 |

Description

| ORF_Name | NTID | AAID | NT Length | AA Length | Score | Probability |
|---|---|---|---|---|---|---|
| 26353925_c1_327 | 3709 | 7881 | 150 | 453 | | |
| Protein name | | | | | Locus_Name | Acc# |

Description
NO-HIT

| ORF_Name | NTID | AAID | NT Length | AA Length | Score | Probability |
|---|---|---|---|---|---|---|
| 26369450_c3_535 | 3710 | 7882 | 78 | 237 | | |
| Protein name | | | | | Locus_Name | Acc# |

Description
NO-HIT

| ORF_Name | NTID | AAID | NT Length | AA Length | Score | Probability |
|---|---|---|---|---|---|---|
| 26375875_c3_538 | 3711 | 7883 | 65 | 198 | | |
| Protein name | | | | | Locus_Name | Acc# |

Description
NO-HIT

| ORF_Name | NTID | AAID | NT Length | AA Length | Score | Probability |
|---|---|---|---|---|---|---|
| 26423386_c1_325 | 3712 | 7884 | 320 | 963 | 1242 | 2.1e-126 |
| Protein name | | | | | Locus_Name | Acc# |
| | | | | | sp:CBPA_ECOLI | P36659:P77 |

Description
CURVED DNA-BINDING PROTEIN

| ORF_Name | NTID | AAID | NT Length | AA Length | Score | Probability |
|---|---|---|---|---|---|---|
| 26445302_f3_269 | 3713 | 7885 | 112 | 339 | | |
| Protein name | | | | | Locus_Name | Acc# |

Description
NO-HIT

| ORF Name | NTID | AAID | NT Length | AA Length | Score | Probability |
|---|---|---|---|---|---|---|
| 26448457_f1_90 | 3714 | 7886 | 472 | 1419 | 2135 | 5.0e-221 |
| Protein name | | | | | Locus Name | Acc# |
| asparagine--tRNA ligase,:asparaginyl-tRNA synthetase | | | | pir:SYECNT | | JS0396:S29 |

Description

| ORF Name | NTID | AAID | NT Length | AA Length | Score | Probability |
|---|---|---|---|---|---|---|
| 26756311_f3_271 | 3715 | 7887 | 254 | 765 | 1010 | 8.2e-102 |
| Protein name | | | | | Locus Name | Acc# |
| | | | | | sp:YJHP_ECOLI | P39367 |

Description

HYPOTHETICAL 27.4 KD PROTEIN IN FECI-FIMB INTERGENIC REGION (F248)

| ORF Name | NTID | AAID | NT Length | AA Length | Score | Probability |
|---|---|---|---|---|---|---|
| 26797888_c2_442 | 3716 | 7888 | 68 | 207 | | |
| Protein name | | | | | Locus Name | Acc# |

Description

NO-HIT

| ORF Name | NTID | AAID | NT Length | AA Length | Score | Probability |
|---|---|---|---|---|---|---|
| 2859578_f1_93 | 3717 | 7889 | 141 | 426 | 435 | 7.0e-41 |
| Protein name | | | | | Locus Name | Acc# |
| | | | | | sp:AAT_ECOLI | P00509 |

Description

ASPARTATE AMINOTRANSFERASE, (TRANSAMINASE A) (ASPAT)

| ORF Name | NTID | AAID | NT Length | AA Length | Score | Probability |
|---|---|---|---|---|---|---|
| 2864000_f1_42 | 3718 | 7890 | 97 | 294 | 86 | 0.0034 |
| Protein name | | | | | Locus Name | Acc# |
| | | | | | gp:CELT24A6 | AF068713 |

Description

Caenorhabditis elegans cosmid T24A6.

| ORF Name | NTID | AAID | NT Length | AA Length | Score | Probability |
|---|---|---|---|---|---|---|
| 29494013_c3_578 | 3719 | 7891 | 138 | 417 | | |
| Protein name | | | | | Locus Name | Acc# |

Description
NO-HIT

| ORF Name | NTID | AAID | NT Length | AA Length | Score | Probability |
|---|---|---|---|---|---|---|
| 29533302_f3_297 | 3720 | 7892 | 72 | 219 | | |
| Protein name | | | | | Locus Name | Acc# |

Description
NO-HIT

| ORF Name | NTID | AAID | NT Length | AA Length | Score | Probability |
|---|---|---|---|---|---|---|
| 29535407_c2_414 | 3721 | 7893 | 68 | 207 | | |
| Protein name | | | | | Locus Name | Acc# |

Description
NO-HIT

| ORF Name | NTID | AAID | NT Length | AA Length | Score | Probability |
|---|---|---|---|---|---|---|
| 29547562_f1_10 | 3722 | 7894 | 470 | 1413 | 1853 | 3.8e-191 |
| Protein name | | | | | Locus Name | Acc# |
| hypothetical protein b1729 | | | | | pir:A64932 | A64932 |

Description

| ORF Name | NTID | AAID | NT Length | AA Length | Score | Probability |
|---|---|---|---|---|---|---|
| 29567676_f2_131 | 3723 | 7895 | 412 | 1239 | 1440 | 2.2e-147 |
| Protein name | | | | | Locus Name | Acc# |
| | | | | | sp:YCFD_ECOLI | P27431:P75 |

Description
HYPOTHETICAL 42.6 KD PROTEIN IN PEPT-PHOQ INTERGENIC REGION

| ORF Name | NTID | AAID | NT Length | AA Length | Score | Probability |
|---|---|---|---|---|---|---|
| 29690657_f1_51 | 3724 | 7896 | 224 | 675 | 815 | 3.8e-81 |
| Protein name | | | | | Locus Name | Acc# |
| | | | | | sp:YEIP_ECOLI | P33028 |

Description
HYPOTHETICAL 30.9 KD PROTEIN IN FRUB-SPR INTERGENIC REGION

| ORF Name | NTID | AAID | NT Length | AA Length | Score | Probability |
|---|---|---|---|---|---|---|
| 29797327_c1_378 | 3725 | 7897 | 249 | 750 | 345 | 2.4e-31 |
| Protein name | | | | | Locus Name | Acc# |
| | | | | | sp:YBCY_ECOLI | P77460 |

Description
HYPOTHETICAL 15.5 KD PROTEIN IN NOHB-APPY INTERGENIC REGION PRECURSOR

| ORF Name | NTID | AAID | NT Length | AA Length | Score | Probability |
|---|---|---|---|---|---|---|
| 29803762_f1_27 | 3726 | 7898 | 464 | 1395 | 2028 | 1.1e-209 |
| Protein name | | | | | Locus Name | Acc# |
| | | | | | sp:PUR8_ECOLI | P25739 |

Description
ADENYLOSUCCINATE LYASE, (ADENYLOSUCCINASE) (ASL)

| ORF Name | NTID | AAID | NT Length | AA Length | Score | Probability |
|---|---|---|---|---|---|---|
| 30084407_f1_9 | 3727 | 7899 | 229 | 690 | 660 | 1.0e-64 |
| Protein name | | | | | Locus Name | Acc# |
| | | | | | sp:YNIC_ECOLI | P77247 |

Description
HYPOTHETICAL 24.3 KD PROTEIN IN PFKB-CEDA INTERGENIC REGION

| ORF Name | NTID | AAID | NT Length | AA Length | Score | Probability |
|---|---|---|---|---|---|---|
| 30100636_f2_111 | 3728 | 7900 | 805 | 2418 | 1548 | 8.0e-159 |
| Protein name | | | | | Locus Name | Acc# |
| probable membrane protein b1834 | | | | | pir:B64945 | B64945 |

Description

| ORF Name | NTID | AAID | NT Length | AA Length | Score | Probability |
|---|---|---|---|---|---|---|
| 30351637_c1_365 | 3729 | 7901 | 432 | 1299 | 1459 | 2.2e-149 |
| Protein name | | | | | Locus Name | Acc# |
| | | | | | sp:YCFW_ECOLI | P75958 |

Description
HYPOTHETICAL 45.3 KD PROTEIN IN MFD-COBB INTERGENIC REGION

| ORF Name | NTID | AAID | NT Length | AA Length | Score | Probability |
|---|---|---|---|---|---|---|
| 31362958_c1_353 | 3730 | 7902 | 433 | 1302 | 1774 | 9.1e-183 |
| Protein name | | | | | Locus Name | Acc# |
| synthase, II | | | | | pir:I41060 | I41060:I84 |

Description

| ORF Name | NTID | AAID | NT Length | AA Length | Score | Probability |
|---|---|---|---|---|---|---|
| 31407177_c3_511 | 3731 | 7903 | 82 | 249 | | |
| Protein name | | | | | Locus Name | Acc# |

Description
NO-HIT

| ORF Name | NTID | AAID | NT Length | AA Length | Score | Probability |
|---|---|---|---|---|---|---|
| 31488760_f1_6 | 3732 | 7904 | 307 | 924 | 1172 | 5.6e-119 |
| Protein name | | | | | Locus Name | Acc# |
| YfeB | | | | | gp:YPU50597 | U50597 |

Description
Yersinia pestis ABC transporter system, periplasmic-binding protein(yfeA), ATP-binding protein (yfeB), integral membrane protein(yfeC), and integral membrane protein (yfeD) genes, complete cds.

| ORF Name | NTID | AAID | NT Length | AA Length | Score | Probability |
|---|---|---|---|---|---|---|
| 31644026_f2_180 | 3733 | 7905 | 86 | 261 | 93 | 0.00020 |

| Protein name | Locus Name | Acc# |
|---|---|---|
| | gp:BTP9011IN | X85213 |

Description
Bacteriophage TP901-1 ORF1,2 & 3.

| ORF Name | NTID | AAID | NT Length | AA Length | Score | Probability |
|---|---|---|---|---|---|---|
| 32032552_c2_423 | 3734 | 7906 | 185 | 558 | 215 | 1.4e-17 |
| Protein name | | | | | Locus Name | Acc# |
| | | | | | sp:TTR_PSESY | P16966 |

Description: ACETYLTRANSFERASE, (TABTOXIN RESISTANCE PROTEIN)

| ORF Name | NTID | AAID | NT Length | AA Length | Score | Probability |
|---|---|---|---|---|---|---|
| 32245250_c2_405 | 3735 | 7907 | 142 | 429 | | |
| Protein name | | | | | Locus Name | Acc# |

Description: NO-HIT

| ORF Name | NTID | AAID | NT Length | AA Length | Score | Probability |
|---|---|---|---|---|---|---|
| 32433265_c2_466 | 3736 | 7908 | 318 | 957 | 196 | 1.0e-19 |
| Protein name | | | | | Locus Name | Acc# |
| | | | | | sp:YCFN_ECOLI | P75948 |

Description: HYPOTHETICAL 32.4 KD PROTEIN IN FHUE-NDH INTERGENIC REGION

| ORF Name | NTID | AAID | NT Length | AA Length | Score | Probability |
|---|---|---|---|---|---|---|
| 32619527_f1_48 | 3737 | 7909 | 97 | 294 | 75 | 0.016 |
| Protein name | | | | | Locus Name | Acc# |
| hypothetical protein C54C6.4 | | | | | pir:T20196 | T20196 |

Description:

| ORF Name | NTID | AAID | NT Length | AA Length | Score | Probability |
|---|---|---|---|---|---|---|
| 32628375_c3_507 | 3738 | 7910 | 284 | 855 | 187 | 1.6e-20 |
| Protein name | | | | | Locus Name | Acc# |
| core protein | | | | | gp:ECRHSEH2 | AF044501 |

Description: Escherichia coli strain ec45 RhsE accessory genetic element coreprotein gene, partial cds, and dsORF-e4, complete cds; and RhsHaccessory genetic element unknown (450), core protein, and dsORF-h1genes, complete cds.

| ORF_Name | NTID | AAID | NT Length | AA Length | Score | Probability |
|---|---|---|---|---|---|---|
| 32805_c3_580 | 3739 | 7911 | 442 | 1329 | 1747 | 6.6e-180 |
| Protein name | | | | | Locus Name | Acc# |
| hypothetical protein b1432 | | | | | pir:C64895 | C64895 |

Description

| ORF_Name | NTID | AAID | NT Length | AA Length | Score | Probability |
|---|---|---|---|---|---|---|
| 33250252_c1_321 | 3740 | 7912 | 65 | 198 | 81 | 0.0034 |
| Protein name | | | | | Locus Name | Acc# |
| orf160 | | | | | gp:AF160864 | AF160864 |

Description
Tetrahymena pyriformis mitochondrial DNA, complete genome.

| ORF_Name | NTID | AAID | NT Length | AA Length | Score | Probability |
|---|---|---|---|---|---|---|
| 33392265_c2_465 | 3741 | 7913 | 145 | 438 | 192 | 4.0e-15 |
| Protein name | | | | | Locus Name | Acc# |
| | | | | | sp:YCFL_ECOLI | P75946 |

Description
HYPOTHETICAL 14.0 KD PROTEIN IN FHUE-NDH INTERGENIC REGION

| ORF_Name | NTID | AAID | NT Length | AA Length | Score | Probability |
|---|---|---|---|---|---|---|
| 33792762_c1_396 | 3742 | 7914 | 298 | 897 | 1196 | 1.6e-121 |
| Protein name | | | | | Locus Name | Acc# |
| | | | | | sp:HTPX_ECOLI | P23894 |

Description
PROBABLE PROTEASE HTPX, (HEAT SHOCK PROTEIN HTPX)

| ORF_Name | NTID | AAID | NT Length | AA Length | Score | Probability |
|---|---|---|---|---|---|---|
| 34199062_c3_512 | 3743 | 7915 | 326 | 981 | | |
| Protein name | | | | | Locus Name | Acc# |

Description
NO-HIT

| ORF Name | NTID | AAID | NT Length | AA Length | Score | Probability |
|---|---|---|---|---|---|---|
| 34564177_f1_75 | 3744 | 7916 | 63 | 192 | | |
| Protein name | | | | | Locus Name | Acc# |

Description
NO-HIT

| ORF Name | NTID | AAID | NT Length | AA Length | Score | Probability |
|---|---|---|---|---|---|---|
| 34579677_c2_443 | 3745 | 7917 | 110 | 333 | 79 | 0.0037 |
| Protein name | | | | | Locus Name | Acc# |
| | | | | | sp:YMDA_ECOLI | P75917 |

Description
HYPOTHETICAL 11.2 KD PROTEIN IN CSGC-MDOG INTERGENIC REGION PRECURSOR

| ORF Name | NTID | AAID | NT Length | AA Length | Score | Probability |
|---|---|---|---|---|---|---|
| 35157752_c2_427 | 3746 | 7918 | 292 | 879 | 215 | 1.4e-17 |
| Protein name | | | | | Locus Name | Acc# |
| hypothetical protein Rv3312c | | | | | pir:G70842 | G70842 |

Description

| ORF Name | NTID | AAID | NT Length | AA Length | Score | Probability |
|---|---|---|---|---|---|---|
| 35214077_c2_422 | 3747 | 7919 | 94 | 285 | 157 | 2.0e-11 |
| Protein name | | | | | Locus Name | Acc# |
| | | | | | sp:ACYP_ECOLI | P75877 |

Description
PHOSPHOHYDROLASE)

| ORF Name | NTID | AAID | NT Length | AA Length | Score | Probability |
|---|---|---|---|---|---|---|
| 35314633_c1_329 | 3748 | 7920 | 231 | 696 | 670 | 8.8e-66 |
| Protein name | | | | | Locus Name | Acc# |
| | | | | | sp:DDG_ECOLI | P76522:P76 |

Description
DDG PROTEIN

| ORF Name | NTID | AAID | NT Length | AA Length | Score | Probability |
|---|---|---|---|---|---|---|
| 35939192_c1_367 | 3749 | 7921 | 420 | 1263 | 1642 | 8.8e-169 |
| Protein name | | | | | Locus Name | Acc# |
| | | | | | sp:PEPT_SALTY | P26311 |

Description

PEPTIDASE T, (AMINOTRIPEPTIDASE) (TRIPEPTIDASE)

| ORF Name | NTID | AAID | NT Length | AA Length | Score | Probability |
|---|---|---|---|---|---|---|
| 36114000_f3_288 | 3750 | 7922 | 384 | 1155 | 1354 | 2.9e-138 |
| Protein name | | | | | Locus Name | Acc# |
| outer membrane protein A precursor | | | | | pir:JC6558 | JC6558 |

Description

| ORF Name | NTID | AAID | NT Length | AA Length | Score | Probability |
|---|---|---|---|---|---|---|
| 36125268_c1_404 | 3751 | 7923 | 88 | 264 | 419 | 3.5e-39 |
| Protein name | | | | | Locus Name | Acc# |
| | | | | | sp:IF3_PROVU | P33319 |

Description

TRANSLATION INITIATION FACTOR IF-3

| ORF Name | NTID | AAID | NT Length | AA Length | Score | Probability |
|---|---|---|---|---|---|---|
| 36131461_c1_342 | 3752 | 7924 | 303 | 912 | 976 | 3.3e-98 |
| Protein name | | | | | Locus Name | Acc# |
| | | | | | sp:YEIE_ECOLI | P32484 |

Description

HYPOTHETICAL TRANSCRIPTIONAL REGULATOR IN LYSP-NFO INTERGENIC REGION

| ORF Name | NTID | AAID | NT Length | AA Length | Score | Probability |
|---|---|---|---|---|---|---|
| 36220341_f1_60 | 3753 | 7925 | 66 | 201 | 119 | 2.2e-07 |
| Protein name | | | | | Locus Name | Acc# |
| hypothetical protein slr1999 | | | | | pir:S75025 | S75025 |

Description

| ORF_Name | NTID | AAID | NT Length | AA Length | Score | Probability |
|---|---|---|---|---|---|---|
| 3912562_c3_547 | 3754 | 7926 | 300 | 903 | 488 | 1.7e-46 |
| Protein name | | | | | Locus Name | Acc# |
| | | | | | sp:YWBI_BACSU | P39592 |

Description: HYPOTHETICAL TRANSCRIPTIONAL REGULATOR IN THIK-EPR INTERGENIC REGION

| ORF_Name | NTID | AAID | NT Length | AA Length | Score | Probability |
|---|---|---|---|---|---|---|
| 3937963_c3_582 | 3755 | 7927 | 133 | 402 | 246 | 7.5e-21 |
| Protein name | | | | | Locus Name | Acc# |
| hypothetical protein b1841 | | | | | pir:A64946 | A64946 |

Description

| ORF_Name | NTID | AAID | NT Length | AA Length | Score | Probability |
|---|---|---|---|---|---|---|
| 3941963_c2_464 | 3756 | 7928 | 264 | 795 | 1022 | 4.4e-103 |
| Protein name | | | | | Locus Name | Acc# |
| | | | | | sp:YCFH_ECOLI | P37346:P78 |

Description: HYPOTHETICAL 29.8 KD PROTEIN IN HOLB-PTSG INTERGENIC REGION

| ORF_Name | NTID | AAID | NT Length | AA Length | Score | Probability |
|---|---|---|---|---|---|---|
| 3944052_c3_542 | 3757 | 7929 | 407 | 1224 | 1260 | 2.7e-128 |
| Protein name | | | | | Locus Name | Acc# |
| | | | | | sp:BCR_ECOLI | P28246 |

Description: BICYCLOMYCIN RESISTANCE PROTEIN (SULFONAMIDE RESISTANCE PROTEIN)

| ORF_Name | NTID | AAID | NT Length | AA Length | Score | Probability |
|---|---|---|---|---|---|---|
| 3944577_c1_403 | 3758 | 7930 | 642 | 1929 | 2960 | 0.0 |
| Protein name | | | | | Locus Name | Acc# |
| | | | | | sp:SYT_ECOLI | P00955:P78 |

Description: (THRRS)

| ORF Name | NTID | AAID | NT Length | AA Length | Score | Probability |
|---|---|---|---|---|---|---|
| 3962765_f3_265 | 3759 | 7931 | 590 | 1773 | 2227 | 9.0e-231 |
| Protein name | | | | | Locus Name | Acc# |
| | | | | | sp:YEJH_ECOLI | P33919:P36 |

Description

HYPOTHETICAL 66.4 KD PROTEIN IN RSUA-RPLY INTERGENIC REGION

| ORF Name | NTID | AAID | NT Length | AA Length | Score | Probability |
|---|---|---|---|---|---|---|
| 4015943_f3_224 | 3760 | 7932 | 189 | 570 | 74 | 0.033 |
| Protein name | | | | | Locus Name | Acc# |
| adenylate kinase | | | | | gp:AF071012 | AF071012 |

Description

Streptomyces lividans ribosomal protein large subunit L15 (rpl0)gene, partial cds; protein translocase (secY) gene, complete cds;and adenylate kinase (adk) gene, partial cds.

| ORF Name | NTID | AAID | NT Length | AA Length | Score | Probability |
|---|---|---|---|---|---|---|
| 4016005_f2_110 | 3761 | 7933 | 89 | 270 | | |
| Protein name | | | | | Locus Name | Acc# |

Description

NO-HIT

| ORF Name | NTID | AAID | NT Length | AA Length | Score | Probability |
|---|---|---|---|---|---|---|
| 4019818_f1_16 | 3762 | 7934 | 147 | 444 | 287 | 3.4e-25 |
| Protein name | | | | | Locus Name | Acc# |
| conserved hypothetical protein b1376 | | | | | pir:C64888 | C64888 |

Description

| ORF Name | NTID | AAID | NT Length | AA Length | Score | Probability |
|---|---|---|---|---|---|---|
| 4024092_f1_49 | 3763 | 7935 | 285 | 858 | 1162 | 6.4e-118 |
| Protein name | | | | | Locus Name | Acc# |
| | | | | | sp:END4_ECOLI | P12638:P78 |

Description

ENDONUCLEASE IV, (ENDODEOXYRIBONUCLEASE IV)

845

| ORF_Name | NTID | AAID | NT Length | AA Length | Score | Probability |
|---|---|---|---|---|---|---|
| 4069067_c3_545 | 3764 | 7936 | 677 | 2034 | 1148 | 9.2e-159 |
| Protein name | | | | | Locus Name | Acc# |
| | | | | | sp:IRGA_VIBCH | P27772 |

Description: IRON-REGULATED OUTER MEMBRANE VIRULENCE PROTEIN PRECURSOR

| ORF_Name | NTID | AAID | NT Length | AA Length | Score | Probability |
|---|---|---|---|---|---|---|
| 4080268_c1_357 | 3765 | 7937 | 196 | 591 | 341 | 6.4e-31 |
| Protein name | | | | | Locus Name | Acc# |
| | | | | | sp:YCFM_ECOLI | P75947 |

Description: HYPOTHETICAL 22.5 KD PROTEIN IN FHUE-NDH INTERGENIC REGION

| ORF_Name | NTID | AAID | NT Length | AA Length | Score | Probability |
|---|---|---|---|---|---|---|
| 4093962_f3_241 | 3766 | 7938 | 490 | 1473 | 1588 | 4.6e-163 |
| Protein name | | | | | Locus Name | Acc# |
| putative sensor kinase | | | | | gp:AF041833 | AF041833 |

Description: Providencia stuartii response regulator homolog (aarR) and putativesensor kinase (aarG) genes, complete cds.

| ORF_Name | NTID | AAID | NT Length | AA Length | Score | Probability |
|---|---|---|---|---|---|---|
| 4120260_c1_368 | 3767 | 7939 | 103 | 312 | 83 | 0.013 |
| Protein name | | | | | Locus Name | Acc# |
| alpha-ketoglutarate permease | | | | | pir:C64656 | C64656 |

Description:

| ORF_Name | NTID | AAID | NT Length | AA Length | Score | Probability |
|---|---|---|---|---|---|---|
| 4303888_f3_240 | 3768 | 7940 | 370 | 1113 | 1661 | 8.5e-171 |
| Protein name | | | | | Locus Name | Acc# |
| | | | | | sp:TRMU_ECOLI | P25745:P75 |

Description: (EC 2.1.1.61)

| ORF Name | NTID | AAID | NT Length | AA Length | Score | Probability |
|---|---|---|---|---|---|---|
| 4551312_c3_537 | 3769 | 7941 | 125 | 378 | | |

| Protein name | | | | | Locus Name | Acc# |
|---|---|---|---|---|---|---|

Description
NO-HIT

| ORF Name | NTID | AAID | NT Length | AA Length | Score | Probability |
|---|---|---|---|---|---|---|
| 4562682_c1_364 | 3770 | 7942 | 412 | 1239 | 1235 | 1.2e-125 |

| Protein name | | | | | Locus Name | Acc# |
|---|---|---|---|---|---|---|
| Hypothetical protein HI1555 | | | | | gp:D90747 | D90747:AB0 |

Description
Escherichia coli genomic DNA. (25.2 - 25.6 min).

| ORF Name | NTID | AAID | NT Length | AA Length | Score | Probability |
|---|---|---|---|---|---|---|
| 4579381_c2_428 | 3771 | 7943 | 82 | 249 | 298 | 2.3e-26 |

| Protein name | | | | | Locus Name | Acc# |
|---|---|---|---|---|---|---|
| major cold shock protein CSPA2 | | | | | gp:YEU82821 | U82821 |

Description
Yersinia enterocolitica major cold shock proteins CSPA1 (cspA1) andCSPA2 (cspA2) genes, complete cds.

| ORF Name | NTID | AAID | NT Length | AA Length | Score | Probability |
|---|---|---|---|---|---|---|
| 46875_c1_330 | 3772 | 7944 | 268 | 807 | 180 | 1.6e-13 |

| Protein name | | | | | Locus Name | Acc# |
|---|---|---|---|---|---|---|
| | | | | | sp:YQEM_BACSU | P54458 |

Description
HYPOTHETICAL 28.3 KD PROTEIN IN AROD-COMER INTERGENIC REGION

| ORF Name | NTID | AAID | NT Length | AA Length | Score | Probability |
|---|---|---|---|---|---|---|
| 4688787_f2_102 | 3773 | 7945 | 209 | 630 | 350 | 7.2e-32 |

| Protein name | | | | | Locus Name | Acc# |
|---|---|---|---|---|---|---|
| unknown | | | | | gp:MXU81516 | U81516 |

Description
Myxococcus xanthus ABC transporter homolog gene, partial cds andRNA polymerase sigma-54 factor (rpoN) gene, complete cds.

| ORF Name | NTID | AAID | NT Length | AA Length | Score | Probability |
|---|---|---|---|---|---|---|
| 4689077_c2_503 | 3774 | 7946 | 303 | 912 | 784 | 7.3e-78 |
| Protein name | | | | | Locus Name | Acc# |
| probable fimbrial protein b1502 | | | | | pir:A64904 | A64904 |

Description

| ORF Name | NTID | AAID | NT Length | AA Length | Score | Probability |
|---|---|---|---|---|---|---|
| 4726515_c2_486 | 3775 | 7947 | 302 | 909 | 458 | 2.6e-43 |
| Protein name | | | | | Locus Name | Acc# |
| probable membrane protein b1840 | | | | | pir:H64945 | H64945 |

Description

| ORF Name | NTID | AAID | NT Length | AA Length | Score | Probability |
|---|---|---|---|---|---|---|
| 4728550_c2_415 | 3776 | 7948 | 184 | 555 | 441 | 1.6e-41 |
| Protein name | | | | | Locus Name | Acc# |
| | | | | | sp:YCBW_ECOLI | P75862 |

Description
HYPOTHETICAL 22.1 KD PROTEIN IN PYRD-UUP INTERGENIC REGION

| ORF Name | NTID | AAID | NT Length | AA Length | Score | Probability |
|---|---|---|---|---|---|---|
| 473131_f2_155 | 3777 | 7949 | 94 | 285 | 233 | 1.8e-19 |
| Protein name | | | | | Locus Name | Acc# |
| unknown | | | | | gp:HIU20229 | U20229 |

Description
Haemophilus influenzae BOLA (bolA), glutathione reductase (gor), phosphatidylserine decarboxylase (psd), 30K protein (rpmF), genes, complete cds.

| ORF Name | NTID | AAID | NT Length | AA Length | Score | Probability |
|---|---|---|---|---|---|---|
| 473388_f3_233 | 3778 | 7950 | 153 | 462 | 599 | 2.9e-58 |
| Protein name | | | | | Locus Name | Acc# |
| | | | | | sp:YTFH_ECOLI | P39316 |

Description
HYPOTHETICAL 17.6 KD PROTEIN IN RPLI-CPDB INTERGENIC REGION (O156)

| ORF_Name | NTID | AAID | NT Length | AA Length | Score | Probability |
|---|---|---|---|---|---|---|
| 4742675_f2_184 | 3779 | 7951 | 103 | 312 | 131 | 1.2e-08 |
| Protein name | | | | | Locus Name | Acc# |
| | | | | | sp:RHTB_ECOLI | P27847 |

Description
HOMOSERINE/HOMOSERINE LACTONE EFFLUX PROTEIN

| ORF_Name | NTID | AAID | NT Length | AA Length | Score | Probability |
|---|---|---|---|---|---|---|
| 4788427_f3_296 | 3780 | 7952 | 385 | 1158 | 1244 | 1.3e-126 |
| Protein name | | | | | Locus Name | Acc# |
| | | | | | sp:OMPF_XENNE | Q56828 |

Description
PROTEIN OPNP)

| ORF_Name | NTID | AAID | NT Length | AA Length | Score | Probability |
|---|---|---|---|---|---|---|
| 4819802_f1_25 | 3781 | 7953 | 70 | 213 | | |
| Protein name | | | | | Locus Name | Acc# |

Description
NO-HIT

| ORF_Name | NTID | AAID | NT Length | AA Length | Score | Probability |
|---|---|---|---|---|---|---|
| 48593_c3_593 | 3782 | 7954 | 231 | 696 | 181 | 5.8e-14 |
| Protein name | | | | | Locus Name | Acc# |
| | | | | | sp:LUMQ_PHOLE | Q51872 |

Description
PROBABLE TRANSCRIPTIONAL REGULATOR LUMQ

| ORF_Name | NTID | AAID | NT Length | AA Length | Score | Probability |
|---|---|---|---|---|---|---|
| 4881342_f3_279 | 3783 | 7955 | 117 | 354 | 150 | 1.1e-10 |
| Protein name | | | | | Locus Name | Acc# |
| | | | | | sp:YOAG_ECOLI | P76247 |

Description
HYPOTHETICAL 6.6 KD PROTEIN IN GAPA-RND INTERGENIC REGION

| ORF Name | NTID | AAID | NT Length | AA Length | Score | Probability |
|---|---|---|---|---|---|---|
| 4885882_c2_461 | 3784 | 7956 | 94 | 285 | 323 | 5.2e-29 |

| Protein name | Locus Name | Acc# |
|---|---|---|
| acyl carrier protein | gp:S65033 | S65033 |

Description
.

| ORF Name | NTID | AAID | NT Length | AA Length | Score | Probability |
|---|---|---|---|---|---|---|
| 4901510_c2_475 | 3785 | 7957 | 379 | 1140 | 97 | 0.00060 |

| Protein name | Locus Name | Acc# |
|---|---|---|
| dipeptidyl peptidase IV-related protein | pir:B75297 | B75297 |

Description

| ORF Name | NTID | AAID | NT Length | AA Length | Score | Probability |
|---|---|---|---|---|---|---|
| 4962556_c2_479 | 3786 | 7958 | 77 | 234 | | |

| Protein name | Locus Name | Acc# |
|---|---|---|
| | | |

Description
NO-HIT

| ORF Name | NTID | AAID | NT Length | AA Length | Score | Probability |
|---|---|---|---|---|---|---|
| 4975215_c3_558 | 3787 | 7959 | 128 | 387 | 496 | 2.4e-47 |

| Protein name | Locus Name | Acc# |
|---|---|---|
| | sp:YCFF_ECOLI | P36950:P75 |

Description
HYPOTHETICAL 13.2 KD PROTEIN HIT-LIKE PROTEIN IN FHUE 5'REGION

| ORF Name | NTID | AAID | NT Length | AA Length | Score | Probability |
|---|---|---|---|---|---|---|
| 5093888_c2_488 | 3788 | 7960 | 168 | 507 | 490 | 1.0e-46 |

| Protein name | Locus Name | Acc# |
|---|---|---|
| | sp:YEBR_ECOLI | P76270:O07 |

Description
HYPOTHETICAL 20.3 KD PROTEIN IN PRC-PPHA INTERGENIC REGION

| ORF Name | NTID | AAID | NT Length | AA Length | Score | Probability |
|---|---|---|---|---|---|---|
| 5100000_f2_130 | 3789 | 7961 | 233 | 702 | 858 | 1.1e-85 |
| Protein name | | | | | Locus Name | Acc# |
| | | | | | sp:PHOP_ECOLI | P23836 |

Description: TRANSCRIPTIONAL REGULATORY PROTEIN PHOP

| ORF Name | NTID | AAID | NT Length | AA Length | Score | Probability |
|---|---|---|---|---|---|---|
| 5110416_f1_89 | 3790 | 7962 | 406 | 1221 | 1409 | 4.3e-144 |
| Protein name | | | | | Locus Name | Acc# |
| | | | | | sp:PNCB_ECOLI | P18133 |

Description: NICOTINATE PHOSPHORIBOSYLTRANSFERASE, (NAPRTASE)

| ORF Name | NTID | AAID | NT Length | AA Length | Score | Probability |
|---|---|---|---|---|---|---|
| 5113452_f2_121 | 3791 | 7963 | 104 | 315 | 127 | 3.1e-08 |
| Protein name | | | | | Locus Name | Acc# |
| | | | | | gp:PMFIMOPR | Z32686 |

Description: Proteus mirabilis fimbrial operon, strain HI4320.

| ORF Name | NTID | AAID | NT Length | AA Length | Score | Probability |
|---|---|---|---|---|---|---|
| 51937_f2_112 | 3792 | 7964 | 147 | 444 | 191 | 5.1e-15 |
| Protein name | | | | | Locus Name | Acc# |
| | | | | | sp:YIGF_ECOLI | P27842 |

Description: HYPOTHETICAL 14.5 KD PROTEIN IN CORA-RARD INTERGENIC REGION (F126)

| ORF Name | NTID | AAID | NT Length | AA Length | Score | Probability |
|---|---|---|---|---|---|---|
| 5212508_f3_244 | 3793 | 7965 | 1173 | 3522 | 4568 | 0.0 |
| Protein name | | | | | Locus Name | Acc# |
| | | | | | sp:MFD_ECOLI | P30958:P77 |

Description: TRANSCRIPTION-REPAIR COUPLING FACTOR (TRCF)

| ORF Name | NTID | AAID | NT Length | AA Length | Score | Probability |
|---|---|---|---|---|---|---|
| 5289068_f2_113 | 3794 | 7966 | 185 | 558 | 405 | 1.1e-37 |
| Protein name | | | | | Locus Name | Acc# |
| adenylate cyclase | | | | | gp:AHAJ3730 | AJ223730 |

Description: Aeromonas hydrophila cyaB gene (strain 218).

| ORF Name | NTID | AAID | NT Length | AA Length | Score | Probability |
|---|---|---|---|---|---|---|
| 5350812_c1_366 | 3795 | 7967 | 290 | 873 | 1002 | 5.8e-101 |
| Protein name | | | | | Locus Name | Acc# |
| hypothetical protein b1120 | | | | | pir:E64856 | E64856 |

Description:

| ORF Name | NTID | AAID | NT Length | AA Length | Score | Probability |
|---|---|---|---|---|---|---|
| 5859593_f2_192 | 3796 | 7968 | 727 | 2184 | 2258 | 4.7e-234 |
| Protein name | | | | | Locus Name | Acc# |
| | | | | | sp:YCCS_ECOLI | P75870 |

Description: HYPOTHETICAL 82.0 KD PROTEIN IN SULA-HELD INTERGENIC REGION

| ORF Name | NTID | AAID | NT Length | AA Length | Score | Probability |
|---|---|---|---|---|---|---|
| 5881510_c1_391 | 3797 | 7969 | 127 | 384 | 246 | 7.5e-21 |
| Protein name | | | | | Locus Name | Acc# |
| hypothetical protein b1839 precursor | | | | | pir:G64945 | G64945 |

Description:

| ORF Name | NTID | AAID | NT Length | AA Length | Score | Probability |
|---|---|---|---|---|---|---|
| 5945343_f1_54 | 3798 | 7970 | 209 | 630 | 587 | 5.5e-57 |
| Protein name | | | | | Locus Name | Acc# |
| | | | | | sp:SPR_ECOLI | P77685:O08 |

Description: LIPOPROTEIN SPR PRECURSOR

| ORF Name | NTID | AAID | NT Length | AA Length | Score | Probability |
|---|---|---|---|---|---|---|
| 5977302_c3_570 | 3799 | 7971 | 157 | 474 | | |
| Protein name | | | | | Locus Name | Acc# |

Description
NO-HIT

| ORF Name | NTID | AAID | NT Length | AA Length | Score | Probability |
|---|---|---|---|---|---|---|
| 6042557_f2_106 | 3800 | 7972 | 320 | 963 | 1000 | 9.5e-101 |
| Protein name | | | | | Locus Name | Acc# |
| | | | | | sp:YFED_YERPE | Q56955 |

Description
CHELATED IRON TRANSPORT SYSTEM MEMBRANE PROTEIN YFED

| ORF Name | NTID | AAID | NT Length | AA Length | Score | Probability |
|---|---|---|---|---|---|---|
| 6053218_c2_481 | 3801 | 7973 | 68 | 207 | 55 | 0.031 |
| Protein name | | | | | Locus Name | Acc# |
| putative pol polyprotein, 3' partial | | | | | gp:ATAC006570 | AC006570 |

Description
Arabidopsis thaliana chromosome II BAC T16I21 genomic sequence, complete sequence.

| ORF Name | NTID | AAID | NT Length | AA Length | Score | Probability |
|---|---|---|---|---|---|---|
| 6057942_c2_472 | 3802 | 7974 | 150 | 453 | | |
| Protein name | | | | | Locus Name | Acc# |

Description
NO-HIT

| ORF Name | NTID | AAID | NT Length | AA Length | Score | Probability |
|---|---|---|---|---|---|---|
| 6093758_c2_406 | 3803 | 7975 | 92 | 279 | | |
| Protein name | | | | | Locus Name | Acc# |

Description
NO-HIT

| ORF Name | NTID | AAID | NT Length | AA Length | Score | Probability |
|---|---|---|---|---|---|---|
| 6097166_f1_22 | 3804 | 7976 | 70 | 213 | | |
| Protein name | | | | | Locus Name | Acc# |

Description: NO-HIT

| ORF Name | NTID | AAID | NT Length | AA Length | Score | Probability |
|---|---|---|---|---|---|---|
| 6255400_f1_92 | 3805 | 7977 | 233 | 702 | 908 | 5.3e-91 |
| Protein name | | | | | Locus Name | Acc# |
| | | | | | sp:AAT_ECOLI | P00509 |

Description: ASPARTATE AMINOTRANSFERASE, (TRANSAMINASE A) (ASPAT)

| ORF Name | NTID | AAID | NT Length | AA Length | Score | Probability |
|---|---|---|---|---|---|---|
| 6337_c2_410 | 3806 | 7978 | 72 | 219 | | |
| Protein name | | | | | Locus Name | Acc# |

Description: NO-HIT

| ORF Name | NTID | AAID | NT Length | AA Length | Score | Probability |
|---|---|---|---|---|---|---|
| 6679767_f2_186 | 3807 | 7979 | 77 | 234 | 192 | 4.0e-15 |
| Protein name | | | | | Locus Name | Acc# |
| | | | | | sp:TETD_ECOLI | P28816 |

Description: TRANSPOSON TN10 TETD PROTEIN (ORFR)

| ORF Name | NTID | AAID | NT Length | AA Length | Score | Probability |
|---|---|---|---|---|---|---|
| 6813753_c2_449 | 3808 | 7980 | 473 | 1422 | 1672 | 5.8e-172 |
| Protein name | | | | | Locus Name | Acc# |
| | | | | | sp:YEEF_ECOLI | P33016 |

Description: HYPOTHETICAL 49.8 KD TRANSPORT PROTEIN IN SBCB-HISL INTERGENIC REGION

| ORF Name | NTID | AAID | NT Length | AA Length | Score | Probability |
|---|---|---|---|---|---|---|
| 6885_c1_338 | 3809 | 7981 | 254 | 765 | 931 | 1.9e-93 |
| Protein name | | | | | Locus Name | Acc# |
| | | | | | sp:RSUA_ECOLI | P33918 |

Description

HYDROLYASE)

| ORF Name | NTID | AAID | NT Length | AA Length | Score | Probability |
|---|---|---|---|---|---|---|
| 7031505_f3_227 | 3810 | 7982 | 414 | 1245 | 1250 | 3.0e-127 |
| Protein name | | | | | Locus Name | Acc# |
| | | | | | sp:YBDN_ECOLI | P77216 |

Description

HYPOTHETICAL 47.8 KD PROTEIN IN CSTA-DSBG INTERGENIC REGION

| ORF Name | NTID | AAID | NT Length | AA Length | Score | Probability |
|---|---|---|---|---|---|---|
| 7033337_c2_460 | 3811 | 7983 | 333 | 1002 | 1193 | 3.3e-121 |
| Protein name | | | | | Locus Name | Acc# |
| malonyl CoA-acyl carrier protein transacylase | | | | | gp:AF044668 | AF044668 |

Description

Salmonella typhimurium (g30k) gene, partial cds; and 50S ribosomalprotein L32 (rpmF), PlsX (plsX), 3-oxoacyl-acyl carrier proteinsynthase III (fabH), malonyl CoA-acyl carrier protein transacylase(fabD), and 3-oxoacyl-acyl carrier protein reductase (fabG) genes,complete cds.

| ORF Name | NTID | AAID | NT Length | AA Length | Score | Probability |
|---|---|---|---|---|---|---|
| 820308_c3_521 | 3812 | 7984 | 182 | 549 | 569 | 4.4e-55 |
| Protein name | | | | | Locus Name | Acc# |
| | | | | | sp:YCBG_ECOLI | P45569:P75 |

Description

HYPOTHETICAL 17.7 KD PROTEIN IN FABA-OMPA INTERGENIC REGION

| ORF_Name | NTID | AAID | NT Length | AA Length | Score | Probability |
|---|---|---|---|---|---|---|
| 824002_c3_588 | 3813 | 7985 | 195 | 588 | 493 | 5.0e-47 |
| Protein name | | | | | Locus Name | Acc# |
| | | | | | sp:YFEE_YERPE | Q56956 |

Description: PUTATIVE YFEABCD REGULATOR YFEE

| ORF_Name | NTID | AAID | NT Length | AA Length | Score | Probability |
|---|---|---|---|---|---|---|
| 970827_c3_532 | 3814 | 7986 | 110 | 333 | 109 | 2.5e-06 |
| Protein name | | | | | Locus Name | Acc# |
| | | | | | sp:YDHA_ECOLI | P28224 |

Description: HYPOTHETICAL 12.6 KD PROTEIN IN PDXH-SLYB INTERGENIC REGION

| ORF_Name | NTID | AAID | NT Length | AA Length | Score | Probability |
|---|---|---|---|---|---|---|
| 975002_f1_19 | 3815 | 7987 | 151 | 456 | 122 | 1.0e-07 |
| Protein name | | | | | Locus Name | Acc# |
| | | | | | sp:YDCQ_ECOLI | P76107 |

Description: HYPOTHETICAL 16.1 KD PROTEIN IN TEHB-ANSP INTERGENIC REGION

| ORF_Name | NTID | AAID | NT Length | AA Length | Score | Probability |
|---|---|---|---|---|---|---|
| 9766642_f2_175 | 3816 | 7988 | 133 | 402 | 344 | 3.1e-31 |
| Protein name | | | | | Locus Name | Acc# |
| | | | | | sp:RL25_ECOLI | P02426 |

Description: 50S RIBOSOMAL PROTEIN L25

| ORF_Name | NTID | AAID | NT Length | AA Length | Score | Probability |
|---|---|---|---|---|---|---|
| 9812828_c3_576 | 3817 | 7989 | 340 | 1023 | 954 | 7.1e-96 |
| Protein name | | | | | Locus Name | Acc# |
| | | | | | gp:STY224978 | AJ224978 |

Description: Salmonella typhimurium, Salmonella Pathogenicity Island 2 (SPI2)genes, ttr gene cluster.

| ORF Name | NTID | AAID | NT Length | AA Length | Score | Probability |
|---|---|---|---|---|---|---|
| 9814402_c1_379 | 3818 | 7990 | 71 | 216 | | |
| Protein name | | | | | Locus Name | Acc# |

Description
NO-HIT

| ORF Name | NTID | AAID | NT Length | AA Length | Score | Probability |
|---|---|---|---|---|---|---|
| 986005_c1_358 | 3819 | 7991 | 356 | 1071 | 1272 | 1.4e-129 |
| Protein name | | | | | Locus Name | Acc# |
| | | | | | sp:YCFO_ECOLI | P75949 |

Description
HYPOTHETICAL 37.6 KD PROTEIN IN FHUE-NDH INTERGENIC REGION

| ORF Name | NTID | AAID | NT Length | AA Length | Score | Probability |
|---|---|---|---|---|---|---|
| 9929592_f1_58 | 3820 | 7992 | 590 | 1773 | 1608 | 3.5e-165 |
| Protein name | | | | | Locus Name | Acc# |
| | | | | | sp:YEJM_ECOLI | P33922:P33 |

Description
HYPOTHETICAL 67.3 KD PROTEIN IN RPLY-PROL INTERGENIC REGION

| ORF Name | NTID | AAID | NT Length | AA Length | Score | Probability |
|---|---|---|---|---|---|---|
| 9932162_f2_129 | 3821 | 7993 | 216 | 651 | 446 | 4.8e-42 |
| Protein name | | | | | Locus Name | Acc# |
| | | | | | sp:YCFC_ECOLI | P25746 |

Description
HYPOTHETICAL 22.9 KD PROTEIN IN PURB-ICDA INTERGENIC REGION (ORF-23)

| ORF Name | NTID | AAID | NT Length | AA Length | Score | Probability |
|---|---|---|---|---|---|---|
| 9948260_f1_17 | 3822 | 7994 | 72 | 219 | | |
| Protein name | | | | | Locus Name | Acc# |

Description
NO-HIT

| ORF Name | NTID | AAID | NT Length | AA Length | Score | Probability |
|---|---|---|---|---|---|---|
| 9969202_c3_526 | 3823 | 7995 | 137 | 414 | 416 | 7.3e-39 |
| Protein name | | | | | Locus Name | Acc# |
| hypothetical protein b0965 | | | | | pir:D64837 | D64837 |

Description

| ORF Name | NTID | AAID | NT Length | AA Length | Score | Probability |
|---|---|---|---|---|---|---|
| 10290928_c3_697 | 3824 | 7996 | 202 | 609 | | |
| Protein name | | | | | Locus Name | Acc# |

Description
NO-HIT

| ORF Name | NTID | AAID | NT Length | AA Length | Score | Probability |
|---|---|---|---|---|---|---|
| 103430_f2_196 | 3825 | 7997 | 512 | 1539 | 1860 | 7.0e-192 |
| Protein name | | | | | Locus Name | Acc# |
| exopolyphosphatase | | | | | gp:AF085682 | AF085682 |

Description
Salmonella typhimurium polyphosphate kinase (ppk) andexopolyphosphatase (ppx) genes, complete cds.

| ORF Name | NTID | AAID | NT Length | AA Length | Score | Probability |
|---|---|---|---|---|---|---|
| 1036307_c1_460 | 3826 | 7998 | 289 | 870 | 223 | 2.1e-18 |
| Protein name | | | | | Locus Name | Acc# |
| | | | | | sp:TONB_PSEPU | Q05613 |

Description
TONB PROTEIN

| ORF Name | NTID | AAID | NT Length | AA Length | Score | Probability |
|---|---|---|---|---|---|---|
| 10563955_f3_324 | 3827 | 7999 | 234 | 705 | 345 | 2.4e-31 |
| Protein name | | | | | Locus Name | Acc# |
| | | | | | sp:Y100_HAEIN | P43941 |

Description
HYPOTHETICAL PROTEIN HI0100

| ORF Name | NTID | AAID | NT Length | AA Length | Score | Probability |
|---|---|---|---|---|---|---|
| 10587568_c1_497 | 3828 | 8000 | 223 | 672 | 406 | 8.3e-38 |

Protein name | Locus Name | Acc#
sp:UVRY_ECOLI | P07027

Description: UVRY PROTEIN

| ORF Name | NTID | AAID | NT Length | AA Length | Score | Probability |
|---|---|---|---|---|---|---|
| 10745916_c1_403 | 3829 | 8001 | 257 | 774 | 748 | 4.8e-74 |

Protein name | Locus Name | Acc#
sp:FLGF_SALTY | P16323

Description: FLAGELLAR BASAL-BODY ROD PROTEIN FLGF (PUTATIVE PROXIMAL ROD PROTEIN)

| ORF Name | NTID | AAID | NT Length | AA Length | Score | Probability |
|---|---|---|---|---|---|---|
| 1075_c3_641 | 3830 | 8002 | 415 | 1248 | 1730 | 4.2e-178 |

Protein name | Locus Name | Acc#
sp:FLC2_PROMI | P42273

Description: FLAGELLIN 2

| ORF Name | NTID | AAID | NT Length | AA Length | Score | Probability |
|---|---|---|---|---|---|---|
| 10804053_f1_109 | 3831 | 8003 | 110 | 333 | 120 | 1.7e-07 |

Protein name: hypothetical protein PH0444 | Locus Name | Acc#
pir:E71155 | E71155

Description:

| ORF Name | NTID | AAID | NT Length | AA Length | Score | Probability |
|---|---|---|---|---|---|---|
| 10969136_c2_616 | 3832 | 8004 | 349 | 1050 | 1426 | 6.8e-146 |

Protein name | Locus Name | Acc#
sp:SELD_ECOLI | P16456

Description: (SELENIUM DONOR PROTEIN)

| ORF Name | NTID | AAID | NT Length | AA Length | Score | Probability |
|---|---|---|---|---|---|---|
| 10972576_f1_97 | 3833 | 8005 | 162 | 489 | 381 | 3.7e-35 |
| Protein name | | | | | Locus Name | Acc# |
| | | | | | sp:FLIL_SALTY | P26417 |

Description: FLAGELLAR FLIL PROTEIN

| ORF Name | NTID | AAID | NT Length | AA Length | Score | Probability |
|---|---|---|---|---|---|---|
| 11025377_f2_226 | 3834 | 8006 | 468 | 1407 | 1778 | 3.4e-183 |
| Protein name | | | | | Locus Name | Acc# |
| | | | | | sp:FLII_ECOLI | P52612:P78 |

Description: FLAGELLUM-SPECIFIC ATP SYNTHASE,

| ORF Name | NTID | AAID | NT Length | AA Length | Score | Probability |
|---|---|---|---|---|---|---|
| 115638_f1_69 | 3835 | 8007 | 205 | 618 | 789 | 2.2e-78 |
| Protein name | | | | | Locus Name | Acc# |
| polyphosphate kinase, | | | | pir:A44306 | | A44306:B28 |

Description:

| ORF Name | NTID | AAID | NT Length | AA Length | Score | Probability |
|---|---|---|---|---|---|---|
| 11816317_f2_195 | 3836 | 8008 | 518 | 1557 | 2098 | 4.2e-217 |
| Protein name | | | | | Locus Name | Acc# |
| | | | | | sp:PPK_ECOLI | P28688 |

Description: POLYPHOSPHATE KINASE,

| ORF Name | NTID | AAID | NT Length | AA Length | Score | Probability |
|---|---|---|---|---|---|---|
| 11924125_c3_724 | 3837 | 8009 | 770 | 2313 | 1402 | 2.4e-143 |
| Protein name | | | | | Locus Name | Acc# |
| | | | | | sp:HYPF_ECOLI | P30131:Q46 |

Description: HYDROGENASE MATURATION PROTEIN HYPF

| ORF Name | NTID | AAID | NT Length | AA Length | Score | Probability |
|---|---|---|---|---|---|---|
| 1204637_f3_352 | 3838 | 8010 | 80 | 243 | | |
| Protein name | | | | | Locus Name | Acc# |

Description
NO-HIT

| ORF Name | NTID | AAID | NT Length | AA Length | Score | Probability |
|---|---|---|---|---|---|---|
| 12208127_f3_388 | 3839 | 8011 | 79 | 240 | 138 | 2.1e-09 |
| Protein name | | | | | Locus Name | Acc# |
| hypothetical protein PH0486 | | | | | pir:A71161 | A71161 |

Description

| ORF Name | NTID | AAID | NT Length | AA Length | Score | Probability |
|---|---|---|---|---|---|---|
| 12210312_f1_111 | 3840 | 8012 | 77 | 234 | | |
| Protein name | | | | | Locus Name | Acc# |

Description
NO-HIT

| ORF Name | NTID | AAID | NT Length | AA Length | Score | Probability |
|---|---|---|---|---|---|---|
| 12269556_f1_38 | 3841 | 8013 | 66 | 201 | 75 | 0.023 |
| Protein name | | | | | Locus Name | Acc# |
| transcription regulator AsnC family homolog | | | | | pir:B69309 | B69309 |

Description

| ORF Name | NTID | AAID | NT Length | AA Length | Score | Probability |
|---|---|---|---|---|---|---|
| 12306553_f3_332 | 3842 | 8014 | 157 | 474 | 685 | 2.3e-67 |
| Protein name | | | | | Locus Name | Acc# |
| | | | | | sp:BCP_ECOLI | P23480 |

Description
BACTERIOFERRITIN COMIGRATORY PROTEIN

| ORF_Name | NTID | AAID | NT Length | AA Length | Score | Probability |
|---|---|---|---|---|---|---|
| 1253877_f2_259 | 3843 | 8015 | 67 | 204 | | |
| Protein name | | | | | Locus Name | Acc# |

Description: NO-HIT

| ORF_Name | NTID | AAID | NT Length | AA Length | Score | Probability |
|---|---|---|---|---|---|---|
| 1265692_c2_573 | 3844 | 8016 | 194 | 585 | 327 | 2.0e-29 |
| Protein name | | | | | Locus Name | Acc# |
| CarH | | | | | gp:ECU17224 | U17224 |

Description: Erwinia carotovora CarR (carR), CarA (carA), CarB (carB), CarC(carC), CarD (carD), CarE (carE), CarF (carF), CarG (carG), CarH(carH), KduI (kduI), KdgT (kdgT), and RexZ (rexZ) genes, completecds.

| ORF_Name | NTID | AAID | NT Length | AA Length | Score | Probability |
|---|---|---|---|---|---|---|
| 1267267_c2_523 | 3845 | 8017 | 364 | 1095 | 756 | 6.8e-75 |
| Protein name | | | | | Locus Name | Acc# |
| | | | | | sp:FLGJ_SALTY | P15931 |

Description: FLAGELLAR PROTEIN FLGJ

| ORF_Name | NTID | AAID | NT Length | AA Length | Score | Probability |
|---|---|---|---|---|---|---|
| 12923217_c3_687 | 3846 | 8018 | 62 | 189 | | |
| Protein name | | | | | Locus Name | Acc# |

Description: NO-HIT

| ORF_Name | NTID | AAID | NT Length | AA Length | Score | Probability |
|---|---|---|---|---|---|---|
| 12931437_c3_703 | 3847 | 8019 | 1129 | 3390 | 94 | 0.012 |
| Protein name | | | | | Locus Name | Acc# |
| chromosome-associated protein-C | | | | | gp:AF092564 | AF092564 |

Description: Homo sapiens chromosome-associated protein-C (hCAP-C) mRNA, partialcds.

| ORF Name | NTID | AAID | NT Length | AA Length | Score | Probability |
|---|---|---|---|---|---|---|
| 1368768_c3_692 | 3848 | 8020 | 204 | 615 | 115 | 5.9e-11 |
| Protein name | | | | | Locus Name | Acc# |
| | | | | | sp:TERS_BPSF6 | Q38627 |

Description: TERMINASE SMALL SUBUNIT (G1P)

| ORF Name | NTID | AAID | NT Length | AA Length | Score | Probability |
|---|---|---|---|---|---|---|
| 13709592_f2_224 | 3849 | 8021 | 62 | 189 | | |
| Protein name | | | | | Locus Name | Acc# |

Description: NO-HIT

| ORF Name | NTID | AAID | NT Length | AA Length | Score | Probability |
|---|---|---|---|---|---|---|
| 13870461_c3_730 | 3850 | 8022 | 188 | 567 | 592 | 1.6e-57 |
| Protein name | | | | | Locus Name | Acc# |
| | | | | | sp:YDJA_ECOLI | P24250 |

Description: HYPOTHETICAL 20.1 KD PROTEIN IN SELD-SPPA INTERGENIC REGION (ORF183)

| ORF Name | NTID | AAID | NT Length | AA Length | Score | Probability |
|---|---|---|---|---|---|---|
| 14181557_f3_342 | 3851 | 8023 | 236 | 711 | 778 | 3.2e-77 |
| Protein name | | | | | Locus Name | Acc# |
| | | | | | sp:BAER_ECOLI | P30846 |

Description: TRANSCRIPTIONAL REGULATORY PROTEIN BAER

| ORF Name | NTID | AAID | NT Length | AA Length | Score | Probability |
|---|---|---|---|---|---|---|
| 14266911_f1_83 | 3852 | 8024 | 233 | 702 | 535 | 1.8e-51 |
| Protein name | | | | | Locus Name | Acc# |
| | | | | | sp:CRCA_ECOLI | P37001:P77 |

Description: CRCA PROTEIN

| ORF Name | NTID | AAID | NT Length | AA Length | Score | Probability |
|---|---|---|---|---|---|---|
| 14329638_f3_326 | 3853 | 8025 | 62 | 189 | | |
| Protein name | | | | | Locus Name | Acc# |

Description
NO-HIT

| ORF Name | NTID | AAID | NT Length | AA Length | Score | Probability |
|---|---|---|---|---|---|---|
| 14501251_f2_128 | 3854 | 8026 | 73 | 222 | 70 | 0.033 |
| Protein name | | | | | Locus Name | Acc# |
| hypothetical protein HP1211 | | | | | pir:C64671 | C64671 |

Description

| ORF Name | NTID | AAID | NT Length | AA Length | Score | Probability |
|---|---|---|---|---|---|---|
| 14510930_f1_7 | 3855 | 8027 | 218 | 657 | 630 | 1.5e-61 |
| Protein name | | | | | Locus Name | Acc# |
| hypothetical 23.4K protein (ansA 3' region) | | | | | pir:QQECA5 | H64936:JU0 |

Description

| ORF Name | NTID | AAID | NT Length | AA Length | Score | Probability |
|---|---|---|---|---|---|---|
| 14632203_c2_532 | 3856 | 8028 | 80 | 243 | | |
| Protein name | | | | | Locus Name | Acc# |

Description
NO-HIT

| ORF Name | NTID | AAID | NT Length | AA Length | Score | Probability |
|---|---|---|---|---|---|---|
| 14650378_f2_138 | 3857 | 8029 | 78 | 237 | 48 | 0.012 |
| Protein name | | | | | Locus Name | Acc# |
| | | | | | gp:HUMTCBXX | M13845:M16 |

Description
Human T-cell receptor active beta-chain (V3-D-J-C) mRNA, clonePL4.22.

| ORF Name | NTID | AAID | NT Length | AA Length | Score | Probability |
|---|---|---|---|---|---|---|
| 14660260_c3_706 | 3858 | 8030 | 98 | 297 | | |
| Protein name | | | | | Locus Name | Acc# |

Description
NO-HIT

| ORF Name | NTID | AAID | NT Length | AA Length | Score | Probability |
|---|---|---|---|---|---|---|
| 14663500_f2_169 | 3859 | 8031 | 86 | 261 | | |
| Protein name | | | | | Locus Name | Acc# |

Description
NO-HIT

| ORF Name | NTID | AAID | NT Length | AA Length | Score | Probability |
|---|---|---|---|---|---|---|
| 14901031_f3_337 | 3860 | 8032 | 218 | 657 | 687 | 1.4e-67 |
| Protein name | | | | | Locus Name | Acc# |
| | | | | | sp:ATDA_ECOLI | P37354 |

Description
ACETYLTRANSFERASE) (SAT)

| ORF Name | NTID | AAID | NT Length | AA Length | Score | Probability |
|---|---|---|---|---|---|---|
| 15024152_c3_622 | 3861 | 8033 | 386 | 1161 | 1264 | 1.0e-128 |
| Protein name | | | | | Locus Name | Acc# |
| | | | | | sp:FLHB_YEREN | Q56886 |

Description
FLAGELLAR BIOSYNTHETIC PROTEIN FLHB

| ORF Name | NTID | AAID | NT Length | AA Length | Score | Probability |
|---|---|---|---|---|---|---|
| 15050430_f1_5 | 3862 | 8034 | 69 | 210 | | |
| Protein name | | | | | Locus Name | Acc# |

Description
NO-HIT

| ORF Name | NTID | AAID | NT Length | AA Length | Score | Probability |
|---|---|---|---|---|---|---|
| 15088562_f2_222 | 3863 | 8035 | 123 | 372 | 193 | 3.1e-15 |
| Protein name | | | | | Locus Name | Acc# |
| | | | | | sp:FLIT_ECOLI | P26610 |

Description: FLAGELLAR PROTEIN FLIT

| ORF Name | NTID | AAID | NT Length | AA Length | Score | Probability |
|---|---|---|---|---|---|---|
| 15703187_c2_549 | 3864 | 8036 | 101 | 306 | 74 | 0.013 |
| Protein name | | | | | Locus Name | Acc# |
| conserved hypothetical protein BB0538 | | | | | pir:A70167 | A70167 |

Description:

| ORF Name | NTID | AAID | NT Length | AA Length | Score | Probability |
|---|---|---|---|---|---|---|
| 16069405_f1_21 | 3865 | 8037 | 277 | 834 | 788 | 2.8e-78 |
| Protein name | | | | | Locus Name | Acc# |
| | | | | | sp:DHG_BACME | P40288 |

Description: GLUCOSE 1-DEHYDROGENASE,

| ORF Name | NTID | AAID | NT Length | AA Length | Score | Probability |
|---|---|---|---|---|---|---|
| 16173562_f3_323 | 3866 | 8038 | 219 | 660 | 516 | 1.8e-49 |
| Protein name | | | | | Locus Name | Acc# |
| | | | | | sp:NARP_ECOLI | P31802 |

Description: NITRATE/NITRITE RESPONSE REGULATOR PROTEIN NARP

| ORF Name | NTID | AAID | NT Length | AA Length | Score | Probability |
|---|---|---|---|---|---|---|
| 16203452_c2_531 | 3867 | 8039 | 110 | 333 | 262 | 1.5e-22 |
| Protein name | | | | | Locus Name | Acc# |
| | | | | | sp:FLIE_ECOLI | P25797 |

Description: FLAGELLAR HOOK-BASAL BODY COMPLEX PROTEIN FLIE

| ORF Name | NTID | AAID | NT Length | AA Length | Score | Probability |
|---|---|---|---|---|---|---|
| 16273428_c1_411 | 3868 | 8040 | 61 | 186 | 134 | 5.5e-09 |
| Protein name | | | | | Locus Name | Acc# |
| hypothetical protein 12 flaA operon | | | | | pir:S14505 | S14505 |

Description

| ORF Name | NTID | AAID | NT Length | AA Length | Score | Probability |
|---|---|---|---|---|---|---|
| 16423467_c3_640 | 3869 | 8041 | 367 | 1104 | 1530 | 6.5e-157 |
| Protein name | | | | | Locus Name | Acc# |
| | | | | | sp:FLC2_PROMI | P42273 |

Description

FLAGELLIN 2

| ORF Name | NTID | AAID | NT Length | AA Length | Score | Probability |
|---|---|---|---|---|---|---|
| 16600000_c3_655 | 3870 | 8042 | 253 | 762 | 552 | 2.8e-53 |
| Protein name | | | | | Locus Name | Acc# |
| | | | | | sp:YAAJ_ECOLI | P30143 |

Description

HYPOTHETICAL 51.7 KD PROTEIN IN THRC-TALB INTERGENIC REGION (ORF8)

| ORF Name | NTID | AAID | NT Length | AA Length | Score | Probability |
|---|---|---|---|---|---|---|
| 193786_f1_16 | 3871 | 8043 | 351 | 1056 | 889 | 5.5e-89 |
| Protein name | | | | | Locus Name | Acc# |
| GlpX | | | | | gp:KPNGLPX | D55718 |

Description

Klebsiella aerogenes glpX gene for GlpX, complete cds.

| ORF Name | NTID | AAID | NT Length | AA Length | Score | Probability |
|---|---|---|---|---|---|---|
| 19537568_f1_92 | 3872 | 8044 | 483 | 1452 | 1005 | 2.8e-101 |
| Protein name | | | | | Locus Name | Acc# |
| | | | | | sp:FLID_PROMI | P42274 |

Description (FRAGMENT)

| ORF Name | NTID | AAID | NT Length | AA Length | Score | Probability |
|---|---|---|---|---|---|---|
| 19538176_c3_716 | 3873 | 8045 | 241 | 726 | 341 | 6.4e-31 |

| Protein name | Locus Name | Acc# |
|---|---|---|
| | sp:YC49_HAEIN | P44137 |

Description

HYPOTHETICAL PROTEIN HI1249 PRECURSOR

| ORF Name | NTID | AAID | NT Length | AA Length | Score | Probability |
|---|---|---|---|---|---|---|
| 19554636_f3_380 | 3874 | 8046 | 227 | 684 | 1053 | 2.3e-106 |

| Protein name | Locus Name | Acc# |
|---|---|---|
| FlgA | gp:PMU82214 | U82214 |

Description

Proteus mirabilis flagella rod protein FlgD (flgD) gene, partialcds, flagella rod proteins FlgC (flgC) and FlgB (flgB), flagellaassembly protein FlgA (flgA), anti-sigma factor FlgM (flgM),facilitator of flagella filament assembly FlgN (flgN) and FloA(floA) genes, complete cds.

| ORF Name | NTID | AAID | NT Length | AA Length | Score | Probability |
|---|---|---|---|---|---|---|
| 19630306_c2_574 | 3875 | 8047 | 772 | 2319 | 3253 | 0.0 |

| Protein name | Locus Name | Acc# |
|---|---|---|
| hypothetical protein b2463 | pir:F65021 | F65021 |

Description

| ORF Name | NTID | AAID | NT Length | AA Length | Score | Probability |
|---|---|---|---|---|---|---|
| 1964078_f2_210 | 3876 | 8048 | 191 | 576 | 474 | 5.2e-45 |

| Protein name | Locus Name | Acc# |
|---|---|---|
| | sp:YEAB_ECOLI | P43337 |

Description

HYPOTHETICAL 21.4 KD PROTEIN IN PABB-SDAA INTERGENIC REGION

| ORF Name | NTID | AAID | NT Length | AA Length | Score | Probability |
|---|---|---|---|---|---|---|
| 19641067_c2_611 | 3877 | 8049 | 615 | 1848 | 2533 | 3.4e-263 |

| Protein name | Locus Name | Acc# |
|---|---|---|
| | sp:UVRC_ECOLI | P07028:P76 |

Description

EXCINUCLEASE ABC SUBUNIT C

| ORF Name | NTID | AAID | NT Length | AA Length | Score | Probability |
|---|---|---|---|---|---|---|
| 19695160_f2_174 | 3878 | 8050 | 135 | 408 | 327 | 2.0e-29 |
| Protein name | | | | | Locus Name | Acc# |
| | | | | | sp:YFFB_ECOLI | P24178 |

Description
HYPOTHETICAL 13.6 KD PROTEIN IN ACRD-DAPE INTERGENIC REGION

| ORF Name | NTID | AAID | NT Length | AA Length | Score | Probability |
|---|---|---|---|---|---|---|
| 20006915_c1_480 | 3879 | 8051 | 127 | 384 | | |
| Protein name | | | | | Locus Name | Acc# |

Description
NO-HIT

| ORF Name | NTID | AAID | NT Length | AA Length | Score | Probability |
|---|---|---|---|---|---|---|
| 20126385_c1_485 | 3880 | 8052 | 135 | 408 | | |
| Protein name | | | | | Locus Name | Acc# |

Description
NO-HIT

| ORF Name | NTID | AAID | NT Length | AA Length | Score | Probability |
|---|---|---|---|---|---|---|
| 20159535_c3_619 | 3881 | 8053 | 203 | 612 | 993 | 5.2e-100 |
| Protein name | | | | | Locus Name | Acc# |
| flagella class I protein FlhC | | | | | gp:PMU96964 | U96964 |

Description
Proteus mirabilis flagella master operon flhDC: flagella class I protein FlhD (flhD) and flagella class I protein FlhC (flhC) genes, complete cds.

| ORF Name | NTID | AAID | NT Length | AA Length | Score | Probability |
|---|---|---|---|---|---|---|
| 20189077_f1_41 | 3882 | 8054 | 123 | 372 | 126 | 3.9e-08 |
| Protein name | | | | | Locus Name | Acc# |
| hypothetical protein Y1115 | | | | | pir:T15030 | T15030 |

Description

| ORF Name | NTID | AAID | NT Length | AA Length | Score | Probability |
|---|---|---|---|---|---|---|
| 2036341_c3_702 | 3883 | 8055 | 171 | 516 | | |
| Protein name | | | | | Locus Name | Acc# |

Description: NO-HIT

| ORF Name | NTID | AAID | NT Length | AA Length | Score | Probability |
|---|---|---|---|---|---|---|
| 2048557_f3_369 | 3884 | 8056 | 360 | 1083 | 1348 | 1.3e-137 |
| Protein name | | | | | Locus Name | Acc# |
| | | | | | sp:FLIM_SALTY | P26418 |

Description: FLAGELLAR MOTOR SWITCH PROTEIN FLIM

| ORF Name | NTID | AAID | NT Length | AA Length | Score | Probability |
|---|---|---|---|---|---|---|
| 20569763_f1_91 | 3885 | 8057 | 1330 | 3993 | 4840 | 0.0 |
| Protein name | | | | | Locus Name | Acc# |
| | | | | | sp:PUTA_ECOLI | P09546:P78 |

Description:

| ORF Name | NTID | AAID | NT Length | AA Length | Score | Probability |
|---|---|---|---|---|---|---|
| 20587930_c1_430 | 3886 | 8058 | 266 | 801 | 942 | 1.3e-94 |
| Protein name | | | | | Locus Name | Acc# |
| | | | | | sp:THID_SALTY | P55882 |

Description: (HMP-P KINASE)

| ORF Name | NTID | AAID | NT Length | AA Length | Score | Probability |
|---|---|---|---|---|---|---|
| 20589158_c1_481 | 3887 | 8059 | 108 | 327 | | |
| Protein name | | | | | Locus Name | Acc# |

Description: NO-HIT

| ORF Name | NTID | AAID | NT Length | AA Length | Score | Probability |
|---|---|---|---|---|---|---|
| 20604676_c2_514 | 3888 | 8060 | 302 | 909 | 1057 | 8.6e-107 |
| Protein name | | | | | Locus Name | Acc# |
| | | | | | sp:MOTA_SALTY | P55891 |

Description
CHEMOTAXIS MOTA PROTEIN (MOTILITY PROTEIN A)

| ORF Name | NTID | AAID | NT Length | AA Length | Score | Probability |
|---|---|---|---|---|---|---|
| 20734638_f2_221 | 3889 | 8061 | 134 | 405 | 372 | 3.3e-34 |
| Protein name | | | | | Locus Name | Acc# |
| | | | | | sp:FLIS_SALTY | P26609 |

Description
FLAGELLAR PROTEIN FLIS

| ORF Name | NTID | AAID | NT Length | AA Length | Score | Probability |
|---|---|---|---|---|---|---|
| 20787593_c1_473 | 3890 | 8062 | 141 | 426 | | |
| Protein name | | | | | Locus Name | Acc# |

Description
NO-HIT

| ORF Name | NTID | AAID | NT Length | AA Length | Score | Probability |
|---|---|---|---|---|---|---|
| 208255_c1_447 | 3891 | 8063 | 223 | 672 | 945 | 6.4e-95 |
| Protein name | | | | | Locus Name | Acc# |
| cytosine deaminase:uracil | | | | | gp:SYNSUIC | L37432 |

Description
Expression vector pZEO-SG1, cytosine deaminase:uracilphosphoribosyltransferase fusion protein (codA:upp) gene, completecds; (thymidine kinase):(phleomycin/zeocin binding protein) fusionprotein (tk:Sh ble) gene, complete cds.

| ORF Name | NTID | AAID | NT Length | AA Length | Score | Probability |
|---|---|---|---|---|---|---|
| 20892202_c3_688 | 3892 | 8064 | 122 | 369 | | |
| Protein name | | | | | Locus Name | Acc# |

Description
NO-HIT

| ORF Name | NTID | AAID | NT Length | AA Length | Score | Probability |
|---|---|---|---|---|---|---|
| 2142177_c3_714 | 3893 | 8065 | 255 | 768 | 899 | 4.8e-90 |
| Protein name | | | | | Locus Name | Acc# |
| | | | | | gp:STY224978 | AJ224978 |

Description: Salmonella typhimurium, Salmonella Pathogenicity Island 2 (SPI2) genes, ttr gene cluster.

| ORF Name | NTID | AAID | NT Length | AA Length | Score | Probability |
|---|---|---|---|---|---|---|
| 21484436_c3_653 | 3894 | 8066 | 66 | 201 | | |
| Protein name | | | | | Locus Name | Acc# |

Description: NO-HIT

| ORF Name | NTID | AAID | NT Length | AA Length | Score | Probability |
|---|---|---|---|---|---|---|
| 21912805_c2_607 | 3895 | 8067 | 329 | 990 | 125 | 2.4e-07 |
| Protein name | | | | | Locus Name | Acc# |
| hypothetical protein | | | | | pir:G75435 | G75435 |

Description:

| ORF Name | NTID | AAID | NT Length | AA Length | Score | Probability |
|---|---|---|---|---|---|---|
| 2204183_c2_566 | 3896 | 8068 | 264 | 795 | 985 | 3.7e-99 |
| Protein name | | | | | Locus Name | Acc# |
| | | | | | sp:YFGE_ECOLI | P76570:P76 |

Description: HYPOTHETICAL 28.4 KD PROTEIN IN FOCB-URAA INTERGENIC REGION

| ORF Name | NTID | AAID | NT Length | AA Length | Score | Probability |
|---|---|---|---|---|---|---|
| 2220002_c1_428 | 3897 | 8069 | 304 | 915 | 644 | 5.0e-63 |
| Protein name | | | | | Locus Name | Acc# |
| hypothetical protein b0867 precursor | | | | | pir:C64825 | C64825 |

Description:

| ORF Name | NTID | AAID | NT Length | AA Length | Score | Probability |
|---|---|---|---|---|---|---|
| 22353436_c3_654 | 3898 | 8070 | 159 | 480 | 185 | 2.2e-14 |
| Protein name | | | | | Locus Name | Acc# |
| | | | | | sp:YEBF_ECOLI | P33219 |

Description
PRECURSOR (ORF122)

| ORF Name | NTID | AAID | NT Length | AA Length | Score | Probability |
|---|---|---|---|---|---|---|
| 2243806_c3_676 | 3899 | 8071 | 160 | 483 | 470 | 1.4e-44 |
| Protein name | | | | | Locus Name | Acc# |
| transposase homolog A | | | | | gp:HPU95957 | U95957 |

Description
Helicobacter pylori insertion sequence IS606 transposase homologs A(tnpA) and B (tnpB) genes, complete cds.

| ORF Name | NTID | AAID | NT Length | AA Length | Score | Probability |
|---|---|---|---|---|---|---|
| 22478380_f1_99 | 3900 | 8072 | 149 | 450 | 268 | 3.5e-23 |
| Protein name | | | | | Locus Name | Acc# |
| | | | | | sp:FLIO_SALTY | P54699 |

Description
FLAGELLAR PROTEIN FLIO

| ORF Name | NTID | AAID | NT Length | AA Length | Score | Probability |
|---|---|---|---|---|---|---|
| 22532962_c3_627 | 3901 | 8073 | 551 | 1656 | 1183 | 3.8e-120 |
| Protein name | | | | | Locus Name | Acc# |
| | | | | | sp:FLGK_ECOLI | P33235:P77 |

Description
FLAGELLAR HOOK-ASSOCIATED PROTEIN 1 (HAP1)

| ORF Name | NTID | AAID | NT Length | AA Length | Score | Probability |
|---|---|---|---|---|---|---|
| 22688537_c3_715 | 3902 | 8074 | 184 | 555 | 719 | 5.7e-71 |
| Protein name | | | | | Locus Name | Acc# |
| CDPdiacylglycerol--glycerol-3-phosphate 3-phosphatidyltransferase,:glycerophosphate | | | | | pir:XNECPG | E64954:A25 |

Description

| ORF Name | NTID | AAID | NT Length | AA Length | Score | Probability |
|---|---|---|---|---|---|---|
| 22709376_c3_725 | 3903 | 8075 | 273 | 822 | 579 | 3.9e-56 |
| Protein name | | | | | Locus Name | Acc# |
| | | | | | sp:YEAF_ECOLI | P77486:007 |

Description
HYPOTHETICAL 27.8 KD PROTEIN IN GAPA-RND INTERGENIC REGION PRECURSOR

| ORF Name | NTID | AAID | NT Length | AA Length | Score | Probability |
|---|---|---|---|---|---|---|
| 22852250_c2_571 | 3904 | 8076 | 129 | 390 | 513 | 3.8e-49 |
| Protein name | | | | | Locus Name | Acc# |
| | | | | | sp:YBAN_ECOLI | P45808:P77 |

Description
HYPOTHETICAL 14.8 KD PROTEIN IN PRIC-APT INTERGENIC REGION

| ORF Name | NTID | AAID | NT Length | AA Length | Score | Probability |
|---|---|---|---|---|---|---|
| 22869010_c3_728 | 3905 | 8077 | 98 | 297 | 296 | 3.8e-26 |
| Protein name | | | | | Locus Name | Acc# |
| | | | | | sp:YEAC_ECOLI | P76231 |

Description
HYPOTHETICAL 10.3 KD PROTEIN IN ANSA-GAPA INTERGENIC REGION

| ORF Name | NTID | AAID | NT Length | AA Length | Score | Probability |
|---|---|---|---|---|---|---|
| 23469818_c3_689 | 3906 | 8078 | 166 | 501 | 73 | 0.032 |
| Protein name | | | | | Locus Name | Acc# |
| | | | | | gp:MMIGVH13 | X02466 |

Description
Mouse germline immunoglobulin V(H)II gene H17.

| ORF Name | NTID | AAID | NT Length | AA Length | Score | Probability |
|---|---|---|---|---|---|---|
| 23476550_f2_172 | 3907 | 8079 | 83 | 252 | 80 | 0.0029 |
| Protein name | | | | | Locus Name | Acc# |
| NADH dehydrogenase subunit 1 | | | | | gp:LFAJ5427 | AJ005427 |

Description
Lysiphlebus fabarum mitochondrial DNA for tRNA-Ser(UCN) gene and partial cytb, ND1 genes.

| ORF_Name | NTID | AAID | NT Length | AA Length | Score | Probability |
|---|---|---|---|---|---|---|
| 23491311_f2_218 | 3908 | 8080 | 79 | 240 | | |
| Protein name | | | | | Locus Name | Acc# |

Description
NO-HIT

| ORF_Name | NTID | AAID | NT Length | AA Length | Score | Probability |
|---|---|---|---|---|---|---|
| 23572127_f2_212 | 3909 | 8081 | 148 | 447 | 193 | 3.1e-15 |
| Protein name | | | | | Locus Name | Acc# |
| | | | | | sp:UP03_ECOLI | P37903:P76 |

Description
UNKNOWN PROTEIN 2D_000B3L FROM 2D-PAGE

| ORF_Name | NTID | AAID | NT Length | AA Length | Score | Probability |
|---|---|---|---|---|---|---|
| 23597675_f3_292 | 3910 | 8082 | 118 | 357 | 265 | 7.3e-23 |
| Protein name | | | | | Locus Name | Acc# |
| cICK0721Q.5 (polypeptide from patented cDNA | | | | | gp:HSICK721Q | AL021366 |

Description
Homo sapiens DNA sequence from cosmid ICK0721Q on chromosome 6.Contains a 60S Ribosomal Protein L35A LIKE pseudogene, a genecoding for a 60S Ribosomal Protein L12 LIKE protein in an intron ofthe HSET gene coding for a Kinesin related protein, the PHF1 (PHF2)gene coding for alternative splice products PHD finger proteins 1and 2, the gene coding for five different alternatively

| ORF_Name | NTID | AAID | NT Length | AA Length | Score | Probability |
|---|---|---|---|---|---|---|
| 23625900_f3_267 | 3911 | 8083 | 340 | 1023 | 1533 | 3.1e-157 |
| Protein name | | | | | Locus Name | Acc# |
| glyceraldehyde-3-phosphate dehydrogenase, A | | | | | pir:DEECG3 | A25209:C64 |

Description

| ORF_Name | NTID | AAID | NT Length | AA Length | Score | Probability |
|---|---|---|---|---|---|---|
| 23635887_f2_127 | 3912 | 8084 | 140 | 423 | 129 | 1.9e-08 |
| Protein name | | | | | Locus Name | Acc# |
| conserved hypothetical protein | | | | | pir:G75273 | G75273 |

Description

| ORF Name | NTID | AAID | NT Length | AA Length | Score | Probability |
|---|---|---|---|---|---|---|
| 23649140_f2_116 | 3913 | 8085 | 622 | 1869 | 1667 | 2.0e-171 |
| Protein name | | | | | Locus Name | Acc# |
| proteinase IV, | | | | | pir:PRECT4 | F64936:A24 |

Description proteinase IV,

| ORF Name | NTID | AAID | NT Length | AA Length | Score | Probability |
|---|---|---|---|---|---|---|
| 23652177_f2_184 | 3914 | 8086 | 122 | 369 | 357 | 1.3e-32 |
| Protein name | | | | | Locus Name | Acc# |
| | | | | | sp:YFGD_ECOLI | P76569:P76 |

Description

HYPOTHETICAL 13.4 KD PROTEIN IN FOCB-URAA INTERGENIC REGION

| ORF Name | NTID | AAID | NT Length | AA Length | Score | Probability |
|---|---|---|---|---|---|---|
| 23679592_c2_602 | 3915 | 8087 | 125 | 378 | 102 | 6.1e-05 |
| Protein name | | | | | Locus Name | Acc# |
| lysin | | | | | gp:A22375 | A22375 |

Description

Bacteriophage LM4 lysin gene from patent EP0510907.

| ORF Name | NTID | AAID | NT Length | AA Length | Score | Probability |
|---|---|---|---|---|---|---|
| 23679677_c1_441 | 3916 | 8088 | 120 | 363 | | |
| Protein name | | | | | Locus Name | Acc# |

Description

NO-HIT

| ORF Name | NTID | AAID | NT Length | AA Length | Score | Probability |
|---|---|---|---|---|---|---|
| 23703125_c1_415 | 3917 | 8089 | 391 | 1176 | | |
| Protein name | | | | | Locus Name | Acc# |

Description

NO-HIT

876

| ORF Name | NTID | AAID | NT Length | AA Length | Score | Probability |
|---|---|---|---|---|---|---|
| 23714013_c2_547 | 3918 | 8090 | 65 | 198 | 180 | 7.4e-14 |
| Protein name | | | | | Locus Name | Acc# |
| | | | | | sp:YOAH_ECOLI | P76260 |

Description: HYPOTHETICAL 6.6 KD PROTEIN IN FADD-PABB INTERGENIC REGION

| ORF Name | NTID | AAID | NT Length | AA Length | Score | Probability |
|---|---|---|---|---|---|---|
| 23922051_f1_15 | 3919 | 8091 | 112 | 339 | 91 | 0.00086 |
| Protein name | | | | | Locus Name | Acc# |
| hypothetical protein | | | | | gp:HS69M211 | AL117235 |

Description: Novel human gene mapping to chomosome 1.

| ORF Name | NTID | AAID | NT Length | AA Length | Score | Probability |
|---|---|---|---|---|---|---|
| 23928787_c2_513 | 3920 | 8092 | 148 | 447 | 266 | 5.7e-23 |
| Protein name | | | | | Locus Name | Acc# |
| | | | | | sp:ATMC_SALTY | P22037 |

Description: MG(2+) TRANSPORT ATPASE PROTEIN C

| ORF Name | NTID | AAID | NT Length | AA Length | Score | Probability |
|---|---|---|---|---|---|---|
| 24016077_f2_198 | 3921 | 8093 | 226 | 681 | | |
| Protein name | | | | | Locus Name | Acc# |

Description: NO-HIT

| ORF Name | NTID | AAID | NT Length | AA Length | Score | Probability |
|---|---|---|---|---|---|---|
| 24017503_c2_565 | 3922 | 8094 | 414 | 1245 | 541 | 4.1e-52 |
| Protein name | | | | | Locus Name | Acc# |
| | | | | | sp:YBDG_ECOLI | P39455:P77 |

Description: HYPOTHETICAL 46.6 KD PROTEIN IN PHEP-NFNB INTERGENIC REGION

| ORF Name | NTID | AAID | NT Length | AA Length | Score | Probability |
|---|---|---|---|---|---|---|
| 24219180_c1_400 | 3923 | 8095 | 427 | 1284 | 1946 | 5.4e-201 |
| Protein name | | | | | Locus Name | Acc# |
| FloA | | | | | gp:PMU82214 | U82214 |

Description: Proteus mirabilis flagella rod protein FlgD (flgD) gene, partial cds, flagella rod proteins FlgC (flgC) and FlgB (flgB), flagella assembly protein FlgA (flgA), anti-sigma factor FlgM (flgM), facilitator of flagella filament assembly FlgN (flgN) and FloA(floA) genes, complete cds.

| ORF Name | NTID | AAID | NT Length | AA Length | Score | Probability |
|---|---|---|---|---|---|---|
| 24220033_c3_677 | 3924 | 8096 | 760 | 2283 | 373 | 2.1e-62 |
| Protein name | | | | | Locus Name | Acc# |
| | | | | | sp:YC17_HAEIN | P45114 |

Description: PROBABLE TONB-DEPENDENT RECEPTOR HI1217 PRECURSOR

| ORF Name | NTID | AAID | NT Length | AA Length | Score | Probability |
|---|---|---|---|---|---|---|
| 24225302_f1_106 | 3925 | 8097 | 151 | 456 | 739 | 4.3e-73 |
| Protein name | | | | | Locus Name | Acc# |
| | | | | | sp:FLGN_PROMI | P96975 |

Description: FLAGELLA SYNTHESIS PROTEIN FLGN

| ORF Name | NTID | AAID | NT Length | AA Length | Score | Probability |
|---|---|---|---|---|---|---|
| 24334540_f2_243 | 3926 | 8098 | 106 | 321 | 470 | 1.4e-44 |
| Protein name | | | | | Locus Name | Acc# |
| | | | | | sp:FLGM_PROMI | P96974 |

Description: NEGATIVE REGULATOR OF FLAGELLIN SYNTHESIS (ANTI-SIGMA-28 FACTOR)

| ORF Name | NTID | AAID | NT Length | AA Length | Score | Probability |
|---|---|---|---|---|---|---|
| 24397015_f1_84 | 3927 | 8099 | 66 | 201 | | |
| Protein name | | | | | Locus Name | Acc# |

Description: NO-HIT

| ORF Name | NTID | AAID | NT Length | AA Length | Score | Probability |
|---|---|---|---|---|---|---|
| 24408402_c1_493 | 3928 | 8100 | 352 | 1059 | 370 | 5.4e-34 |
| Protein name | | | | | Locus Name | Acc# |
| | | | | | sp:PTER_MOUSE | Q60866 |

Description
PROTEIN)

| ORF Name | NTID | AAID | NT Length | AA Length | Score | Probability |
|---|---|---|---|---|---|---|
| 24417875_c3_712 | 3929 | 8101 | 386 | 1161 | 184 | 2.3e-22 |
| Protein name | | | | | Locus Name | Acc# |
| hypothetical protein | | | | | pir:H75628 | H75628 |

Description

| ORF Name | NTID | AAID | NT Length | AA Length | Score | Probability |
|---|---|---|---|---|---|---|
| 24495157_c2_533 | 3930 | 8102 | 200 | 603 | 761 | 2.0e-75 |
| Protein name | | | | | Locus Name | Acc# |
| FliZ protein | | | | | gp:XNE131736 | AJ131736 |

Description
Xenorhabdus nematophilus partial fliC gene, fliA, fliZ genes and partial putA gene.

| ORF Name | NTID | AAID | NT Length | AA Length | Score | Probability |
|---|---|---|---|---|---|---|
| 24508436_c1_479 | 3931 | 8103 | 331 | 996 | | |
| Protein name | | | | | Locus Name | Acc# |

Description
NO-HIT

| ORF Name | NTID | AAID | NT Length | AA Length | Score | Probability |
|---|---|---|---|---|---|---|
| 24616067_c3_733 | 3932 | 8104 | 79 | 240 | | |
| Protein name | | | | | Locus Name | Acc# |

Description
NO-HIT

| ORF Name | NTID | AAID | NT Length | AA Length | Score | Probability |
|---|---|---|---|---|---|---|
| 24640932_c3_718 | 3933 | 8105 | 410 | 1233 | 1268 | 3.8e-129 |
| Protein name | | | | | Locus Name | Acc# |
| | | | | | sp:YDEA_ECOLI | P31122:P77 |

Description: HYPOTHETICAL 42.5 KD PROTEIN IN UXAB-MARR INTERGENIC REGION

| ORF Name | NTID | AAID | NT Length | AA Length | Score | Probability |
|---|---|---|---|---|---|---|
| 24642202_c1_483 | 3934 | 8106 | 100 | 303 | | |
| Protein name | | | | | Locus Name | Acc# |

Description: NO-HIT

| ORF Name | NTID | AAID | NT Length | AA Length | Score | Probability |
|---|---|---|---|---|---|---|
| 24647187_c1_396 | 3935 | 8107 | 298 | 897 | 910 | 3.3e-91 |
| Protein name | | | | | Locus Name | Acc# |
| | | | | | sp:CHER_SALTY | P07801 |

Description: CHEMOTAXIS PROTEIN METHYLTRANSFERASE,

| ORF Name | NTID | AAID | NT Length | AA Length | Score | Probability |
|---|---|---|---|---|---|---|
| 24787827_f1_87 | 3936 | 8108 | 475 | 1428 | 1412 | 2.1e-144 |
| Protein name | | | | | Locus Name | Acc# |
| | | | | | sp:PABB_SALTY | P12680 |

Description: PARA-AMINOBENZOATE SYNTHASE COMPONENT I, (ADC SYNTHASE)

| ORF Name | NTID | AAID | NT Length | AA Length | Score | Probability |
|---|---|---|---|---|---|---|
| 24815675_c2_580 | 3937 | 8109 | 553 | 1662 | 2394 | 1.8e-248 |
| Protein name | | | | | Locus Name | Acc# |
| | | | | | sp:GUAA_ECOLI | P04079 |

Description: AMIDOTRANSFERASE) (GMP SYNTHETASE)

| ORF Name | NTID | AAID | NT Length | AA Length | Score | Probability |
|---|---|---|---|---|---|---|
| 24901515_c2_522 | 3938 | 8110 | 265 | 798 | 1108 | 3.4e-112 |
| Protein name | | | | | Locus Name | Acc# |
| | | | | | sp:FLGG_SALTY | P16439 |

Description

FLAGELLAR BASAL-BODY ROD PROTEIN FLGG (DISTAL ROD PROTEIN)

| ORF Name | NTID | AAID | NT Length | AA Length | Score | Probability |
|---|---|---|---|---|---|---|
| 25469790_f2_183 | 3939 | 8111 | 211 | 636 | 559 | 5.1e-54 |
| Protein name | | | | | Locus Name | Acc# |
| gcvR protein | | | | | pir:F65023 | F65023:A49 |

Description

| ORF Name | NTID | AAID | NT Length | AA Length | Score | Probability |
|---|---|---|---|---|---|---|
| 25509678_f3_344 | 3940 | 8112 | 350 | 1053 | 1592 | 1.7e-163 |
| Protein name | | | | | Locus Name | Acc# |
| hypothetical protein b2097 | | | | | pir:H64976 | H64976 |

Description

| ORF Name | NTID | AAID | NT Length | AA Length | Score | Probability |
|---|---|---|---|---|---|---|
| 25517667_c1_397 | 3941 | 8113 | 164 | 495 | 544 | 2.0e-52 |
| Protein name | | | | | Locus Name | Acc# |
| chemotaxis protein cheY | | | | | pir:QRECCY | E25195:A28 |

Description

| ORF Name | NTID | AAID | NT Length | AA Length | Score | Probability |
|---|---|---|---|---|---|---|
| 25579717_f3_363 | 3942 | 8114 | 234 | 705 | 76 | 0.030 |
| Protein name | | | | | Locus Name | Acc# |
| | | | | | gp:PSMERTRP | Y09210 |

Description

Pseudomonas sp. merT, merR and partial merP genes.

| ORF Name | NTID | AAID | NT Length | AA Length | Score | Probability |
|---|---|---|---|---|---|---|
| 25634677_c2_597 | 3943 | 8115 | 182 | 549 | | |
| Protein name | | | | | Locus Name | Acc# |

Description
NO-HIT

| ORF Name | NTID | AAID | NT Length | AA Length | Score | Probability |
|---|---|---|---|---|---|---|
| 25806587_c1_401 | 3944 | 8116 | 138 | 417 | 667 | 1.8e-65 |
| Protein name | | | | | Locus Name | Acc# |
| FlgB | | | | | gp:PMU82214 | U82214 |

Description
Proteus mirabilis flagella rod protein FlgD (flgD) gene, partialcds, flagella rod proteins FlgC (flgC) and FlgB (flgB), flagellaassembly protein FlgA (flgA), anti-sigma factor FlgM (flgM),facilitator of flagella filament assembly FlgN (flgN) and FloA(floA) genes, complete cds.

| ORF Name | NTID | AAID | NT Length | AA Length | Score | Probability |
|---|---|---|---|---|---|---|
| 25830092_c3_695 | 3945 | 8117 | 74 | 225 | | |
| Protein name | | | | | Locus Name | Acc# |

Description
NO-HIT

| ORF Name | NTID | AAID | NT Length | AA Length | Score | Probability |
|---|---|---|---|---|---|---|
| 25877327_c3_617 | 3946 | 8118 | 91 | 276 | 80 | 0.011 |
| Protein name | | | | | Locus Name | Acc# |
| | | | | | sp:ATMC_SALTY | P22037 |

Description
MG(2+) TRANSPORT ATPASE PROTEIN C

| ORF Name | NTID | AAID | NT Length | AA Length | Score | Probability |
|---|---|---|---|---|---|---|
| 259777_c1_407 | 3947 | 8119 | 315 | 948 | 675 | 2.6e-66 |
| Protein name | | | | | Locus Name | Acc# |
| | | | | | sp:FLGL_SALTY | P16326 |

Description
PROTEIN)

| ORF_Name | NTID | AAID | NT Length | AA Length | Score | Probability |
|---|---|---|---|---|---|---|
| 26205087_f2_186 | 3948 | 8120 | 452 | 1359 | 1031 | 4.9e-104 |
| Protein name | | | | | Locus Name | Acc# |
| | | | | | sp:XAPB_ECOLI | P45562:P77 |

Description: XANTHOSINE PERMEASE (XANTHOSINE TRANSPORTER)

| ORF_Name | NTID | AAID | NT Length | AA Length | Score | Probability |
|---|---|---|---|---|---|---|
| 26259678_c2_590 | 3949 | 8121 | 495 | 1488 | 160 | 2.3e-08 |
| Protein name | | | | | Locus Name | Acc# |
| | | | | | sp:PACB_BPP1 | P27753 |

Description: TERMINASE B PROTEIN (PACASE B PROTEIN) (DNA PACKAGING B PROTEIN)

| ORF_Name | NTID | AAID | NT Length | AA Length | Score | Probability |
|---|---|---|---|---|---|---|
| 26282550_c1_500 | 3950 | 8122 | 153 | 462 | | |
| Protein name | | | | | Locus Name | Acc# |

Description: NO-HIT

| ORF_Name | NTID | AAID | NT Length | AA Length | Score | Probability |
|---|---|---|---|---|---|---|
| 26304625_f3_291 | 3951 | 8123 | 73 | 222 | | |
| Protein name | | | | | Locus Name | Acc# |

Description: NO-HIT

| ORF_Name | NTID | AAID | NT Length | AA Length | Score | Probability |
|---|---|---|---|---|---|---|
| 26304702_c1_491 | 3952 | 8124 | 406 | 1221 | 927 | 5.1e-93 |
| Protein name | | | | | Locus Name | Acc# |
| | | | | | gp:STY224978 | AJ224978 |

Description: Salmonella typhimurium, Salmonella Pathogenicity Island 2 (SPI2) genes, ttr gene cluster.

| ORF Name | NTID | AAID | NT Length | AA Length | Score | Probability |
|---|---|---|---|---|---|---|
| 26462817_c1_478 | 3953 | 8125 | 231 | 696 | 95 | 0.00023 |
| Protein name | | | | | Locus Name | Acc# |
| | | | | | sp:TRI7_HUMAN | Q15651 |

Description
THYROID RECEPTOR INTERACTING PROTEIN 7 (TRIP7) (FRAGMENT)

| ORF Name | NTID | AAID | NT Length | AA Length | Score | Probability |
|---|---|---|---|---|---|---|
| 26563750_c3_691 | 3954 | 8126 | 221 | 666 | | |
| Protein name | | | | | Locus Name | Acc# |

Description
NO-HIT

| ORF Name | NTID | AAID | NT Length | AA Length | Score | Probability |
|---|---|---|---|---|---|---|
| 26567837_c2_557 | 3955 | 8127 | 120 | 363 | | |
| Protein name | | | | | Locus Name | Acc# |

Description
NO-HIT

| ORF Name | NTID | AAID | NT Length | AA Length | Score | Probability |
|---|---|---|---|---|---|---|
| 26604053_c3_620 | 3956 | 8128 | 741 | 2226 | 1538 | 1.9e-226 |
| Protein name | | | | | Locus Name | Acc# |
| | | | | | sp:CHEA_SALTY | P09384 |

Description
CHEMOTAXIS PROTEIN CHEA,

| ORF Name | NTID | AAID | NT Length | AA Length | Score | Probability |
|---|---|---|---|---|---|---|
| 26671910_f1_96 | 3957 | 8129 | 477 | 1434 | 299 | 1.9e-28 |
| Protein name | | | | | Locus Name | Acc# |
| | | | | | sp:FLIK_ECOLI | P52614 |

Description
FLAGELLAR HOOK-LENGTH CONTROL PROTEIN

| ORF Name | NTID | AAID | NT Length | AA Length | Score | Probability |
|---|---|---|---|---|---|---|
| 26751442_f2_134 | 3958 | 8130 | 167 | 504 | | |

Protein name | | | | | Locus Name | Acc#

Description
NO-HIT

| ORF Name | NTID | AAID | NT Length | AA Length | Score | Probability |
|---|---|---|---|---|---|---|
| 26751941_c2_548 | 3959 | 8131 | 285 | 858 | 738 | 5.5e-73 |

Protein name | | | | | Locus Name | Acc#
| | | | | | sp:YAAJ_ECOLI | P30143

Description
HYPOTHETICAL 51.7 KD PROTEIN IN THRC-TALB INTERGENIC REGION (ORF8)

| ORF Name | NTID | AAID | NT Length | AA Length | Score | Probability |
|---|---|---|---|---|---|---|
| 26754636_c1_461 | 3960 | 8132 | 728 | 2187 | 2039 | 7.5e-211 |

Protein name | | | | | Locus Name | Acc#
| | | | | | sp:PTRB_ECOLI | P24555:P78

Description
PROTEASE II, (OLIGOPEPTIDASE B)

| ORF Name | NTID | AAID | NT Length | AA Length | Score | Probability |
|---|---|---|---|---|---|---|
| 26813250_c1_391 | 3961 | 8133 | 138 | 417 | 567 | 7.2e-55 |

Protein name | | | | | Locus Name | Acc#
flagella class I protein FlhD | | | | | gp:PMU96964 | U96964

Description
Proteus mirabilis flagella master operon flhDC: flagella class Iprotein FlhD (flhD) and flagella class I protein FlhC (flhC) genes, complete cds.

| ORF Name | NTID | AAID | NT Length | AA Length | Score | Probability |
|---|---|---|---|---|---|---|
| 281552_c1_488 | 3962 | 8134 | 358 | 1077 | 176 | 2.1e-15 |

Protein name | | | | | Locus Name | Acc#
hypothetical protein SCI51.04 | | | | | pir:T36867 | T36867

Description

| ORF Name | NTID | AAID | NT Length | AA Length | Score | Probability |
|---|---|---|---|---|---|---|
| 2816927_c2_606 | 3963 | 8135 | 258 | 777 | 186 | 3.1e-23 |
| Protein name | | | | | Locus Name | Acc# |
| hypothetical protein | | | | | pir:B75629 | B75629 |

Description

| ORF Name | NTID | AAID | NT Length | AA Length | Score | Probability |
|---|---|---|---|---|---|---|
| 2847036_c1_502 | 3964 | 8136 | 117 | 354 | 90 | 0.00026 |
| Protein name | | | | | Locus Name | Acc# |
| | | | | | sp:YDBJ_ECOLI | P52646 |

Description
HYPOTHETICAL 5.0 KD PROTEIN IN TRKG-HSLJ INTERGENIC REGION

| ORF Name | NTID | AAID | NT Length | AA Length | Score | Probability |
|---|---|---|---|---|---|---|
| 2847217_f3_347 | 3965 | 8137 | 61 | 186 | | |
| Protein name | | | | | Locus Name | Acc# |

Description
NO-HIT

| ORF Name | NTID | AAID | NT Length | AA Length | Score | Probability |
|---|---|---|---|---|---|---|
| 2933562_c2_516 | 3966 | 8138 | 572 | 1719 | 1398 | 6.3e-143 |
| Protein name | | | | | Locus Name | Acc# |
| | | | | | sp:MCPS_ENTAE | P21822 |

Description
METHYL-ACCEPTING CHEMOTAXIS SERINE TRANSDUCER

| ORF Name | NTID | AAID | NT Length | AA Length | Score | Probability |
|---|---|---|---|---|---|---|
| 29398963_f1_45 | 3967 | 8139 | 192 | 579 | 143 | 6.2e-10 |
| Protein name | | | | | Locus Name | Acc# |
| hypothetical protein APE1508 | | | | | pir:E72631 | E72631 |

Description

| ORF Name | NTID | AAID | NT Length | AA Length | Score | Probability |
|---|---|---|---|---|---|---|
| 29406643_f3_269 | 3968 | 8140 | 61 | 186 | | |
| Protein name | | | | | Locus Name | Acc# |

Description
NO-HIT

| ORF Name | NTID | AAID | NT Length | AA Length | Score | Probability |
|---|---|---|---|---|---|---|
| 29454138_c3_711 | 3969 | 8141 | 150 | 453 | 99 | 0.00014 |
| Protein name | | | | | Locus Name | Acc# |
| hypothetical protein aq_142 | | | | | pir:F70313 | F70313 |

Description

| ORF Name | NTID | AAID | NT Length | AA Length | Score | Probability |
|---|---|---|---|---|---|---|
| 29485807_f2_211 | 3970 | 8142 | 218 | 657 | 612 | 1.2e-59 |
| Protein name | | | | | Locus Name | Acc# |
| | | | | | sp:YEBN_ECOLI | P76264:O07 |

Description
HYPOTHETICAL 22.1 KD PROTEIN IN MANZ-CSPC INTERGENIC REGION

| ORF Name | NTID | AAID | NT Length | AA Length | Score | Probability |
|---|---|---|---|---|---|---|
| 29533280_f3_341 | 3971 | 8143 | 1051 | 3156 | 3990 | 0.0 |
| Protein name | | | | | Locus Name | Acc# |
| | | | | | sp:YEGN_ECOLI | P76398:O08 |

Description
HYPOTHETICAL 112.1 KD PROTEIN IN ALKA-BAES INTERGENIC REGION

| ORF Name | NTID | AAID | NT Length | AA Length | Score | Probability |
|---|---|---|---|---|---|---|
| 29797761_f2_136 | 3972 | 8144 | 67 | 204 | | |
| Protein name | | | | | Locus Name | Acc# |

Description
NO-HIT

| ORF_Name | NTID | AAID | NT Length | AA Length | Score | Probability |
|---|---|---|---|---|---|---|
| 29844001_f1_100 | 3973 | 8145 | 273 | 822 | 814 | 4.9e-81 |
| Protein name | | | | | Locus Name | Acc# |
| | | | | | sp:FLIR_ERWCA | P34202 |

Description
MOPE)

| ORF_Name | NTID | AAID | NT Length | AA Length | Score | Probability |
|---|---|---|---|---|---|---|
| 30366301_f3_335 | 3974 | 8146 | 496 | 1491 | 1406 | 9.0e-144 |
| Protein name | | | | | Locus Name | Acc# |
| hypothetical protein b2494 | | | | | pir:E65025 | E65025 |

Description

| ORF_Name | NTID | AAID | NT Length | AA Length | Score | Probability |
|---|---|---|---|---|---|---|
| 30645632_c1_399 | 3975 | 8147 | 712 | 2139 | 3471 | 0.0 |
| Protein name | | | | | Locus Name | Acc# |
| | | | | | sp:FLHA_PROMI | Q51910 |

Description
FLAGELLAR BIOSYNTHESIS PROTEIN FLHA

| ORF_Name | NTID | AAID | NT Length | AA Length | Score | Probability |
|---|---|---|---|---|---|---|
| 31437_c3_618 | 3976 | 8148 | 65 | 198 | | |
| Protein name | | | | | Locus Name | Acc# |

Description
NO-HIT

| ORF_Name | NTID | AAID | NT Length | AA Length | Score | Probability |
|---|---|---|---|---|---|---|
| 31687665_c2_591 | 3977 | 8149 | 115 | 348 | | |
| Protein name | | | | | Locus Name | Acc# |

Description
NO-HIT

| ORF Name | NTID | AAID | NT Length | AA Length | Score | Probability |
|---|---|---|---|---|---|---|
| 31725635_f3_365 | 3978 | 8150 | 584 | 1755 | 1646 | 3.3e-169 |
| Protein name | | | | | Locus Name | Acc# |
| | | | | | sp:FLIF_SALTY | P15928 |

Description
FLAGELLAR M-RING PROTEIN

| ORF Name | NTID | AAID | NT Length | AA Length | Score | Probability |
|---|---|---|---|---|---|---|
| 3174052_f2_117 | 3979 | 8151 | 63 | 192 | | |
| Protein name | | | | | Locus Name | Acc# |

Description
NO-HIT

| ORF Name | NTID | AAID | NT Length | AA Length | Score | Probability |
|---|---|---|---|---|---|---|
| 32069078_c2_605 | 3980 | 8152 | 184 | 555 | | |
| Protein name | | | | | Locus Name | Acc# |

Description
NO-HIT

| ORF Name | NTID | AAID | NT Length | AA Length | Score | Probability |
|---|---|---|---|---|---|---|
| 32226586_c3_723 | 3981 | 8153 | 249 | 750 | 949 | 2.4e-95 |
| Protein name | | | | | Locus Name | Acc# |
| DNA-binding protein, fatty acid/fatty acyl-responsive | | | | | pir:H64864 | H64864:S01 |

Description

| ORF Name | NTID | AAID | NT Length | AA Length | Score | Probability |
|---|---|---|---|---|---|---|
| 32235706_c3_686 | 3982 | 8154 | 142 | 429 | 150 | 1.1e-10 |
| Protein name | | | | | Locus Name | Acc# |
| hypothetical protein 48 | | | | | pir:T00182 | T00182 |

Description

| ORF Name | NTID | AAID | NT Length | AA Length | Score | Probability |
|---|---|---|---|---|---|---|
| 32289031_f3_315 | 3983 | 8155 | 130 | 393 | 69 | 0.045 |

| Protein name | | | | | Locus Name | Acc# |
|---|---|---|---|---|---|---|
| ORF 17 | | | | | gp:AF133242 | AF133242 |

Description: SVTS2 plectrovirus, complete genome.

| ORF Name | NTID | AAID | NT Length | AA Length | Score | Probability |
|---|---|---|---|---|---|---|
| 3257175_c1_471 | 3984 | 8156 | 289 | 870 | 200 | 3.7e-15 |

| Protein name | | | | | Locus Name | Acc# |
|---|---|---|---|---|---|---|
| | | | | | sp:YDAU_ECOLI | P76065 |

Description: HYPOTHETICAL 32.5 KD PROTEIN IN SIEB-TRKG INTERGENIC REGION

| ORF Name | NTID | AAID | NT Length | AA Length | Score | Probability |
|---|---|---|---|---|---|---|
| 32690932_f2_162 | 3985 | 8157 | 356 | 1071 | 642 | 1.7e-99 |

| Protein name | | | | | Locus Name | Acc# |
|---|---|---|---|---|---|---|
| hypothetical protein AAC26069.1 | | | | | pir:T03003 | T03003 |

Description:

| ORF Name | NTID | AAID | NT Length | AA Length | Score | Probability |
|---|---|---|---|---|---|---|
| 32805_f3_325 | 3986 | 8158 | 442 | 1329 | 1780 | 2.1e-183 |

| Protein name | | | | | Locus Name | Acc# |
|---|---|---|---|---|---|---|
| hypothetical protein b1432 | | | | | pir:C64895 | C64895 |

Description:

| ORF Name | NTID | AAID | NT Length | AA Length | Score | Probability |
|---|---|---|---|---|---|---|
| 33210875_c2_612 | 3987 | 8159 | 347 | 1044 | 532 | 3.7e-51 |

| Protein name | | | | | Locus Name | Acc# |
|---|---|---|---|---|---|---|
| | | | | | sp:YC48_HAEIN | P44136 |

Description: HYPOTHETICAL PROTEIN HI1248

| ORF Name | NTID | AAID | NT Length | AA Length | Score | Probability |
|---|---|---|---|---|---|---|
| 33241300_f2_194 | 3988 | 8160 | 217 | 654 | 707 | 1.1e-69 |
| Protein name | | | | | Locus Name | Acc# |
| 5'-phosphoribosylglycinamide transformylase | | | | | gp:STU68765 | U68765 |

Description

Salmonella typhimurium 5'-phosphoribosylglycinamide transformylase(purN) and 5'-phosphoribosyl-5-aminoimidazole synthetase (purI)genes, complete cds.

| ORF Name | NTID | AAID | NT Length | AA Length | Score | Probability |
|---|---|---|---|---|---|---|
| 33312887_c1_464 | 3989 | 8161 | 66 | 201 | | |
| Protein name | | | | | Locus Name | Acc# |

Description

NO-HIT

| ORF Name | NTID | AAID | NT Length | AA Length | Score | Probability |
|---|---|---|---|---|---|---|
| 33448792_c2_587 | 3990 | 8162 | 104 | 315 | 84 | 0.0063 |
| Protein name | | | | | Locus Name | Acc# |
| glutamine PRPP amidotransferase | | | | | pir:A69122 | A69122 |

Description

| ORF Name | NTID | AAID | NT Length | AA Length | Score | Probability |
|---|---|---|---|---|---|---|
| 33595187_c2_538 | 3991 | 8163 | 476 | 1431 | 1795 | 5.4e-185 |
| Protein name | | | | | Locus Name | Acc# |
| | | | | | sp:CYCA_ECOLI | P39312 |

Description

D-SERINE/D-ALANINE/GLYCINE TRANSPORTER

| ORF Name | NTID | AAID | NT Length | AA Length | Score | Probability |
|---|---|---|---|---|---|---|
| 33632876_f2_204 | 3992 | 8164 | 468 | 1407 | 2029 | 8.6e-210 |
| Protein name | | | | | Locus Name | Acc# |
| | | | | | sp:YEGQ_ECOLI | P76403:O08 |

Description

PUTATIVE PROTEASE YEGQ,

| ORF Name | NTID | AAID | NT Length | AA Length | Score | Probability |
|---|---|---|---|---|---|---|
| 33641066_f1_76 | 3993 | 8165 | 420 | 1263 | 1144 | 5.2e-116 |
| Protein name | | | | | Locus Name | Acc# |
| | | | | | sp:YEGM_ECOLI | P76397 |

Description: HYPOTHETICAL 44.5 KD PROTEIN IN ALKA-BAES INTERGENIC REGION PRECURSOR

| ORF Name | NTID | AAID | NT Length | AA Length | Score | Probability |
|---|---|---|---|---|---|---|
| 33708137_f3_260 | 3994 | 8166 | 167 | 504 | 666 | 2.3e-65 |
| Protein name | | | | | Locus Name | Acc# |
| | | | | | sp:PURU_ECOLI | P37051 |

Description: HYDROLASE)

| ORF Name | NTID | AAID | NT Length | AA Length | Score | Probability |
|---|---|---|---|---|---|---|
| 33866505_c2_520 | 3995 | 8167 | 64 | 195 | 46 | 0.034 |
| Protein name | | | | | Locus Name | Acc# |
| hypothetical protein F29A7.2 | | | | | pir:T31704 | T31704 |

Description:

| ORF Name | NTID | AAID | NT Length | AA Length | Score | Probability |
|---|---|---|---|---|---|---|
| 33881250_f3_277 | 3996 | 8168 | 190 | 573 | 492 | 6.4e-47 |
| Protein name | | | | | Locus Name | Acc# |
| Disulfide bond formation protein dsbB | | | | | gp:D90752 | D90752:AB0 |

Description: Escherichia coli genomic DNA. (26.3 - 26.7 min).

| ORF Name | NTID | AAID | NT Length | AA Length | Score | Probability |
|---|---|---|---|---|---|---|
| 34021938_f2_257 | 3997 | 8169 | 81 | 246 | | |
| Protein name | | | | | Locus Name | Acc# |

Description: NO-HIT

| ORF Name | NTID | AAID | NT Length | AA Length | Score | Probability |
|---|---|---|---|---|---|---|
| 34040877_c3_672 | 3998 | 8170 | 300 | 903 | 1135 | 4.7e-115 |
| Protein name | | | | | Locus Name | Acc# |
| | | | | | sp:DAPA_ECOLI | P05640:P78 |

Description
DIHYDRODIPICOLINATE SYNTHASE, (DHDPS)

| ORF Name | NTID | AAID | NT Length | AA Length | Score | Probability |
|---|---|---|---|---|---|---|
| 34098252_c2_596 | 3999 | 8171 | 828 | 2487 | | |
| Protein name | | | | | Locus Name | Acc# |

Description
NO-HIT

| ORF Name | NTID | AAID | NT Length | AA Length | Score | Probability |
|---|---|---|---|---|---|---|
| 34175917_c1_482 | 4000 | 8172 | 1034 | 3105 | 214 | 4.1e-16 |
| Protein name | | | | | Locus Name | Acc# |
| structural protein P5 | | | | | gp:AF155037 | AF155037 |

Description
Alteromonas phage, complete genome.

| ORF Name | NTID | AAID | NT Length | AA Length | Score | Probability |
|---|---|---|---|---|---|---|
| 34178188_f1_70 | 4001 | 8173 | 493 | 1482 | 812 | 7.9e-81 |
| Protein name | | | | | Locus Name | Acc# |
| | | | | | gp:AB033988 | AB033988 |

Description
Shewanella violacea gene for RpoN(sigma54), nitrogen reguratory IIAprotein, phosphocarrier protein NPR, hypothetical proteins, partialand complete cds.

| ORF Name | NTID | AAID | NT Length | AA Length | Score | Probability |
|---|---|---|---|---|---|---|
| 34182827_c3_658 | 4002 | 8174 | 466 | 1401 | 1594 | 1.1e-163 |
| Protein name | | | | | Locus Name | Acc# |
| | | | | | sp:PHEP_ECOLI | P24207:P77 |

Description
PHENYLALANINE-SPECIFIC PERMEASE

| ORF Name | NTID | AAID | NT Length | AA Length | Score | Probability |
|---|---|---|---|---|---|---|
| 34189040_c1_393 | 4003 | 8175 | 356 | 1071 | 825 | 3.3e-82 |
| Protein name | | | | | Locus Name | Acc# |
| | | | | | sp:MOTB_ECOLI | P09349 |

Description: CHEMOTAXIS MOTB PROTEIN (MOTILITY PROTEIN B)

| ORF Name | NTID | AAID | NT Length | AA Length | Score | Probability |
|---|---|---|---|---|---|---|
| 34240762_c2_589 | 4004 | 8176 | 125 | 378 | 203 | 2.7e-16 |
| Protein name | | | | | Locus Name | Acc# |
| protein gp46 | | | | | pir:T13133 | T13133 |

Description:

| ORF Name | NTID | AAID | NT Length | AA Length | Score | Probability |
|---|---|---|---|---|---|---|
| 34413442_f2_225 | 4005 | 8177 | 334 | 1005 | 1336 | 2.3e-136 |
| Protein name | | | | | Locus Name | Acc# |
| | | | | | sp:FLIG_SALTY | P15933 |

Description: FLAGELLAR MOTOR SWITCH PROTEIN FLIG

| ORF Name | NTID | AAID | NT Length | AA Length | Score | Probability |
|---|---|---|---|---|---|---|
| 34569801_f2_229 | 4006 | 8178 | 95 | 288 | 343 | 4.0e-31 |
| Protein name | | | | | Locus Name | Acc# |
| | | | | | sp:FLIQ_ECOLI | P33134 |

Description: FLAGELLAR BIOSYNTHETIC PROTEIN FLIQ

| ORF Name | NTID | AAID | NT Length | AA Length | Score | Probability |
|---|---|---|---|---|---|---|
| 34609627_c1_505 | 4007 | 8179 | 440 | 1323 | 1575 | 1.1e-161 |
| Protein name | | | | | Locus Name | Acc# |
| | | | | | sp:DADA_ECOLI | P29011 |

Description: D-AMINO ACID DEHYDROGENASE SMALL SUBUNIT,

| ORF Name | NTID | AAID | NT Length | AA Length | Score | Probability |
|---|---|---|---|---|---|---|
| 34634717_f2_164 | 4008 | 8180 | 217 | 654 | 194 | 2.4e-15 |
| Protein name | | | | | Locus Name | Acc# |
| | | | | | sp:MTMU_MYCSP | P43641 |

Description
METHYLTRANSFERASE MUNI) (M.MUNI)

| ORF Name | NTID | AAID | NT Length | AA Length | Score | Probability |
|---|---|---|---|---|---|---|
| 35314675_c2_586 | 4009 | 8181 | 104 | 315 | | |
| Protein name | | | | | Locus Name | Acc# |

Description
NO-HIT

| ORF Name | NTID | AAID | NT Length | AA Length | Score | Probability |
|---|---|---|---|---|---|---|
| 35345275_c1_402 | 4010 | 8182 | 412 | 1239 | 1132 | 9.7e-115 |
| Protein name | | | | | Locus Name | Acc# |
| flagellar hook protein flgE | | | | | pir:S10365 | S10365:S15 |

Description

| ORF Name | NTID | AAID | NT Length | AA Length | Score | Probability |
|---|---|---|---|---|---|---|
| 35351050_c1_496 | 4011 | 8183 | 208 | 627 | 433 | 1.1e-40 |
| Protein name | | | | | Locus Name | Acc# |
| drgA protein:protein slr1719:protein slr1719 | | | | | pir:S75047 | S75047 |

Description

| ORF Name | NTID | AAID | NT Length | AA Length | Score | Probability |
|---|---|---|---|---|---|---|
| 35360837_c3_624 | 4012 | 8184 | 146 | 441 | 673 | 4.2e-66 |
| Protein name | | | | | Locus Name | Acc# |
| FlgC | | | | | gp:PMU82214 | U82214 |

Description
Proteus mirabilis flagella rod protein FlgD (flgD) gene, partialcds, flagella rod proteins FlgC (flgC) and FlgB (flgB), flagellaassembly protein FlgA (flgA), anti-sigma factor FlgM (flgM),facilitator of flagella filament assembly FlgN (flgN) and FloA(floA) genes, complete cds.

| ORF Name | NTID | AAID | NT Length | AA Length | Score | Probability |
|---|---|---|---|---|---|---|
| 35626462_f1_54 | 4013 | 8185 | 105 | 318 | 100 | 2.2e-05 |
| Protein name | | | | | Locus Name | Acc# |
| hypothetical protein APE0395 | | | | | pir:B72732 | B72732 |
| Description | | | | | | |

| ORF Name | NTID | AAID | NT Length | AA Length | Score | Probability |
|---|---|---|---|---|---|---|
| 35657503_c3_685 | 4014 | 8186 | 252 | 759 | 664 | 3.8e-65 |
| Protein name | | | | | Locus Name | Acc# |
| dnaC protein homolog | | | | | pir:T03011 | T03011 |
| Description | | | | | | |

| ORF Name | NTID | AAID | NT Length | AA Length | Score | Probability |
|---|---|---|---|---|---|---|
| 35944090_c1_434 | 4015 | 8187 | 64 | 195 | | |
| Protein name | | | | | Locus Name | Acc# |
| Description | | | | | | |
| NO-HIT | | | | | | |

| ORF Name | NTID | AAID | NT Length | AA Length | Score | Probability |
|---|---|---|---|---|---|---|
| 35953_f2_206 | 4016 | 8188 | 74 | 225 | 128 | 5.6e-08 |
| Protein name | | | | | Locus Name | Acc# |
| hypothetical protein APE2401 | | | | | pir:H72469 | H72469 |
| Description | | | | | | |

| ORF Name | NTID | AAID | NT Length | AA Length | Score | Probability |
|---|---|---|---|---|---|---|
| 35975312_c2_539 | 4017 | 8189 | 150 | 453 | 298 | 2.3e-26 |
| Protein name | | | | | Locus Name | Acc# |
| conserved hypothetical protein b1376 | | | | | pir:C64888 | C64888 |
| Description | | | | | | |

| ORF Name | NTID | AAID | NT Length | AA Length | Score | Probability |
|---|---|---|---|---|---|---|
| 36120161_c2_518 | 4018 | 8190 | 356 | 1071 | 1374 | 2.2e-140 |
| Protein name | | | | | Locus Name | Acc# |
| | | | | | sp:CHEB_SALTY | P04042 |

Description: PROTEIN-GLUTAMATE METHYLESTERASE,

| ORF Name | NTID | AAID | NT Length | AA Length | Score | Probability |
|---|---|---|---|---|---|---|
| 36142941_c1_395 | 4019 | 8191 | 552 | 1659 | 1116 | 4.8e-113 |
| Protein name | | | | | Locus Name | Acc# |
| | | | | | sp:MCP1_ECOLI | P02942:P76 |

Description: PROTEIN)

| ORF Name | NTID | AAID | NT Length | AA Length | Score | Probability |
|---|---|---|---|---|---|---|
| 36210936_f1_81 | 4020 | 8192 | 464 | 1395 | 1246 | 8.1e-127 |
| Protein name | | | | | Locus Name | Acc# |
| | | | | | sp:BAES_ECOLI | P30847:P76 |

Description: SENSOR PROTEIN BAES,

| ORF Name | NTID | AAID | NT Length | AA Length | Score | Probability |
|---|---|---|---|---|---|---|
| 36381562_c3_708 | 4021 | 8193 | 333 | 1002 | 778 | 3.2e-77 |
| Protein name | | | | | Locus Name | Acc# |
| | | | | | sp:YJHU_ECOLI | P39356 |

Description: HYPOTHETICAL TRANSCRIPTIONAL REGULATOR IN FECI-FIMB INTERGENIC REGION

| ORF Name | NTID | AAID | NT Length | AA Length | Score | Probability |
|---|---|---|---|---|---|---|
| 3917918_f1_58 | 4022 | 8194 | 68 | 207 | 255 | 8.4e-22 |
| Protein name | | | | | Locus Name | Acc# |
| | | | | | gp:D90875 | D90875:AB0 |

Description: E.coli genomic DNA, Kohara clone #422(55.5-55.8 min.).

| ORF Name | NTID | AAID | NT Length | AA Length | Score | Probability |
|---|---|---|---|---|---|---|
| 3937878_f1_71 | 4023 | 8195 | 460 | 1383 | 515 | 4.2e-82 |//
| Protein name | | | | | Locus Name | Acc# |
| proline/betaine transporter | | | | | pir:A71877 | A71877 |

Description

| ORF Name | NTID | AAID | NT Length | AA Length | Score | Probability |
|---|---|---|---|---|---|---|
| 3945300_c3_646 | 4024 | 8196 | 275 | 828 | 314 | 4.7e-28 |
| Protein name | | | | | Locus Name | Acc# |
| hypothetical protein PAB0518 | | | | | pir:G75120 | G75120 |

Description

| ORF Name | NTID | AAID | NT Length | AA Length | Score | Probability |
|---|---|---|---|---|---|---|
| 3948387_c3_621 | 4025 | 8197 | 169 | 510 | 622 | 1.1e-60 |
| Protein name | | | | | Locus Name | Acc# |
| | | | | | sp:CHEW_ECOLI | P07365 |

Description
PURINE-BINDING CHEMOTAXIS PROTEIN

| ORF Name | NTID | AAID | NT Length | AA Length | Score | Probability |
|---|---|---|---|---|---|---|
| 3953152_c1_507 | 4026 | 8198 | 164 | 495 | 498 | 1.5e-47 |
| Protein name | | | | | Locus Name | Acc# |
| | | | | | sp:YEAA_ECOLI | P39903:P76 |

Description
HYPOTHETICAL 15.5 KD PROTEIN IN ANSA-GAPA INTERGENIC REGION

| ORF Name | NTID | AAID | NT Length | AA Length | Score | Probability |
|---|---|---|---|---|---|---|
| 3988467_c3_671 | 4027 | 8199 | 367 | 1104 | 1282 | 1.2e-130 |
| Protein name | | | | | Locus Name | Acc# |
| | | | | | sp:PERM_ECOLI | P77406:P71 |

Description
PUTATIVE PERMEASE PERM

| ORF_Name | NTID | AAID | NT Length | AA Length | Score | Probability |
|---|---|---|---|---|---|---|
| 4010880_c2_575 | 4028 | 8200 | 304 | 915 | 521 | 5.4e-50 |

| Protein name | Locus Name | Acc# |
|---|---|---|
| hypothetical protein PhuW | gp:AF055999 | AF055999 |

Description

Pseudomonas aeruginosa hemin uptake locus, hypothetical proteinPhuW (phuW), ATPase component (phuV), ABC-type permease (phuU),periplasmic binding protein (phuT), hemin degrading factor (phuS),and outer membrane hemin receptor (phuR) genes, complete cds.

| ORF_Name | NTID | AAID | NT Length | AA Length | Score | Probability |
|---|---|---|---|---|---|---|
| 4025468_c3_696 | 4029 | 8201 | 557 | 1674 | | |

| Protein name | Locus Name | Acc# |
|---|---|---|
| | | |

Description

NO-HIT

| ORF_Name | NTID | AAID | NT Length | AA Length | Score | Probability |
|---|---|---|---|---|---|---|
| 4031513_c2_579 | 4030 | 8202 | 491 | 1476 | 2193 | 3.6e-227 |

| Protein name | Locus Name | Acc# |
|---|---|---|
| IMP dehydrogenase (EC 1.1.1.205) | gp:D90880 | D90880:AB0 |

Description

E.coli genomic DNA, Kohara clone #427(56.5-56.9 min.).

| ORF_Name | NTID | AAID | NT Length | AA Length | Score | Probability |
|---|---|---|---|---|---|---|
| 4032593_f1_23 | 4031 | 8203 | 88 | 267 | 72 | 0.023 |

| Protein name | Locus Name | Acc# |
|---|---|---|
| cytochrome b | gp:ASU50009 | U50009 |

Description

Aerodramus spodiopygius assimilis cytochrome b gene, mitochondrialgene encoding mitochondrial protein, partial cds.

| ORF Name | NTID | AAID | NT Length | AA Length | Score | Probability |
|---|---|---|---|---|---|---|
| 4094002_f3_348 | 4032 | 8204 | 463 | 1392 | 1271 | 1.8e-129 |
| Protein name | | | | | Locus Name | Acc# |
| | | | | | sp:BRNQ_HAEIN | P71345 |

Description
CHAIN AMINO ACID UPTAKE CARRIER)

| ORF Name | NTID | AAID | NT Length | AA Length | Score | Probability |
|---|---|---|---|---|---|---|
| 4100318_f1_42 | 4033 | 8205 | 68 | 207 | | |
| Protein name | | | | | Locus Name | Acc# |

Description
NO-HIT

| ORF Name | NTID | AAID | NT Length | AA Length | Score | Probability |
|---|---|---|---|---|---|---|
| 4120306_f1_39 | 4034 | 8206 | 72 | 219 | | |
| Protein name | | | | | Locus Name | Acc# |

Description
NO-HIT

| ORF Name | NTID | AAID | NT Length | AA Length | Score | Probability |
|---|---|---|---|---|---|---|
| 4197252_c3_625 | 4035 | 8207 | 267 | 804 | 826 | 2.6e-82 |
| Protein name | | | | | Locus Name | Acc# |
| FlgD | | | | | gp:PMU82214 | U82214 |

Description
Proteus mirabilis flagella rod protein FlgD (flgD) gene, partialcds, flagella rod proteins FlgC (flgC) and FlgB (flgB), flagellaassembly protein FlgA (flgA), anti-sigma factor FlgM (flgM), facilitator of flagella filament assembly FlgN (flgN) and FloA(floA) genes, complete cds.

| ORF Name | NTID | AAID | NT Length | AA Length | Score | Probability |
|---|---|---|---|---|---|---|
| 4296930_c1_486 | 4036 | 8208 | 175 | 528 | | |
| Protein name | | | | | Locus Name | Acc# |

Description
NO-HIT

900

| ORF Name | NTID | AAID | NT Length | AA Length | Score | Probability |
|---|---|---|---|---|---|---|
| 4319463_f3_288 | 4037 | 8209 | 233 | 702 | 518 | 1.1e-49 |
| Protein name | | | | | Locus Name | Acc# |
| repressor protein cI | | | | | pir:S04828 | S04828:S02 |

Description

| ORF Name | NTID | AAID | NT Length | AA Length | Score | Probability |
|---|---|---|---|---|---|---|
| 4320217_f3_370 | 4038 | 8210 | 260 | 783 | 943 | 1.0e-94 |
| Protein name | | | | | Locus Name | Acc# |
| | | | | | sp:FLIP_ECOLI | P33133 |

Description
FLAGELLAR BIOSYNTHETIC PROTEIN FLIP

| ORF Name | NTID | AAID | NT Length | AA Length | Score | Probability |
|---|---|---|---|---|---|---|
| 4428458_f1_85 | 4039 | 8211 | 82 | 249 | 209 | 6.3e-17 |
| Protein name | | | | | Locus Name | Acc# |
| | | | | | gp:VCH231128 | AJ231128 |

Description
Vibrio cholerae z67r gene.

| ORF Name | NTID | AAID | NT Length | AA Length | Score | Probability |
|---|---|---|---|---|---|---|
| 4470032_c2_567 | 4040 | 8212 | 246 | 741 | 1067 | 7.5e-108 |
| Protein name | | | | | Locus Name | Acc# |
| | | | | | sp:PUR7_ECOLI | P21155 |

Description
(SAICAR SYNTHETASE)

| ORF Name | NTID | AAID | NT Length | AA Length | Score | Probability |
|---|---|---|---|---|---|---|
| 4470877_f2_163 | 4041 | 8213 | 256 | 771 | | |
| Protein name | | | | | Locus Name | Acc# |

Description
NO-HIT

901

| ORF Name | NTID | AAID | NT Length | AA Length | Score | Probability |
|---|---|---|---|---|---|---|
| 4491655_f1_40 | 4042 | 8214 | 83 | 252 | 76 | 0.0077 |

Protein name: envelope glycoprotein

Locus Name: gp:AF086991  Acc#: AF086991

Description: HIV-1 isolate 206 from USA:Georgia, envelope glycoprotein V3 region(env) gene, partial cds.

| ORF Name | NTID | AAID | NT Length | AA Length | Score | Probability |
|---|---|---|---|---|---|---|
| 4562813_c1_489 | 4043 | 8215 | 210 | 633 | 520 | 6.9e-50 |

Protein name:

Locus Name: sp:YE74_HAEIN  Acc#: Q57213:O05

Description: HYPOTHETICAL ABC TRANSPORTER ATP-BINDING PROTEIN HI1474

| ORF Name | NTID | AAID | NT Length | AA Length | Score | Probability |
|---|---|---|---|---|---|---|
| 4563768_c1_462 | 4044 | 8216 | 401 | 1206 | 562 | 2.5e-54 |

Protein name: symbiosis island integrase

Locus Name: gp:MELOSYMI1  Acc#: AF049242

Description: Mesorhizobium loti sugar binding protein gene, partial cds;regulatory protein gene, complete cds; tRNA-Phe gene, completesequence; symbiosis island integrase (intS) gene, complete cds; andunknown genes.

| ORF Name | NTID | AAID | NT Length | AA Length | Score | Probability |
|---|---|---|---|---|---|---|
| 4570327_f2_160 | 4045 | 8217 | 202 | 609 | 94 | 0.011 |

Protein name: cI protein

Locus Name: gp:AF034975  Acc#: AF034975

Description: Bacteriophage H-19B essential recombination function protein (erf),kil protein (kil), regulatory protein cIII (cIII), protein gp17(17), N protein (N), cI protein (cI), cro protein (cro), cIIprotein (cII), O protein (O), P protein (P), ren protein (ren), ninorf-58-A, nin orf-58-B, Roi (roi), nin orf-204, nin orf-59, Qprotein (Q), Shiga-like toxin A subunit (slt-IA),

| ORF Name | NTID | AAID | NT Length | AA Length | Score | Probability |
|---|---|---|---|---|---|---|
| 4687818_c1_453 | 4046 | 8218 | 351 | 1056 | 846 | 2.0e-84 |

| Protein name | Locus Name | Acc# |
|---|---|---|
| lipoprotein-34 precursor:lipoprotein nlpB | pir:D65023 | D65023:S25 |

Description

| ORF Name | NTID | AAID | NT Length | AA Length | Score | Probability |
|---|---|---|---|---|---|---|
| 46903_f1_47 | 4047 | 8219 | 472 | 1419 | 1579 | 4.2e-162 |

| Protein name | Locus Name | Acc# |
|---|---|---|
| | sp:EX7L_ECOLI | P04994:P78 |

Description

LARGE SUBUNIT)

| ORF Name | NTID | AAID | NT Length | AA Length | Score | Probability |
|---|---|---|---|---|---|---|
| 4726550_c1_512 | 4048 | 8220 | 324 | 975 | 106 | 2.3e-07 |

| Protein name | Locus Name | Acc# |
|---|---|---|
| | sp:BUDR_ENTAE | P52665 |

Description

PROBABLE BUD OPERON TRANSCRIPTIONAL REGULATOR (FRAGMENT)

| ORF Name | NTID | AAID | NT Length | AA Length | Score | Probability |
|---|---|---|---|---|---|---|
| 4740676_f3_351 | 4049 | 8221 | 123 | 372 | 230 | 3.7e-19 |

| Protein name | Locus Name | Acc# |
|---|---|---|
| | sp:HOLE_ECOLI | P28689 |

Description

DNA POLYMERASE III, THETA SUBUNIT,

| ORF Name | NTID | AAID | NT Length | AA Length | Score | Probability |
|---|---|---|---|---|---|---|
| 4816068_c1_398 | 4050 | 8222 | 221 | 666 | 739 | 4.3e-73 |

| Protein name | Locus Name | Acc# |
|---|---|---|
| | sp:CHEZ_SALTY | P07800 |

Description

CHEMOTAXIS PROTEIN CHEZ

| ORF Name | NTID | AAID | NT Length | AA Length | Score | Probability |
|---|---|---|---|---|---|---|
| 4875833_f3_276 | 4051 | 8223 | 526 | 1581 | 1874 | 2.3e-193 |
| Protein name | | | | | Locus Name | Acc# |
| | | | | | sp:NHAB_ECOLI | P27377:P77 |

Description
NA(+)/H(+) ANTIPORTER 2

| ORF Name | NTID | AAID | NT Length | AA Length | Score | Probability |
|---|---|---|---|---|---|---|
| 4876268_f3_268 | 4052 | 8224 | 298 | 897 | 828 | 1.6e-82 |
| Protein name | | | | | Locus Name | Acc# |
| hypothetical protein b1780 | | | | | pir:D64938 | D64938 |

Description

| ORF Name | NTID | AAID | NT Length | AA Length | Score | Probability |
|---|---|---|---|---|---|---|
| 4879678_f2_161 | 4053 | 8225 | 577 | 1734 | 1232 | 2.5e-125 |
| Protein name | | | | | Locus Name | Acc# |
| exodeoxyribonuclease VIII homolog | | | | | pir:T03004 | T03004 |

Description

| ORF Name | NTID | AAID | NT Length | AA Length | Score | Probability |
|---|---|---|---|---|---|---|
| 4883555_f2_227 | 4054 | 8226 | 156 | 471 | 352 | 4.4e-32 |
| Protein name | | | | | Locus Name | Acc# |
| | | | | | sp:FLIJ_ECOLI | P52613:P76 |

Description
FLAGELLAR FLIJ PROTEIN

| ORF Name | NTID | AAID | NT Length | AA Length | Score | Probability |
|---|---|---|---|---|---|---|
| 4884702_c1_474 | 4055 | 8227 | 119 | 360 | | |
| Protein name | | | | | Locus Name | Acc# |

Description
NO-HIT

| ORF_Name | NTID | AAID | NT Length | AA Length | Score | Probability |
|---|---|---|---|---|---|---|
| 4898543_c2_613 | 4056 | 8228 | 113 | 342 | 330 | 9.4e-30 |
| Protein name | | | | | Locus_Name | Acc# |
| | | | | | sp:EMRE_ECOLI | P23895 |

Description
RESISTANCE PROTEIN)

| ORF_Name | NTID | AAID | NT Length | AA Length | Score | Probability |
|---|---|---|---|---|---|---|
| 4957881_c1_404 | 4057 | 8229 | 262 | 789 | 871 | 4.4e-87 |
| Protein name | | | | | Locus_Name | Acc# |
| | | | | | sp:FLGH_SALTY | P15929 |

Description
FLAGELLAR L-RING PROTEIN PRECURSOR (BASAL BODY L-RING PROTEIN)

| ORF_Name | NTID | AAID | NT Length | AA Length | Score | Probability |
|---|---|---|---|---|---|---|
| 506577_c1_424 | 4058 | 8230 | 145 | 438 | 405 | 1.1e-37 |
| Protein name | | | | | Locus_Name | Acc# |
| | | | | | sp:YJBA_ECOLI | P23896 |

Description
HYPOTHETICAL 15.6 KD PROTEIN IN PGI-XYLE INTERGENIC REGION

| ORF_Name | NTID | AAID | NT Length | AA Length | Score | Probability |
|---|---|---|---|---|---|---|
| 5084437_c1_414 | 4059 | 8231 | 89 | 270 | | |
| Protein name | | | | | Locus_Name | Acc# |

Description
NO-HIT

| ORF_Name | NTID | AAID | NT Length | AA Length | Score | Probability |
|---|---|---|---|---|---|---|
| 5132052_f1_37 | 4060 | 8232 | 103 | 312 | 122 | 1.0e-07 |
| Protein name | | | | | Locus_Name | Acc# |
| hypothetical protein 88 | | | | | pir:G42465 | G42465 |

Description

| ORF Name | NTID | AAID | NT Length | AA Length | Score | Probability |
|---|---|---|---|---|---|---|
| 5198568_c2_614 | 4061 | 8233 | 373 | 1122 | 1040 | 5.5e-105 |
| Protein name | | | | | Locus Name | Acc# |
| | | | | | sp:ALR2_KLEAE | O30746 |

Description: ALANINE RACEMASE, CATABOLIC,

| ORF Name | NTID | AAID | NT Length | AA Length | Score | Probability |
|---|---|---|---|---|---|---|
| 5251425_c1_442 | 4062 | 8234 | 85 | 258 | 79 | 0.025 |
| Protein name | | | | | Locus Name | Acc# |
| hypothetical protein Y113G7B.2 | | | | | pir:T26437 | T26437 |

Description:

| ORF Name | NTID | AAID | NT Length | AA Length | Score | Probability |
|---|---|---|---|---|---|---|
| 5292950_c1_425 | 4063 | 8235 | 289 | 870 | 802 | 9.1e-80 |
| Protein name | | | | | Locus Name | Acc# |
| | | | | | sp:RRMA_ECOLI | P36999 |

Description: METHYLTRANSFERASE)

| ORF Name | NTID | AAID | NT Length | AA Length | Score | Probability |
|---|---|---|---|---|---|---|
| 5315832_f1_98 | 4064 | 8236 | 144 | 435 | 459 | 2.0e-43 |
| Protein name | | | | | Locus Name | Acc# |
| | | | | | sp:FLIN_SALTY | P26419 |

Description: FLAGELLAR MOTOR SWITCH PROTEIN FLIN

| ORF Name | NTID | AAID | NT Length | AA Length | Score | Probability |
|---|---|---|---|---|---|---|
| 547076_f2_209 | 4065 | 8237 | 277 | 834 | 659 | 1.3e-64 |
| Protein name | | | | | Locus Name | Acc# |
| | | | | | sp:YIDA_ECOLI | P09997:P76 |

Description: HYPOTHETICAL 29.7 KD PROTEIN IN IBPA-GYRB INTERGENIC REGION

| ORF_Name | NTID | AAID | NT Length | AA Length | Score | Probability |
|---|---|---|---|---|---|---|
| 594550_f1_56 | 4066 | 8238 | 386 | 1161 | 1479 | 1.6e-151 |
| Protein name | | | | | Locus Name | Acc# |
| | | | | | sp:DAPE_ECOLI | P24176 |

Description: SUCCINYL-DIAMINOPIMELATE DESUCCINYLASE, (SDAP)

| ORF_Name | NTID | AAID | NT Length | AA Length | Score | Probability |
|---|---|---|---|---|---|---|
| 5977262_f2_208 | 4067 | 8239 | 132 | 399 | 255 | 8.4e-22 |
| Protein name | | | | | Locus Name | Acc# |
| | | | | | sp:SOXS_SALTY | Q56143 |

Description: REGULATORY PROTEIN SOXS

| ORF_Name | NTID | AAID | NT Length | AA Length | Score | Probability |
|---|---|---|---|---|---|---|
| 5984411_c3_709 | 4068 | 8240 | 283 | 852 | 670 | 8.8e-66 |
| Protein name | | | | | Locus Name | Acc# |
| molybdenum transport protein molB homolog HI1525 | | | | | pir:B64127 | B64127 |

Description

| ORF_Name | NTID | AAID | NT Length | AA Length | Score | Probability |
|---|---|---|---|---|---|---|
| 6017767_c3_707 | 4069 | 8241 | 290 | 873 | 363 | 3.0e-33 |
| Protein name | | | | | Locus Name | Acc# |
| hypothetical protein ycgL | | | | | pir:G69758 | G69758 |

Description

| ORF_Name | NTID | AAID | NT Length | AA Length | Score | Probability |
|---|---|---|---|---|---|---|
| 6042511_f3_262 | 4070 | 8242 | 297 | 894 | 1134 | 6.0e-115 |
| Protein name | | | | | Locus Name | Acc# |
| | | | | | sp:EX3_ECOLI | P09030 |

Description: ENDONUCLEASE VI)

| ORF_Name | NTID | AAID | NT Length | AA Length | Score | Probability |
|---|---|---|---|---|---|---|
| 6046936_f3_350 | 4071 | 8243 | 64 | 195 | 56 | 0.027 |
| Protein name | | | | | Locus Name | Acc# |
| cytochrome b | | | | | gp:AF072668 | AF072668 |

Description: Exoneurella lawsoni cytochrome b gene, mitochondrial gene encoding mitochondrial protein, partial cds.

| ORF_Name | NTID | AAID | NT Length | AA Length | Score | Probability |
|---|---|---|---|---|---|---|
| 6049077_c1_454 | 4072 | 8244 | 150 | 453 | 505 | 2.7e-48 |
| Protein name | | | | | Locus Name | Acc# |
| | | | | | sp:YEAL_ECOLI | P76240:007 |

Description: HYPOTHETICAL 15.3 KD PROTEIN IN GAPA-RND INTERGENIC REGION

| ORF_Name | NTID | AAID | NT Length | AA Length | Score | Probability |
|---|---|---|---|---|---|---|
| 6145965_f2_203 | 4073 | 8245 | 1031 | 3096 | 3772 | 0.0 |
| Protein name | | | | | Locus Name | Acc# |
| | | | | | sp:YEGO_ECOLI | P76399:008 |

Description: HYPOTHETICAL 111.0 KD PROTEIN IN ALKA-BAES INTERGENIC REGION

| ORF_Name | NTID | AAID | NT Length | AA Length | Score | Probability |
|---|---|---|---|---|---|---|
| 6290686_c1_421 | 4074 | 8246 | 506 | 1521 | 1934 | 1.0e-199 |
| Protein name | | | | | Locus Name | Acc# |
| | | | | | sp:PUTP_ECOLI | P07117 |

Description: SODIUM/PROLINE SYMPORTER (PROLINE PERMEASE)

| ORF_Name | NTID | AAID | NT Length | AA Length | Score | Probability |
|---|---|---|---|---|---|---|
| 6307942_c1_448 | 4075 | 8247 | 438 | 1317 | 1786 | 4.8e-184 |
| Protein name | | | | | Locus Name | Acc# |
| | | | | | sp:URAA_ECOLI | P33780 |

Description: URACIL PERMEASE (URACIL TRANSPORTER)

908

| ORF Name | NTID | AAID | NT Length | AA Length | Score | Probability |
|---|---|---|---|---|---|---|
| 6438436_c3_731 | 4076 | 8248 | 659 | 1980 | 2639 | 2.0e-274 |
| Protein name | | | | | Locus Name | Acc# |
| | | | | | sp:TOP3_ECOLI | P14294 |

Description: DNA TOPOISOMERASE III,

| ORF Name | NTID | AAID | NT Length | AA Length | Score | Probability |
|---|---|---|---|---|---|---|
| 6459593_f1_68 | 4077 | 8249 | 349 | 1050 | 1428 | 4.2e-146 |
| Protein name | | | | | Locus Name | Acc# |
| phosphoribosylformylglycinamidine cyclo-ligase,:5'-phosphoribosyl-5-aminoimidazo | | | | | pir:AJECPC | A25955:B65 |

Description

| ORF Name | NTID | AAID | NT Length | AA Length | Score | Probability |
|---|---|---|---|---|---|---|
| 6523392_f1_107 | 4078 | 8250 | 69 | 210 | | |
| Protein name | | | | | Locus Name | Acc# |

Description: NO-HIT

| ORF Name | NTID | AAID | NT Length | AA Length | Score | Probability |
|---|---|---|---|---|---|---|
| 6640717_c2_556 | 4079 | 8251 | 491 | 1476 | 1890 | 4.6e-195 |
| Protein name | | | | | Locus Name | Acc# |
| | | | | | sp:YDGR_ECOLI | P77304 |

Description: HYPOTHETICAL 54.0 KD PROTEIN IN NTH-GST INTERGENIC REGION

| ORF Name | NTID | AAID | NT Length | AA Length | Score | Probability |
|---|---|---|---|---|---|---|
| 6679688_c1_429 | 4080 | 8252 | 116 | 351 | | |
| Protein name | | | | | Locus Name | Acc# |

Description: NO-HIT

| ORF Name | NTID | AAID | NT Length | AA Length | Score | Probability |
|---|---|---|---|---|---|---|
| 6694028_c3_674 | 4081 | 8253 | 686 | 2061 | 1299 | 2.0e-132 |
| Protein name | | | | | Locus Name | Acc# |
| | | | | | sp:YPFI_ECOLI | P76562:P76 |

Description

HYPOTHETICAL 74.9 KD PROTEIN IN DAPE-PURC INTERGENIC REGION

| ORF Name | NTID | AAID | NT Length | AA Length | Score | Probability |
|---|---|---|---|---|---|---|
| 6723930_f3_317 | 4082 | 8254 | 72 | 219 | | |
| Protein name | | | | | Locus Name | Acc# |

Description

NO-HIT

| ORF Name | NTID | AAID | NT Length | AA Length | Score | Probability |
|---|---|---|---|---|---|---|
| 6912775_f1_6 | 4083 | 8255 | 347 | 1044 | 1284 | 7.6e-131 |
| Protein name | | | | | Locus Name | Acc# |
| | | | | | sp:ASG1_ECOLI | P18840 |

Description (L-ASNASE I)

| ORF Name | NTID | AAID | NT Length | AA Length | Score | Probability |
|---|---|---|---|---|---|---|
| 7125090_c1_420 | 4084 | 8256 | 252 | 759 | 1033 | 3.0e-104 |
| Protein name | | | | | Locus Name | Acc# |
| FliA, sigma 28 | | | | | gp:XNE131736 | AJ131736 |

Description

Xenorhabdus nematophilus partial fliC gene, fliA, fliZ genes andpartial putA gene.

| ORF Name | NTID | AAID | NT Length | AA Length | Score | Probability |
|---|---|---|---|---|---|---|
| 7150308_c3_705 | 4085 | 8257 | 729 | 2190 | 503 | 9.5e-46 |
| Protein name | | | | | Locus Name | Acc# |
| eliminase | | | | | gp:ECELIM | X96495 |

Description

E.coli gene encoding eliminase.

| ORF Name | NTID | AAID | NT Length | AA Length | Score | Probability |
|---|---|---|---|---|---|---|
| 7164701_f3_366 | 4086 | 8258 | 254 | 765 | 496 | 2.4e-47 |
| Protein name | | | | | Locus Name | Acc# |
| flagellar assembly protein fliH | | | | | pir:A64958 | A64958 |

Description

| ORF Name | NTID | AAID | NT Length | AA Length | Score | Probability |
|---|---|---|---|---|---|---|
| 7235930_c3_684 | 4087 | 8259 | 66 | 201 | | |
| Protein name | | | | | Locus Name | Acc# |

Description
NO-HIT

| ORF Name | NTID | AAID | NT Length | AA Length | Score | Probability |
|---|---|---|---|---|---|---|
| 7305465_c2_568 | 4088 | 8260 | 298 | 897 | 800 | 1.5e-79 |
| Protein name | | | | | Locus Name | Acc# |
| hypothetical protein b2475 | | | | | pir:B65023 | B65023 |

Description

| ORF Name | NTID | AAID | NT Length | AA Length | Score | Probability |
|---|---|---|---|---|---|---|
| 7760_c2_519 | 4089 | 8261 | 254 | 765 | 193 | 1.5e-14 |
| Protein name | | | | | Locus Name | Acc# |
| FloA | | | | | gp:PMU82214 | U82214 |

Description
Proteus mirabilis flagella rod protein FlgD (flgD) gene, partialcds, flagella rod proteins FlgC (flgC) and FlgB (flgB), flagellaassembly protein FlgA (flgA), anti-sigma factor FlgM (flgM),facilitator of flagella filament assembly FlgN (flgN) and FloA(floA) genes, complete cds.

| ORF Name | NTID | AAID | NT Length | AA Length | Score | Probability |
|---|---|---|---|---|---|---|
| 792137_c2_595 | 4090 | 8262 | 164 | 495 | | |
| Protein name | | | | | Locus Name | Acc# |

Description
NO-HIT

911

| ORF Name | NTID | AAID | NT Length | AA Length | Score | Probability |
|---|---|---|---|---|---|---|
| 805257_f1_88 | 4091 | 8263 | 488 | 1467 | 1884 | 2.0e-194 |
| Protein name | | | | | Locus Name | Acc# |
| | | | | | sp:SDHL_ECOLI | P16095 |

Description
(L-SD1)

| ORF Name | NTID | AAID | NT Length | AA Length | Score | Probability |
|---|---|---|---|---|---|---|
| 816068_f2_205 | 4092 | 8264 | 301 | 906 | 879 | 6.3e-88 |
| Protein name | | | | | Locus Name | Acc# |
| | | | | | sp:YEGS_ECOLI | P76407:O08 |

Description
HYPOTHETICAL 32.0 KD PROTEIN IN OGRK-GATR INTERGENIC REGION

| ORF Name | NTID | AAID | NT Length | AA Length | Score | Probability |
|---|---|---|---|---|---|---|
| 839816_c3_704 | 4093 | 8265 | 107 | 324 | | |
| Protein name | | | | | Locus Name | Acc# |

Description
NO-HIT

| ORF Name | NTID | AAID | NT Length | AA Length | Score | Probability |
|---|---|---|---|---|---|---|
| 859456_f1_28 | 4094 | 8266 | 92 | 279 | | |
| Protein name | | | | | Locus Name | Acc# |

Description
NO-HIT

| ORF Name | NTID | AAID | NT Length | AA Length | Score | Probability |
|---|---|---|---|---|---|---|
| 860676_f2_244 | 4095 | 8267 | 105 | 318 | | |
| Protein name | | | | | Locus Name | Acc# |

Description
NO-HIT

912

| ORF Name | NTID | AAID | NT Length | AA Length | Score | Probability |
|---|---|---|---|---|---|---|
| 862775_f2_171 | 4096 | 8268 | 69 | 210 | 69 | 0.012 |
| Protein name | | | | | Locus Name | Acc# |
| hypothetical protein 1 (CYb-COII intergenic region) | | | | | pir:B26696 | B26696 |

Description

| ORF Name | NTID | AAID | NT Length | AA Length | Score | Probability |
|---|---|---|---|---|---|---|
| 976577_c3_626 | 4097 | 8269 | 368 | 1107 | 1389 | 5.7e-142 |
| Protein name | | | | | Locus Name | Acc# |
| | | | | | sp:FLGI_SALTY | P15930 |

Description
FLAGELLAR P-RING PROTEIN PRECURSOR

| ORF Name | NTID | AAID | NT Length | AA Length | Score | Probability |
|---|---|---|---|---|---|---|
| 9776925_c2_604 | 4098 | 8270 | 302 | 909 | 358 | 1.0e-32 |
| Protein name | | | | | Locus Name | Acc# |
| probable ABC-type transport system membrane protein | | | | | pir:T36640 | T36640 |

Description

| ORF Name | NTID | AAID | NT Length | AA Length | Score | Probability |
|---|---|---|---|---|---|---|
| 978463_f3_316 | 4099 | 8271 | 63 | 192 | 72 | 0.020 |
| Protein name | | | | | Locus Name | Acc# |
| hypothetical protein ssr2998 | | | | | pir:S74661 | S74661 |

Description

| ORF Name | NTID | AAID | NT Length | AA Length | Score | Probability |
|---|---|---|---|---|---|---|
| 9894761_f3_270 | 4100 | 8272 | 94 | 285 | | |
| Protein name | | | | | Locus Name | Acc# |

Description
NO-HIT

| ORF Name | NTID | AAID | NT Length | AA Length | Score | Probability |
|---|---|---|---|---|---|---|
| 9948260_c1_457 | 4101 | 8273 | 72 | 219 | | |
| Protein name | | | | | Locus Name | Acc# |

Description
NO-HIT

| ORF Name | NTID | AAID | NT Length | AA Length | Score | Probability |
|---|---|---|---|---|---|---|
| 10631302_c2_164 | 4102 | 8274 | 77 | 234 | 75 | 0.0099 |
| Protein name | | | | | Locus Name | Acc# |
| GDP-D-mannose dehydratase | | | | | gp:APU75690 | U75690 |

Description
Anabaena PCC7120 first mannosyl transferase (rfbZ) gene, partialcds, undecaprenyl-phosphate galactosephosphotransferase, completecds, GDP-D-mannose dehydratase gene, partial cds.

| ORF Name | NTID | AAID | NT Length | AA Length | Score | Probability |
|---|---|---|---|---|---|---|
| 10740686_c3_190 | 4103 | 8275 | 282 | 849 | 1050 | 4.8e-106 |
| Protein name | | | | | Locus Name | Acc# |
| glycerol diffusion facilitator protein | | | | | gp:ECU13915 | U13915 |

Description
Escherichia coli HB101 glycerol diffusion facilitator protein(glpF) gene, complete cds.

| ORF Name | NTID | AAID | NT Length | AA Length | Score | Probability |
|---|---|---|---|---|---|---|
| 1213402_f1_11 | 4104 | 8276 | 336 | 1011 | 1350 | 7.7e-138 |
| Protein name | | | | | Locus Name | Acc# |
| sulfate binding protein precursor, periplasmic:sulfate starvation-induced protein | | | | | pir:BYEC | S40860:H65 |

Description

| ORF Name | NTID | AAID | NT Length | AA Length | Score | Probability |
|---|---|---|---|---|---|---|
| 12695252_c2_149 | 4105 | 8277 | 376 | 1131 | 1219 | 5.9e-124 |
| Protein name | | | | | Locus Name | Acc# |
| | | | | | sp:CYTR_ECOLI | P06964 |

Description
TRANSCRIPTIONAL REPRESSOR CYTR

| ORF Name | NTID | AAID | NT Length | AA Length | Score | Probability |
|---|---|---|---|---|---|---|
| 12891441_c2_156 | 4106 | 8278 | 313 | 942 | 1048 | 7.8e-106 |
| Protein name | | | | | Locus Name | Acc# |
| triose phosphate isomerase | | | | | gp:AF098509 | AF098509 |

Description

Enterobacter cloacae phosphofructokinase (pfkA), putativesulfur-binding protein (sbp), putative CDP-diglyceride hydrolase(cdh), and triose phosphate isomerase (tpi) genes, complete cds;and unknown genes.

| ORF Name | NTID | AAID | NT Length | AA Length | Score | Probability |
|---|---|---|---|---|---|---|
| 13679561_c3_178 | 4107 | 8279 | 513 | 1542 | 2083 | 1.6e-215 |
| Protein name | | | | | Locus Name | Acc# |
| | | | | | sp:PROP_ECOLI | P30848 |

Description

PROLINE/BETAINE TRANSPORTER (PROLINE PORTER II) (PPII)

| ORF Name | NTID | AAID | NT Length | AA Length | Score | Probability |
|---|---|---|---|---|---|---|
| 13729562_c3_191 | 4108 | 8280 | 515 | 1548 | 2246 | 8.7e-233 |
| Protein name | | | | | Locus Name | Acc# |
| | | | | | sp:GLPK_ECOLI | P08859:Q59 |

Description (GLYCEROKINASE) (GK)

| ORF Name | NTID | AAID | NT Length | AA Length | Score | Probability |
|---|---|---|---|---|---|---|
| 13790901_c2_150 | 4109 | 8281 | 177 | 534 | 801 | 1.2e-79 |
| Protein name | | | | | Locus Name | Acc# |
| heat shock protein hslV, | | | | | pir:JT0760 | JT0760:S40 |

Description

| ORF Name | NTID | AAID | NT Length | AA Length | Score | Probability |
|---|---|---|---|---|---|---|
| 14486535_c2_159 | 4110 | 8282 | 262 | 789 | 420 | 2.7e-39 |
| Protein name | | | | | Locus Name | Acc# |
| 3-oxoacyl reductase (fabG) RP762 | | | | | pir:F71636 | F71636 |

Description

| ORF Name | NTID | AAID | NT Length | AA Length | Score | Probability |
|---|---|---|---|---|---|---|
| 14642758_c3_169 | 4111 | 8283 | 61 | 186 | | |
| Protein name | | | | | Locus Name | Acc# |

Description: NO-HIT

| ORF Name | NTID | AAID | NT Length | AA Length | Score | Probability |
|---|---|---|---|---|---|---|
| 15041392_f3_92 | 4112 | 8284 | 651 | 1956 | 1735 | 1.2e-178 |
| Protein name | | | | | Locus Name | Acc# |
| | | | | | sp:BTUB_SALTY | P37409 |

Description: VITAMIN B12 RECEPTOR PRECURSOR

| ORF Name | NTID | AAID | NT Length | AA Length | Score | Probability |
|---|---|---|---|---|---|---|
| 16828463_c1_114 | 4113 | 8285 | 250 | 753 | 978 | 2.0e-98 |
| Protein name | | | | | Locus Name | Acc# |
| ferredoxin--NADP+ reductase,:methyl viologen-resistance protein | | | | | pir:S40867 | S40867:A47 |

Description:

| ORF Name | NTID | AAID | NT Length | AA Length | Score | Probability |
|---|---|---|---|---|---|---|
| 16910_c2_148 | 4114 | 8286 | 745 | 2238 | 2617 | 4.2e-272 |
| Protein name | | | | | Locus Name | Acc# |
| primosomal replication factor Y:protein n' | | | | | pir:A35505 | S40878:A35 |

Description:

| ORF Name | NTID | AAID | NT Length | AA Length | Score | Probability |
|---|---|---|---|---|---|---|
| 16931457_f1_36 | 4115 | 8287 | 203 | 609 | 248 | 4.6e-21 |
| Protein name | | | | | Locus Name | Acc# |
| | | | | | sp:YPRO_OWEFU | P21260:P21 |

Description: HYPOTHETICAL PROLINE-RICH PROTEIN (FRAGMENT)

| ORF Name | NTID | AAID | NT Length | AA Length | Score | Probability |
|---|---|---|---|---|---|---|
| 1956392_c2_140 | 4116 | 8288 | 455 | 1368 | 498 | 1.5e-47 |
| Protein name | | | | | Locus Name | Acc# |
| | | | | | sp:CBPX_SULSO | P80092 |

Description: THERMOSTABLE CARBOXYPEPTIDASE,

| ORF Name | NTID | AAID | NT Length | AA Length | Score | Probability |
|---|---|---|---|---|---|---|
| 196928_c2_152 | 4117 | 8289 | 310 | 933 | 982 | 7.6e-99 |
| Protein name | | | | | Locus Name | Acc# |
| | | | | | sp:MENA_ECOLI | P32166 |

Description: OCTAPRENYLTRANSFERASE)

| ORF Name | NTID | AAID | NT Length | AA Length | Score | Probability |
|---|---|---|---|---|---|---|
| 20198512_f2_53 | 4118 | 8290 | 78 | 237 | 93 | 0.0023 |
| Protein name | | | | | Locus Name | Acc# |
| major surface glycoprotein 110 | | | | | gp:AB028490 | AB028490 |

Description: Pneumocystis carinii msg110 gene for major surface glycoprotein110, partial cds.

| ORF Name | NTID | AAID | NT Length | AA Length | Score | Probability |
|---|---|---|---|---|---|---|
| 2042787_c2_134 | 4119 | 8291 | 470 | 1413 | 1919 | 3.9e-198 |
| Protein name | | | | | Locus Name | Acc# |
| | | | | | sp:UDHA_ECOLI | P27306 |

Description: UNKNOWN DEHYDROGENASE A,

| ORF Name | NTID | AAID | NT Length | AA Length | Score | Probability |
|---|---|---|---|---|---|---|
| 21648285_c1_123 | 4120 | 8292 | 391 | 1176 | 878 | 8.0e-88 |
| Protein name | | | | | Locus Name | Acc# |
| VioA | | | | | gp:AF125322 | AF125322:L |

Description: Escherichia coli O7-specific lipopolysaccharide biosynthesis genecluster, complete sequence.

917

| ORF Name | NTID | AAID | NT Length | AA Length | Score | Probability |
|---|---|---|---|---|---|---|
| 21876453_c3_187 | 4121 | 8293 | 136 | 411 | 538 | 8.6e-52 |
| Protein name | | | | | Locus Name | Acc# |
| | | | | | sp:HSLU_ECOLI | P32168 |

Description
HEAT SHOCK PROTEIN HSLU

| ORF Name | NTID | AAID | NT Length | AA Length | Score | Probability |
|---|---|---|---|---|---|---|
| 22046892_c3_176 | 4122 | 8294 | 157 | 474 | | |
| Protein name | | | | | Locus Name | Acc# |

Description
NO-HIT

| ORF Name | NTID | AAID | NT Length | AA Length | Score | Probability |
|---|---|---|---|---|---|---|
| 22478452_f1_32 | 4123 | 8295 | 134 | 405 | 271 | 1.7e-23 |
| Protein name | | | | | Locus Name | Acc# |
| | | | | | sp:YIJD_ECOLI | P27308 |

Description
HYPOTHETICAL 13.0 KD PROTEIN IN UDHA-TRMA INTERGENIC REGION (ORFB)

| ORF Name | NTID | AAID | NT Length | AA Length | Score | Probability |
|---|---|---|---|---|---|---|
| 23473187_f3_88 | 4124 | 8296 | 349 | 1050 | 1268 | 3.8e-129 |
| Protein name | | | | | Locus Name | Acc# |
| | | | | | sp:ARGC_ECOLI | P11446 |

Description
ACETYL-GLUTAMATE SEMIALDEHYDE DEHYDROGENASE) (NAGSA DEHYDROGENASE)

| ORF Name | NTID | AAID | NT Length | AA Length | Score | Probability |
|---|---|---|---|---|---|---|
| 23619066_c2_161 | 4125 | 8297 | 233 | 702 | 1019 | 9.2e-103 |
| Protein name | | | | | Locus Name | Acc# |
| | | | | | sp:CPXR_ECOLI | P16244:P76 |

Description
TRANSCRIPTIONAL REGULATORY PROTEIN CPXR

| ORF Name | NTID | AAID | NT Length | AA Length | Score | Probability |
|---|---|---|---|---|---|---|
| 23704467_f3_64 | 4126 | 8298 | 219 | 660 | 279 | 2.4e-24 |
| Protein name | | | | | Locus Name | Acc# |
| | | | | | sp:CPXP_ECOLI | P32158:065 |

Description: PERIPLASMIC PROTEIN CPXP PRECURSOR

| ORF Name | NTID | AAID | NT Length | AA Length | Score | Probability |
|---|---|---|---|---|---|---|
| 238431_f1_35 | 4127 | 8299 | 299 | 900 | 970 | 1.4e-97 |
| Protein name | | | | | Locus Name | Acc# |
| glutamate racemase, | | | | | pir:I41187 | I41187:I52 |

Description:

| ORF Name | NTID | AAID | NT Length | AA Length | Score | Probability |
|---|---|---|---|---|---|---|
| 239061_f2_55 | 4128 | 8300 | 86 | 261 | | |
| Protein name | | | | | Locus Name | Acc# |

Description: NO-HIT

| ORF Name | NTID | AAID | NT Length | AA Length | Score | Probability |
|---|---|---|---|---|---|---|
| 24040966_c1_102 | 4129 | 8301 | 274 | 825 | | |
| Protein name | | | | | Locus Name | Acc# |

Description: NO-HIT

| ORF Name | NTID | AAID | NT Length | AA Length | Score | Probability |
|---|---|---|---|---|---|---|
| 24414751_c2_165 | 4130 | 8302 | 115 | 345 | 97 | 6.3e-06 |
| Protein name | | | | | Locus Name | Acc# |
| 4-ketoreductase | | | | | gp:AF055922 | AF055922 |

Description: Streptomyces fradiae dipeptidil carboxypeptidase (ddcA), tylosinresistance protein (tlrB), glycosyltransferase (tylN), methyltransferase (tylE), 4-ketoreductase (tylD), ferredoxin(tylH2), cytochrome P450 (tylH1), macrocin O-methyltransferase(tylF), epimerase (tylJ), acyl-CoA oxydase (tylP), andbutyrolactone receptor (tylQ) genes, complete cds.

919

| ORF Name | NTID | AAID | NT Length | AA Length | Score | Probability |
|---|---|---|---|---|---|---|
| 24635330_c1_111 | 4131 | 8303 | 99 | 300 | 335 | 2.8e-30 |
| Protein name | | | | | Locus Name | Acc# |
| | | | | | sp:MENG_ECOLI | P32165 |

Description
(EC 2.1.-.-)

| ORF Name | NTID | AAID | NT Length | AA Length | Score | Probability |
|---|---|---|---|---|---|---|
| 24741300_c3_186 | 4132 | 8304 | 270 | 813 | 322 | 6.6e-29 |
| Protein name | | | | | Locus Name | Acc# |
| | | | | | sp:FTSN_ECOLI | P29131 |

Description
CELL DIVISION PROTEIN FTSN

| ORF Name | NTID | AAID | NT Length | AA Length | Score | Probability |
|---|---|---|---|---|---|---|
| 25423153_f1_13 | 4133 | 8305 | 149 | 450 | 325 | 3.2e-29 |
| Protein name | | | | | Locus Name | Acc# |
| | | | | | sp:YIIR_ECOLI | P32161 |

Description
HYPOTHETICAL 16.5 KD PROTEIN IN TPIA-FPR INTERGENIC REGION (O146)

| ORF Name | NTID | AAID | NT Length | AA Length | Score | Probability |
|---|---|---|---|---|---|---|
| 25437932_f1_16 | 4134 | 8306 | 99 | 300 | 296 | 3.8e-26 |
| Protein name | | | | | Locus Name | Acc# |
| | | | | | sp:YIIU_ECOLI | P32164 |

Description
HYPOTHETICAL 9.6 KD PROTEIN IN GLPF-HSLU INTERGENIC REGION (O81)

| ORF Name | NTID | AAID | NT Length | AA Length | Score | Probability |
|---|---|---|---|---|---|---|
| 25525280_c2_147 | 4135 | 8307 | 106 | 321 | 514 | 3.0e-49 |
| Protein name | | | | | Locus Name | Acc# |
| regulatory protein metJ | | | | | pir:A23081 | A23081 |

Description

| ORF_Name | NTID | AAID | NT Length | AA Length | Score | Probability |
|---|---|---|---|---|---|---|
| 25548160_c3_175 | 4136 | 8308 | 396 | 1191 | 1542 | 3.5e-158 |
| Protein name | | | | | Locus Name | Acc# |
| | | | | | sp:ARGE_ECOLI | P23908 |

Description
(N-ACETYLORNITHINASE) (NAO)

| ORF_Name | NTID | AAID | NT Length | AA Length | Score | Probability |
|---|---|---|---|---|---|---|
| 2611575_c1_118 | 4137 | 8309 | 83 | 252 | | |
| Protein name | | | | | Locus Name | Acc# |

Description
NO-HIT

| ORF_Name | NTID | AAID | NT Length | AA Length | Score | Probability |
|---|---|---|---|---|---|---|
| 26369063_c3_166 | 4138 | 8310 | 160 | 483 | 153 | 5.0e-20 |
| Protein name | | | | | Locus Name | Acc# |
| hypothetical protein E02A10.2 | | | | | pir:T20410 | T20410 |

Description

| ORF_Name | NTID | AAID | NT Length | AA Length | Score | Probability |
|---|---|---|---|---|---|---|
| 26757762_f1_30 | 4139 | 8311 | 581 | 1746 | 2278 | 3.5e-236 |
| Protein name | | | | | Locus Name | Acc# |
| | | | | | sp:POXB_ECOLI | P07003 |

Description
(POX) (PYRUVATE DEHYDROGENASE (UBIQUINONE))

| ORF_Name | NTID | AAID | NT Length | AA Length | Score | Probability |
|---|---|---|---|---|---|---|
| 276575_f2_62 | 4140 | 8312 | 171 | 516 | 237 | 6.8e-20 |
| Protein name | | | | | Locus Name | Acc# |
| | | | | | sp:YPRO_OWEFU | P21260:P21 |

Description
HYPOTHETICAL PROLINE-RICH PROTEIN (FRAGMENT)

| ORF Name | NTID | AAID | NT Length | AA Length | Score | Probability |
|---|---|---|---|---|---|---|
| 29454701_c1_120 | 4141 | 8313 | 397 | 1194 | 252 | 2.9e-21 |
| Protein name | | | | | Locus Name | Acc# |
| capm protein (capM2) RP414 | | | | | pir:E71699 | E71699 |

Description

| ORF Name | NTID | AAID | NT Length | AA Length | Score | Probability |
|---|---|---|---|---|---|---|
| 29537937_f2_54 | 4142 | 8314 | 892 | 2679 | 3505 | 0.0 |
| Protein name | | | | | Locus Name | Acc# |
| | | | | | sp:CAPP_ECOLI | P00864 |

Description

PHOSPHOENOLPYRUVATE CARBOXYLASE, (PEPCASE) (PEPC)

| ORF Name | NTID | AAID | NT Length | AA Length | Score | Probability |
|---|---|---|---|---|---|---|
| 29736686_f3_77 | 4143 | 8315 | 390 | 1173 | 1422 | 1.8e-145 |
| Protein name | | | | | Locus Name | Acc# |
| | | | | | sp:METB_ECOLI | P00935 |

Description (THIOL)-LYASE)

| ORF Name | NTID | AAID | NT Length | AA Length | Score | Probability |
|---|---|---|---|---|---|---|
| 30213425_f3_84 | 4144 | 8316 | 350 | 1053 | 771 | 1.7e-76 |
| Protein name | | | | | Locus Name | Acc# |
| | | | | | sp:CYSB_ECOLI | P06613:P76 |

Description

CYS REGULON TRANSCRIPTIONAL ACTIVATOR

| ORF Name | NTID | AAID | NT Length | AA Length | Score | Probability |
|---|---|---|---|---|---|---|
| 33620680_f3_93 | 4145 | 8317 | 172 | 519 | 221 | 3.0e-17 |
| Protein name | | | | | Locus Name | Acc# |
| pherophorin-S | | | | | pir:T10798 | T10798 |

Description

| ORF Name | NTID | AAID | NT Length | AA Length | Score | Probability |
|---|---|---|---|---|---|---|
| 34382682_f3_89 | 4146 | 8318 | 412 | 1239 | 751 | 4.5e-112 |окат
| Protein name | | | | | Locus Name | Acc# |
| argininosuccinate synthase,:protein F6I7.40:protein F6I7.40 | | | | | pir:T06667 | T06667 |

Description

| ORF Name | NTID | AAID | NT Length | AA Length | Score | Probability |
|---|---|---|---|---|---|---|
| 34433138_c1_94 | 4147 | 8319 | 112 | 339 | 166 | 2.3e-21 |
| Protein name | | | | | Locus Name | Acc# |
| hypothetical protein E02A10.2 | | | | | pir:T20410 | T20410 |

Description

| ORF Name | NTID | AAID | NT Length | AA Length | Score | Probability |
|---|---|---|---|---|---|---|
| 34578193_c2_151 | 4148 | 8320 | 320 | 963 | 1420 | 2.9e-145 |
| Protein name | | | | | Locus Name | Acc# |
| | | | | | sp:HSLU_ECOLI | P32168 |

Description

HEAT SHOCK PROTEIN HSLU

| ORF Name | NTID | AAID | NT Length | AA Length | Score | Probability |
|---|---|---|---|---|---|---|
| 36214002_c1_103 | 4149 | 8321 | 481 | 1446 | 1272 | 1.4e-129 |
| Protein name | | | | | Locus Name | Acc# |
| deoxyribodipyrimidine photo-lyase,:DNA photolyase:photoreactivating enzyme | | | | | pir:S22321 | S22321:S78 |

Description

| ORF Name | NTID | AAID | NT Length | AA Length | Score | Probability |
|---|---|---|---|---|---|---|
| 36621093_c2_126 | 4150 | 8322 | 111 | 336 | 174 | 2.5e-21 |
| Protein name | | | | | Locus Name | Acc# |
| hypothetical protein E02A10.2 | | | | | pir:T20410 | T20410 |

Description

| ORF Name | NTID | AAID | NT Length | AA Length | Score | Probability |
|---|---|---|---|---|---|---|
| 3908318_f2_59 | 4151 | 8323 | 260 | 783 | 967 | 3.0e-97 |
| Protein name | | | | | Locus Name | Acc# |
| | | | | | sp:ARGB_ECOLI | P11445 |

Description: (N-ACETYLGLUTAMATE 5-PHOSPHOTRANSFERASE)

| ORF Name | NTID | AAID | NT Length | AA Length | Score | Probability |
|---|---|---|---|---|---|---|
| 3909687_c2_162 | 4152 | 8324 | 466 | 1401 | 1926 | 7.1e-199 |
| Protein name | | | | | Locus Name | Acc# |
| | | | | | sp:CPXA_ECOLI | P08336 |

Description: SENSOR PROTEIN CPXA,

| ORF Name | NTID | AAID | NT Length | AA Length | Score | Probability |
|---|---|---|---|---|---|---|
| 3917553_f2_38 | 4153 | 8325 | 177 | 534 | 267 | 4.5e-23 |
| Protein name | | | | | Locus Name | Acc# |
| | | | | | sp:RFAB_ECOLI | P27127 |

Description: (GALACTOSYLTRANSFERASE)

| ORF Name | NTID | AAID | NT Length | AA Length | Score | Probability |
|---|---|---|---|---|---|---|
| 3947263_f2_60 | 4154 | 8326 | 463 | 1392 | 1942 | 1.4e-200 |
| Protein name | | | | | Locus Name | Acc# |
| | | | | | sp:ARLY_ECOLI | P11447 |

Description: ARGININOSUCCINATE LYASE, (ARGINOSUCCINASE) (ASAL)

| ORF Name | NTID | AAID | NT Length | AA Length | Score | Probability |
|---|---|---|---|---|---|---|
| 4094803_f3_76 | 4155 | 8327 | 438 | 1317 | 624 | 6.6e-61 |
| Protein name | | | | | Locus Name | Acc# |
| | | | | | sp:YJJJ_ECOLI | P39410 |

Description: HYPOTHETICAL 49.8 KD PROTEIN IN DEOD-LPLA INTERGENIC REGION (O443)

| ORF Name | NTID | AAID | NT Length | AA Length | Score | Probability |
|---|---|---|---|---|---|---|
| 4102317_f2_52 | 4156 | 8328 | 175 | 528 | 597 | 4.8e-58 |

| Protein name | | | | | Locus Name | Acc# |
|---|---|---|---|---|---|---|
| | | | | | sp:YQHA_ECOLI | P52082 |

Description
HYPOTHETICAL 18.6 KD PROTEIN IN HYBA-EXBD INTERGENIC REGION (F164)

| ORF Name | NTID | AAID | NT Length | AA Length | Score | Probability |
|---|---|---|---|---|---|---|
| 4109437_f2_61 | 4157 | 8329 | 242 | 729 | 913 | 1.6e-91 |

| Protein name | | | | | Locus Name | Acc# |
|---|---|---|---|---|---|---|
| | | | | | sp:YIJC_ECOLI | P27307 |

Description
HYPOTHETICAL 26.6 KD PROTEIN IN UDHA-TRMA INTERGENIC REGION (ORFA)

| ORF Name | NTID | AAID | NT Length | AA Length | Score | Probability |
|---|---|---|---|---|---|---|
| 4339431_f3_78 | 4158 | 8330 | 815 | 2448 | 3222 | 0.0 |

| Protein name | | | | | Locus Name | Acc# |
|---|---|---|---|---|---|---|
| metL bifunctional enzyme:aspartokinase II/homoserine dehydrogenase II | | | | | pir:DEECK2 | S40883:A00 |

Description

| ORF Name | NTID | AAID | NT Length | AA Length | Score | Probability |
|---|---|---|---|---|---|---|
| 4454437_c1_125 | 4159 | 8331 | 327 | 984 | 124 | 0.00018 |

| Protein name | | | | | Locus Name | Acc# |
|---|---|---|---|---|---|---|
| ATP-dependent Clp proteinase, homolog | | | | | pir:S72278 | S72278:S78 |

Description

| ORF Name | NTID | AAID | NT Length | AA Length | Score | Probability |
|---|---|---|---|---|---|---|
| 4726386_c1_115 | 4160 | 8332 | 231 | 696 | 270 | 2.1e-23 |

| Protein name | | | | | Locus Name | Acc# |
|---|---|---|---|---|---|---|
| | | | | | sp:YIIQ_ECOLI | P32160 |

Description
HYPOTHETICAL 21.8 KD PROTEIN IN TPIA-FPR INTERGENIC REGION PRECURSOR

| ORF Name | NTID | AAID | NT Length | AA Length | Score | Probability |
|---|---|---|---|---|---|---|
| 4741301_f3_90 | 4161 | 8333 | 314 | 945 | 1302 | 9.4e-133 |
| Protein name | | | | | Locus Name | Acc# |
| oxidative stress transcriptional regulator | | | | | gp:ECU74302 | U74302 |

Description: Erwinia carotovora oxidative stress transcriptional regulator(oxyR) and 5,10-methylenetetrahydrofolate reductase (metF) genes, complete cds and unknown dehydrogenase (udhA) gene, partial cds.

| ORF Name | NTID | AAID | NT Length | AA Length | Score | Probability |
|---|---|---|---|---|---|---|
| 5208387_c1_104 | 4162 | 8334 | 340 | 1023 | 413 | 1.5e-38 |
| Protein name | | | | | Locus Name | Acc# |
| glycosyltransferase | | | | | gp:AF146532 | AF146532 |

Description: Klebsiella pneumoniae waa gene cluster.

| ORF Name | NTID | AAID | NT Length | AA Length | Score | Probability |
|---|---|---|---|---|---|---|
| 6515841_f3_72 | 4163 | 8335 | 104 | 315 | 76 | 0.0081 |
| Protein name | | | | | Locus Name | Acc# |
| hypothetical protein SC4A7.24c | | | | | gp:SC4A7 | AL133423 |

Description: Streptomyces coelicolor cosmid 4A7.

| ORF Name | NTID | AAID | NT Length | AA Length | Score | Probability |
|---|---|---|---|---|---|---|
| 6647762_c3_196 | 4164 | 8336 | 109 | 330 | 79 | 0.00039 |
| Protein name | | | | | Locus Name | Acc# |
| nucleotide sugar epimerase homolog | | | | | pir:C70155 | C70155 |

Description:

| ORF Name | NTID | AAID | NT Length | AA Length | Score | Probability |
|---|---|---|---|---|---|---|
| 7241313_f2_41 | 4165 | 8337 | 330 | 993 | 1387 | 9.3e-142 |
| Protein name | | | | | Locus Name | Acc# |
| phosphofructokinase | | | | | gp:AF098509 | AF098509 |

Description: Enterobacter cloacae phosphofructokinase (pfkA), putative sulfur-binding protein (sbp), putative CDP-diglyceride hydrolase(cdh), and triose phosphate isomerase (tpi) genes, complete cds; and unknown genes.

| ORF Name | NTID | AAID | NT Length | AA Length | Score | Probability |
|---|---|---|---|---|---|---|
| 787800_c2_163 | 4166 | 8338 | 351 | 1056 | 282 | 1.2e-24 |
| Protein name | | | | | Locus Name | Acc# |
| | | | | | sp:YOC8_MYCTU | Q50587 |

Description
HYPOTHETICAL 39.6 KD PROTEIN CY19G5.08C

| ORF Name | NTID | AAID | NT Length | AA Length | Score | Probability |
|---|---|---|---|---|---|---|
| 822127_c1_124 | 4167 | 8339 | 233 | 702 | 292 | 1.0e-25 |
| Protein name | | | | | Locus Name | Acc# |
| hypothetical protein BbLPS1.06 | | | | | gp:BBR007747 | AJ007747 |

Description
Bordetella bronchiseptica cosmid BbLPS1.

| ORF Name | NTID | AAID | NT Length | AA Length | Score | Probability |
|---|---|---|---|---|---|---|
| 835942_f1_8 | 4168 | 8340 | 198 | 597 | 398 | 5.9e-37 |
| Protein name | | | | | Locus Name | Acc# |
| | | | | | sp:RFAB_SALTY | Q06994 |

Description
GALACTOSYLTRANSFERASE)

| ORF Name | NTID | AAID | NT Length | AA Length | Score | Probability |
|---|---|---|---|---|---|---|
| 9777211_f2_51 | 4169 | 8341 | 74 | 225 | 347 | 1.5e-31 |
| Protein name | | | | | Locus Name | Acc# |
| | | | | | sp:RL31_ECOLI | P02432 |

Description
50S RIBOSOMAL PROTEIN L31

| ORF Name | NTID | AAID | NT Length | AA Length | Score | Probability |
|---|---|---|---|---|---|---|
| 979528_c3_168 | 4170 | 8342 | 398 | 1197 | 1414 | 1.3e-144 |
| Protein name | | | | | Locus Name | Acc# |
| | | | | | sp:TRMA_ECOLI | P23003 |

Description
METHYLTRANSFERASE) (RUMT)

| ORF Name | NTID | AAID | NT Length | AA Length | Score | Probability |
|---|---|---|---|---|---|---|
| 9803125_f3_66 | 4171 | 8343 | 403 | 1212 | 1378 | 8.3e-141 |

| Protein name | | | | | Locus Name | Acc# |
|---|---|---|---|---|---|---|
| | | | | | sp:EMRD_ECOLI | P31442 |

Description: MULTIDRUG RESISTANCE PROTEIN D

| ORF Name | NTID | AAID | NT Length | AA Length | Score | Probability |
|---|---|---|---|---|---|---|
| 9819130_f1_14 | 4172 | 8344 | 61 | 186 | | |

| Protein name | | | | | Locus Name | Acc# |
|---|---|---|---|---|---|---|

Description: NO-HIT

SEQUENCE LISTING (8344 sequences)

SEQ ID NO: 1 - DNA, 693 bp, Proteus mirabilis
acaaatcgttcaataaataatacgttttttatgcatattaacagtcgtctagataataacgtacttagagatattctgcttgtttcattagcggatgggatcgttggaatatcttatggtgctttagcacatactcaaggtttcgatttttgggtacctctttcgttatcgatttttgttttagcaggggcttctgaatttctatttatcggagtggttgcgatggggggaagcgccatctatgcggcactcgctggtttaatggtcaatgcaaggcacatcccttttagtatggcggtgaaagagttacccggaaaagggattaaatcactattaggctttcatatattaaatgatgaaagtgtggtttttgggttatctcaatcgactgctgagcaaaatagattagcattttgggcttgtggattaggcattttactgatgtggccgttaggtactatgctaggtgtttatttaggctcttttattgttgatataaaaatgcttggtttagatgcgatgttcccagcgattattttggcactaagtttaccggcattgaaaaataaattaacacgaaaagccgctattattggtagtgtgattgccttagcaacgacactgtttctccctgcgggaataccggttttattatccttgttaggcgttttatttgtggtgagaaaaatatga

SEQ ID NO: 2 - DNA, 216 bp, Proteus mirabilis
gaatttttatcaggagtaaaaatgaacgttaatgatcatgttgtagtaaaaacggatggctgtgaagatcgtcaaggaaccattttactgattgaagaatttaatgaaggcattatgtacttggtttcactgcctgaatatccgaatggtatttggttttttaatgaaaaagaaggtggtgaaggcacttttgttcgaccagtacaacaaaaatga

SEQ ID NO: 3 - DNA, 819 bp, Proteus mirabilis
tggtgcgtatcatatatggtgcgtttacaaaatgccattgagccgttatgggaaaatcgtcctaactatgatgtattggcagatatcgctgaaaaattaggtgttaaagagaaatttactgaaggtagaacctaccaagagtggattgagtattgctataaccaagtaaaagcaaataacccagcgcttccttcttttgctgaaactaacgatatggggattgtggatagaaaacttcctcctcgtagcgcttatgtggcattagaagcatttcgccaagatcctatcgccaacccactaaaaacagcatcaggtaaaattgaaatctattctgagaaattaatgcaagacactgaaggttggatcttaccagaaggtgatcgtattccagcaattccagaatattgtaaaaatgaagaaggtgttgaaaatgttaccttaaaagagaagttcccactgcaaatgacgggcttccacgataaaggtcatgtccactctacctattttaacgtcgcaatgttacgtgaagctattccccatcaattttggttaaaccccgttgatgcggcacagcgtggattaaaatctggcgatattgctgagatttataacgaacgtggtcgcttgcatattcgtgtcaaagtgacagatcgtgtattacctggtgtgattgcagtaccacaaggtgcatggcgttcacttgatacaacaggtgtagataccggtggatgtattaatacattaacaagctggcacccatcgccgtttgctaaaggaaatccacaacatactaaccttgttgaagtgaaacgtgcataa

SEQ ID NO: 4 - DNA, 192 bp, Proteus mirabilis
ttattattgtcattttttgactggttgaaagtgtttaaatgcgtagtatattatttacatatgataagtgttgttatgaattgtaatactcttatcaagtcaaaatattattttaataaaattaaaaaaggtgcccatgatattatattttttcatatattattaatgatggcccgcactattataaattag

SEQ ID NO: 5 - DNA, 204 bp, Proteus mirabilis
ttgcacaagtcacctactttgtcggtgtgcttttcgtgctgcattcacttatcgcctagctacaaccctaattatttagagcagattattgtgaacatgttaactcacaatatactggctatgtggttagcaaagtttatgatgataccgcttactgaatttcagcgcatctctttattattgctattctacggcaaaagctaa

SEQ ID NO: 6 - DNA, 360 bp, Proteus mirabilis
cacagggagtccaatatgaggacatttgctataaaccagcataatgatctagtgattgatgctaaaggtgatctgcaaatttgtgataacgatgaagcagtaaaaaacctttgtcagcattttattaaagcggttcgtggagagatgttgcataaaaaagataaaggtattccttattggtcagcaacatttagccgtcaagttgatattcctttatttgaaatggcttttcgacaacgtctggctgaaatcgaggaagttgtggctatcagccattttaatgcctttttagataatggcgtactgaaatatcaggcggatatacgcacaatatatggaggatttacattacatggctga

SEQ ID NO: 7 - DNA, 546 bp, Proteus mirabilis
accatgactttaaaagagttagtgactggtttcggcacccaggtacgcagcatttggatgattggcttacacgcctttgccaaacgcgaaacgcagatgtacccggaagaacctgtcaatgttgcaccgcgttatcgtggacgtattgtattgacccgtgatcctgatggtgaagagcgttgtgttgcttgtaacttgtgcgcagcggtgtgccctgttggttgtatctcattacaaaaagcagaacatgaagatggtcgttggtatcctgaatttttccgtatcaacttttcgcgttgtatcttttgtggcttatgtgaagaagcatgtccaacaacggctctacaattaacccctgatttcgaaatgggtgaatttaagcgtcaagatctggtttatgaaaaagacgatttattaatttcagggcctggtaaatatcctgaatataacttttaccgtaaaacaggtatggcgattaatggcaaagataaaggtgaagcagatgatgaagcgaaacctatcgatgtcaaaagcctgttaccgtaa

SEQ ID NO: 8 - DNA, 210 bp, Proteus mirabilis
tcaaaaaaaccaccaatagatttagttaatagttttttttcaataaaaaattacactttatctcttaaaggtctaattgttaatttttttattttatttttcataatttattgtttaataagaaaaatatttacacaccacgtttacacctctttactttttcttgtccttttttttcaaaaaattgcaaggttaactattgcaaaatga

SEQ ID NO: 9 - DNA, 2256 bp, Proteus mirabilis
actgaaacgccgaggtggtggctttggtttaacaacagcttgtgctgcgggcggattgggtgcagcgatgattttggaggtggaataatggcgactcaacaaaggatacaaacctcatctgagaaatcaccggtattccagttttcagtacgtcccgataaggtcggaattatcaccattaatgttgtagatgaaaaggtcaatacactgaaagctgcttttgttgaacagtttcaaaatgtattaaaacaggctcagcaacattcaggtgtaaaaggattaattatcacatcaggtaaacctgataattttattgctggtgctgatatatcaatgattgcagattgcaaaaccaaagaagaggccaccgcattagcgaaagcagggcaagatctttttactcaattagaaaattatcctttgcctgtcgtcgcagccatcaatggcgcctgtttaggtgggggattagaactagcattagcctgccatgggcgaatttgctccgataacagtaaaacacgtttaggccttcctgaagttcaattaggattactaccaggttcggggggaacccaaagattaccacgtttaataggggttacgaccgctttagatatgattttaactggacgacaaattaatgccaaacgggctttcaagcttggcttagttgatgacgttgtaccacaagctattttattagatgttgcagcccaatggattttaacagctaaaaaagctgctaaaaaacagactattatggagcgtttttgggcaaataccacattaggaagaaatatcctctttgatcaagctaaaaagcgcactttagctaaaaccaaaggtcattacccagcggcagagcgtattcttcacgttattgaacgaggcttagagaaagatattcaaacaggttttaaagaagaagctaatgcgtttggtgaattagccatgaccccggtttcatctgcattacggcatctcttttttgcctcaacagcattgaaaaatgaaacaggatcatctgcaaagccagataacttacaccatataggtattttaggtggggggttaatggggggcggtattgcttttgtgacagcaacaaaaggtaatttacccgttagaattaaagatattagtgataaaggtattgcgcaggcacttaactatagttggaaagcgttatcaactaaggtcaagaaaaaacggctctctgttcgtgaacgccaacgacaaatggggttattatcagggacattggattatagcggtttccatcaaactaaccttattgtcgaagctgtttttgaagatttggctttaaagcaaaaaatggtggctgatattgaagccttaggcgaaggtaagatcatctttgcttcaaatacatcttctcttcctatccataaaattgctgaaaaagcacaatatccagaaaaaataatagggctgcactattttagtcccgttgaaaaaatgcccttagttgaagtgatccctcatgaaaaaacggatgctaagacaatcgccacaactgttgcttttgctaaaaaacaaggcaaagttgccattgtggtaggagataaacccggtttttatgtcaatcgaattctcgccccttatattagtgaagccttaacctgtttggttgaaggggaaacgatagagaatattgacaaagcattagttcaatttggctttccagtcggccccattcaacttttagatgaagtgggaattgatattggtactaaaataacgcctattttagtcaatgagtttggtgagcgttttgcatctcctcctgcggttgatgcgattattgcggatgacagaaaagggcgtaaaaacggtcgtggtttttatctctataatcagcatgccttacctttctctttaggaaaaaataaaaagcgtgcagatccgatgatttatcgcttattacaggttaaacctaaaaatcagttatcggcttcagaaataaccgaacgttgtttattgcttatgcttaatgaagctgttcgttgtttagatgaaaacattattcaacaacctagggatggtgatattggtgctgttttcggtattggttttcctcccttctttggtggaccattccggtatatagatagtatgggaacaacaaaaatagtcgataagcttaatcaattaactgaaaaatacggtgaaaagttccagccatgtgagcgattagcagcaatggccaagttaaatgaacgattctatagctaa

SEQ ID NO: 10 - DNA, 183 bp, Proteus mirabilis
aaagataagttcgagaaaagcattaagacaccaagcaggagtactttcgtactcctgtctcgtttttattgttataatcacctttcatttttatttcgtttatctctattatctatccctaacattttaatttttcatactgtttttttaattagttattattataaattaatttatatttaa

SEQ ID NO: 11 - DNA, 648 bp, Proteus mirabilis
tcaccgtttacatctagtgtctatccactcacaataatctcttcaatcacgctattgggagatattatgagttacttttttgcccacctttctcgtttaaagctaattacacgctggcctctgatgcgtaatattcgccaagaaaatgtctctgagcatagtttacaagtggcttttgttgcccatgcattagcggtgattaaaaatcgtaaatttgatggcaatgtcaacgccgagcgtattgcactacaagcaatgtatcatgatgccagtgaggttatcaccggtgatatgccaactcctattaaataccacaatccacaaattgctcatgaatataaaaaaatagaaaaatatgctcagcaaaaattgattgaaatgttacccgaagagttacaaaaagattttcgccctcttatcgatgagcaattacatagtgaggaagaaacttttattgtcaaacaagctgatagtttatgtgcctatttaaaatgccttgaagagttagctgcgggtaatagcgaatttaatttggccaaaaatcgtttagaaaaaacgttagcagaaagacatagccctgagatggactattttatgaaagtatttgtaccaggctttagtttatcgctagatgagatcagtgagtaa

SEQ ID NO: 12 - DNA, 1104 bp, Proteus mirabilis
attcaccttacctgtgaaaatcagtgctcacttaacccgaggtcaaattggccttccgttagggatggctggcatttcgccatcactggtgggtgtatcggttcgtcaactgcggggtattgcataatgagctggttatctcctgaagttacagagattttactcactgttttaaaagccgtggtgatcttgctggtggttgtcacttgtggtgcttttatgagtatgggggagcgtcgtctactgggattattccaaaaccgttatgggcctaaccgtgtaggttatgcaggttcagcacagttaattgcggatatgatcaaaatgttctttaaagaggactggatcccaaaatttgctgatcgctttatctttaccatagcaccagtgattgccttttcttccttattattgtcatttgctattgtgccagttagctcaacctgggttgtggctgatttaaacatcggtattttatttttcttgatggtagcgggtttagcggtgtatgccgttttatttgctggctggtcaagtaacaataaatattcgttattaggtgcaatgcgtgcttcagcacaaacagttagttatgaggttttcttaggactttctattttaggtgttgtggcacaagcgggttcgtttaacttaacggatattgtcaattcgcaagcccatatgtggaacattatcccacaattctttggctttattacctttgcgattgctggcgttgccgtttgtcaccgtcatccttttgaccaacctgaagcagagcaagagttggcggatggttatcacattgaatattccggtatgaaattcggtctgttctttgtcggtgaatatatcggtatcgttgccgtttctggcttaatagtgacgttattcttcggtggttggcaaggtcctttcttaccgtcattcgtttggtttgcactgaaaacaggattcttcatgatgatgtttattctgatccgtgcatcattaccgcgtccgcgttatgaccaagtgatggcttttggttggaagatctgcttaccgttaactttaatcaatctgttggtcactgctgcagtgatcctctacaacgctcaataa

SEQ ID NO: 13 - DNA, 225 bp, Proteus mirabilis
catggaattacctatttatcttgttgtcgtagtgtcttttatattataaagacgatggttaataaaacgtcactcataaaagcctatcgcattactatgatgacattaatgatacgcatcatgcttagggtaaaaaacttgatgctaattatagttgccaatcatcaattggacgatttttattcaccccaaaatttttgcccgaaaatcggcgaaaagggttga

SEQ ID NO: 14 - DNA, 2712 bp, Proteus mirabilis
gagaacgagttaagcgaaatggataaagattattatagctactggggcaagtttaaatcagaaaataatcatgaatactatcatttgcttccatatcatagtttggacgtggctgctgtaggtatgatattgtttccagaaaactcaaaaattataaaagatatttctacttttttacaaatacacccaaaagaattttctaaactgtttttattattgctttctcttcacgatgttggcaaattttcttcttcatttcaatatattaatccaaatataatagataaattaaaagtgcctgaaagtaggttttcctatgatggaaataattatcgccatgatcgtttaggttattacttttggagaaaaataaaaaatactattttttcatcaataataatatctaacgctgattataaagaaagaaaaatatctgatggtttttggattatttttgaaacagcattagggcatcatggaaaacctattaataagaataatattgatgagtctatagagaattatattcataaagataatgataaagctgctattgattttactcttgatatattaaaattattttctcccaaactttctgtagaaaatttttatgataaaggatggaaagaaagattaaaacaaatatcatggcttcttgccgggatggtaacactttcagattggatcggttcaaatagagattattttccttattataagaaaaaaataccgttatctgaatattggtttttagccttaaatagagcaaaaaaagctgtattatcaagtggttttaatcgaaattatcaaatatcaccttttatttctgttgaataccattttggttataaacctacaccattacaacaatgggctgaaaaagttacaattaatgaacaccctcaattgtttatattagaagatactacaggttctggaaaaacagaggctgcattaacacttgctcatcgacttatggaagttgatgcagctgatggcttttacttcgggttacctacacaagctacatctaatgcaatgtttttaaggataattaatcactataaaaagatattcgatgaaaaaaaagaagtaccaagtattgtgcttgcacacagtgctagtaatatgaatgaacagtttactaaaataattagagatggtaacgagcgatataatattagtgataacaccgcatctgcacaatgttatcaatggttatcagactcaagaaagaaagcattattagcaactataggggttggaaccttggatcaggcattattatctatgttaccaagaagacaccaatctttaagattattaggactaaatagaaaaattattatttttgatgaaatccattcagctgatgaatttatgtttgaaataatagaaaaactattatcaacacatttacatcaaggtggttcagttattttattaacagcaacattatcacttaaacaaagaaaaagaataatagatagctggtttaatgcctttgatcaaatatctcctgaaatagaatcaaaaagctttccattggcaacacatctaacttgttttccaaaagttataaaaaaagaatatccattaaaaagtaggaatcaagtaagtagaaaagttaaagttgaaataataaataaagaagaacaatgtattgatattattattagtgctataaataatggaaattgtgtggtttggataaggaatacggttaatgatgcgataaaatcatattatgatataaaaaaaagattatctaaagataataattgtttattatttcatagtagatttaatttaaaagataggaagatacgagaagagcaagtattaaagtattttggaaaaaatagtaccgctcaacaaagaaaaggcactgtattaattgctactcaagtttttcaagaaagtttagatgctgatgctgatatcatgatttcagatatttgtcctattgatgatcttattcaacgctcaggacgattacatcgacatacacgaacaaaatatggggattacacatcagaaacgattgataaacgtcgacctcctattttatatgtacatgctcctttatttatagagaccccatcaagctgttggttaacagaacaattttcatcaacagaagcagtttatcgttcacctggtcgtttatggttaacattaagaagtttaactcgattaggtgaaattaatatgccaaaagatgcgagaaagttaattgaatccgtctatagtgataatgcttacaatgaaattcctcaatctttaatacaaaaagaaaataatgatataggtgaaaaaaaagccagagtatcaaaagcaaaaattcaattattaaagataactaaaggctatagtgaagaaagttcagaattttggacagaagatcactatgatattagtactagatatagtgatatagaaatggttaatattcttttattaaaaaaaataaaagataattatgttccttggatagaagattctcatttttctattgctttaagtacagttaagatttctaaaaagaaatatgctgataaattagtatcagtaccccaagaggtaattgatacaattaataagcaatatccacaggcacgatatttacaattgtggataccagatgaagatcagtattatcaatatgatcatttaatcggtttttgtgaaagacaggaattgtcatga

SEQ ID NO: 15 - DNA, 1761 bp, Proteus mirabilis
catagatatacaactttatttgttgtgaaaaatgttagggtaatgtcaatgtcaaaaattaaaaataatgtttctatcactgaaatgagccggcgtggcttcattcagtctgcagctgttctttctggcgctgctgctgtagctggaacggtatcattacctttctctgctaatgctcaaacaccccagggtattcgtcctgatgagacgtctgaaaccatcaaatacagtgcatgcttagtgaactgtggtagtcgttgcccattaaaagttcatgttaaagatggcgtgatccgccgtatttccaatgaaaccatgtttgatgactcaacctttggtcttcatcagatccgtccttgcttacgtggacgttccgttcgttggaaaacttataatccagaccgtttaaaataccccatgaaacgtgtcggtaaacgtggtgaaggtaaattcgagcgtatctcttgggatgaagcgacttcgattatcgctgataagctaaaatatactatcgatacctatggtaatgaggctatttattaccaatatggtactggatctaccggagcgaatttacatggtagaacagcctgtaaacgtctattaagtacagtcggtggcttcttaagtgactacggtacttactcttattcacaattaaccggcatcgtcccttatgtgtatggtgatatgctggaatctctgttaacagaaatcgaaaactcagatttggttgtgatgtttggtcataatcttgctgaaactcgtatgtctggcggtggtcagttctatgaaacactgaatgcgttagataagagtaaaagtaaagtaattattatcgacccgcgtcgtactgatagtgtcacaacattaggtgcagagtggatccctatctatccgggtactgatgctgcattagtggctgcgttaggttatgtgatgatccaagagggtatcactgatgaggcatttttacgtgaatattgcatcggttgggataaacaaactctgccagcctcagcacctgaaaatggctcttacaaagactatattctcggtaatggtcctgatggaattgctaaaacccctgagtgggcaagtcaattaaccggaatttccgttgcgcgtattattcaattggcacgtgaaattggtaatgccagagcggcgtggatctcccaaggctggggtattcagcgtaccagtaatggtgaacaagcttgccgtgccattatgatgttgccattaatgtctggtcatattggtcgtcctggtactaataccggatgttggggcggtagcattgaataccctgtcgcaagttttgccataccaaatccagtaaaaacccagatcccaacatttatgtggtctgaagcggttgctcgtggtgaagagttaaccagtaaaaatgccggtgtcagaaataaagataagctggatacgggcattaaatttatgtggtgttactccagtaatgtgattggtaaccagcatgctgatctcaataaaacacatgaattactgcaagatgaatcaaaatgtgaatttattttagtgtgggataaccacatgacaccatcagcaaaatatgccgatattttactgcctgatgtcactactgtggaaactaacgatcttatcaataactcttatgctagtggtgcgtatcatatatggtgcgtttacaaaatgccattgagccgttatgggaaaatcgtcctaactatgatgtattggcagatatcgctgaaaaattag

SEQ ID NO: 16 - DNA, 258 bp, Proteus mirabilis
ctatttgatacagataaaaatctaaccaaactagaacagaaaaaacaagctctcttatttaccctaagtcgttattatgcagtcacagaaatcaatcaatatattgatatgttaaatcaacaattatcgctattagagcagtattggcatacattaatagagcaactgatacaattaaaacgcaatctttccgaggcaaaaaccgtgctctcacctcatcttgtattccttaatcacttttcacaccattatcaataa

SEQ ID NO: 17 - DNA, 681 bp, Proteus mirabilis
aggggcgatacaagtggtgatggtatgaatattcaacagtttgattatcattcagatcttttacaagcgatactttggcaatatgaaaatgccgataaattaaaatcactggctcattttaaggcagattattttcaccaatccaccgtgttattttggcaaaattggtatcgcgatatatttaatattgataccgccaacgactttggtttagcggtttgggggcgtattttagatgtgcctttaggcattgatatttccccaagtgagaaaacaaaaataggttttggctttggtaaaaagaaagctaattttaacgcaaattttcgacgcaataccgattacaccttatcactgacgttagatcaaaaaagaatgttgataagaatgcgttatttcaatctcacccaaagtccgacggtcaccaatattaatcaatttttaaaacgttttttctggcggggtgaaagtaaagtatttgtacttgatccctttgatatgacgtatatgtattacgtttttaattttaatcccgatgaacgcttacgtttattattagaaaacttcgatttaatgccacgtccttctggcgtaggcgtcaaatatcgcatcataactaaaaaagcatttggttatggttcatatcgtaaaaatttcttaaagagtaatttcggagaataa

SEQ ID NO: 18 - DNA, 1041 bp, Proteus mirabilis
acgcagtcaacatgctgcaacataaaatatgacgagtataaactggcgaaggtcagattcagacgaaaaggtccgttaatgagctggattgaaaaaattcttaataaaagcaatatcacgagttcacgtaaagccaatatcccagaaggggtttggacaaaatgtgatagctgtgggcaagtactttaccgcgcagaattagagcgtaatttagaagtgtgccccaaatgtgatcatcacatgcgtatttcagcacgccgtcgcttagaaacttttcttgatacaggaagcacgactgagctgggcagtgagttagagcctaaagatattctgaaattccgcgactctaaaaaatataaagacagaattgctgcggctcagaaacaaacccatgaaaaagatgccctagtggtgatgaaaggtacgttaaaagaaatgcctgttgtggccgcatcttttgaatttgcatttatgggcggctctatggcgtctgttgtgggtgcgcgttttgttcgtgcggttgaacaagcattagaagataattgtccactgatttgcttctctgcaagtggtggtgcacgtatgcaagaagcattgatgtcattaatgcaaatggcaaaaaccagtgccgcattagctaaaatgcaagagcgtggtttaccttatatctcagtgatgaccgatcctactatgggtggggtttctgcaagtttagcaatgttaggcgatattaatgttgctgagccgaaagccttgattggttttgccggtccacgtgttattgaacaaactgtacgtgagaaattacccgcgggtttccaacgtagtgaattcctgctagaaaaaggggcgatagatatgatagttcgccgtcctgaaatgcgtgatgagctagctgaattactggctaagctgactcagtatgatttagcgaaagacgaagatgaactgctaggcgaagaaatgatcgctgatgacatcgaatcttctgacaatgagccagaaattaacatcgaaacgaataaaaaagaagatgtctaa

SEQ ID NO: 19 - DNA, 237 bp, Proteus mirabilis
ctacgggcaactaagtacacaccagcggtaaccatggtggcggcgtggatcaacgcagaaacaggtgttggaccggccatcgcatccgctaaccaagtttgtaatggcagttgtgctgatttacctaccgcaccccctaagaccattaacattgcccagttaatgatgcttgatcctgcggtcagttgttcaggagccagtaccgccatttcgcggaaacttagcgtacctaattga

SEQ ID NO: 20 - DNA, 207 bp, Proteus mirabilis
agtaatagaactcgatctaattttaaacatttgttaattaatttatataagcataaacacttagcgttagagtacttattaaatttaaataaatttccaattattatttactataatttgaattataatttcctttatggattattatttatttatattttttcttgttctcttattaaagataatccaaatagaaaaagaccataa

SEQ ID NO: 21 - DNA, 774 bp, Proteus mirabilis
ccgcttatgactttagcttgtaggcaatataacacgcataacgaagggccatggttagtttggttgcatggactattaggagacagtcatgagtgggagaccgtcattaaggcttgccatgaatatccctcactcgtgattgatttgccccgtcatggtaactctgcctctattggggtaaataattttgtcgagatgagtgcattactccatgacactttaaaagaatacgatattaatcattactggctgattggttactctttaggtggcagaattgcgatgtatcacgcatgttttggtgaaacatcgggattaatgggattgattgttgaagggggaaacccaggtttatatgatgcaatagaaagacaaaaccgtattgcacatgataaacgttgggccgcgcgttttcgcaatgaacctattaatgatgtattaacgcaatggtatcaacagcctgtctttgctgatttaagcgatgaaatgcgtcagttattagttgaaaaacgcagtagtaatgcaggtttttgtattgcggaaagtttagaaacactctctttaggccatcagccttggttagttgcagaattacaacaactcaccttaccctttatttggttgtgtggtgagcaagataaaaaatttcaatcaatagcgcagcaatattcgctgccattaacgactatcccgcaagctggtcataatgcccatcaggcacagcctgatgcttatgctgcggtgataaaccatgtattatccctctttggttaa

SEQ ID NO: 22 - DNA, 1770 bp, Proteus mirabilis
atagttatgacgataaaacagacaattgggataaaaaaaatcgctagtttgagcttattactgctcttttttctactctcttcttctgcggttgccaaagagtggactattggtgtgttagcgttgcgaggcgacgcctcaacccaaagacattggcaaccgcttatcgataccttagatcaacaaatacccacagatagctttctgctgttaccacttaacttgtcagaaatgaagcaagcagtggcagacaagagagtagattttctattgaagactccagcacaatttgtccagcttgatagtgcatatccgctacgttggttactctctttacgctcgggttatgagcctgataacacaacaagaaatgtgattggtagccttattttggtgcgcaaagacagcgcaatcacatcgattcatgaattagtcggaaagcgtgttggcgccattgcaccagatgcctttggtggatatctgttaggttacaaagcactgcgtgaagaagggattgatcctgaacaggattttacattacgttttagtggttttccggctgatgcgttactttacttattacgtgatggcgatattaatgcagcgatcatcccagtttgtttattagaaaatatggataacgaaggtcttattaataaagaagattatcgtccattattaaattattctaccaatacttcttgtttaaccagtactccgctctatcctaattggtcatttgctgcattagatactgttcctgacacattagtggataaagtggcacgaacattactcaatgatgaaagcgacgccatgaaatggggggctcccgcttctcattctcaagtggaaaatttactccgagaagtcaaccaacacccaaggcagcgacaactttggcaagatgcgaaaatttgggctatccagcaccgttttattatcggattatcattgggtgccattatcttactggttttcaaccaaatctggattagttatttggtcagaagacgtagccatcaattagaacaagcgcatatccatttaagagagcaaaaagaggcattagaacaagctcagcgtttaaatattttaggtgaaatggcgtcaggctttgctcatgagcttaatcaacctctttctgcgatcaaaagttatgcccaaggtagtgctatccgcctagaaaaagagaacaaaaatcatccattactccccgcattacgacagatagaccaacaagcccaacgtggcgcagatattattcgcaatctacgtttatgggtaggtaagcaatcagcaaatagtgatacagtgccactgtcagaacaaaatattgcccaatgtattgaacatatttggcggttattacgtattgatgaaaaatatccacaagtgactctgatcactaagattgataaacatgataccctatacttacctgaaacattattagagcaaatattatctaatttgatcaccaatagcctacaggcgggtactaaagtgctacagataagcacccataaagcgccagataggttgttaattgtgatcaaagatgatgcgggaggaatgagccatagccagcttgaacaacctttctccccttttcaaaccaccaaaacagaaggtcttggtttaggtttggtgatttgccaacgcttattaaattcacaaggtgctgatattcacatagaaaatcaaaaagataagcaaaataatgttggattaaaaatcacccttattttccccaataacaataattag

SEQ ID NO: 23 - DNA, 1476 bp, Proteus mirabilis
ttcgccatgacaataactcctgaacaattgatcgcaatgctaccgctgttagtcgtcatcttgacggtggtggttgtgatgctgtccattgcgtggcgacgcgatcactttactattgccaccttgacagcaactggttttatcatcgctctcggatcactttactacgttaatgcattaggcgtagttgatgtgaccaccctctaccatgtagatggttattccagctttttcacggcattaactattattgctggtttaggcacggttgcttttgcttatccttggttggaaggttatcaagataataaagaagagttttatatgctggtggcgattgctgtcattggcggtattttactctcttctgcgcaccacttggcgtcaatgtttattggtattgagttattaacattgccgttatttggtctgattggttatgctttccaacaacgtccttcactggaagcgagcattaaatatatgctgctttctgcggcggcctcttctttcttgttatttggtatggcactactttatgctgaagcaggaaatctctcctttacggcgatggggcaaagtttaagtgatagcaatatccataaaccattagtacttgctgggttaggcatgatgttagtgggaattggttttaagctctctttattcccattccaattatggacaccggatgtataccaaggtgcaccagcaccaacaggtgcatttttagcaacagcgagcaagattggtatatttgcggtagtgatgcgcttattccttgaagcaccggcggcggatagcgaaacattacgcatgatcttaggctttatggctattgcctctatcctgtttggtaatatcatggcgctgactcagaagaacgtaaaacgtttactcggttactcttctgtctctcaccttggttatttactggttgcattaattgtcttgcaatatagccctatactggcacaagaaaccgctgagatttatttagcaggttatctctttgcaagtttaggtgcatttggtgcgattgctgtggcttctagcccgtacaataaaggtgaattagagtctcttgaagattatcgtgggcttttctggcgtcgtcctgttgctgccgtcgtgatgtcattaatgatgctatcactggcaggggtgccaataacattaggctttattggtaaactgtatgttattcttgctggtattgattcaagtttgtggtggttaacaggcatggtagtgttaggtagtgcgataggtttattctactatctacgtgctgcagctatcgttttcttacgcaaactagataacgataatgcaccagcggttacgaccacatcacaaaatatggcaacattaattactttagtttgcgccattatcgtgattgtattaggtgtatggccacaaccattgattgagctgacacgttttgcaattattgcacctgcgataaattaa

SEQ ID NO: 24 - DNA, 1803 bp, Proteus mirabilis
atagaaatgaccgatcagatagcgcaaaatagcgcacggccagcgtgggaaaccagcgatcatattgatgatcaggtggttaacgaactgcgtcagaaatttgggccagatgcgtttacattccagccgactcgtaccggcatgccagtggtatgggttaagcgggaacaacttattgaggttatgcaatacctcaaatctttaccaaaaccatatgtcatgctgtacgacttgcatggcgttgatgagcgtgtacgcacgcatcgtcaaggcttgccggcagctgatttttccgttttctatcatctgatatcactcgatcgtaataaagatatcatgctgaaagtcgcattaagtgaaaaagatcttaatctaccgactctcacttctatctttccgaactcgaattggtatgagcgtgaagtgtgggatatgtttgggatcgtctttaacggacaccctaatctacgccgtattatgatgttgccgaattgggaaggtcatccactgcgtaaagattatcccgctcgggcgacagaatttgatccttatgtgctgactaagcagaaagaggatctggaaatggaatcactgacctttaaaccagaagagtggggaatgaaacgcggtactgagaatgaggactttatgttcttaaacctcggccctaatcacccatcttctcacggtgcattccgtattattttgcaacttgatggcgaagaaatcgtcaactgtgtacctgatgttggttatcaccatcgtggtgcagagaaaatgggcgagcgtcaatcatggcatagttatattccttataccgaccgaattgaataccttggtggttgtgttaacgaaatgccttatgtactggcggtggaaaagcttgccggtattgaagtacctgagcgcgttaaagtcattcgtgtcatgctgtctgagctatttcgtattaatagccatttactgtatatcagtacctttatccaagatgttggtgcgatgacaccggtattctttgcctttactgatcgtcaaaaagtttacgatattgtggaagcaattaccggtttccgtatgcatccggcatggttccgtatcggtggtgttgcccacgatttaccaaaagggtgggaacgcttactacgtgaattcttagattggatgccaaaacgtcttgattcttacgttaaagccgccttgcaaaacagcattttaaaaggccgtaccattggtgttgcctcttataacgctaaagaagcgttagattggggggtaacgggtgccgggcttcgtgctacaggggttgagtttgacgtgcgtaaatggcgtccatactcagggtatgaaaactttgagtttgaaattccagtggcaagcaatggtgactgttacgatcgtgtcatgctgaaagtcgaagaattacgtcaaagcttacgtattctcgagcagtgctataaaaatatgccagcagggccatttaaagccgaccatccactgacgactccgccaccaaaagagcgcacattacagcatattgaaaccatgattaaccacttcttacaggtttcatggggccctgttatgcctgcgaatgaatcattccagatggtggaagccactaaagggatcaacagctattatttaaccagtgatggcagcacgatgagctatcgtacgcgtattcgtacgccaagttttgctcacctgcaacaaatcccagcggttatccgcggtagtctggtttctgacttgattgtctatctgggaagtatcgattttgtaatgtcggatgtggatcgttaa

SEQ ID NO: 25 - DNA, 1365 bp, Proteus mirabilis
tcgctgatgacatcgaatcttctgacaatgagccagaaattaacatcgaaacgaataaaaaagaagatgtctaatatcataactgctcctcaagccacatcgcctttgtcggtgtggctttcttatcttgaacacttacactcaagtgctattgatatgggacttgagcgcgtgggcaaggtaggtcaattactgaatgtattacgtcctgcccctaaagttatcactgtatcgggtactaatggtaaaggaaccacttgccatatgctcgagtcaattttgatggcttcaggattgaaagtgggggtttatagttcacctcatcttgtccgttataccgagcgtgttcgcattcaaggtaaagagctttcaccagctgatttttgtcaagtatttgctgaaatagagcaaaccagaggcgatatttcgctgactttttttgaatacggcacactcgccgcattgaaactatttcaacaagctcaacttgatgtggttattcttgaagttgggttaggggggcgtttagacgcaaccaatattgttgatgccgatattgcagctatcaccagtattgcccttgatcataccgattggctaggggctgatagagaacatattggtcatgaaaaagccggcatcttccgtaaaaatcactatgctgttgtaggcgagccagatatgccactgtctattgcacaagtcgcgcagcagaaacaggctaaattatttcgtcgtggtgttgattggtcattttctattgatggtgatcactggcattggcgtagtgcagataagcagtttgaaaaacttcccatccccaatattcccttagccaacgcaggtacggcaatggcagtgatacgctgcttattgaaaagcgacgataaagtgagccaagggatcacccatcaaagtatcgttgagggaatgagtaaagctcagttgccgggacgttttcagataatttcgcagcatccattagttatttttgatgttgctcataatccgcatgctgctgggtatttagccgaaaaactggcgcaattaccgcgttattctgataccaaagtgcgcattgttgttggtatgctgggtgataaagatattgcgggtacattagcgtgtttatcccctcaagccgatcagtggtatgttgcaccattgaatgagtttcgtggcgcatcagctcaggtattagctcagcacctcgactatccggcagtatttgatagtgtcgagcaagcatggcaacaagcaatatctgaggcgcaaaaaaatgatattgtggttgtatgtggatcattccataccgttgctcatgtaatggaactattggaaaaggagagtgcgagtggcaagtaa

SEQ ID NO: 26 - DNA, 351 bp, Proteus mirabilis
cttaatttttttacctttatgggtattcgcctgttgtattggcggttatatgccgtagtacacgtttttattggggtcttttctatgttttttcaagataaaaataatattttgggtatacctaaattgccaccaagagccatgatttttctggttccgtttttcctatcttttgtgatgtgtggcattgtttcttttattagtacagcaaaaacaatgggtttaaatagccttatgtttgcaccttggttctcttcatggggggtatcttggatgattgcgtttccaaccgttttattcgttttaccctttgcaagaaagctatcactcttattagtaaaaccacattaa

SEQ ID NO: 27 - DNA, 201 bp, Proteus mirabilis
ctttgttttgccaaaataaacagagacacacggctattttctgttagtatacaggcgggtgcttggatcattttggttcaagcatttgcaaggaccaaaaagacgaaagccccgaattctatttacataaaattcgaggcagtctcaagccatcaacaacttgattctgtctcctttaacaaggagtgtcaagagaaatga

SEQ ID NO: 28 - DNA, 2838 bp, Proteus mirabilis
ggtggttatttgcgatatctttcgtcatttaaaacgtcattaaaaatttcccgctacctttttcgtgcactgggtatcatgttgtgggcaatgggcgcattattaaccatgttttatctcatcaacatctttaatgatactaaatcagatatccgacaagaatatagtaataactataccgatttattgggcttctttcgccaaacctcgagtactatccgcgatttgcaatatttagcagagcggcatcaagagcaactcaatttaaaccctaagatgaataattcttttttttatgaagggcctttttcacttcataaattaagtgaaagtgccgattgtgaattattcaaagggcaaacaaacaattattttcgatcatttaatagtattctgtattactggaaagataatacccctgctttacaaggtatcaaccaagtatttatggttggctctcatagtatgtgtatgattaatttcccattgcgtgcatcacctattgatactgaactgttgaaaaaaatggtttatgaaaatacacgtaattacattaatcaacgagctcaagggaaagagagtaatcaatactggatagtacctgatgccaagggggatagcggtatcctctatgtcatgtcgccagtttatgcgtcagggaaatttattgcactcattggtatcgaaagggcgatccgattggagtatttttcacctacgaaagatcgcgttatctctattcatcttttaaacaataaaaataatccagtcttaagttatcctgaagagaataattatcgcagtgtaagggatgtaccggatgttagtgctccttactttggctttgatgatgattttagtgatttagttgcaaaacgtaagctacttccttcttcttttagtgtggtttattcactaccattaaaacaaattttaaatgaatttaagtttactatttttaatgccattattttaaatatcatttcggcgattgttatctttattttcgtttggatttttgagcgaaaaatattttcacctgcagaaaataatgcttcacgcttagaggagcatgagcagtttaatcataaaatagtcgcgtcagccccagtaggaataagtatcttaagaatacgcgatggcatgattattttaagtaatgagctcgcccataattattttcgcttattaagtcatagtgataaacaaaatattctctctattattgctgaaaaaagtagcaatatagtggatgtggtcactaataatcataatcatttgcaaattagttttgtgaattcacgttatcagaatgaagatgtggcgatttgcgtattagtggatatcagcgctcgtgttaaaatggaacgctctctacaaaatatggcaacggccgcagaacaagcaaaccaagctaaatcaatgttcttagcgacagtcagccatgaattgcgtacaccactgtatggcattattggtaacttagaattattacaatcattgacgcaaaatgaagagactgccagattattaaaaacaatggataactcttcatcgctgctactcaaaattatcagcgatatccttgatttctcgaagatagaatcgaaacaattaaaaattgacgttaagccattcaattgtcgccaagttgtctcttttgttatctctaactatttgccgttaattgctaaaaaagatttagctatttactgctttattgagccggatgtacctaaaatcgttaataacgatccggttcgtgtccaacaagttatctctaatctactaaataatagtattaaatttactacgacaggatgtattactttgcacctgtatcgagatgaatattatctctatttcgatattcatgataccggcagagggataaatgaaaaaatgcttcatcagctttttgaacccttctttcaggtctcgcaaaatacagaaagtgcttcagaaggtacaggattaggattagcgatttgtgaaaaactgattaacttgatggatggtgatatcagtgttgtttctcaagaaaatgtaggtagtcgttttactgtgcggatccctttatatggcgcactaaattcgagtgatggacaaaccaaatataatctctataaagagagtactattcgctgctttatcagtattaaaaatctgtatctagaaagctttgttgaacgatatttaagttatgtgggcttacattgccaattattcacggaagtgactcaggtctctgagaatgattttattatcaccgatcatgatgaatgtttagataagtcttgccaatttatccgtatttatgaacactattttgagcctgcaaagaaaatctctgagaataattggttatgcagtacatataaattaaatgaattaattaagattatcctacaattaccacaaacaaaattagagtctgatgactcagaaaataacgcgttaatgacggatcacgatctacaattattgacagtgctcattgttgatgatcaccctatcaatcgtttattgttgaccgatcaactgaaaaaaattggttttaataccgcaacggcagaagatggctgtgatgctttagcctttatgcaagaaaatcatgtcgatattattttaaccgatgtcaatatgccaaatatgaatggttatcaattagcgacaacagtgcgtgaattgagtcgcactattcctattattggtgttacagcaaatgcgattgccgaagaaaaacaacgttgtattgatgcgggaatgaatgattgtgtttccaagccagtctctcttactgtattaaaagacgtattactcacctatgtggcataa

SEQ ID NO: 29 - DNA, 1089 bp, Proteus mirabilis
tgcatttgtgcagccattagttggacaagggcaacccgcattatggcaggaggttcactcatgatttcatccgtttcgcaaattcaagaagtgatagcgatcccccaagaatacttttggttaccttgggcagtgcaatatttcttttttatcggcattgcgtgttgcgcaacactttatgcatgctggcaatgttggaaagggcgtacaggtaatcctcgtttagaagctgttgcggtttttattgctgttacggcggggatcaccgcccctttagcattaaccgctgatctccatcaaaccgcacgtgtttggcatttttatgcttatccaactccttggtcgtggatggcatggggatcactattactgccactcttctctgcatttagtattttgtactttattgccatggtcgtgcgtttagtgtggaaacgtgaatataagttaacgcgttgggttgctttagcctgcgccttaacctcgataggtttattgctctataccggccgtgaagcttctattttaaaagcaagaccggtgctttatacctactggctgccgatattactgttttttagtgccatgcaagtattgcctacgctattagcattaggtacgcgacgagagcctgtgtatcagcgtgaactggctatgtggtttatcggatctttaatgttacttgctgtatgtacaggtttttggattgcgggggatactatttcaggacaagccattaggcaacaattggcaataggaagtttaggctggtggagtgcgataggggttattgccttatggatagtgtctgttgctatgggcggattaatggcaaaacaggcacgctcagtggcatttattactgtaatggcttttatttcaatgggattggcgtgggtattacgttggctaatgttaatgggaagccaatatattcccaaatataacattattaccaatccttatcagttcccgctgggtaatgatggattattagcgattgttggaacatttgggctttggatagcgttaaccattatattcagagaaagtattcgttgggttgtcaggagagtacagcatggctaa

SEQ ID NO: 30 - DNA, 897 bp, Proteus mirabilis
aaaattagtgcaggagcagttttactgatgaacgaccaagagagtgctgatgtgatagcgcagtcaatcagtgagcctgcgattgtggcagaaagtacaccattaaagatagcgctaggcattgaatatgacggtagccactattatggctggcaacgtcaaaatgaggttcgtagtgtccaagaaaggttagaaaaagcgttatctcaagtagcaaatgagcctatctctgttttttgtgccggcagaactgatgccggagttcatgcaaccgggcaggttgtgcactttgagacaacggctcatcgcaaagatgcggcatggacgatgggggttaatacccatttaccacaagatattgccgttcgttgggtaaaaacggtagcgaatgattttcatgctcgatttagcgcaaccgcaagacgttatcgttatgtgatttttaatcatcgctatcgtcctgctattttatcctcaggggtaacgcatttccattaccctctagatgcacaacgaatgcatcaagctgcccaatgtttattaggcgagaatgattttacctcgtttagagccgtacaatgccaatctagaacaccttggcgtaatgtgatgcatgtgaatgtttcacgctatggtgattatgtggtggtagatataaaagccaatgcttttgtccatcatatggtaagaaatattgtggggagtttattggaaattggctgtggtaatcaggctattacttggatggctgaattattagccttaaaagataggactaaagcagcagcaactgcaaaagcaaatggtttatatcttgtttcggttgattaccctgaacgtttcgaacttcctaaacctgcaatggggccgctatttttagcagataacccattttaa

SEQ ID NO: 31 - DNA, 192 bp, Proteus mirabilis
ctcaactacgctcctcaaattagacacttctactctaatttggggagtttttttataaaattaaaatataaatgcaaagttctatatagagatacaccacagatattagaaataaagaaaataggtctcacagactatgttctgaaagtgacaataaaaaatgatatcatagaagcgaaatttacgagataa

SEQ ID NO: 32 - DNA, 1212 bp, Proteus mirabilis
atgaagcgcgcagtgatcacgggtctgggtattgtttcgagcattggtaataaccagcaagaagtgctggactctttaaaagaaggccgttccgggataactttctcagaagaatttaaagagatggggctacgtagccacatttggggtaatgttaagcttgatactgaaggtcttattgaccgtaaaatccgccgttttatgagtgatgcatcggtttatgcctatttatctatgcaacaagcgattgaagattcaggtctaacagaagatcaagtttctaacattcgttctggtttagttgtcggctccggtggtggttctcctcgtaaccaagtacaaggttcggacggcatgagagctaaaggtctacgcggtgtaggtccttatatggtaactcgtgcaatggcgtctggtgtatcagcttgtttagctacaccgtttaaaattaaaggcgttaactattcaattagttcagcttgctcaacatcagcacactgtattggtcatgcggttgaattaattcaattaggtaaacaagatgtggttttcgccggtggtggtgaagagctaagttgggagatgacctgtgagtttgatgctatgggggcactttcaacaaaatataatgatacaccagccaaagcttctcgtacctatgataaaaaccgtgatggtttcgttatcgctggtggtggcggtattgtggttgttgaagaattagagcacgcattagcacgtggtgcgcatatctacgctgaaattgtcggctatggtgcaacatctgatggtgctgacatggttgctccatcgggagaaggtgccgtacgttgtatgcaaatggcaatgcaaggtattgatcatgttgattatatcaatactcatggtacatcgacgcctgtgggtgatttaaaagagcttgaagcgattgctgaagtttttggaactaaaacaccggctatttctgcaactaaggcaatgacaggtcactcattaggggctgcaggtgttcatgaagccatttacagtctactgatgttagagcatggttttatcgcaccaagtattaatattgaagagcttgatgataaagcggatggtatgaatatcattaccaaaccaacagagcaaaaactagatacagtgatgtcaaatagctttggtttcggtggcactaatgcttcacttgtgatgagtaagtataagaaatag

SEQ ID NO: 33 - DNA, 681 bp, Proteus mirabilis
ataatgtatttatcaaggatctcaatagactattctgctgattatttacactcactattagcgaataagttgccggacggatatacaattcatcagttattatggcggttgtttactgaagaaaaagaacgctcatttttgtatcgattagaaataggaaaaaatggtaaacctattttttatattctttcttctatagctccaactactaagaataatttttttaaaatagaaactaaaccttttttacccaaattagttaaaaaaatgaaattagccttttcattaagagcaaatccaacggtttgtattactgataaagaaggaaaacggcagcgtcatgatgttcttatgcatgctaaaaaacaagctcaacttgatggaaaagattacagtcatgatgatattcatcatttaatgcaacaagctgcattaaattggattagttctgatgatcgtttaaataaatggggtatttcattaactcagttacctgatattaaagcttatacacctgagcgtattaaaaagccttcaggaaaaataatgtctttttcttctgttgattatcaaggtgttctaacaatcgaagaacctcatttattttggcaacaatatcagcaagggtttggcagagcaaaagcgtttggttgtggattgatgcttatcaggaatatttaa

SEQ ID NO: 34 - DNA, 1431 bp, Proteus mirabilis
gacagtatggcaacagtagttaattttacacaatggccgtggcatcactgggcgcagcttaacccaaatgaaacggccatcatattcggtgattcacctataacatggcaacaattaagttgtcatattaatcaattggcgaaccatttagcgaaacagggtgttaatactaaaagtaccgtgttgctacgtggtaaaaatcatatccatgttgtttttacgctacttgctgtttttcaatgcggtgcaaaagtattaccgttagatcctcagctccctaagtctctacttgatgatttattaccccatttaaacatcgatttttatgctgatttaagtggatcaacacttgagttagatgcgaggttactcgatctttcaggtgtcgaattcaataacaaatcacatcaagataaaaataacatggcaggtgttgcatggacatcttctcgtatggcaacactgatcttaacctctggatcatcaggtttacctaaagccgcagtacatacttttcaagctcatctttgtagtgcagaaggtgttcttgaattgataccctttgaaaaaagcgacagttggttattgtctttacctctctttcatgtatctgggcaaggaattctttggcgttggttattacgaggcgctaccttggtagtgcgtaatatgcacccctttattgctgctttgcaaggctgtactcatgcttctttagtgccaacgcaactttggcgtttattacaaaatacacaacaggatagttcgcagcccatcacattaaaagcggttttattagggggagcgatgatcccaactgaattaacccaatgcgccgaaaataaaggtattcagtgttggtgtggttatggcatgactgaaatggcctctactgtttgtgcaaaacgcgcagatggtaaagcgggagttggtacgccattaaagggtaaagcggtcagattagtggataatgaaatccagatcaaatctgatagtgttgcattaggatattggtttgatggtcaattaaagccgttatcacagactcaggatgattggtatgcaacacgggatagaggttgttttaaagagggggaatggtgcattttagggcgattagataatctgttttttagtgcgggtgaaggtatacagccagaagatattgaaaaggtgctaaatagtcaccctaatgttcgccaaacatttattgtcccgattgacgatattgaatttggtcaacgtcccgttgctgttgttgatactgatattgagacaattaatcaattaccacaatggtatcatacgcgtttagcaggctttcaacgtcccatcgcttgtttactattaccagaacagctaaagagtggagggatcaaaatctctcgtaaacaagtgcaacagtgggtgaaagggcaacaagtaaattga

SEQ ID NO: 35 - DNA, 1029 bp, Proteus mirabilis
tattgtctttttttattatctaacgctgatttatcacgatcttcatggcaaactacagactttctatttcgtcagatccgtcagaggacaacagttttggatatcacagcaaaagaagaagccgtagctgatttaagcacgatcttagatatgttacgttgggctatgagtcagtttaattcatcagatatttattatggtcatggtacggataacgcatgggatgaagcgttacagcttgttctacctacactggctcttcctttagatattcctgatgctcttttatcaaccaaacttacaacctctgaaaaaatggaaatcattcaacttattgaggttcgtattgaacaaaaaattcctgtgccttatttaacgcatcgagcgtggttttgtggacatgaattttatgttgatgaacgtgtcttgatccctcgttctcccattggtgaattgattaataaccattttgctggactgattgggcaagagccaacccgtatccttgatttatgtactggcagtggatgtattgctattgcttgcgcccatgaatttcaagaagcagaagtcgatgcagtcgatatttcagctgatgcgttagaagttgccgagtttaatattgaaaatcatggtttaattcatcgtgtttatccaatgcaatctgatctctttgaggcaattgttcctacaccatacgatattatcgtgacgaatccaccttacgttgatgctgaagatatgggtgacttgcctgatgaataccatattgaacccgaacttgcattggcttctggtgtggatggcttagatatcaccagacaaattttactaaaagcacctgattatttaagcgaaaaaggcattcttgtctgtgaagtcggtaatagcatggtgcatcttatcgaacaatttcctgaagttccttttacttggcttgagtttgaaaagggaggcattggtgtctttatgttaacgcgtgagcaacttgtcgaattttcagatagctttgctagcgataaacgttga

SEQ ID NO: 36 - DNA, 744 bp, Proteus mirabilis
tcctctaatttaataattcattattcattcacgaaaaggaagagtaaaatgaaaaagaaatttctctattttaccttactagcggctatatcaacatcagcgctagctgtaacaccttcggctcaattacagatcaatggggatataaaaccgccaacttgtacaatcaatagttctaacaatacagaagttgtctttgactatggccgcatatcgccaagcttgataccacaatcttcaaactatcaatatgtggatatgaaaccagaaacaagcatcagtattgaatgtgatgctaaaacttatttgacgtttatacctactgacacatatggtgatgtagatcttgattataatactagttttgatagtgcttggtttcgcttagttgataaagccaacccagataaagctgttggggcttcattttttaattggaaagatgcaactgttgacggaaaaacggcttttataagccgagcaacacctaaaacagctgaagtaggggtatctgtcttagttaaaaataatattcatgggtggacatcagagcaacaagaggatgtatccgccgcatctcttaaattagtctcaggtgaaatctttaccacaaaatttataccaggaatatcatctcatacatttattctttctcgtgataagctagctaaaaaagcgatagatattagtaatggactcgattttattggtgaggccgtattaacattctctttcggtgtttaa

SEQ ID NO: 37 - DNA, 546 bp, Proteus mirabilis
gaaacaaatttgcaacattcatcttttaaggtatttacaatgaatgtattaaaagacattttagagcgtgatttagcacgtattaatgccgcagaaaagcgtgatggcaaaccacactttaatagccaatttttaaaaaatcatatttggctttgcgtcagtatggtgttgtcatatttattactggccgctttgcttatttactctccttactttggggtcatttcgctgactcttttcactttgatgtttattgtgatggcaggaatactgctatttgatatcaaacctatttataagtttgatgatatcggcgttcttgaccttagagtttgctataacggcgaatggtatacttttgaaaaattatctgatgaagcgattaatgagatacgccagcacccggctatcccagcgcaaataaaagaagacatcaatgacattatacgcacaaaacaagagatacacttttatgacgtgtatttaatcgcattcgatcccatcaccaaaccgatttcgtcagaaaaattatcaccccaagtctaa

SEQ ID NO: 38 - DNA, 792 bp, Proteus mirabilis
atagtgacctatgctctgattatcataggacagttagcggagaacattatgaagtatcgcctgtgcggtgttgctcttttagtagctttactttcaggatgtgcaagcacacctaacaatggtgacagtcgttctgatcccttggaagggtttaaccgccagatgtttaattttaactattatgttttagatccttacgtattacgacctgtagccgtagtatggcgtgattatgttccaccaccagcacgtaatggactatcgaatttcttaggtaaccttgaagagccagcaagtatgctaaatagcatcttacgtggagattttgaaaaaggggctaagcatttcggacgtttttggatcaataccgtatttggtattggtggtttaatcgatgttgcaggaatgtctagagaatcaatggaaaaagaagttcctgtaaggtttggtagtacgttagggcattatggtgtgggatatggcccttatgtggtattaccgggctatggcagctttacagtgcgagaagaggggggcgattgggctgatgccacctatccagtactgagttacctcactttctggatgtctgcgggtaaatgggcccttgaaggtattgaaacgcgagctcaattattagattcagatgcaattttacaaaactcatctgatccatatttaatgatgcgtgaagcctatttccaaaaaaatgatttcgatgctaatggcgggaaaacaggtgaaaatccaaacgcaaaagcgattgaagatgatttagattctatcgattaa

SEQ ID NO: 39 - DNA, 1512 bp, Proteus mirabilis
tctatctcgtatttaaggataaatatgtctattaaacaaacacgctatgttgatattgcgagtgcggtgattggtgcctctactgcaccaatgcgtaaactgaccgcacgtattttttcaacaaaccctaaaattccagcagggaaagtactcgaatttacttctggtcaagttgatgcgtttctgggagctgattctccagaagcgcaatttgcccgccaatattttagttatgtgagtccggctcccgtcagcaagcctaaagagctacaaattgcctcttatgagccaatgggacgagcgccaacactctttggtgggccggttgccacactggataaattaaagctgattgaagagggtgagttaacgctggtgattggcgatgtgaccaaaaaaatcagcaagctctctcttcaagacgtgacgtcctatagtgatattgcatctttaattcaagcaaaactcaatgctgaaagtgagccacaatttgccagttgttatgtgacttttaatgctatggatagtgctttcttaatcagcggcggtgtgcaagaaaaagcgcagattagcgtcaacaactcacctcttgctgatgccttagggttaagtcagggacaaacttctgagggtaatgcatcacagactgcccttgaagcctttatggctgcagaagctatttctgactcatttggtagtgcaacatttttaaccgaactatctattgagcaaagtgtggaactggctgaatacgtagcaggtgaaaatgtcaaataccaactttatttatcggtgccagatcaacaagctgaaatgtacagcaaggcattaatgaatacagcatcgacagggttgaatttaaaaaccgaggaaaacttttttgtgcaagcgttgcctatggcgattatggcagcaacagattttgagcgtactaatgccaccaccaattacatgtatcgacaatttggtattacattcccatcgcaagttaccacagatatggcggccgatcgcttagataaattgcgcgtgaactattatggtgaaacggcggtatctggctctgagattagtttctatcaacgtggctttttatgtggtaatggtgctaatccagtagatatgagcgtacatgccaatgagcaatggctaaaagcgtatattgcacagcagtggcttagtttactactgtcaacgcgcggtattcctgcgaataaagatggtgaagcaagagcgatgatgatcattgctggtgcagtaaccaaggcattaaacaatggcactattcaaacgggtaaggcattaacagaagtacaaaaaatcgcaattacagatgcggcaggtgatgatttagcgtggcacgatgtacaaaacaaaggttattggtacaacgctgaaatcgttgaacaaacagggccagggaatttaccggaatacaccatgaaatatgtattgatttacggtaaaggcgattgggttcgtaaagttgaaggctcacataatttagtttaa

SEQ ID NO: 40 - DNA, 534 bp, Proteus mirabilis
tgccatgctctctccaataatttctttggagaattaatgatggaaatgacacacgcacaacgcttgatcctctctaatcaatataaaatgatgactatgatggatcctgataacgctgaacgttatcgtcgctatcagacaattattgaacgtggttatggattacaattacgtgaattagaccgcgattttgatgagatgtcagaagagacctgccgaaccattattaacatcatggaaatgtaccatgcattgcaagtttctcgagaaaatttaaaatcaccagaaatgccggatgctcgtcgagtggcatttatgggctttgatgcagcaacagaatctcgttatcttagctatgtacgctttatggtcaatactgaagggcgatatacgcattttgatagtggtagtcatggttttaactctcaaactcctatgtgggagaaataccaaagaatgctggctgtttggttagcctgtccacgtcaatatcacctaagcagtgttgagatccaacaaatactgaatgcgtaa

SEQ ID NO: 41 - DNA, 1128 bp, Proteus mirabilis
tttttgtctcattgcttatatagcaggaggctttgcatgagtttattatttacgcctaataaattaggacctcatcaattagacaaccgtattattgttgcaccaatgtgccaatattctgcgcaagatggaatacccacatcttggcatacaatgcactatgggcaattagcattatcaggtgccgctttagtgattatagaagcgacggcggtagagcctcgaggtagaattagttataaagatctcggattatggtctgaggaacatggtcgcgcattaaaacagcttattagcgatataaaacagcatactaatgctaaaataggtatacagttggctcatgcggggcgaaaagcatcaacatcgttgccatgggaaggtggaaaatcattggctcctgatgatgagaatggctggcaaaaagtagcaccttctagtattgcttttggtcaatatcatcagcctcaagcattaacaattgatgagattgaaaagataaaaaacgcatttgttgaagcagctaaaagagctgagtcagcaggtattgatgttattgagatacatggtgctcatggttatttactgcatgaattcttatcaccattatcaaaccatcgcaccgatcagtatggcggtgattttaataatcgtagccgcttgttaattgatgtttttactgcagtcaaaaaagcagtctctgacaaaatgtgtgtgggagtaagaatatcagcgactgattgggttgaaggaggatgggatctggaaagttctatcgcattaactcaacatcttgaagatctcggttgccactatattcatgtttcttccggtggcttatcagacaaacaagccatcaagctaggacctaattatcaggttccctttgctcaagccatctataatgaaacacaattacccgtgattgcggttgggttaattacagagccagagcaagcagaagctattttactgactgaacaagctgattttatcgcattaggcagaggaatactttatgatcctcgttggccttggcatgcggctgaaaagttaaagcagaccattaaagtcgctccgcaatatttgcgttgtgcgccacatggtagtaaagatttttttaaatag

SEQ ID NO: 42 - DNA, 606 bp, Proteus mirabilis
gttaaaaatcagtatactttagagatgatatttcttatcaatttatataaggtggttatcgctatggttccttaccaacccgtattaaccttttggtttgaagaatgtaccccaaaacagtggtttcaaaaggatagcgcttttgataaagaaattaaggatagatttggtgagctatgtattagcgcaagtcgcgcagagcttgcctcttggcgcgagagcattgaagggcggttaggggaaattattattctagaccagttttcacgtaatatttggcgtgatacaccaaaggctttcgcccaagataatatggcgttaattcttgctcaagaagccattcggttacccgaatatctcaccctgacaccagtaaaacgcaaatttctgatcatgccatttatgcattcagaatcacaaaaaatccatcaagatgccattgcgttgttttcacaattaaatgatgacgacacttatcaatatgaattacgccataaagagattatcgataaatatggtcgttatcctcatcgtaatgaaattttagggcgtacttccacagcagaagagttagcgtttttacaacaacccagctcctcattctaa

SEQ ID NO: 43 - DNA, 735 bp, Proteus mirabilis
aagccatgtcagattaaccagcggcaaacatccgcagcagtaataagcgaggcattaaaaatggattatacgctcacccgcatagatccgaacggtgagaatgaccgttatcccctgcaatcacaggaaattgtcagtgacccgttagatgctcacgttcatcgcagcgtgtatatgggaaaactggaacatgcgttacatgacgttgtgaactggggcagaaaaaactctttatggccatataattttggtctttcctgttgttacgttgaaatggtgacgtcatttactgcggtccatgacgtagcgcgttttggttctgaagtattacgtgcttcccctcgtcaagctgactttatggtggttgcaggaacctgctttacaaagatggcgcccgttattcagcgtttatacgatcagatgttagagcctaagtgggttatttccatgggagcttgcgctaactctggtggtatgtatgacatctattcggtagtgcaaggtgttgataaattcattcctgttgatgtgtatatcccaggatgcccacctcgtccagaagcttatatgcaagcattgatgttattacaagagtccattggtaaagaacgtcgcccattatcttgggtggtgggcgaccaaggcgtttaccgtgtcaatatgcagtcagaacgagaaagaaaacacggtgagcggatcgcagtaaaaaatctgcgtactccagacgaaatttaa

SEQ ID NO: 44 - DNA, 1038 bp, Proteus mirabilis
aaaatgagtcaatttattcaattacatattttaacttcttatgctccttctaatttaaatcgtgatgatttaggacgacccaaaacagcgataatgggaggatttgaacgtttaagaataagttctcaaagtttgaaacgtcattggcggacatcagagttatttaatattgctctttctggtaatattggtattcgtactaaaaaatttggtttacagctttacgatgcattaattgaaggtggggtttctgaaaaaaatgccaaaaagtgggttgggttaattatagaacaatatggaaaaataaagaaagattctattgaaacagaacaacttgttcatattagccatttagagaaatctttggcatttgatttaattaatttacttataaaagagcaaagagagccaacaaagcaagaattagagagtttaaaaacaataaatacctcagtagatattgcgttgtttggtagaatgttagcttcagcaccgaaatataatattgaagctgcttgccaagttgctcatgctattagtgttcatagtactgttattgaagatgattattttacggctgtcgatgatttaaataatggtgaaacagatactggctcagcacatattggtgaagcaggatttgctgctgctcttttttatagttatatctgtattaataaaacgcaattaattgagtctttagacggtaatgaagagctggcaaataaagcaatccaagcattaactgaagttgcgattaaagtttctccaacaggtaaacaaaatagctttgcttctcgtgcttatgctagctatgttttggcagaaaaaggaagttatcagccacgctctttatctgttgcatttctaaaaccaattgatgatgaagatatggaaaatgcggctattaatgcattaaagtttagaatggagaattttgacaaagtttatggtacttgtgcagagtctcgctatcaacttaatgcagtacaaggggaaggttccctttctggattattacaatttgttgcagagtaa

SEQ ID NO: 45 - DNA, 603 bp, Proteus mirabilis
cttgattgtctatctgggaagtatcgattttgtaatgtcggatgtggatcgttaatcatgcaaaatgaattaaaccataaagaggatgccgcgaagattgaaatcgttgatgtaactcattcaaagaaaaacacgtttgttttaacgcaagaagagcgtgctgaaattgaacaagaaaaacatcactatgaagatccccgtgctgcatcgattgaagcgctgaaaatagtgcaaaaaaatcgaggttgggttgaagacggtgctatctatgctattgccgatgtgcttggtataccggctagcgatgtagaaggggtagcaaccttttatagtcaaattttccgccaacccgtcggccgtcacattattcgtttttgtgacagtgtggtttgccatattacaggttatcaaggcattcaggcagctattgagaagcacctcaatatccttcctggccaaacaacaccagatggtcgttttaccttactgccaacctgttgtttaggtaactgtgacaaaggtcctactatgatggtagatgacgatactcacagttttgttaaacctgaagagattgaaacgttactggagcagtatccatga

SEQ ID NO: 46 - DNA, 1548 bp, Proteus mirabilis
cctctccgtctggctgatgaggatcttttcatgtgcggtattgtcggtatcgctggagttaatccagtaaaccaatcgatttatgatgcgttaacggtgttacaacaccgaggtcaagatgcagcaggcattgcaacaattgatgagaataacggttttcgtctacgcaaagcaaatgggctggtgaaagatgtctttgaaacgcgtcatatgttgcgtttaaaaggaactatcggaataggacatgtacgttatccaaccgcgggcagttcgagtgcatcagaagcgcaacctttttatgttaactcaccttttgggatcacacttgcacataatggtaatttaaccaatgcgcatttgttgcgtcgtcaattatttgaaactgctcgtcgacatatcaataccacctcagactccgaaattttactcaatgtgctagcgtatgaattagatcgcttcgatcattttccgctagagccagataatatttttaccgctgttgcggctatgcataaaaaattacgtggcgcttatgcttgcgttgctttgatcatcggtcacggcttattagcttttcgtgatccttatggcattcgtcctttagtgttaggcaaacgtactttagaagatggacgcagtgagtatatggttgcgtctgaaagtgtcgctctagatacactaggatttgaattcttgcgtgatgtagcacccggtgaggctgtttatatcacagagcaaggacaactgtttactcgtcaatgtgctgaaaatccgcaattagtgccttgtctatttgagtatgtttattttgcgcgtccagactcttttattgataaaatttccgtatataacgcccgtctacgtatggggcaaaaactcggcgctaaaattgctaaagagtgggaagatttacaaatagatgtggtgatccctattcctgaaacttcttgtgatattgcattagaaattgcccacatcttaaataaaccttatcgacaaggttttgtgaagaatcgttatgttggacgtacttttattatgcccggccagcaagagcgtcgtaaatcagtacgtcgtaaactaaatgccaaccgtgcagaatttcgcgataaaaacgtgttacttatcgatgactctatcgtacgtggcacaacatcagagcaaattgttgagttagcgagagaagcgggggctaaaaaagtttattttgcctcagccgctccagaagtgcgtttccctaatgtttatggtattgatatgcctaatgccaatgaattaattgctcatgggcgtgaagtggatgaaatacgtaaactgattggtgctgatggacttatttttcaagatctctctgatttaattgccgctgttcaagaagaaaatccagatatcaaccaattcgaatgctctgtatttgatggtgtctatatcacaaaagatattgatcaaggctatttagattaccttgaaaatttacgtcgtgatgatgaacataaaattcgtgatcaacatgaagctgagaacttagaaatctataacgaaggctaa

SEQ ID NO: 47 - DNA, 555 bp, Proteus mirabilis
atgtcagcacatcattatcagcagttaattgatatttttaatcaatgttttagcgatagttaccaaacacgtttagttaaaggtgataacgagccaatttacttgcctaagagtgaagagataccttatcaccaaatcattttcgcacatggattttacgcgagtgcattacatgaaatatcgcattggtgtattgctggggatgcgcgtcgtcagcaggttgattatggttattggtattgtcctgatgggcgagatcaagtgactcaagagcagtttgaacgagttgaaatcaagcctcaagctcttgactggttattctgccaagcagccaattatccatttaacgtgagttgcgataatttagacggggattttgagccagaccgttaccagtttagaaacaaggtgagagagcaagtattagcttatttgcgcgataaaaatatcccgccacgtgcacagctatttattaatgcgttacatttgttttacaatacacctgagttaacgccggagcaatttccttatcaggaaaatcccctcgttaattaa

SEQ ID NO: 48 - DNA, 468 bp, Proteus mirabilis
tttaaggaacaaacaatgaacgatatttcagcaacaggcttaagccttattattcaagcaagtaaaacatttccagcgggtattccgatcaccaccttttctgatgaaggtgatcctttagatttaccgacagttaatattacacaaacagcggtagatattaatggtaatttggtcagttggtcttcaccaacacctcaaacggtcaccattaatgtgttagcgggaagtgaagaagacgaaaatctagctattttgtttgatgctaatacggcaagacggggacgacgtcctgccagtgatgtgattactttagtcgcttcttatggtgatggctctattaccacggcacgtaatggacgtattactggcggttgccgaggtaattcagtcgcaggggtaggacgccttaaatctaagcagtacacttttattttccaagattttgaccgtgttagagcgcgttaa

SEQ ID NO: 49 - DNA, 1260 bp, Proteus mirabilis
tttatgcagcagcaactgcttacatggatacgtcagtttaatgaagagtacgctcaaatcacttctctgttacttgttttattgatcatttttgttgttgctcttgttctccactttattttgcacaaacttgtgctccctaagctttcaaaagctatcagtaaatacgatcaaaagtggcaactctcttttgaaattaataagttattcagtcgatttgcctttcttatccaaggtgtagtcattaatatccaagccttattatggatgggacccggtaagacacaggagatattaaccaccacagctcaagcatggtgtttacttttcggtttattgatgattttctcaattatggatctctgtttgcagatcatgagaaattccccttcttttggccgattaccccttagaggtattttccaaagtttaaaattagtcgccagcgtgctgattggtatcatgattgtttcattactgatcggtaaatcaccgcttattttattaagtggtttaggtgccatgactgcggtgttgatgttggtgtttaaagatccaattatgggacttgttgccggtattcaactctccgccaataatatgattagcttgggtgattggttagaaatgcctaaatatggtgctgatggtgccgtagtggatattagcctcaccacagtaaaagtacgtaattgggataataccgttacgaccattcctacttattctttaatttctgattcgtttaaaaactggcaagcgatgacacaatcaggtgggcgtcgaattaagcgcagtttatctcttgatatcaatagtatttactttttagatcaagagaatattgataaattagaaaaggcacagcttcttgaaccttatataaaaagcaaagtaggtgaaatctccagctataacgctagcctttgtcatgagcatcaaatgccacttaatcaacgtggtatgacgaatgtcggtacatttcgcgcttacgtggaagcttatctaaaaaatcatccgaagatccataaacagatgaccattatggtaagacagcttgccccaacctctgaagggctacctatcgagatttatgcctttaccaatacaaccgtgtgggtagagtatgaagctattcagtcagatatttttgatcatatattcgctattcttcctcagtttggtttacggatacaccaatcaccaacaggtagcgatgttagagcattaaaattccctgccaatatcgacacaccatag

SEQ ID NO: 50 - DNA, 621 bp, Proteus mirabilis
ctcatgaagcaatatggtttttattttgactccactaaatgcactggctgtaaaacctgtcaagtcagttgcaaggacgaaaaagatttagatttaggccctaaattccgtcgtgtttatgaatatggcggtggtagctgggcaaaacaagacggtatctggacacaaaatatttatagttattatttatcaatttcttgtaaccactgctctaaccctacttgcgtggcaggttgccctactggcgcgatgcataaacgtgaagaagacggtttagtggttgttaatcaagatgtttgtgttggatgccgttattgtgaattacgttgcccttatggcgcaccacagtttgatgaaaagaaaaaattgatgtcaaaatgtgatggttgctatgagcgtgtcgcccaaggtatgaaaccggtctgtgttgaatcttgtccacaacgtgcactggattttgatgatattgaagtgatcagagcgaaacatggtacagagtgtggtatcgcaccaatgccagatccaagcttaactaacccaaatatcgtgataaaagcacataaagatgcaaaaccttctggtgataaaaccggctcagttcaaaatgcggcggaggtataa

SEQ ID NO: 51 - DNA, 921 bp, Proteus mirabilis
acaatgattaatgcaaatcgtccgataatgaatctcgacctcgatctgcttagaacgtttgttgctgtagcagatttgaatacttttgcagccgctgcggccgctgtatgtcgaactcaatctgcagtcagtcagcagatgcaacgtttagagcaattagtcggcagagaactctttgcccgtcatggtcgtaataaactgttaacagagcatggcttacaattattaggctatgcacgtcaaattctccgtgctaatgatgatgcaactgcttcattaacatatagcgatgctgaaggtgagttacgtattggtgcatctgatgactccgtcgatacactattaccatttttgttaaatcgtatcgcatcagtatatccacgtttagcggttgatgtgcgtattaagcgttctcaatttattgagactatgcttgataaccacgaaatcgacttagcattaaccactgcacgtattggacatcatccacgcacagcgttacgtacagcacctgttttgtggcattgtgcccctgatttccaattacaaatgaatgagcctattcctttagtagtcatggacgaaactaacccattccgtcagttggcgacaaatacactagatgacgcaggtattcaatggcgtattgcgtatgaagcggcttctttatctgccgttcgtgctgctgtaaatgccgaagtggggatcacagctcgtccattagaaatgcaaaatgctgatttacgtatattaggcgaaagcgaagggttacctcgtttgcctgagactcagtactggttatatcgtaattttgatgagcaaaacgaagctgtattaacggtattcaatgccatcgaaaataagaaaacgccttatactgtcacttcagttgaagaagcgcattctttagatttagagtaa

SEQ ID NO: 52 - DNA, 222 bp, Proteus mirabilis
tgtggctctaacagtagcggtgtattattttatcccaattcgacaaagccaactgagactacttgtcaaatgcccttccttttacttcctcatttctctactgcaatagttagtttaaaaagacaatatcgcgaaaggcgcaatagaaaaagtcaactaagcgttataagtatgaaaataattataaaacaaagagatagatataaattcaaacgttcttaa

SEQ ID NO: 53 - DNA, 1689 bp, Proteus mirabilis
tcaatgtctaatagttcgtttaatcgccaatgggctaaagttatactggaaactttgactcgtcatggtttacgtcatatctgtatcgcacccggatcacgttcaacgcctttaacgcttgcggcagccgccaatcataaacttatttgtcatacgcatttcgatgagcgtggtttaggtcacttagcattaggtttggcgaaagccactcaacagcctgttgctgtgattgtcacctcaggtactgcagtggcaaacttatacccggctttaattgaagcgggacttactggtgaacgggtgatttttctcacggcagatagaccgcctgaactgattaattgtggcgccaatcaggctatacgccaacaaggtatttttgccagccatccctcagaaacactctctttaccacgccctacagcagatattcctgctcgttggctggtttctacattagataatgccatgaataatcttgtgcatggtgctttgcatgtaaactgcccttttgcagagccattatatggtgatgatatagagcatgacacaccatggacacaagcattaggaaagtggtggcaaagtgataaaccttggttacaagaaacgctttctccctctgtgactacacaccctcaatgggatcgactacgtcagaaaaaaggggtagttattgctggacgtatcagtgcgaaagaggggattgccgttgccaaatgggcctcacaattgggatggcctctgttaggtgatgtgttatcacaaacaggacaaccactaccttgtgctgacttatggctaaataatccacaagttaaggctgaattaaaccaagcagaaatagtgatccaatttggctccagtttaacaggcaaacgcttattacaatggcaagcgaattgctcaccgcaaatgtattgggtgattgatgctattccgggacgtttagatccggggcatcatcaaggggagaagtttaccttatccccgagtcaatggttaacggcacatcctgctattgataatttaccttgggcgttgtcattaagtcatattgctacacaaacttatcaacatgttactgaagtaacagactattttggtgaagcacaagttgctcatcagttagatcatctacttcctcacaatggccagctttttgttggcaatagtttaattgtgcgcttaattgatgcttttgcacaattgccacagggctatcctgttatgagtaatcgtggtgctagtggcattgatggattactttcaacctcagcaggtgttcatcgagccactcaaaaaccgacgttaactatcttgggtgatttatcggcattatatgatttaaatagtttggcactacatcaacaagtctatgccccaaatgtggtgattatcgtcaataacaatggtgggcagatattctctatgttaccgacgcctatggcagagcgggagcgtttttactgtatgccccatgctttaaattttaaacatgctgctgccatgtttggtttagattatgttgcaccaaactgttgggatgatctgtttactacagtgactgcatgttggcagggggaagccaaaacaacattaattgaattgattgtcaatgaaactgagggtgctgaaaccttaaatcagttggtaaaacaggtaaccgcttatgactttagcttgtag

SEQ ID NO: 54 - DNA, 1278 bp, Proteus mirabilis
gcgcgctataaggagcctagtatggactttttccgctttctaatgagcgatgtgctttcagagcctgctatattggtgggtttaatcgcattgattggtttaattgctcagaaaaaacctgcgacagaatgtattaagggcaccgttaaaaccattatgggttttgttattttaggtgcaggggcaggtttagtcattaactcgcttggtgatttctcaacgattttccaacatgcatttggcattcaaggtgttgtacctaataacgaagccattgtctctattgcacaaaaaagctttggtaaagagatggcactgattatgttctttgccatgttaatcaatatattaattgcacgcttaacaccgtggaaatatattttcttaacgggtcaccacactttatttatgtcgatgatggtcgcggtgattttggcaacagcgggtttagaaggggcggtattagttgcagtaggttcattagttgttggggtatcaatggtatttttcccagccattgcacatccttatatgaaaaagatcactggctctgatgatgtcgcattaggccatttctctactatttcctatgttgtatctggttttattggtagtaaatttggcaataaagcgcattcaacggaagagatgaatgtacctaagagtttactctttttgcgtgatacgccagttgcgatcgctttcaccatgggcataatttttattattacgtgtttatttgccggtgacacttttgttcgtgaagttagtggtggtaaaaactggtttatgttctccttaatgcaatccatcacctttgcggcaggtgtttatattatcctacaaggtgtacgtatggtgattgcagagattgttcctgcatttaaaggcatttctgataagttagttcccaatgcaaaacctgcgcttgattgtcccgtggtatttccttatgcacctaatgccgttttagtcggttttctgagtagttttgcagcgggtgtcattggcatgtttattctttatgctttagattggactgtgattatacccggggtggtacctcatttctttgtgggtgcaactgcaggcgtatttggtaacgccacagggggacgccgaggtgctattttaggtgcttttgctcaaggtttattgattactttcttacccgtatttttattacctgtacttggtgatattggtattgccaataccacatttagtgatgcagacttcggtgtgattggtattctattagggattattgttcgttaa

SEQ ID NO: 55 - DNA, 192 bp, Proteus mirabilis
cactctcataagaatcatcttatttatctaattatttgtatactagctaactttctaattaaaagcttacaatcagaaaatagaaagagccttattgtcgaaatgagctgggatatgttgttcattattctcaggaacatcaaccataccccccataacatcctcaaagaagttacctatattaatgcctaa

SEQ ID NO: 56 - DNA, 666 bp, Proteus mirabilis
gcagactgtaaaatatacgctattgaatatcaccttattgcggaggtttttatgatcgatctttattatgcaaacaccccgaatggccaaaaaattacgcttttcctcgaagaagtcgccatgccttatactttgcatcatgttgatattggcaaaggtgatcaatttaaacccgaatttttagctatatcacccaataataaaattcctgctattgtcgataatgctcccgctgacggtggtgagccactctctatttttgaatcaggtgctattcttatctatttagcagaaaaaagtggcaaattacttagccatgatctgcgagaaaaaatgacccaactgcagtggctattttggcaagtggggggatttggtcctatacttggacaaaatcatcactttacccgttacgcccctgaaaaagtaccttacgcaattaatcgttatacaaaagagaccgagcgtttatatcaggtgttagagagccgactcgctcaatctccttatcttggtggaaacgattatagcattgctgatatagccacctatacttgggctcgttaccatgacacacaccatattgatctagcagattatcctgcggtagaaaaatggctaaatacaataagccaacgtccagcagccaaaaaactgtttggttag

SEQ ID NO: 57 - DNA, 897 bp, Proteus mirabilis
aaagttatcaaggttaatacaatttatcacggaggtaaaatgtctgagattgtgtatttaaataaccaatttgtacctaaagaacaagctaatatctctgtttttgatcgaggtttcttatttgctgatgccgtttatgaagttaccgccgttattaacggacaattaattgattttgaagggcattttcaacgtttacagcgctcttgcaaagcattatcaatgcctttttctttaaccaaagagcaattaaaagagatccacgggcaattgatagataagaaccatctgcatgaaggacttatctatttacaagtcactcgtggcgccgattcatcacgtttttttgatttcccgtcttcatcagtcgctcctacattggtgctatttgttcaacactcaacggtggtaaatcatcctaatgcaagcaaaggaatttctgtcgtaagtgttgaggatattcgttggcaacgctgtgatattaaaacggtggcattacttgctgcatgtctagctaaacatcatgcgcatcagcaaggtgctgatgatgctatttttatcaaagagagttatatcaccgaagggagttcaagcaatttctttattgttaatcagcaagatgaaattatcactcgcccattaagccaagatattttaccggggatcacgcgacaagcgattattcagttagccaaagagcaaaaactcaccatcattgagcgtttatttacactcgaagaagcgaaacaagccaaagaggcttttattagttcagcgactaccttaatttggccggtgatctccattgataatgaaaaaataaatcaaggtaaggtaggggcgttatcacaacgcttaagagagatttatcttgagaaagccggtgtgaaaccatag

SEQ ID NO: 58 - DNA, 273 bp, Proteus mirabilis
ctaaagttaaataacagagttataaaaaggatcgttactatgaaactgaaaactattttaccgatttgtgccgcctctttctctttactgctattagcaggttgttcatcgccacaaaaaattgaaaccgtcgatgggcaaaccattttgaccacagataaacctcaagaagatgagtctaccggattaattatttataaagatgctgaaaccggtgcaatcaaacaaattaatcgcgatcaaataagaagaatggttgagcttgatgattaa

SEQ ID NO: 59 - DNA, 555 bp, Proteus mirabilis
agaacgctaaaaatgaacaaaaaattcatattacctccttcagaaatagaattatttcaggagatgataaaaggcaccaaaaagctcccacaagataaaatacgccaccaaacaccgcgaaaaaaagtgactcattatccaacagagcgattacagcaagagcaaatagatgcttcttactatttctccgatgagtttcaacctaacttggcaacagaaggcccgatgcgttatttaagagaaggggcaaatgcgtacgagctaaaaaaattgcgtcgtggtgattatgtaccagagttttttttagatttacatggattaacacaattaatcgccaaacaagaaattggtgccttaatcgcggcctgtagaagagagcatgtgtattgtgcctgtattatgcatgggcatggtaaacatattttaaaacagcaaacccctctttggttagctcaacaccctgatattattgcttttcatcaagcaccaaaagagtggggaggtgatgctgcactattgctgttagtcgaaaatgatgatattgcgcgtcgttaa

SEQ ID NO: 60 - DNA, 321 bp, Proteus mirabilis
ttttctataaaaccaaaaggatctttatttattttgcagaacaaatttatttatacaaaaaataaaaaagcagtcacttattataagcaactgcctttatcatttatacaaggaaatctaagtataactaactatttcttatacttactcatcacaagtgaagcattagtgccaccgaaaccaaagctatttgacatcactgtatctagtttttgctctgttggtttggtaatgatattcataccatccgctttatcatcaagctcttcaatattaatacttggtgcgataaaaccatgctctaacatcagtagactgtaa

SEQ ID NO: 61 - DNA, 1068 bp, Proteus mirabilis
agccgaataaatctgatcacgatgataaaaacacgtaaacgccgaaatacaggtcgcgtcactttacaagaagttgctaaacatgccggagtcggttcaatgaccgtatctcgcgcattgcgtacgcctgaattagtgtcggataaattaagagaaaaagttaaccaagcagtggcagagttgggatatatccccaatgcctcagcaggggccttagcttccgctcaaagccatattattgctgtactactgccctcttttactgataaagctagtgctgattttatgcaatcattgcagcagatcctcagccgtcatcattatcaaatattagtgggatgttatgaatatcagctccataaagcgactgatgtaattaatatgctattacagagtaaccctgccgcattagttgcctttggctcccaattaagtgatgtacagttcttacatatcagtaatgccaatgtgcctgttgtcagtgtcgcgagtcaatctaatgagcaatctgcaataagtattgattgcggttatgaaaaagcggcatttgatttaacccattatttaattcagcaaggtaaacgttgtgtcggctatgttggtgcgctacaaggacaacgtttacaccaccagcaaattaccggctggtcgcgtgctttattaaaaaattatttaaatgctgagcaaagtgttactacgcccgaccccgcttctatggcatatggtcgacaagcattaacagagattttattacgtcagcccgaactagatgccgttatttgtagccatgagagtattgctttgggaatgatgtttgagtgccaacgaagattaattaaaattccccaagatctcgctatcgcctgcttagaaggctctgaaaatagcgcccaaatagcaccttccctgacatctatacattttaattaccataaaataggtaaagaggcaggtaagcacctaattgcactattgcaacatttacgtgatgaggttgataacgctatgtttgaaaataccgttatcaactatgcttatcgtttagaactcggacaaagtaccccttag

SEQ ID NO: 62 - DNA, 624 bp, Proteus mirabilis
  unsure (14): Identity of nucleotide at the above locations are unknown.
caaggaataaagtncagtgcacccgctgtctggaaatggttaaatggtgaatccgttcctgactcaacaaatattttagccttaagtcagtggctagatgttcgagctgaatggttagaatatggcagaggcgccaagaaaaatgatggcatttcagttaatgaaataatgcctgttaatgattgggataatagtactcctatagagcgagatgaagtggagatcccattttattcaacaattgaattggccgcaggttttggcagttgtaccactgataatcaaaaggtggaattattgagattctctcgttctacatttaatcaatatggtgtacagccaagtgatgctgttgcttttaaagtgcatggcgatagtatgtcaccggttattcctgacagctctattgtaaccatcagtacagggcatactaagattattgatggtggtatttacgctattcagcaaggtgacttgttaagagttaaaatcttgcaccgcctacccaataataaaatcattattcgtagctataatacgattgattatcctgatgaagaatcaaccttagaagaagtaaaaatcttagggcgagtttttaattggtcggtgatgggctggtga

SEQ ID NO: 63 - DNA, 192 bp, Proteus mirabilis
  unsure (121): Identity of nucleotide at the above locations are unknown.
cttaatgaaaatatcgatagcattaaaaaggtgaggggaaaaattgatctggattattttatattaaataaacaggagaaatttaatataaaagttggtaatgtttgcaacggatacttgnattactttatattttatactttgattttcttgccttggtttttatttataaaaactaggggagcaaagtga

SEQ ID NO: 64 - DNA, 333 bp, Proteus mirabilis
gaggtagaaaaaatgcaagaaataccattacaagccattcctaatcaacgattttctgtagcaatagccagtgtgaattggcaattaacgcttaaagtggctaatcaaaccatgttttgtgatatcgagcgagaaggcgaaatacttattacaggaatgcgccttgttgctaatacaccgataattccttatcgctatttaaatcagggaattaatttaatgtttttaacagagcatgatgcattaccttggtatgaggaatttaccaagacgcaatcattagtgtattggagtgaggaagatggatcttcgacgaataaggctcggaattga

SEQ ID NO: 65 - DNA, 306 bp, Proteus mirabilis
gaaataatgaaagaaaatccagatctatgggaacaaatatgcattgttctttattcaatgaaagagcaaggtatatcagccttactcgctgggggaatggctattcttcgaagtttatataacgcaggaggatggaaaaaaacttttttagatggactgatgtgtgcaatgtttgcttggtttatcaaagatattctccttttatttagtattaatcatcaatttgcttacttagccagtgtctttattggttatgtaggcattgaacctgtaagcaaacttcttataaggaaaaataggagttaa

SEQ ID NO: 66 - DNA, 1236 bp, Proteus mirabilis
ggaagaaagaagatgtctttagctattcgatatcttgcgttattaccacttttcgttattactgcttgccaacagcctgtaaattataatccaccagcaactcaagtggctcaagctcagcctgctattgtcaataattcatggattgaaatttcacgaagcgcactcgactttaatgtaaaaaaagtccaatcattattaggtaagcaatcctctctttgtgcagtgttaaaaggagatgcttatgggcatgatttatcgttagttgccccaattatgatagaaaataatgtgcaatgtattggtgtaacaaataaccaagaattaaaagaagtacgtgatttaggatttaaaggccgtttaatgcgagtgcgtaatgcgacagaacaagaaatggcacaggcaaccaactataacgtagaagagttaattggtgatcttgatatggcaaaaagattagatgctattgccaagcaacaaaataaagtcattcctattcatttagcattaaattcaggtggcatgtctcgtaatggtttagaggtcgataataaatctgggcttgaaaaagcaaaacaaatttctcaattagctaacctaaaagtggttggtattatgtctcattatcccgaagaagatgctaataaagtaagggaagatctggctcgttttaagcaacaatctcagcaagtgttagaggtgatgggattagagcgtaacaatgtcacattacatatggcaaatacctttgcgacaattaccgtgcctgagtcatggctggatatggtacgtgtgggaggtattttttatggtgataccattgcgagtacagactataaacgtgtgatgacctttaaatctaacattgcttcaattaattattatcctaaaggtaatacggttggttatgatcgtacttacacattaaaacgtgactcagtactagccaatattcctgtaggttatgcagatggttatcgtcgcgtttttagtaatgcggggcatgcattaattgctgggcaacgcgtacctgttttaggaaaaacatcaatgaataccgttatggttgatattaccagtcttaacaatatcaaaccaggtgatgaagttgtattttttggcaaacaaggtaatagcgaaattaccgcagaagaaattgaagatatcagtggtgcattgtttaccgaaatgtcaattttatggggagcaaccaatcaacgggtattagttgattaa

SEQ ID NO: 67 - DNA, 1149 bp, Proteus mirabilis
aatttaattgaggaagctatgtcttataccactttttcacaagttagaaatgatcagcttcaggagcccatgttttttgggcaacctgttaacgtagcgcgttatgatcagcaaaagtaccctatttttgaaaaactaattgaaaagcaactctctttcttctggcgtccagaagaagttgatgtttctcgtgatcgtattgactacaatgcgcttcccgatcacgaaaaacacatttttattagtaatttaaaatatcaaactctgcttgattcgatccaaggtagaagccctaacgtggcatttttacctttaatttcgattccagaattagaaacttgggtagaaacatggtcgttttctgaaaccattcattcacgctcttatacccatattattcgtaatatcgtcaacgatccgtcggttgtttttgatgatattgttgaaaatgaagagattttaaaacgtgctcgtgatatctcatcttattatgatgagttaatcaatttaactaacctttaccatatgtttggtgaaggtacgcatcaaataaagggtaaaactgttgaagtgactttacgtaagctcaaaaaacagctttacctatgcttaatgagtgttaatgctttagaagcgattcgtttctatgtcagctttgcctgttcatttgcctttgcagagcgcgaactgatggaaggtaacgctaaaatcattaaattgattgcccgtgatgaagcattacacttaactggcacacagcatatgctcaatttactgcgttcaggtcaagatgatcctgaaatggccgaaattgccgcagaatgcgaacaagaatgttatgacctatttgttgaagcagcagagcaagaaaaagagtgggcagaatacctattctcagaaggctctatgatcggtttaaataaagagatcctttgccaatatgttgaatatattactaatattcgtatgcaggcagtaggacttaaattgccgtttaaagcacgttcaaaccctattccatggattaatgcttggttagtatctgataatgtgcaagttgcaccacaagaagttgaagtaagctcatatctagtaggtcaaatcgactcacaagtagatactgatgatttaagtaacttcgaactgtaa

SEQ ID NO: 68 - DNA, 336 bp, Proteus mirabilis
tatttttatgaggaaacgatgatctatctgcattctggtggcggtgactccgctaaacaacaaagagttaatcaagccgcaacagataaagcgcaacaaattgcccaagatcagcaatctttactctataccatctcctcagcgagtgattttccgacgacggttgaaaatatcggcgctattttattaattgagcccagtattgaattagctctagaggtgtgtcgccgttatcaatcatcaatagagatagtgatggctgaaagtgcaatcacgggggcaaagttgactgtatgccaaattgaatttgaagtgataaaaatttgtgttatttaa

SEQ ID NO: 69 - DNA, 924 bp, Proteus mirabilis
aatatttatgataaggataacaatacgatgaaaaatttctttaaaataagccttattgctagcacggtattggttttatctgcctgtgatcaacttgatttagataataaaaaagataagttttattacagtaatcccagtgaaaaaagcatgagctttgttgttgatgataaaacatatcaggttgagccgggtaaaagtggttatttaacactctcaccgggcgaacatagtttacaagatagtgcaggtaataaatccacttttatggtgtatgaaaacaacaatggtggaattttaaatcctgataattttatgtattaccgtttatctgaagtctatgctgtacaaggtaagggagatcgctttaaaccaacagaatataaagtggttattaatggctatcagttagaaatgccattacaaagcacgaatgctaccttgattgatggcaatgtatttaaatgtacttatacgttaggtgaacctttccccagtgaaattaaaagccataataaaaacgaaatggggaacatcaaaaccaaatgttttgataaacctgaattaatccaatatattatgactgattatggtcaagatctaaaaccactttcccctcaagatgagtataacgatactgttaatctagcgttagactacagtttacctcaaccacaatttactgatcctgatattcaagcagaggcagaaaattgggttgcattgcttgatcaaattaaagaaagtaatgatcctaatatccataaacagcttaaaacaccattacatgaagcaataaataagttatcaaaagccgatagtgaaagagcagtaaaaaactctgttgaagataataaatactataattcttttattcaccaagcgagccaatatcaatcttatgggatcttacctagagattaa

SEQ ID NO: 70 - DNA, 780 bp, Proteus mirabilis
accatgcatgaacttcctcttgtcttttttactgttttaggctctagcgcagcaggtctgtttctgatcgcttatatcagtaaaaagttaggtcaaattgatgaacaacaactgcgtaatgccaatattcttgctctgatattaatgcttgtgggcttaggtattggtggattacacgtaggtcagccactacgctttttcaatatgttattaggcgtaggccgttctccaatgagtaacgaagcttttctaagtggtgtatttactggttttgcttttgcaacagtggcactcactattatgaaaaaatggcggggattacgtgaaatttgtaatctatttaccgttatttttggtttagcttttgtttggtcaattccgcaagtttaccatattccaacaattgctaactggaatacagattacaccacgttacagttttggatgacgctattaattggcggtggagtacttgcaatggtcagtggtgcaagacgtttaggggcattgtcctttattatcggtgccataattacctttgcagcacgctccggttatgtcagtttcctaagctttaatggcccagaattaagtgctgagcaatcactgttttggggtttccaattagcagtattagcattaggtattgtggttgtcgggtttagtgcattaaaagcgcaaacctcaaaagtgaccttagcaacttgtgccgcagcggtcgtaattgctgaattatccggtcgcattgccttttataacttatggcatataaccatgtaa

SEQ ID NO: 71 - DNA, 420 bp, Proteus mirabilis
tgtgattgccttagcaacgacactgtttctccctgcgggaataccggttttattatccttgttaggcgttttatttgtggtgagaaaaatatgatctcaacaacttcacttatcgcaggtatcgctattttagccgtaggaacttatgccatgcgcatctccggtatcttattaaataataaaacggggatgtctgagcgggtcaaagaaatgttttcactttcagcaatcgtgatcttattttcggttgcaatgacatctactttttttgatggtgaccaactcgctgatattgccaagattattggtgtgggtgttgcgggcgttttaacttggaaaaagaaaccttttattttggtggtattaagtgctgctattattaccgcgatgctacgttggatagccactttgtggggataa

SEQ ID NO: 72 - DNA, 528 bp, Proteus mirabilis
aataaaggagatgaaatgaatgataatgatattaataaagctattcgagagcaattaataaaacaattaataaaaacagatatcaatgctgaagttattacaggatatcaaccggaagaaatcactgataataatattattatgttttttcctattaaggaggtgagccaaggttggcagaaaagaagttatgatgttcaaggtaataatgccaatcacactgaacaacaacttgttgagttaacttatcaagttcagagctttactaaaaaacaatctgattttactgcaggtgatttaattagaacaacgcgaatgatcattcattcgctgccttttattgaatcaatgagaaaaaaaggaataggaatacaacgtgcgacagaaattaggcgtgcgccaataattaatgaaggaaatagctatgaacataatccttcatttgattttaatgtcacttttcccagctcgttatctctaaacactgcagctacacatttacttatatctaatctatctcgtatttaa

SEQ ID NO: 73 - DNA, 759 bp, Proteus mirabilis
gtgatactggagacaaatatggatcttggtaaacgaaaattcttacaacaattaggggtccttaccgcaggtgcttcactggttcctctctctcaagctggcattaaactatccccagagcgccgtgaaggctcagaggataaacgttatggcatgctgatcgatctgcgtcgttgtgttgggtgtcaatcttgtacagtgagctgtacgattgaaaaccaaacgccacaaggacaatttaggacgacagtaaaccaatatcaagttgctatcaaggggcaagagggaataacgaacgtcttactccctagattatgtaaccattgtgacgagcctccgtgtgtacctgtttgccctgttcaagcaacatttcaacgcaaagacgggatcgtcgtgattgataatgaacgttgtgtaggttgtgcttattgtgtgcaagcatgtccttatgatgcccgttttatcaaccattccactcagacagccgataaatgtactttttgtgctcatcgcctagaagttgggttattacctgcctgtgttgaatcttgtgtggggggcgctcgtattatcggtgatatgaaagatccacacagcacgataagtaaaatgatccgcgagcatgaacatgaattaaaagtacttaaaccagaaagtggcaccttgccacaagttttttatcttggtttagatgatgcatttgtgcagccattagttggacaagggcaacccgcattatggcaggaggttcactcatga

SEQ ID NO: 74 - DNA, 708 bp, Proteus mirabilis
ggatttatggaattattaacgcaatttgctgatttaataaaatttctaattgattttattttacacattgatgtccatttagccgagttagtcgctcaatatggtacatgggtatatgccattctatttttaattattttttgtgaaacggggcttgttgtcacgccattcttaccgggcgattcgttactgtttgttgcgggggctttatctgcgttagataccaatgatgttaatgttcacctaatggttctcttactgcttttcgctgcgattttaggtgatgcggttaactattctattgggcgcatttttggtgaaaaactctttagtaatcccaattcacgtatctttaaacgagaatacttagataaaacccatgctttctatgaaaaacatggtggtaaagcgataattttggcaagatttgtgccgattgtccgaactttcgcgccattcgttgcaggaatgggcaaaatgtcatatcgtcattttgctttttataatgttacgggtgccattgcatgggtactgctatttacttatgctggatacttttttggtgacttagatattgttcaaaagaacttaaaattgctaattgttgccattattgttatttctattttaccaggtgttatcgaagtgatacgccatcgtagagcgagtgcaaaggccaaaaaagagagtgataaccaagaggtttga

SEQ ID NO: 75 - DNA, 579 bp, Proteus mirabilis
tttttgaaggaaactatgatgtcatcaccttcggcacccattgaaattatttctcaatctattgctagagaaagaaaaaaagcaggtctttcacttgcagaaatcgcaaggcgagcggggatcgcaaagtcaacgttatcccaattagaagcgggacaaggtaatccaagtatcgaaactttatgggctatttgcgtcgcactcaatattccgttttcacaactgatttcctcacctaaaccagaagttaaagtgatccgcaaaggtgatggatttaaaattagtgcagaaaaggcctattaccatgcctttttattgtcatcttgccccaatggcgcgaagcgcgatatttatacggttattgctcaaccgggtaaagatagagtatcagatcctcatagtaaaaatgtcacagaacatattcttataattagcggtcgtgccattgtcggtactttagataatcaacaagagttatctcccggtgactatatttgttaccctggtgacgttactcatgtgctacgtgcattagagccagatactaccgctgtcatgatcattgaacatcacaattag

SEQ ID NO: 76 - DNA, 951 bp, Proteus mirabilis
ccatctggtttaaaaatagatgtgagaataatgaaaagtgtaatcttcccgctgttagcggtacttatttggtcaattaatgcggttgtcaataaagcggcaacatctgtgatagatccagccgctatctcattttatcgctggttcttagcatttttactgatgacgccgtttctgttagtccctgtttggcatcatcgtaaaaccgtaaaacaatattggtggaaattatttattctcggcgcattaggtatggggttatatcaaagtttagcttactatgcggcttattatgtgacagcaacctttatgggaatattgaattcacttattccattattaaccgttattattagtatttttgtactgcgtgtcgtgcctactgtagggattgcactcggaactattttatctattagtgggcttgtctggttagtcagccacggtgatccttcacaactcctttctcaaggtttaggacgtggtgaattaatgatgtttatcgcatcaactgcctatgcattttacggagtacttaccaaacgttggtcaattcctttacctaattggcagtctctatatgtacaaataggttttggtgttttattactaatacctaattttcttaccgcagaaagtattgcattaacaaaagataatgttggattagttatttttgcaggggttggcgcctctattttagcgccttatctgtggatcttaggtgtaatgaaattaggtgcaaatacaacctctatctttatgaatttaattcctctatttaccgcaatgatcgctgtagcagtgttaggtgaagagatgcacagttatcattttattggcggaggcgttatattgttagggatattcttagtacaaaaactaagagcaccactgaatttccgtcgtcaatctgtcacaaaaaaagcagattgtcagcaggagatgtga

SEQ ID NO: 77 - DNA, 2694 bp, Proteus mirabilis
atgcgtacactgacccaattaaagccaaatacattaactcgcttatatgctctgtttcttctgtttatggccatatccctttttctatatgcttatagctattttgatacttggctagaaagtaaaaaaaatgccattaacaacacgactaataagtttgcatctcaagttgaagattaccgctatcacgctaaccaactattccagttatcaaacaaaattaatgatccaaccctctttctgcctttaaaaatcaatccggtcaaactacgctctgatgtttattggcttgaaggacgcgatcagaccgttgacgcaattgtttttggtaaatcgaatgaacaaacctttcagttaaccggttattttgcaaacgcgttagaaattatttggggggtacgtaataactatagctctctctattatcttaatggtaaaggcaatgatcttatccttattactacccactcaatactaaaaccagaattgcgctataaagaaagctatttaacactaacggctgaaaacaaacgttctgagctattaatgcaatcaacggcattagatgaaaaagagagcctttctcccattaggaaaatgccgacagaaaatatttattactatacctatcgcaccatgtttaatgtgccagggcaactgaccagtgttattgcctttgatttacccataaataattttctacctgctgagctatcacctcaatatttaagattattacccacaggacagcagagtgtttatgataaaaacaatattgaggtatcaacggatgggacttcactcatcttctcacagcccattgcaggaataccctactctttatcttatgagtatccactaaaatcgattttcaatgagattgtgtataaaaatatctggttacttatcagcctactcatttttatctcgatttcagtgtttggccatatctatattcgtaataaatatgtattcccttatatttcgatgacgcgtaatcttcgcatcaaagaagagatgactaacgatatcatttctaatcttcctattggtctattggtgtataatttttcatcaaaccacaaaattattagtaatagccacgcagagaaactattacctcatatcgatttatctaagatccgccagatggcgattgaacataatggtttaatccaaacggccattgataacgaaatttatgagatccgcaccagtagcaacagcaatatcgataatactgctctattcatttttctgaataaagacaacgaagcattaatcaataagaaattgcagctagcacaacaagaatatgaaaaaaacacgattgcacgccgcaagatcttatccaatatgtcattggaactcatacgaccaattaaagatattaatgagatggtatatcaatttaaagatctacttcctaacgatactcaccaacaattactgagtctgctattagaaaaaacgaattatatttctgagtggatagaaaacattacgctaattaataagttagaaaatcaagaatggaaaatacatcaagatgaatttgaactttcaacgctagttgaatctattctaataaccgcatcaccatttatgataagaaagggattaacactttatttccataataatattaaacctagtttacttttatttaatgatggcccagcattaagtaagattattttatcattgattaattatgccattagtacgactaattatggaaaaataaccgtcaatctaaatttagaaaaaaataatgataaagaagaaatagtaattgatattattgatagtggcagtgggttaacagctcaagatctggctaatattaaatatccatttttaggtcaagctatgggtgataaatattattccaactcgggtattattttttatttatgtcatttgttgtgtaacaaaatacaaggcactttgaccattacaagccaagaaagtattggctctcatttccgtatcgtacttccataccagcatatagatacagaagagcgctcttttgacatattattagagggtataactgcaaaactcgccataaaaaaccctgaaatagaaaaaataatctgccaacagcttgataaatatggcgctacatactttgataaaaataaagagaatctttactcagaatacgatatcatacttagagacactccggataataatcctgaatcagcaacagtattattagttagctctattaccggatttgaaaaaatagcaagaaatttaataaagtgtaactataacttcggtgatccattaattgaggctattacttatttgattgaagaaaatgaacaactttctctcgaaacaactcaaacgagtattcgcaatgagaataataaccttgatcatcacgaagtaattcttaataattataggaagaagttgaatgatagtgattataaggaactatttatcaatactgttcccattgatgttgaaaaactacacttagaagcaactaataaagactttcattctctagctcagacagctcatcgtctgaaaggggtttttgctatgttagatttagaatatctcagagagaactgcgaatatttagaagatgacataaaaaatcataatgaattagagataaaagaacgtatcaatcaactggataaatggatccgacagttgctgtag

SEQ ID NO: 78 - DNA, 756 bp, Proteus mirabilis
ttaatcacacttagctttatcttttattatattgctcaaactttatttgccttttatactttcttaaagcatattttgataggtgttattatgaatattttattagttgaagacgatctgcaattgggaaaggcgctctgtcgtggtttagaaattgctggttttcagccctgctgggtaagattgcttgcggatgcacgtgttcaattaaaccaaaaagcctttgatttaatgttgcttgatctaggtcttcctgatggtgatggtcaagatgaacttatcgcactaagaaaaagtggtgaaaaaatacccattattattttgacggctcgtactcaaatagataacttagtacaaacattagattcaggtgctgacgatttcttaccaaaaccttttgctatgcctgaattaatttctcgtgtaaaagccgtaagtcgccgtatggccggtttctcttcacagatttggtctattggtgatttacagcttaatccctcgaatcatcaagtcactttaaatggtgaactattgttattatcaggtaaagagtaccagttattatatgagctgatgcgcaatacagataatgtagtacgtaaatctgatttagaacaacgcttatttggcttagatgacaaaattgaaagtaactcacttgaagttcatatgcacaacttacgccgtaaaataggcaaagagcgtattattacggttcgcggtatcggttatctcttaaaaaaagaagtgaactaa

SEQ ID NO: 79 - DNA, 321 bp, Proteus mirabilis
cacttcttttgttgggagactaaaatggcagacgcaattaatcgttgtaatgcagaagaaacagctgcttgttgttgtgttgatgttggtactattatcgacaacaaaaattgtaccgcatcttatcagcacgtttttgccgataaggctcaagctgaagcgatgttaaatgagctaacagctaaagctaatgccactgcatctgaaccttgccaaattaaacatcaatttgctgatgttgaaggtggcgttcaattaaccgctgattttactttctcttgtgaagcagaaaatctgatcttccaattaggattacgttaa

SEQ ID NO: 80 - DNA, 804 bp, Proteus mirabilis
atgatactttggctgatctcttttggcttaatttcaggtattactacatggttatttggttttggcggtggttttgttactgtgcccctactctatactttgattcttacactttgggctggtgatagtttagcgggtgaacatgctatgcaaattgctgtggctacctctgcgctcattatgttgttttccgctattattacgaccctaaaacaccataaggcgaaaaaaatagattggaaattaattatgatcttattttgggggattgcattcggtgggatcttcggtgccttacttgcctcatccgtccaaggtgaatggatccgatggatttttattggctatctattccttactatcttagattgctattttcgccccggatttatggcgccacgcaaagaaatacaaaaagtaaccaacaaaaaagaagcgttaactggcactattattggcattattgcagcttttttaggtgtaggtggaagtgttatgaccgtacctttattacgccgtagaggtatgtcaatgactcaatcggctgccatggcaaacacattgacattccctttagcattaacggcaacactcacttatatcttattgtctttcactaccccgttaggggatagcgctggatttgttggctatatttggataaaagcagccgttattctaatctgtagtacatggataggattaaaaatagctgaacgttttttatcacgtataccggataaatggcatgcgagagtttatccgctgttattgatattggtgttagtcgttatgctgaactaa

SEQ ID NO: 81 - DNA, 666 bp, Proteus mirabilis
tggaactattggaaaaggagagtgcgagtggcaagtaaatttcaaaatcgcttagtcggagccgttgttcttgtggcggtaggggttatttttcttcctacattatttgacggcgataagaaatataacgaagaccaatttgcctctattcctttagtccccaaacccggtgatgagcaagatattgaatcaatagcgccgattgagcaaaccacaacaccgtcaacgccatcagagggtgcttctgaggcgatgatctctgaagcggtgacgggggttgaacagcctcaagtttctactcctgaagtatcggagcctcaagtagcgccatcaacaccggttgttgagccacctaaagtggttaatccgcctgtagagccaccaactactccgccaccggcggtatcagaaacaaccgcgccgaaaggtgaggcttgggttgtgcagttaggtgccttgaaaaatgcggcgaaggttgaagaaattattgcaaaaatgcacctctccggttatccagtatataccgtgcctgttcgccctgtttcaggaaaagtgacacgtatctatattgggcctaatgcctcaaaagcagagttacaggcgatgttacctcgccttaaagagctaacaggcctgcaaggtgaagtaagagcctataaaccataa

SEQ ID NO: 82 - DNA, 303 bp, Proteus mirabilis
aacagagaactagcgctatacattatggcatctcataaagtgaccctgcaccagcagggtctatcaaccgcattagaatttagctctgaaacgcatccttccttgttggagacgttagagcgcagcaaaattcaaatcgaatatcaatgccgagaaggttattgtggctcttgccgattacgcttagtaaaaggcaaagtatgttatcgcaatgagccattggcatttattcaagctgatgaaattttaccttgtagctgtcaccctgtgagtgatatcgaaatcgagatctgcacaaagtaa

SEQ ID NO: 83 - DNA, 1545 bp, Proteus mirabilis
gggacacattgcgccatgttattaccctggctaatacttattcccttcatcggtggcctgctaagttggcaggctgaacgaatcggctcgcaagttcctcgctgggttgcgttgctgacgatgggattaacactcgttatttctgtgcaactgtggttgcaaggtgactatcaactgattagtgttgatggtgcacctcgctggacagagttttactttgtaccgtggatccctgctttggggattaatattcagtttgcacttgatggcatgtcattattgatggtggtattaactgctattttaggtattttagcggtgctctcttcatggagcgaaaatcaaccatcacaaggggctttccatttcaacctgctgtggatcttagcaggtgttatgggggtattcttagcgactgacttgttcttattcttcttcttttgggaaatgatgttgatcccaatgtatttccttatctctctttggggacataaaggaagtagcgatgagaaacatgttagtgcagcaactaagttctttatttatacacaggcgagtggcctgttaatgttgctggccattatcggtttagctgtcgctttttacagcaaaacaggtatttggacgtttaattatgacaccttactacaagcgcacaccttattaggtagtgaactgcaatttattctgatgcttggcttctttgctgcattcgcagtaaaaatgccaattgtccccgttcatggctggctagctgatgcacatgcagaagcaccaacggcgggctctgttgacttatcaggtattttgctaaaaacagccgcttacggtttattacgttttaacttaccgttattcccagaagcgtctgcattactggcacctgttgcgatgtggctaggcttaatcaccgtattctacgctgcactgttagcattccgtcaaacggatattaaacgtctggccgcttacagtagtatttctcacatgggctttatcgtgattgcgatttatgctggctctgttttggcttaccaaggtgcgattattcaaatgatcaccaatggtttgtctgctgccggtctgtttatcatgtgtggcatgctgtatgagcgtttaggtacgcgtgatatgaatcaaatgggtggattgtggaaaagcatccgtttcttaccagcattttcactgttctttgcggttgcctctttaggtatgccaggaacaggtaactttgttggtgagtttatgatcctatttggtacttatggccactttaagctgatcactattatttcggtctttgggttagtttttgcttctgtctacgctttgtggatgatgcaacaagcttactatggttcaccgaaaacagcagaaagaacctataaagggttaaatctgagagaatttttgatcctgtttatcttggtggttttattggttattttgggcttcttcccacaaccagtattagatacttcgatatcagcaatggaaaatctccagacttggtattccgcttctctttcaacagtaaggctgtaa

SEQ ID NO: 84 - DNA, 1038 bp, Proteus mirabilis
acattttactgtattggaggatattttatgggagagggttggaatattgcgcttgtgggcgcaacaggtgctgtgggtgaagctattttagagcttctgcaagagcgtgattttcctattggcgaattaacggcgatcgccagtgaagacagtattggcaaaactatccgtgtaaagggtaaaagtgttgcagtacaaggtattcataatatcgaatgggcggatattcaactcgctttttttgccgcgccggttgagattagtgcgcaatacgcacaacttgcagcagattcaggttgtattgttattgattgcagtggtttatttgcgatggagtgggatgtacctttagttgtaccaggggtgaatacatctatgctggcagagtatcgtaaccgcaatattatcgctattgctgatagcatggtaagccaactgttacgcgctatctatccattaaccgaagccgcaggcttaactcgcttgaatgtgacaaatttgatgtcagtatctcgttttggtaaacaagctgttgatgaattagcggggcaaagtgcgcgcttactgaacggtgttcctccagaacttggtcgctttaataaacaactggcatttaatattttaccattgttagttgataatgaaggctctattcaagaagagcgccaaatggttgatcagatccgtaaaatcttgcaagacgatggactacctatctcagtaaccacattacaagcgcctgttttctatggtcatgcacaatctgtgcagttggaaacatcacgtccaatgggaagtgaagaagcacgggaaacattacaagaacatgactccctcaatattagtgatgaaaatgattttccaactcaagtcaccgatgcctccggtaatgttagcttgaacttaggttgcttacgtaatgattatggtgtgcctgaagcgttacaattttggtctgttgcagataacgtgcgttttggcggagcattaatggctgtagaagtggctgaaaaattagtgcaggagcagttttactga

SEQ ID NO: 85 - DNA, 1071 bp, Proteus mirabilis
tgttgtttatggcatttctctggcggtatttatcccaacgaaggaaatgcaatgaacaaatatctcactgaaaataaatcgatagttttaacaggggatcggatcactggacctttacatcttggtcattatattggctctcttcagcaacgtgtcgaatttcagaataaagcgacacaatatatcttaatggctgatatgcaagggttaaccgataatggctcaacacctgaaaaggtcagtaaatttctttttgatgtggtggctgattatttagctgttggtattgatccgaaactttccacattatgcttacaatccgcactaccggctttatcagaactgactatgctgtatttaaatattgtcacagtatctcgcttagagcgtaatccaacagtaaaacatgagattttgcaaaaaaatctttctcgttcattgccggcgggatttttaacctatcctgtcagtcaagcggcggatattactgcatttagtgcagatattgtgcccgcaggagaagatcaattgcctatgattgagcaaaccaatgaaatcgtcaccaaaataaatagcttaataggacaacccgtattgacaagctgtaaggtcgtagtagggcaagtcggtcgtttacctggtacagatggtagtgggaaaatgtctaaatccttaggtaatacgattaatttatcatccacagccgatgaaattaaaaaagcggtttattcgatgtataccgatccgcaacatattgatgttgcatcaccaggtcatattgaaggtaatgtggtgttcacctatttagatgctttttgccaagataaagccacggtgacagcaatgaaggctcattaccaaagaggaggacttggtgatatgaaatgcaaagctatgcttaatgatatcttacaagagcttctgcaaccaatacgtgaaaaaagagcgcaacttattaatgataaagcttatttattacaagtgatcaaagaagggagcgataaagcgaaagaagtgactcaacaaaagcttgatgaagtaaaacgtggtctaggattattgatcttgtga

SEQ ID NO: 86 - DNA, 2760 bp, Proteus mirabilis
cgcctgcaatgcaggcctttgggaagcatgctgactatggctacgattcatgtagacggcaaagaatatgaagttaacggggctgataacctgttagaagcctgtcttaatttaggcttagatattccttatttttgctggcacccagcgctgggaagcgttggcgcttgccgccagtgtgcggttaagcagtatcaaaatgctgaggatacccgcggtcgtttggtaatgtcttgtatgacacctgcggctgatggcacgtttatctccattgatgacgaagaagcgaaaaaattccgcgaaagcgttgttgaatggtatatgactaaccatcctcacgattgtcctgtttgtgaagaagggggaaactgccaccttcaagatatgaccgttatgacaggtcatactatgcgtcgctatcgctttactaagcgtacacatagaaatcaagagttagggccgtttatttctcatgaaatgaaccgctgtattgcttgttaccgctgtgttcgttactacaaagattatgctgatggcactgatctgggtgtctttggtgcacataacaacgtgttctttggacgggttgaagatggcacattagagagcgaattctcaggtaacttagttgagatttgtccaacgggtgtctttactgacaaaactcactcatcacgttataaccgtaagtgggatatgcagtttgccccaagtatttgccaaggttgtagcatgggttgcaatatcagcccaggtgagcgttatggtgaattgcgtcgtattgaaaaccgttataacggtacagtaaaccgttacttcctttgtgatcgtggtcgttttggctacggttatgtcaatttagcgagtagacctcgtcaacctaaaaaacgtttaggcagtaactggcttgaaatcagtgcagcacaagcaacgcaagccgctgcagaaatgctgaagaaagggcaacgtgttgtcggtatcggctcaccacgagccagtattgaaagcaactttgctttacgtgaagtggttggggctgaaaatttctatagtggtatttcggctgcagagcaggctcgcttgaccttaatgctggatattttacaaaaaggtggcgtttatactccatctctccgtgagattgaagactatgacgcagtactggtgttaggtgaagacttaacacagacaggtgctcgtatggcactgtcagtacgtcaagccgtaaaaggtaaagcacgtgagatggcagccgcacaaaaagtggctgattggcaaattgccgccatcatgaatatcggtcaacgggcgaaatatccactgtttgtcactcatgttgatgaaactcgtctggatgatgttgccgcttggagttatcgtgcgccggtggttgaacaagcgcgtttaggttttgccattgctcatcatattaatggtgaagctcctgcggttgatggcttagatgaagcgttgaataaacagattgacatgattgttcaagccttatcgcaagcgaaaaaaccgttaattattagtggtagtcatgccggtagcgaagaagttatcaaagcggctgctaatatcgcttttgccttaaaagccaaggggagcgaagttggtctctcttatgtggcagatgatgccaatagcatggggctggcgatgatgaaagcgaaaccactggatgacgcattgaaagtgatgcgtagtggtcaagcagatagcgctattgtgatggaaaacgacttgtatcgccattttgccgccgacgtcattgatgacgcgattgctaaagtggatcacctaattgtgattgaccatcagcaaactgagatcatggaaaaagcacaccttgtgttacctgcttcctcctttgctgaaagtgatggcactatggtgagtcaagagggcagagcgcaacgttacttccaagtgtttgaaccttctttctataacaaagaagtggtgatgcatgaaagctggcgttggctaagtgctgttgattcacaatggcatgaaggtaatcttgactggacgcaattagatcatgtgattgagctatgtgcaacgcgtctaccgcaatttgccggtattgtgaatgcggcacctaatgcatcattccgtattcgtggtcaaaaattagcccgtgaaccgcatcgttatagtggtcgtacttccatgttggcaaatgtttcagtacatgaacagcgtcaaccgaaagatatcgatagcccatttgctttctctatggaaggaaacaacagcccaacggctcctcgccagcaaattccatttgcatgggcaccgggttggaactcaccacaagcatggaataagttccagtctgaagtcgggggaagcttacgttttggtgatccgggtgtacgcttaatcgaatgtagtgataacacattaggttatttcactgatattccaccagcctttaacctagttgaaaatcaatgggttgtagctccttactatcgtctgtttggtagcgaagagttatcgcaacgttcacaagtgatccaacaacgtatggacaacgcttatttaaccgtgagtgaatctgatgccatcgcattagcattatctcaaggtcaacaagcgatgtttacttacgaaggtcgtgaattcaccttacctgtgaaaatcagtgctcacttaacccgaggtcaaattggccttccgttagggatggctggcatttcgccatcactggtgggtgtatcggttcgtcaactgcggggtattgcataa

SEQ ID NO: 87 - DNA, 192 bp, Proteus mirabilis
ccggagaggtgcatttttgcaataatttcttcaaccttcgccgcatttttcaaggcacctaactgcacaacccaagcctcacctttcggcgcggttgtttctgataccgccggtggcggagtagttggtggctctacaggcggattaaccactttaggtggctcaacaaccggtgttgatggcgctacttga

SEQ ID NO: 88 - DNA, 636 bp, Proteus mirabilis
agaagtttgctgaagactttaaaattactaaggaaaatggagaacaatatgggatcttataaatcaaaaaatattactttatataattatccagaattaaaaattaatgtattacgttggtgggaaagtctatttttatcaccaaatgaattaagtaaaaaaggtattttaccagcaccgaatcgttataaatctgaattgaaacgttgtgattctattactgctattatgttaaccgaagggtttcgtgctttatggttgagttttcctgtggaccttattaataatgctacaacggaagatattgagcgttgggcaataatagtagctatattagtttatattacgcaggatagtgaaaaacactttgctactattgcaggtgaaaaagatgagagtaaaaaatcttgtatcagtgaatcccgttttttacaactacaatcttcgcgtacttatgatgagtttattcggcgtttaaggagaattttaattcagattaaagggaaatcatctgtcttatcaatgtgtaaagatattgaaaagtgggttttagaaaaacagcgctttagttctatacaaacaaataaacaaattattattgagtgggcaatgaaatattatcaggctgccatttaa

SEQ ID NO: 89 - DNA, 339 bp, Proteus mirabilis
cgatctcgtcgaaaacgaaaaagtaggggagccaaaatgatacctcttcaacatggtttgatcttggctgcggtactatttgtgttaggttttacttgcttagtacttcgccgcaacctgttatttatgttgatcggactcgaaattatgattaattcagctgcgctagcctttgtggttggtggtagctattggggtcaaacagatggtcagattatgtatattctggcaatcagtttggcagcggcagaggcaagtattggcttggcattgttattacaacttcatcgtcatcgccaaaacctcaatattgatacagtcagtgagatgcgcggatga

SEQ ID NO: 90 - DNA, 1404 bp, Proteus mirabilis
atgaagatccgctctttctttatttatactatctttctacaaacgatatctatcgtgatgttatggggcgtttggttagcttggatagaatttgattatcttgctgactttgaaactatctacaataagcaacaagaaattattgctgaaggatttgccaatacactcgaaacggtttcttctcaacccgagacagtaaaacagatagctcaccatttacaaaacatgtatatcgataccatgcttaatggtgaagatgatgatttacactatttaccttggtttattgtcttaaataaagataatgatctgatttataccaatagaccggaactttctctgcctaaacgggtactgtcgcttgcctctgaaaaaatctctgtggctggggagaaatggtatttatcttatagttggggaaaacaacataaaattaaagtttttattggtgaatccgtcgaagatagaggacatgtcattggtaaccctatttccggtacttttgtgcccttcctatttattttagcgacggtgatcttggctatcttaattactgcttattttagtttgcgccctttaagacaagccgcagagctgatttctaaccgaaaacctcgtaatttaacgccaattaatgtcggacaacaatttaaagagatccgccctatctttaaagagcttaaccaattaatggcaagaatagatgcggctaatattagagaaaaacaatttatggctgatgcggctcatgagctaagaaccccgattgcagcagtgattgcccaattgcacattctctctttagtcgatgaaaagcaggagcgagaagaaattattgaagatatgaaacaatctctggatagagccgccgcactttcccaccagcttattgatttagcaagattagagtgtgacgatttccctataaaaatagaatcctttgatgtttataatattattggtaatgctattgctcagcgcgtgccttatgccttaacaaaaaatattgagctatctttaaatgaaggtatgtcacttaaaatagaaacagataaacaagcactactgtctatttttaataacttattggataatgcaatcaaatattgccccaataatagtcaagtcgaagtgactattgaacataaagatacccatcatctcaatattattctgcgtgataatggaccaggaattgcacctgagtatattagctcactattttcccgtttttatcgtgttccgggatcacaagggacgggcagtggtttaggcttatctattgcacaaaatctcgctgaaaaaattcaagcaaccatttccattactgaagggctacacaataaaggtattggttttattattaccttaccgttaaaaattaaaccactagataatgagtaa

SEQ ID NO: 91 - DNA, 1242 bp, Proteus mirabilis
agtcatacccgattaggtaaacgtgctatgaatcaaataaaaaaatcaagtaaactcgaccatgtttgttatgacattcgaggaccggttttgcaagaagcaaaacgtctggaagaagaaggtaataaagtattaaaactcaatattggtaacccagcacctttcggttttgaagcgccagatgaaatcttagtagatgttattcgtaacctacctagctctcaaggctatagcgactctaaagggcttttttcagcacgtaaagccatcatgcaacattaccaagcccgtgatatgcgtgatgtaactgttgaagatatctatattggtaacggtgtttcagagcttatcgtacaagctatgcaagcattattaaatgatggcgatgaaatgctagttccagcgcctgattacccattatggaccgctgcggtttctctttctgggggtaatgctgttcattatatgtgtgatgagcaacaaggttggtttcctgatttagatgatatccgtcgtaaaatctcccccagaacgcgcggtattgtgattataaaccctaacaatccaaccggcgcggtatatagcaaagagattttgctagaaattgttgaaattgcccgtcaacacaatttgattatttttgccgacgaaatttatgacaaaattctttatgatgatgcccaacatcactctattgccgcaatggcacctgatttattaaccgttacctttaacggtttatcaaaaacctatcgtgttgcaggattccgccaaggttggatggtacttaatggcccgaaaaaacaagcaaaaggctatattgaaggcttaaatatgctggcatctatgcgcttatgtgccaacgtgccgatgcaacacgcgatccaaacggcattgggtggctatcaaagtatcagtgaatttattctacccggaggccgtttatacgagcaacgcaaccgcgcatgggagcttatcaatcaaattccaggggtttcttgcgttaaaccaatgggagcgttgtatatgttccctaaaatagacttaaatcgttatagtattaaagatgaccaaaaaatgatcctcgatttactattacaagaaaaagtcttattagtgcaaggtactgcatttaactggccccaccctgatcatttccgtattgtgacactcccccgtgagaatgatttagagatggcgattcaaaaatttggtcgttttattgtcggctaccatcaatag

SEQ ID NO: 92 - DNA, 681 bp, Proteus mirabilis
tatataacccgaattgacataaaactatgttatctttattttaataacttgaaaatagatatcacaaggaagttattagtgaaaatattaattattgatgagtgttactttactcgtaatggtattcggcatttcttcttaaaaaaaaatgtaaggcatgaaattattgatatgtcttctattgaagaagctaatcattatattaataactctatgcctgatattatttttattgatctcactaaatattgtcgtgaagtggcacattgtcagcacttacaatatttcttttcactgactcaagagtgtcgtttatacctctatattgatgccaactatccggacaaagatagacctatcgccttgacaaataactgttttatccttgctaaacgggtactaccttgggtattagagagaacatcaacattaacttctcgttgccaagtttttttccccacttataaacattctctttgctcaatatttagcatacaagaacaaaaaatcataaattactggatgggagaattgcctaactatcaaattgccaaaaaattaaaaattagcaatagcaccgtttattcgcataaaagacatattactgaaaaaataaatgtaaaaaatagaattgaacttttctttatatataatatattaaaatatatctatgagaaataa

SEQ ID NO: 93 - DNA, 1365 bp, Proteus mirabilis
gtcatgaaccgtaaaaacctgtttactcgcacagctctcgctgccattgtaggaacactttcctcttatgcaagcgctgccggttttcagttaaatgaatattcaacttcagcactaggtcgtgctttttcaggagaaggcgttattgcagatgatgcgagtgtaggtagtcgaaaccctgccgcattgaccatgtttgatcgtcctgagttttccgttggtgctatccatattaatcccagtgttgatattaaaggtaaatctccactctctggcgccagcactaatgccggcgatatcgccccaagtgctttagtccccaatattcactttgttgcgcctatcaacgataaatgggcaattggtgcatcaggtactactaactttggtttagctaccgactttaaaaaagattacccagcaggtttaattggcggaaaaactgatttaaaaaccatgaacttaaatttaagtgcaggttatcgagttaataaacaatttagtgtcggtttaggcttaaatgcgctctatgctgatgctgaaattacccgccatgtaggtgaagccggtaagctattgggtggtaccttatctcaacatccagatactaactatcagggattaggccgttatttatcaagcttatcgccaagtgatcgttttgcacaattaaaaggggatgcttggggctttggctggaacgccggtttattatatgagtttgatgaagataaccgtatcagcttcacttatcgctctaaagtaaaagtgaaatttaaagatggtgattatcaaagtgatatccgctcattacccgcactagaaggtatgggagtgattggtactaatggagacaccatcaaaggtaaattagaccttaacctaccggagatttgggaatttgccgcttaccaccgtgtcgcccctaaatgggctgtccattataatttagcttataccagttggagtgagtttaaagagttaagagcaacacgtaaaagtgatggtcaacaactcttcaacaaagaagaaggcttccgtgatgcatggcgtattgcattaggaaccacttattaccatgatgataattggacattccgcaccggtattgcctttgatgatagtcctgttcctgcggataaacgctctatctcgatccctgaccaagatcgcttctggttaagtgcaggggcaacctacgcatttaataaagatatgtctgtggatgttggtttagcctatatgcacggtaagaaagtgacgattaaagagaagctatctgaaagcttaccattgccggcttatgaatttgaatcatcaggtaaagcatggttatacggtatgaactttaactatcgcttctaa

SEQ ID NO: 94 - DNA, 249 bp, Proteus mirabilis
cccgtgaaccgcatcgttatagtggtcgtacttccatgttggcaaatgtttcagtacatgaacagcgtcaaccgaaagatatcgatagcccatttgctttctctatggaaggaaacaacagcccaacggctcctcgccagcaaattccatttgcatgggcaccgggttggaactcaccacaagcatggaataagttccagtctgaagtcgggggaagcttacgttttggtgatccgggtgtacgcttaa

SEQ ID NO: 95 - DNA, 2238 bp, Proteus mirabilis
ccgcctgaccgcttaagttttttgatgtactgccagtgttatgctggcagtactgtttcacataacgagcaaccgatatttaaagaggtttccgtgtcccgtacaattatgctagtcccaactgatacacgcgtaggtttaaccagcgtcagcttgggtgtaatccgttctatggaacaaaaaggcgttcgccttagtgtattcaaacctatcgcacagcctcgtgttaaaggcgcattagatcaaaccactgcgattatccgctctcactccacaattcaatccgcagaacctttaaatatggattacgttgagtcattactcagctccaataaaaaagatgttctgatggaagaaattgttgctagatatcacgaaaatactgctgatgcagaagttgtactgattgaaggcttagtgccaatgcgtaagcacccttttgcacaatctttaaactatgagattgccaaaacattaggtgctgaaattgttttcgttactgcattaggcaacaacaccgctgagcagttaaaagagcgcattgaatttgctcgtgctgaatttggtggtgtaaaaaatcaaaatatcacaggtgtgattgttaataaattaaatgcccctgtggatgatcaaggtcgtactcgccctgatttatcagaaatttttgatgactcaagcaaagcgattatctctaatgtcgatttaaataccatcgaaaaaaatagcccacttcctttattgggttgcattccatggaacttcgatttaatcgctactcgtgctacagatatggcaaaacacttaaatgcgactatcatcaataagggtgatattgaaactcgtcgtattaagtctgtgactttctgtgctcgtagtattccacatatgttagagcatttccgcccaggttcattgcttgtcacttctgccgatcgcccagatgttttagtttcagcatgtcttgctgcaatgaatggcgttgaaatcggtgctatcttactcacaggtggttaccaaatcgatgcaccaattaaacaattgtgtgagcgtgcatttgagactggtctacctatctttatggttaattcaaacacttggcagacttcattaaatctgcaaagctttagcttagaagtgccagcagatgaccatgagcgtatcgaaaaaattcagaactatgttgctcaacatatcaataaccaatggattgattcactgacagcaaactctgaacgtcctaatcgtttatcaccaccagcattccgttatcaattaacggaattagctcgtaaggcgaaaaaacgcatcgtattacctgaaggtgatgaacctcgtaccgttaaagccgcgtctatttgtgctgaacgtggtatcgcaacctgtgtactgttaggtgatcctgaagaaattcgtcgtgttgctgcagcacaaggtgttgaattaggtacaggtattgaactcgtcaatcctaaagaagtacgtgaaatttatgtacctcgcttagttgaactgcgtaaaaacaaaggtatgacagaagttgttgctcgtgaacagttagaagataacgttgttctcggtaccttaatgttagaaaaaggcgtcgttgatggtcttgtttctggcgctgttcatacaaccgctaacactattcgcccaccactacagttaattaaaactgcacccggtagctcattagtgtcttctgtgttctttatgctattaccagaacaagtctatgtttatggtgactgcgcaattaacccagatccaaccgcagaacaactggctgaaatcgctattcaatctgcagactcagcaaaagcgtttggtatcgacccacgcgttgcgatgatctcttactctacaggtaactcaggtgctggcagtgacgttgaaaaagtgcgagaagcaactcgtttagcacaagaaaaacgtccagatctgattattgatggtcctttacaatacgatgcggctgtaatggctgacgttgctaaatctaaagcaccaaactcacctgttgcgggtaaagcaactgtgtttatcttccctgatctaaacaccggtaacactacctataaagcagtacaacgttcagcagacttggtttccattggaccaatgttacaaggtatgcgtaaacctgttaacgacctttctcgtggcgcgttagtcgatgatatcgtctacactgttgcattaactgcaattcaagcaagccaacaagaaaatgcctaa

SEQ ID NO: 96 - DNA, 1221 bp, Proteus mirabilis
ggctgttcgcttcgttttattcacccatgctattttttaatgttcactattccacaaattggagaagatgtgatggaaaagaaaaagctcacaacggcggctggtgcaccagttgtagataataataatgtaataacagcaggacctcgtggtccaatgttactacaagatgtctggtttttagaaaaactcgcccattttgatcgtgaagttattcctgaaagacgtatgcacgcaaaaggctctggtgcctttggtacatttacggtcactcacgatattacgaaatatactcgagctaaaattttctctgaagtgggtaaaaaaacagaaatgtttgctcgtttttcaacagtagcgggtgaacgtggtgcagctgatgctgagcgcgatattcgtggatttgccttaaaattttatacagaagaaggtaactgggatatggtgggtaataatactcctgtattctatctacgtgatccccttaaattccctgatcttaaccatatcgtaaaacgtgaccctcgcactaatatgcgtaatatggcttataaatgggatttcttttctcatttaccagaatctctacaccaattaactatcgatatgagcgatcgtggtttacctttaagctatcgctttgtgcatggttttggtagccacacttatagctttatcaataaagataatgaacgtttctgggttaaattccatttccgttgccaacaaggcatcaaaaacttaatggatgatgaagcggaagctctagtaggtaaagatagagaaagctctcagcgtgatctttttgaagccattgaacgtggtgattatccgcgttggaagttacaaattcagatcatgccagaaaaagaggcatcaaccgtgccttataacccatttgatttaaccaaagtttggccacatgctgattatccactcatggatgtcggttactttgagttaaaccgtaatccagataactacttctctgatgttgaacaagctgcatttagccctgcgaatattgttccaggtattagcttctcaccagataagatgttacaaggtcgtctattctcttatggtgatgcgcatcgttaccgtttaggcgttaaccatcatcaaatccctgttaatgccccaaaatgcccattccataattatcatcgtgatggtgctatgcgtgttgatggtaatagtggtaatggtattacttattag

SEQ ID NO: 97 - DNA, 978 bp, Proteus mirabilis
cccataatgcgaaacgccaaactctattcattcagcctgccaatggaggcaggtgttgttctgcgctaccaaagattaaaaacgcgtgatggttttcttgtctgtttagagcaaaatggcaaacaaggttggggtgaaatttcacctcttcctgagtttagccatgaaacgttagaacaagcacaagatgccgcacaatcttggctagcagcttggtgtctaggtgaaaatcctactgacagtgaattgccaagtgtcgcttttggtattagttgcgcattagcagagcttgaaggcactttaccagaagaagccaattatcgtgccgcacctttatgcaacggtgatcctgatgacttaattttaagtcttaatgaaatgagtggggagaaagttgctaaagttaaggtcggtctgtatgaagctgtacgagatggtattgtcgtcaacttattactagaggcaatccccgacttaaaactaaggcttgatgccaatcgcagttggacgccagctaaagcagaaggttttgccaagtacgtgaacccacaatggcgcgaccgtattgcatttttagaagagccatgcaaaaccccagaagagtcactcgccttttcacaagtaacaggtatcaatattgcttgggatgagactgtgcgtgatgaagattttgaagtgaaagctcaagagggtgttacggcgattgttatcaagcctacgctagtaggaagtcttgctcgttgccaatctatcgttgaacaagcgcatgctttaggtctagaggcgattattagctcgagtattgaaagtagctttggattgacacaactggcaagagtagctcagtggttaacaccagattctattcccggtttagataccgttgatcttatcaaacaacaacttattcgttgttggccagatgtagatattccgcttatcacgcttgaacagcttaagacagtatggcaacagtag

SEQ ID NO: 98 - DNA, 387 bp, Proteus mirabilis
tattatattttttcatatattattaatgatggcccgcactattataaattagatatcaatcaaagtgaaaagcgagaacatattatgagtaacaagtatccagttgcttacgctgttggacaaaaaataaaatcattaagaaaatctcaaggttataccgtatttcagttagcaaaagaaatcgatattagtgaacagcaattatttcgctacgaacgcggagttaatcgtatcgacattgattgcttagttaaagtccttgatgtgttaggcattaatataggtaacttctttgaggatgttatggggggtatggttgatgttcctgagaataatgaacaacatatcccagctcatttcgacaataaggctctttctattttctga

SEQ ID NO: 99 - DNA, 1233 bp, Proteus mirabilis
aatatcaggcggatatacgcacaatatatggaggatttacattacatggctgattatcgatatattaataataaaggcgttattgttcctgatacggcagcgctacgaaaggaggtagaagacgaatttcgcactgtctttgggcaatcaatcaatttatcgccagaaacgccccaaggggttttggcaacaatggaaattgaaaatcgcgatgccattgtgcgtaataatgccgaacttgctaatcaaattaatcccgatattgctggggggatttttcttgatgcaatatgggcgttaatgggaggagagcgtattaatgccacacactcctatttaagtgatgtggaatttatgggggtgcccggcaccattatccctaaaggttcacaagccctaacgataaatggcgcagtatttgaaacattaacctctcttattatcgcagacactggaaaaataactggggatatgcgcgctaaagagtacgggcctatcacttgtggtattgggcaattaaataaagtggcaagttcggtattaggctgggaaaaagtcaataataccacgcacgctattattggccgttatgcagaatctgatattaaagccaggcgtcggcgtaaacagactctcgctaaaaataccatcagtgttgcccaagctattacatcgtccctctatgaattagccggggttaactctctctcttttcgagaaaacttcactgataaaacattaactatcgatggtatttccttattgccacatagcatttatgtctgtgttgaagggggagacagccatgaaattgccaatgttttattaagaacgaaaacaataggtgcggcgtttaatggtgatattgaaataaatctcttagagccagcaagtggtcaagcatatccgattaaattttcacgacccaaagaagtgacgattttttgcaaagttaccgttaaaaaatcctcttttgatgcacaaaccattattcctgatgcactagaaaaatggagtcatggagagatagagggggataatgggctggtggtagggcgagatgtctctccttttgagatctccgctgccgtcaatgctgtggagccacatttatttgtcacaaaagttgagttatcaacagatggaaaaaattggcatgtagcattaattcccattgccattaatcaaattgcccgcttacctaaaggggcgatacaagtggtgatggtatga

SEQ ID NO: 100 - DNA, 2334 bp, Proteus mirabilis
cgaggcgctagcggcgtccaaggagagataatgtcgctattacccgtatttagtcaggtactgacgttagacgcggaggtatctgataacgcattaaataatatcaggaaatcgaccaacgaaattcttgaggaaatgaagaaaatagagcagggcgcatcagcaggtattaatcgcttttttgcctttgttcaagaaatagccgccagttttaacgaattatcactggagcctgaaataaacctttcggtggacaaccaagaaattattcaagcctctgaaactgttgaaaattcgatacaacaaatcgttaaaacggcacttagtagtactcaagaatttgatacttttttacaaaatatcttaacggggctgacgagtttatcgcttgatgagcccataaatattgaaataaatagtggtgaaacacaagagaagatccattcaattacgtcaagcattgacgctctaaaagatgcgatgtcagtattaaattacacgagaaatttgcttagcaatgatgtggatagtgatgcaagtcatcttgcgaatttaaatgctgaatatcaggcaatggaagatcagcttgcttcattaaataatgaattaactttattaactgaggcagaaaagaaaaataaagaaaataaattagttattgatgaggtgattaaaaatctaggtgccgattacgatcaatttatcagcaccatgcaaacccaaggtattaaagcggcaatagaagaagctcaagctcaacgtcgattaagcagtagtgttgatgaaaccgggaaaagttatcagcaaaccgtcgataaaatgaaagattttatcctaaacgccataggtgcaacggatattatggggacgttacaaaaggtattttctgcgtcacttgaacgttctcaagaaatcgaatcattagataaactcagtaaaaaaatgggtgttgcggcgattgatattgacgctttttcaggtgcgatggctgcaattggtggcacgaaagaagctgctcaagcggatttagccgctatggcaactgcgtttgacgatacgcaagatcccatagagcagcttttacaggtcgctgataacgttaaaaatatgagttttgatgatgcccaaaaagagctggaaaaattaggtgttgttgatgataaaaccatcgaattaatgatgaaaggtcgtcaagagctagagcgtacgatgggggtacaaaaacaattctcaggtattaacgacgacagtattgaaagtgcaatccaactcaatgccacaatacataaatttagtcaattagcggcacaattcaaaaataactttttagatatgattattcctacgctggcaaaaggcatggaatggtttgataaattagtcgatttttgtgtgaaaaataaagatattgtgattagctttttctccgccatcggcgccgctgttgctatttattatttacccgtcatgatctctgctgccgcatcgacacttgccatggcattacctattattgctattgcaacggtgattggtttattaggtgtcgcctttaaactcgtctatgacgatattatgaattttattaacggtaacgattccatgatcggccgtatattagaaaaatacccagtattaaaaagtgtgatcatgacgatatggcaggcatggcaatcattctttgaatatttaaaagaggctgtcactgttgttgctgattttgttattgctgcatgggatctaatatctaactcatttaatcaatttatacagactctagaaatagggattaataattttattgcttgggggcaatccattattgatatctttatttttgtttctgattcagtggtgagcctatttgaatggatgtggggctgtgttgaaaagatattggattttgtcgatgaaaaaatcaacctaatacaagatatatggcaatcagccaaaagctttttcggtatggacgacgaagaaaaagaaattcgtgtggtgcaaaaggtagagcggcgattaacaaatgagggggagcttgactatatcttgccacaatctcaaacagcgacacgatattatagtcctatgcaggaggttaaatcgttaaataacggattagcaatatcgtcaaataacagtttaaacccgatgaccagtcaaatgatcagtaaccaatcaagtattaaaaatgaaagtaatgtgcaaattggtgagatcaaaattgaaactcaagccacaaatggtgcggaggtggttaaagaaatcaagaaatcttatacagagcaagaggctaaaaatatatcgcagaatcactctagtggctggagggtgtag

SEQ ID NO: 101 - DNA, 333 bp, Proteus mirabilis
atatattataggaggcctttgcctcctataattttagttaaaactattagttatgcttatccccacaaagtggctatccaacgtagcatcgcggtaataatagcagcacttaataccaccaaaataaaaggtttctttttccaagttaaaacgcccgcaacacccacaccaataatcttggcaatatcagcgagttggtcaccatcaaaaaaagtagatgtcattgcaaccgaaaataagatcacgattgctgaaagtgaaaacatttctttgacccgctcagacatccccgttttattatttaataagataccggagatgcgcatggcataa

SEQ ID NO: 102 - DNA, 510 bp, Proteus mirabilis
caacaaaataggtttatattgattatgcaaatttttattatgcgccacggtgaggctacttttgatgcgcctagtgatgcactacgatctttaacagagcgtggtgaatatgaatcattaaccatggcgaattggatgacacagcaagagcatagtattgattatgttttagttagtccttatttgcgggcacaacaaacacttaatgttgtgcaacaaggcttagtattacccgctaagatagaaaccgatgaagggcttattcctgggggtaatcctgatcatattgcacattatttaagggcattaggggaagtgggatatcacaatattctagttatatcacatctacctttagtggggtatgtcgtggcagagctttgtccaacagtgagtgctccgatgttttctacctcaacgattgcttgtgttaattttgatttatcaacaggctcggggaaattgctgtggcaagtctccccagcaaacttaaaacaaattaccgaataa

SEQ ID NO: 103 - DNA, 2055 bp, Proteus mirabilis
aatacaggtagttccgtgaataacactgctataaataccgcctctttaagttggaatgaacttggtactccgatttcaaaacagtttgatgacatctatttttccaaccaagatggtcttaaagaaactcgacatgtattcctacatggaaatcattttccatctcgttttggtacacatgtacgctctgagtgtgttatagcagaaaccggatttggcacaggattaaactttttaacactgtggcaagccttcgagcaatttcgtcatcactcacctgatgcgtcattaaagcgtttacattatgtcagttttgaaaaatttcctctgactaaagctgatttgcaaacagcccatagccattggccagaactagcacaatattcaacagcgctttgtgcacagtggcctttacctattgccggttgtcatcgtcttattcttgctaatggcgcgataacgcttgatttatggttcggtgatatcaatacattactgccacaaactcgccaagctttacataataaagttgatgcgtggtttcttgacggctttgcaccaagtaaaaacccacaaatgtggagtgaaacattatttcaagcaatggcagactcgatgcgtgaaaatggcacttttgccacctttaccgcagctgggatagtaaaacgaggattgcaacatgttggttttgaaataaagaaaataaaaggctttggtcaaaaaagagaaatgttaacaggggtatttccccatcctcctgccaatgcatttgttccctactatgccagaccttgtgctacacaaacaaaagatatcgccattatcggtggggggatcgccagtgcattaactgcgctcgcctgcttaaaaagaggcgccaaagtcacgctctattgtgaagatacacatcctgcggcaaatgcctcaggcaatcggcagggtgtgttatacccattacttaatggtaaatctgatgagttagaacactttttcactagcgcttttttatatgcccgccgttattatgatgagttaaaccataatggcgtcaacttttcacatcaatggtccggtgttgcccaagtcatttataatgaaaaagtgcgcaaaaaaatagcgcgaataatcgagcattccacacctttttctcaactcgctcattatgtccatcaagatgaaatgaattcactttgtggattagccatcaaccaagatggtcttttttatcctcaagcaggttggctttctcccacagagttaaccaccaatgcattaaaatacgcacaacaacaaggtctcaagctactctttgaacatcaagtcactcaattaacctcacaacaacagcattggcagttagaggtgactcaccaagcaacaacgtataaaacacaacatgattgcgttattttagctaatgggcaccgtattactgattttatacaaagtgaaaaactacctatcagtgcagtaaggggtcaagttagccatatttcaacgacacctgatatcgcacaattaaaagcggtgctctgctatgatggctattttacgccggttgatcctcaagataatctgcattgtgttggggcaagctttcgtcgtgatcgactagatttaaatgtttcaattgaagagcaacaaaataatcaatggcacctcacgcactgtttagcacaatcaccttgggcacagcaggtagattttagtgataacgatgcgcgtgtcgggatccgctgtacaataagagatcaccttcctttattaggtgaagtacccgattttgaaaaattagttgtcgcctatacgcatttagatcgatttaagcgtagaaagcaaacacctattttggcaccgagttatcatcagctttatattattagtgcattaggttcacgtggtttatgctctgcacctttatctgctgagatcttagcaagccaaatctttgatgagccatttcctgtagaagatagtgtgttaaatgccttacatccaaatcgtttctgggtaagaccattactacgcggaaaagctattgaattaaaatcatag

SEQ ID NO: 104 - DNA, 801 bp, Proteus mirabilis
atggattggctattttcagatggcatctaccttctactcttttttgttgctgtattagcaggctttattgactctattgctggcggtggtggattgatcactattcctgccttgctctctgcgggaatatcacccgtacaagcgttggcaacaaataagcttcaatcagtgggcggttctttttcagccacactctattttattcgtcgtcgcgtcattgatttaaaagcacagcgctttgccatttttatgacttttattggtgctgtttctggtgcgatgttagtacaatttattaatcctgaattactaaaacaagcgctacctgttcttactatcgcaatcggtctctattttttattaacaccatctatcggggctaaggatagtaagcaacgtcttggctattatactttcggggttattattggcggtggtattggcttttatgatggtgtttttggtcctggaacaggatcttttttcgctttaggttatgtcatgttacttggttataatctctcaaaggcgacggcacatgctaaattactcaatttcacctctaattttggctctttgctattttttatgcttggtggacaggtaatttggaccataggtttagttatgttatgcgggcagtttattggtgctcgcttaggtgcagggttggtgttaaccaaaggacaaaaattaattagaccaatgctggtcattatctcctttttgatgagcatcaaacttattcatgacaatcatggagatactattgcactttggttttctgcactttttaattag

SEQ ID NO: 105 - DNA, 237 bp, Proteus mirabilis
aaaaattgcagtaattgtacgctaattttgttaaagaaacagactaagaagaaaaaattttcaacaaatgtcattagcaattggtgtttttttagcatttatttcattattgatcgcatattttacttaagtaacatccaacaagcttataacaacttttcttgttttaccgtagcctttgctactgtaagtctttttaataccctaacactattttttaagctttatcccttttag

SEQ ID NO: 106 - DNA, 954 bp, Proteus mirabilis
atagataggcttatgataaagtcacctccatttaaaacatcatttttacagcccaaatattggctgacatggttggggataggattactctatcttctcgttctactcccttatcccgttatctactggttgggtacacggctaggtcgtttatctaaagtctttttaaaaaaacgtgtacaaatagcagaacgtaatcttgagctatgttttcctgacatgcctaaaaatgaacgtgaagcgttagtgaataaaaacttcgaatccgtaggtatggggctatttgaaacaggaatggcttggttttggcctgattggcgtgtgaaacgttggtttaaaatcagtggtagagaaaatattcaaaaagtacaagaaactggccaaggtattattgtcgttggtatacactttttaactctagagttaggtgcacgtatatttggcatgctaaaccccggtattggtgtgtatcgccctaatgacaatccagttatggactggttacaaacttggggtcgtttgcgttctaacaaatttatgttagatagaaaagatgtcaaaggtatgatccgcaatttaaaagctggagagatcctctggtatgcccctgaccacgattacggcccacgaaagagtgtctttgccccactttttgccgtagataaagcagcgacaacaacaggaacctatattctagtcaaaaccagtcatccggctctgatcccgtttacaccaaagcgcttacctgaagcaaaaggttatgaactaattatttcacctgccgtagctgattttcccatcgatagtgaagaaaacaccgctatcgcaatgaataaagtggtcgaacaagaaattttacgtgctcctgatcaatatatgtggttacaccgtcgttttaaaacccgcccacctggagaagcttctttatataatgagataaagaaagtacactag

SEQ ID NO: 107 - DNA, 603 bp, Proteus mirabilis
tctggcttaaggaaaaaaataacgatgaatagcaactctaaacaatttgtcatgctacacgatgaaaaacgttgcattggctgccaagcttgtaccgtagcatgtaaagtcatcaatgatattcctgaaggatacagccgactacaagtacaaattcaaggccctcataatgatgaggcaggagatccacattaccaatttttccgagtttcctgtcaacattgtgaagatgcgccttgcgtttctgtctgccctacaggtgcttcatttattgatgaaaatggcattgtacaggttaaaaaagagctctgtattggctgtgattactgtgttggtgcttgtccttatcacgttcgatatatcaatccattaacacacattgctgataaatgtaatttctgtgctgatactcgactaacagaaggtgagttacccgcttgtgtaacggtatgtccaactgatgcattggcatttggtcgcattgactcacccgagatccaagcttggatcaaacagaaatccgtttatcaataccaattagataatgtcggaaaaccaaatttattccgccgtaaagagatccatcagggagataaagcatga

SEQ ID NO: 108 - DNA, 195 bp, Proteus mirabilis
cttcagctaagttacaaattaatcgagatatcaagccaccaacatgcactatcaattattcctgaaaatgctaagtatgcattaggctctcaacgtagcaatattaaaacatcctgtaatgtagatacttttttaacatttacagtttcagatttttttgtagaaaataaagctaacatatggaaaaaactttag

SEQ ID NO: 109 - DNA, 207 bp, Proteus mirabilis
ccagtgccaagagtgaaattaaccggttgcgtagttatgctgagcgtgatcctgagcgggtgtacatcagagccagttgtgcaaaaaacgacgccaattccaccccccgcgtggatgatgcaacccgcgccagacctactgacgccgctatccgaaattattggatactcagagaaagaattgctcagtcagagtccatcatcttag

SEQ ID NO: 110 - DNA, 771 bp, Proteus mirabilis
agcatgacaagtatctggggagccgaactctattatacgccagattactggcctgtatggttaattgcagcaggtttgatcattgtcgccatgatagccatattggtgctacatggttttttacgttatgcactggcacctaagcaaagtggtcactatgaagaagagcgtgtttacttatactctaaagccattcgtttttggcattggggtaatgccttactgttcattcttctattaatcagtggattgttaggccatttttctatcggtaatgttccatcgatggtactactacataaaatctgtggttttattctcatcgctttttggataggttttgttgtaattaacctaaccacaaataatggtgtacattacaaagtcagaccgcaaggattaattggacgctgtatcaagcaagctcgcttttatctttatggtattatgaaaggtgaaccacatccttttgccgcgactgcaacagataaatttaaccctctccaacaacttgcttacttaggtgttatgtttgggttagttccactacttcttatcacaggcgtactatgcttataccctgaagtcttaggttatggctattggatgttaaaagtacactttatattaggcatcgttgcactcatgtttatttgtgcacacttctacttatgtactttaggcgatacctttacacaaacattccacagcatgattgatgggcatcatcgacatcaaaaacatggtgaaagcacaacaacaaaaaattga

SEQ ID NO: 111 - DNA, 1329 bp, Proteus mirabilis
gaattcattttgtcaggagtcgttatgaagtcatcagcgagcagtaccataaaagatcgtgttgcgattgtcagtggattgcgtctcccatttgctaaacaagcaaccgcttatcgggggatccctgcggttgagctggggcgctcggttgtacaagaattagtgatccgtaatgaaattcctcctgaaattattgatcaactggtgtttggtcaagtagtacaaatgcctgccgcaccgaatattgcccgcgaaattgtacttggcgcagggctaagtgtaaaaacagatgcttatagtgtaacccgtgcttgtgcaacgagttttcaggctattgctaatgtggctgaaagtatgttggcaggtcatgtttcagtgggtattgctggtggcgcagattcatcttctgtattaccgattggcgtgagtaaaaaattagccgatgttttactcagtttaagtaaagcgaaaacattagggcaacggcttagttatttaagtcaactacgctttggtgatctgctacccgttgcacccgcagtggctgagtattccacaggtttacgtatgggggatactgctgagcagatggctaagacttatcatatttcaagagttgcgcaagatgaattagcgcatcgctctcatcaattagcggccaaagcgtgggaaatgggaaaattaaatgacgaagttatgacggcatttttcccaccctataaatcaggttttcatcaagataataatatccgcaaaaattctgtacttgattcttacgcaaaattgaagcccgcctttgataggcgccacggtagtgtgacagcggctaatagtacgcctcttacggatggtgctgctgctgtgctaatgatgaaagagtctgttgccaaaagtttaggctatcaacctttaggttatctgcgtagctatgcttttaccgccattgatgtctggaaagatatgttactggggccttcttatgcgactccgttagcactatcaagagccggtcttactttgagtgatttaacactaatagatatgcatgaagcttttgcggctcaaacgttgagtaacttaaccttatttgcaagtgataaatttgctcaagagcaacttggactgtcaaaagcaataggtgaagttgatatggataaattcaatgttcttggtggctctattgcttatggacacccctttgctgcaacaggggcgagaatggtgactcaaacattacatgaactgaaacgccgaggtggtggctttggtttaacaacagcttgtgctgcgggcggattgggtgcagcgatgattttggaggtggaataa

SEQ ID NO: 112 - DNA, 657 bp, Proteus mirabilis
tttatagcgagtcatagtatgaacacgaaacattggtcacgtgtcgaatatttacacgaaacagtaaaaaataagaatattattattaaaggtcaacatagctattacagtgattgttgggataatggctttgaagcatctgtagtgcgttacctttatggcgatgaatttagccttcagtgggaacctttatgggaaatcgataaattatatatcggtgactatgtttgtattggtgctgaagcggttattttgatggggggcaatcatactcatcgtatggattggttttctctttatccatttttagacaatattaaagaagcctatattggtaaaggtgatacttatattcacgatggtgtatggataggtatgcgggcaatgattatgcctggcgttactattggtgaaggggctattatcgcagcaaatagtgtagtgacaaaagatgttgctccttatagtatcgttggtggaataccggctaagcatgttaaataccgatttgaaccaaaagtgatagagcaacttttatctttaaatatttatagttggtcagagaaaaagtttgccgcattaaaaccttatttatgccaagcttcaattgataagctgttaactgctcatacgcaatataaccaagatatgaaatag

SEQ ID NO: 113 - DNA, 1071 bp, Proteus mirabilis
gacacacggagccggtatatgaccactgcacaacctatcaccctcactattcgccgtcctgatgattggcatgttcactttcgtgatgatgacatgctaaaaaccgttgttccttataccagtcgttattttggcagagctatcgtaatgccaaatcttgttcccccgatcaccaccattgaagccgcccgtcgttatcgtgatcgcataaaagcagctattcctagtggcgataaattcgaaccattaatgacctgctatttaacggatagcactctgccatcagaagttgaacaaggttttttacaaggcgtatttactgcttgtaaactttatcctgccaatgcgacgacaaattctagccatggtgtttccgatatcaataaaatctatcctattcttagtgtaatggaaaaaataggtatgccattgcttattcatggggaagttactgcatcagatatcgatatttttgatagagaagctcgttttattgataacgtgatggctcccgttcgcaaacaatttcctgccttaaaaattgtttttgaacatatcaccaccaaagaagcggcacagtatgtcttagagggaaatgaatttcttggtgcaactattacaccacaacacttaatgtttaaccgtaatcatatgcttgtcggtggtgtgaaaccgcatttgtactgtttacctatccttaagcgtaatgtacaccaagaggcattaaggcaagccgttgcatcaggccattcgcgtttcttcttaggtactgattccgcacctcatttacaacatcgcaaagaatcatcttgtggatgcgctggcgtgtttaacgcccccaccgctttagcagcttatgctagcgtatttaaagagctcaatgccctttctcactttgaagccttctgttcactcaatggcccacgtttttatggtttaccggttaatgaaggcactattaccttaacggaaaaatccgttactgcacctgcagaaattatgagtggtgatgaagcattaatccccttcttagcaaatgaagatattcattgggatattagtgtcaattaa

SEQ ID NO: 114 - DNA, 1386 bp, Proteus mirabilis
aacgttactggagcagtatccatgacagcaatttcaggagcaaaaccgattattcgtagcgcagaaacgcatccgctaacgtggcgcttacgtgatgatcgtcagccagtatggctggatgaataccgtgcaaaaaacggttataaagcggcagaaaaagcattaaaaagcatggcacctgatgaggtgacttctgaagttaaagatgcaggcttaaaaggacgtggtggtgctggattctcaacaggcttgaaatggagtctgatgccaaaagatgaaagtatgaatatccgttacatcctttgtaatgcagatgaaatggagccgggaacctataaagaccgcctgttaatggaagaactgccacatctgttaatcgaagggatgattatcggtgcgcatgcattgaaagcttatcgtggttatattttcctacgtggtgaatatattgaagcggctaagcacctgcgccatgctattgaagaagccaaagcagcgggttttttaggcaaaaatatcttcggctctggtatcgattttgagctatttgttcacacaggagcaggtcgttatatctgtggtgaagaaacagcactgatcaactcactggaaggtcgtcgtgctaaccctcgctcgaaaccgccattccctgcaacctccggtgcttggggaaaacctacctgcgtgaataacgttgaaacgctgtgtaacgtacccgcgattattgagcatggcaaagattggtatatcggtttaagcgccggtaaaagtccagatgcaggtaccaaattaatgggattctctggtcgcgtgaaatatccaggcttatgggaattaccttttggtactacagctcgtgaaatcttagaagattatgcgggggggatgcgtgatgggctgaaattaaaagcttggcaacccggtggtgcaggaacggatttcttaacagaagatcatctcgatctccctatggattttggcacgatcgccaaagctggtagccgtttaggtactgcgttggcgatggcggtagataatgaaattaacatggtttcattaacccgtaacttggaagagttctttgcgcgtgaatcttgtggctggtgtacaccttgtcgtgatggcttgccatggagtgtcgaaatcttacgcgcgatagaaaaaggtcaaggtcgtcctggtgatattgagactcttgagcacctctgccgctctttaagcccagggcacacattctgtgctcacgcaccaggggcagtagagcctttacaaagcgcaatcaaatatttccgtgaagaatttgaggctggcattattcaagaagactataccaatgccaatcttatccgtggtattcagcctaacttgctgaaaagccgctggtag

SEQ ID NO: 115 - DNA, 2298 bp, Proteus mirabilis
gaagaaactggaggttatatgagtattagtcgtcgttcttttattaaggggatgggtataggatgtgttggttgtacggtgggaagtttaccaccaggggccctcgcacttaatccagtaacatctcttaagggtcagtctaaattaacaccaagtttgtgtgagatgtgttcttaccgttgtcctatagaagctcaggttgttaataacaaaactgtctttatccaaggtaaccgaaattcaccacatcaaaaaactcgagtctgtgcgagaggaggcagtggtgttagccttatttatgatccgaaacgcattgtaaagcccatgaaacgcaaaggccctagaggtgccggagaatgggaagttattagctgggaacaagcttatacagaaattgccgaaaagatggcaagcatcaaacaacattatggtgctgaaagtatctttttctcatcaaaatcaggttctctttcctctcatttatttcatttagcggcggcatttgggtcaccaaacacctttacgcatgcatcaacttgtcctgcgggcaaagccattgctgcatcggtaatgatgggtggtgatttaaaaatggatctcgcaaattctaaatatattctttcttttggtcataatctttatgaaggaattgaagttgcagaaacctatgaattaatgacggcacaagagcgtggtgcaaaattagtcagttttgatcctcgattatccgttgtttccagtaaagcaaatgagtggtttgctatccgaccaggtggcgacttacctgttctaatggccatgtgtcatattatggtaaaagaaaatctttatgataaagattttatagaaaaatttactgtcggtttccctcaattggtggaagtattacaagataccacgcctgaatgggcacaagctcactctgatgttcccgcaaaagatattattcgcataacacgtgaaattgcagctaaagctcctcacgcattagttatgccaggccatcgcgcaacctttaataaagatgaaattaatatgcgcagaatgatcttcaccttcaacgccctactgggaaatattgaacgtgaaggtggcatgtatcaaaagaaagctgctgcaaaatataataaattagcgggcatcgacgttgcccctgaattagctaaaccaaccgttaaaggcatgcctaaaattacggcaaaacgagtcgatgctacagcgcctcaatttaaatatatcaataaaggcggcggtattgttcaatctatcattgactctacactccatggtgtaccttaccaaaccaaagcttggattatgtcacgccataatccatttcaaacagtaagttgccgacctgatctagaaaaaacagcccaaaaactcgacttaattgtcagttgtgatgtgtatttaagtgaaagtgcatcttatgcagattatctgttaccagaaagcacttatttagaaagagatgaagagatttctgatgtctctggtttaaatcctgcttatgcattaagacaacaagttgtcgaacctattggtgataccaaaccaagttggttaatttggatggaattaggaaaaaaactggggttagcaagttattatccttgggaaaacatgggagttcgtcaactttatcaagttaaaggggatgaaaatctctataaagagatccaccaaaaaggctatttatcttatggtattccgctgcttttacgtgaaccatcctatgtaaaagcctttgttgaacaatacccagatgctatcaaacatgttgatagtaacaatatgatggaaaaatctctttcttttaaatcaccaagtggtcttattgagatctattcggaagagttagaaagtctattagagaattatggtattcctcgtttccataacttcccattaaaacaaaaagatgaactctattttatccaaggaaaagtcgcagtacataccaatggtgcgactcaatatgtacctttattagcagagctaatgtggaaaaatcctgtctggttacatcctgataccgcaaaaagtcatggaattaagcatggtgatgagatcattttagaaaatagcgtaggcaaagagaaagcccatgccttaattacgacaggtattcgtcctgacacggtgtttgtctatatggggtcaggttctaagactggcgaaaaaacgccagcaaccacgaatgggatccactgcagtagtttattacctcatgaaattagccctgtttcaggcactgatgtacatacttcaggcgtcaaaattagtctggcttaa

SEQ ID NO: 116 - DNA, 192 bp, Proteus mirabilis
cctataaatgggcaacctgaaattttataccgcaaaaaagcgctcccgatgacaaacattgccaaggagtcttgtggtgtgaaatttaaggaaacacaatatataggggtttgttcaaatggtgataacaagataatggtaattgagggattgatcaagtgtacaaatctgaatgtttctgtggataaatag

SEQ ID NO: 117 - DNA, 306 bp, Proteus mirabilis
ccaaatagtggtggtgtgttccaagagcaacctgactttaaagagccaccactttctattgaaggtgcagccgatcactggaaccatcgtgaagatgaagattatttcagccaacctcgtgcactgtatgagctattaagcgatgacgagcatcaacgtatgtttgcgcgtattgcgggcgaattatcacaagcaagtaaagaaacacaacaacgccaaatcgacttatttaccaaagttcatcctgaatatggcgctggtgttgaaaaagcgattaaagtgttagaagggaaagacgctaaataa

SEQ ID NO: 118 - DNA, 792 bp, Proteus mirabilis
ataacaaaaggaaatgttatgaatagcgtaacttcacaattacaggaatttgattgcaatcaatttttccatactattaaatcaattagaaaaataacttctgaactatttgaacatgataatatcttaaatcataatcttattaccatatcaataaacaataataaaatttacgatgaaataattattttctctattctgctaaaaagccggctaaaccagaaattgttaacagggatatttaaaaatattaatgaaattaatcatgcaatggctgatagagagttgacacagcaattatcagaaaaactgctccaagagaaaatgtttattgagcagttatttaaagatgaattaactgaatctatagaaattatagaaaagcacatcagttttattaatgataaaaaacagctcttaacaaccaccactattattagtgaaatagataaattaattagaaataaagaagaaatatctattgaaatcaatgagaaaattgccaagcaaaagttatcgattaatgaaattaaagaacaactcgatataattactaaaagtgaagatattatttataataaaaatatcctcgatttttttacctctcacctgccaagtaaacagacaatttctaaactgcagttggcttcttcagaaaaagatattctctctgtttttatcgatctgctaaagcaattttttacccatctggagaaagggttttcttaccaaaaactggtagagacacgtcatactcttattgataactatttgatacagataaaaatctaa

SEQ ID NO: 119 - DNA, 2313 bp, Proteus mirabilis
agccagaaaggtgcatcgctcatgaatcacagcctgctcgtcacaaaacgtgatggtcataaagaacgcattgacttagacaaaattcaccgtgttattacttgggccgctgaaggtctagaaaatgtctctgtttctcaagttgagttacgttctcagattcagttttatgatggtatcaaaactgccgatatccatgaaacactggttaaagctgctgcagacttaatatctggtgaaacacctgattatcagtatcttgctgctcgtcttgctgtctttaatttacgtaaaaaagcctatggtcaatttgagccaccggcattgtatgatcacgttaaacatttagttgaactcggtaaatatgaccgtcatcttctcgaagattacaccaaagaagagttcgaacagatggataagtttattgttcatcaacgtgatatgaatttctcttatgcagcagtgaaacagctagaaggtaaatattttgttcaaaaccgtattactggtgatatttacgaaagtgcacaatttctctatgtgttagttgccgcttgcctattttcgcgttatccaaaagagacgcgtatggattatattgagcgcttttataacgcggtatccacatttaaaatttcactcccaacacctattatggcgggtgtaagaactccgacacgtcaatttagctcctgtgttctaattgagtgtgatgatagccttgattctatcaatgcgacctcaagtgctattgttaaatatgtatctcaacgtgcaggtattggaattaatgccggtcgtattcgtgcattaggtagtgctattcgtaatggtgaagcattccacacgggttgtatcccattctataagcacttccaaacggcggtaaaatcttgttcacaaggtggggtacgtggtggtgcagcaacgctattttatcctttatggcatttagaagttgaaagcctactggtattaaaaaataaccgtggtgttgaagataaccgtgtacgccatctcgattatggtgtgcagttaaacaaattaatgtatgaacgtttaatcaaaggtcaggatattacattatttagcccgtctgatgtgccgggcctctatgatgcattctttgctgatcaagacgaatttgaacgtttatatgtacaatatgagaaagataagagtattcgccaaaaacaagttaaagcggttgaattattctcactcatgatgcaagagcgtgcctctacaggtcgtatctatattcaaaacgttgaccactgtaatacacacagtccgtttgatccggcgattgcacctatccgtcaatcaaacttatgtttagaaatagcactaccaaccaaaccattaaatgatattaaagatccaaatggtgaaattgccctatgtacactttcggcctttaatcttggggcgattgaaaatctagacgatttagaagagctagcacgtttagccgttcgcgcgttagatgctttgttagattaccaagattatccaattttagcagctaaaaaaggtgctatgggtcgtcgtacactgggtattggtgtgatcaactttgcttattatctggctaaacacggtgttcgctactcagatggcagtgcaaacaacttaacacaccgtgcctttgaagctattcaatactatttattaaaagcatcaaatgaattagcaaaagagcaaggggcatgcccatggtttaatgaaaccacctatgcagaaggtatcttacctattgatacttataaaaaatcattagatgtactgactaatgaacctctgcattatgactgggaaagcttacgcaaagagatcaaacaatacggtttacgtaactcaacgctctctgcattgatgccatcagaaacatcatcacaaatatcaaatgcaaccaatggtatcgaaccacctcgtggttatatcagtattaaagcttctaaagatggcatcttacgtcaagtggttccagagtatgagcgcctaaaaggggcttatgaattactgtggcaaatgccaagtatcgaaggttatttgcagttagtcggtattatgcaaaagtttgtcgaccaagcgatttctgccaacactaactacgatcctactcgtttccctagtggtaaggttcctatgaaccagctgctaaaagatttgctgctcgcctataaatatggtgtaaaaacactctattatcacaatacccgtgatggtgcagaagatgtacaaggtgatctggaagaagtcgttgaaacggcagattcagattgtgaaggcggcgcgtgtaaaatttaa

SEQ ID NO: 120 - DNA, 1089 bp, Proteus mirabilis
gggatggcgggaaacagtatcgggcaattatttagagtaaccacttttggtgagtctcatggcacagcgttaggttgcattgtggatggtgttcctcccggactacctttaacgcaagcggatctacaagttgatttagatagacgtaaaccgggaacttcacgttataccacacaacgtagagagcctgatcaagtgcgtattttatcgggtgtttttaatggtgtaacaacgggaaccagtattggattattaatagaaaatacggatcagcgctctcaagattatagcgaaattaaagatgtattccgcccagggcatgcagactacacctatgaacagaaatatggtttacgtgattatcgtggcgggggacgctcttctgctcgagaaaccgccatgcgtgtcgcagcgggtgctattgccaaaaaataccttaaacaaaaatttggtattgaagtaaaaggttacttatctcaattagggccgattagttgtgagttagttgattggtcaattgtagaaaccaacccattcttttgcccagatccttctcgcctagatgcccttgatgaatatatgcgagcgctaaaaaaagagggtaattctataggtgccaaagttaccgtggttgcagaaggtgtacctgcaggattaggtgaacccgtttttgatagacttgatgccgatttggctcatgcgttaatgagcatcaacgcagtaaaaggcgttgaaatcggagatggttttgatgtggtgaccttaaaagggactgaaaaccgcgatgaaattaccaaagaaggatttagcagtaatcacgcggggggcgtattaggcggcattagtagtggtcaacctattattgcacacattgctttaaagccaacttcaagtattactattgctggtaagacacttaatcgacaaggtgaagaagtcgatatgatcaccaaagggcgacatgatccgtgtgtcggtatccgagctgttcctattgcagaagctatgatggctattgtgttacttgatcatgcgttacgtcaacggggtcaatgtggtgatgttattcctccattaatgcaatggtga

SEQ ID NO: 121 - DNA, 306 bp, Proteus mirabilis
ataaccaaggggaatatgatgaaaattaccgttgtatgtggaaatggtttaggcagtagcttaatgatggaaatgagcatcaaaagtattttaaaagatctggccgtcaatgctgatgttgatcatgtcgatttaggttcggcaaaagggacaccgagtgatatttatgtgggaactcgtgatattgcggaacaacttaatgctcaagcggttaatggcaaaattgtttctttagataatatgattgataaagtcgcgatgaaagagaaactttcgaccgcattacgtgaattaggcgcgctataa

SEQ ID NO: 122 - DNA, 513 bp, Proteus mirabilis
tggctggagggtgtagttatgataacggaagttagaatttttgatttagcctcttttaccacattgtttgatagtgttaacccaactcaagtcaccatagacgatagccaccaagcgattacatttacggtagaaaatggggaaagccgcagtgaccatgtggtgatcaaccctatcagtatcagtatcagcttattgttaacgggcgatattgccaatgcttatgccactataaaacagttatatgacgaaaatacgttagtgggtattcaaacacgtgttagtacctatcaaccaatgctattagaaagtcttagccatgatgaagatccgtcaaaagtagacgctattgagttaaaactgaagtttattgaatggaaaagcattgagcctgaatacaataaaaaatcagctaaatcgactaaaaaacctaagcaatcctcaacgattaatcgaggaaatgtgaaaagtaaaaaatccatgccaataggaaaaaagagggctaggaggtag

SEQ ID NO: 123 - DNA, 243 bp, Proteus mirabilis
tggtatttcttgcattttttctacctcctagccctcttttttcctattggcatggattttttacttttcacatttcctcgattaatcgttgaggattgcttaggttttttagtcgatttagctgattttttattgtattcaggctcaatgcttttccattcaataaacttcagttttaactcaatagcgtctacttttgacggatcttcatcatggctaagactttctaatagcattggttga

SEQ ID NO: 124 - DNA, 432 bp, Proteus mirabilis
ggttttattatgtccacaacggatttatctctagagttgcaagataaaattaaacactcaatcacccgcgtctctaaagttatttttccaaccacgaccaatcatcactccacactctttggcggaacggcattagcatggatggatgaagtctcttttattaccgctacgcgcttttgccgtaaacgtttagtgacagtttctacagagaaaattaattttaatcaccctattccctctggcaccattattgaattagttggtgaggtaatacgtgtcgggcgtaccagtctaacggtaaatgtttctatttttctcgaagagatgtatgccgaagggcgagaagaagtgatccacggccaatttaattttgttgccgttgatgagcatggtaagccaacccctttattcgataaaccatcgcttttataa

SEQ ID NO: 125 - DNA, 747 bp, Proteus mirabilis
ggagatattatggcccaatatctcgtttttcgtctttatggtccgcttgctagttggggattgccagcagtaggcggtgatagacaaacagggatagctccttcacgttcagctattttaggcttactgagtgcatcattaggcattaatcgaaaagatgaaagtaaactacttcaattgcaacaaagtgttttagttgcaacaaaacaacttgtaccaagtatgttgttaagagactttcatacggcacaagttccctctaaacgtaaaaatattacacacccaactcgacgtagtgaattagctgaaaaagatcaaaatactattttatctagccgagattatcgatgtgatgcgatatggatcattgcgattaaattaacgggacattctcaatatacgcttgaacaactaaaaaatgcattattaaaacctgtttatatactgagtttagggcgtaaatcttgccccctctctttaccaatgatgcctaaaattgtagaagtagagcaattaaaagaggcattggatactcaatttccttatataacaacatcggataaagcagatagttattggtttcattcagatgggtgggtaacgtatttttgggaaggaaattatcaagatatcaagggagaaaatattatgacattgtacccttgggatgatccgataaatagacagcattggcaatttcgtcaacgtaaaatgtatcaaatgagtgtaaaaagggagagtgaataa

SEQ ID NO: 126 - DNA, 1239 bp, Proteus mirabilis
caaataattatacataagagaggttatatggatacaaccacccttgatcatatagataaagtgattgaacaataccaacttcccgaagtcactcttagcttaattctaggtaaaaatatcgatcatggacgtagtgcgggtatttttacaccttatgatcttaataaaatcaaatcttatattgataaagtattaaaattaccttatcaaaaagacactattattgaattattaggctacgaagatattaacatttcccaaatatcagctgaaactattcaaaccctcttcttaaatatgagaacacatgcctttgaatggcaaaaaattgaatactcagtaaaacagcaagctattgatttagagatcaccggtagagaaatcacgagtacaggtgagcaactattggcatttattaataaaatgccaattataaaaaaaataaataggaaaattgaagatatcacaccagaagaactcagttcaataaaatattcaacacaagataaaaaagtgtctaagcaacttgttgccattttagaaagcatgaaaaatgatattaatgagcaatataataataccttaaaaataaaaaacatgatttatgattttagaatagaaattgtgggaggtgaaaatagtaaaggtaatatatgtcattcaatttattatgatatcattaataaaaagaaatatattaatgatttttttgataatagtgatgactcactaaatgaacagagaattttattagaaaatgaaattgaaatattaaaaaaagagtatcaacacttcgtgaaactcgcctttacggggttagcattcggtattattggtgtgatcattactggagggatctttggttcaaaagctgaaaaaatccgtaaaaaaagaaatgaaacaatagagcaactacataatatcaataaaggaataaaacaacaatcaactatttctgagtgtttacaacgttttcaagtcgatttagacgaaatagaacaatatattgaagatgctgatatgtctgtggagcatcttctttatatgtggcaaacaattttaactgaaattaatgcttcattaattaattttaaaaaaattgataacgcaatggagttaattagatttagtatttatttagaaaaaatcattgcaccttggtatatggtggtcggttactcaaaggaaatgatggcggtatttgatgaagctttatcctctttttattcatctaaataa

SEQ ID NO: 127 - DNA, 588 bp, Proteus mirabilis
gaggttgttatgttagacattaataaaaataatttatctcagctaacagagaaactcgttaaaaagcagtgtactttaatgagtatcattgccatgctgggattacttgcgggtattatctgtattattaaccctttttcttcaggggtcgtggtcagtgttttcctcggtgtggtgttttttgcttgtgcaataaccagcataatggcggcctttaatagccggatctcttctggttggtcgatgttaattactttacttgctggttttatctatctatttttaggttatatttttattaccgatcctttaaatggcatgttaagccttgcatttattatcggttatttatttatctttgcaggaatactcagcttagtactcggctttaagcaaattaaagatagcttttatggctggtttaatattttagtgggctttttagatcttgttttagcctatttcttactagcttttggccctgaaacttctataacactggtgatggcattaattggtatacaacttattttaagttctataactattctatcaatagccagtgcaatcaagcggatgactcgttaa

SEQ ID NO: 128 - DNA, 189 bp, Proteus mirabilis
agatcgactatgtctgttattgcaactattggaataggctacctaattggggctgtactctcttttattatcaccttctttttaaccaaagatcccagtttggctatgcgcctactgagtgcttttcttatcgcaataacatggccattgagtttcccaatggccattatattttctatttttggttag

SEQ ID NO: 129 - DNA, 606 bp, Proteus mirabilis
ttttggtatattcaggataaaaattacgatcgtttagcatcgattaaaaaaggtttgttgaggatggaacaagaaaatacggcagtggtcgagtgggttgatattgttgatgaaaaaaatgaagttgttgcacaagcaacacgtcaacaaatgcgagcagaaaacctacgtcaccgagcaacttatattgtcgtgcacgatggcatgggaaaaattttggcacaacgccgtactgaaacaaaagatttctatccaggttggttagatgcaaccgcgggtggtgtagtacaacaaggtgaaaatgcactcgaaagtgcacgtcgtgaagcagaagaagagctaggtattgccggagttccttttgccgaacatggacaattctattatgacgatgagagttgccgcgtttggggaagcttatttagttgtgtatcacatgggccatttgcattacagccagaagaaatcgaggaagtatgctggcttactcccttagaaatcacggaacgttgtgatgaatttacccctgattcacttaaagcactctctctatggttaacgcgaaataatagtactcgcttggacacaaaagaaaccactgactaa

SEQ ID NO: 130 - DNA, 2661 bp, Proteus mirabilis
atccgtagtatgagggacagtggctccatgagcgacattgccagagaaatcacaccagttaatatcgaagaagagctgaaaagctcatatttggattatgcgatgtccgttattgtaggacgcgcattacccgatgttcgagacggactgaagccagtacaccgccgagtgctatttgcgatgaatgtactgggaaacgattggaataaaccttataaaaaatcagcccgtgttgttggggatgtaatcggtaaatatcacccgcacggtgacagtgctgtctatgaaacgattgttcgtttagcacagcctttttctatgcgctacatgttggttgacggtcagggtaacttcgggtcagttgatggtgactccgcggcggctatgcgttataccgaagttcgtatggcgaagatcgcccatgaactgctggcggatttggaaaaagagacggtcgactttgttcctaactatgatggaacagaaaatataccggctgttatgccaacccgtattccaaacttgttagttaatggctcttcaggtattgccgttgggatggcaacgaatatccctccgcataacctcggtgaagttatcgacggttgtcttgcctatgttgataatgaagacatcaccatagaagaattaatggaatatattaccgggcctgattttccgactgctgcgattattaatggtcgcagaggaatattagatgcttatcgtacagggcgtggaaagatttatatccgtgctcaggctgatattgaaactgatgagaaaacgggtcgcgaaaccattatcgtgacagaaattccttatcaggtgaataaagcccgtttaattgaaaaaattgcggagcttgtaaaagataaacgtattgaaggtatcagcggattacgtgacgagtctgataaagacggtatgcgtattgttgttgagatcaaacgtgatgcagtcggtgaagtagtattaaatcacctcttttcacaaactcaaatgcaagtctcttttggtattaatatggttgcgcttcatcaaggccaaccaaaattattgaacctaaaagaaattatcgcagcctttattcgccatcgtcgtgaagtggtgactcgtcgtaccatttttgaattacgtaaagcgcgtgatcgtgctcatatcttagaagcacttgcggtcgctttggccaatatcgatcctgttattgaattaattcgtcaagcaccaaccccagcagaagcgaaagcggcattaattgcccaaccttgggatctcggtagcgtgtctgcgatgttagagcgtgctggtgatagcaatgttgctcgccctgagtggttagagccacaatttggtgtgcatgacggtaaatactatctaacagaacaacaagcacaagccattttagatctgcgtttgcagaaactaaccggacttgagcatgaaaaactgctagatgaatatcgtgaattactgctacaaattgctgagttattgcatattttgagaagccctgagcgtttaatggacgttattcgtgaagagctaacagcaattaaaacacaatataacgatcctcgtcgtactgaaatcactgaaaataccgctgatattaatatcgaagatctgattaatgaagaaaatgtggttgtgacactatctcaccaaggttacgttaaatatcagccattgactgattatgaagcgcaacgtcgtggaggaaaaggtaagtcagccgcaaggatcaaagaagaagactttatcgatcgcctactggtggctaatacacacgatactattttgtgtttctcaagtcgtggtcgcctgtactggatgaaagtttatcagttaccagaagcgagccgcggtgctcgtggtcgcccaattatcaatttattacctctagagcaagatgagcggatcaccgctattcttccagtaagagagtatgaagaaggtaaatttgtctttatggcaacggcgagcggtacggttaaaaagacaccattacaagacttcagtcgtcctcgtagtgccggtattatcgcggttaatttaaatgatggcgatgagcttatcggtgttgatttaaccgacggtagtaatgaagccatgctgttctcagcagatggtaaagtggttcgtttcgcagaagagtgtgttcgcccaatgggtcgtactgcgacaggtgttcgtggtatgaaactggttgatgatgataaagtggtttcactgatcattcctcgtggcgaaggtgatatcttaacagtgactgaaaacggttatggtaaacgtaccgttcaaagtgaatatccaaccaaaaatcgtgcaacacaaggcgttatctcgattaaagtgagtgagcgtaatggtaaagtggtaggcgctattcaagttgaagaaactgaccagattatgatgatcaccaatgccggaacgttagtgcgtacccgagtatcagaagtcagcattgtgggacgtaatacacaaggtgttaccttgatccgtactacagaagacgagctagtcgttggcttacaacgtgttgaagatgaagatgatgcattagatgatgatgaagttgatgaaatgatcagcgacaatatctctgatgttccagagtctgaaccaacagatgatgcggatagtgaagaagaataa

SEQ ID NO: 131 - DNA, 456 bp, Proteus mirabilis
gcaatgagtatgtctacgaccaccgaagttatcgcccactattgggcatttgctgtcttcttaataggcgcattggggttatgttcgctcatgttgctgggtgcccgctatttaggcggccgtgcacaagcaagggctaaacatgttccttatgaatctggccttgattccgttggcagcgctcgtctgcgcatgtcagctaaattctatttagttgccatgtttttcgtaattttcgatgttgaagcactgtttctttatgcttgggccgtttccgtacgtgaagtgggctggttaggctttattgaagcagctgtctttatcgcaattttattagctggattattctatttggttcgtattggtgcattaaattggacaccagttcgctctcgccgtgaaaccgcgggtaaaagccatgtcagattaaccagcggcaaacatccgcagcagtaa

SEQ ID NO: 132 - DNA, 183 bp, Proteus mirabilis
agaggcggtatttatagcagtgttattcacggaactacctgtattttaccaaaaataatgggctatcttaacgctgttcttaagcatcttccaccttttgagtacgcagagatttttcatattatctgcatttttgtaaaaaagatcctgatcggacttgttcagcgtacaagtgtacgctaa

SEQ ID NO: 133 - DNA, 267 bp, Proteus mirabilis
ttaggaggtattatgagtagaaaaaatgaagttattcaaacacatcctgttgtaggctgggatattagcactgtagatatctatgatgcgatgatgctacgtttacattatcttcctgaaaacgaacaccatccagacaatgcagtggttgataaaacactttggcttactactgatgtagcaaaacagttgatttatattcttcaagcaggtattgataaaattgaatcatctgaagattttgtatcagacaacaccaagcattga

SEQ ID NO: 134 - DNA, 921 bp, Proteus mirabilis
atggccttcattcctttaagaccgattccaattaaagatcgacactcaatgatatttattggaatgggacgaattgatgtaaaagatggcgcttttgttgttattgatgaaattaacggtgaaagaatgcttattcctgtaggatccttagcatgtattttattggaacctggaacacgtattagtcatgctgcagttaaattagcagcaaccgtaggaacattactaatatgggttggtgaagcaggtgtgaggctttattctgttgggcaaccgggaggtgcccgatcagataagttattgtatcaagcaaaattagcacttgataatgatttgcgtttgaaagttgttcgcaaaatgttcgaactcagatttggtgaatcggctcctttaaaaagaagtgtggatcaattacgtggaatcgaaggagctcgagttagaaaacaatatcaaatgttagctaagaaatttaaaattgattggaaaggacgacgctacgatccaaaagattgggaagccggagatattattaaccgctgtattagcgctgcgacagcctgtttatatggtgtcactgaagctgcaattttagcagcaggttatgcacccgcaattggttttgtgcatacaggaaagccactttcttttgtttatgatattgcggatatcataaaatttgacactgttgttccagtggcttttaaggttgcatcatataaagcaattgcgcctgatagagaagttcgtattgcttgtagagaagcgtttcgtaagtatcaaacactcaataaacttatccctttaattgaagaagttctttctgcgggagaaattactccacctgaaccacctattgatgctcaaccccctgcaattcctcaagctcacccttttggcgatgaaggtcatagagaaaaatag

SEQ ID NO: 135 - DNA, 510 bp, Proteus mirabilis
tcttactttttatcatggcgacttcggtcgccttttttatggagtttttatatgttgattaaaccaaaagagatcacggtgattgatagtgatcgtcaacagcatacctttattattagccggttacccgccacaattggacgagagatcttggctaaatacccattatcaaatgcccctaaaatcggtgattatgaagtcagtaaagaggccatgttaaagatgatggcgtatgttgctgtagaaaaagaaggccaagaaatttatttaaaaaccagtacattaattgataatcacgtccctgatggggaagcgttaattcgtcttgaattagaaatgttaaagtacaacaccagttttttcggcaacggcgggagccaaaatttccttcaatacctattaggcaagctcagcggttctctcccgtcgattataaaaacgctgatggcttctttgccgtcatcatctcagccggcttcgcctctttcacagaactcaaaacaaccatag

SEQ ID NO: 136 - DNA, 222 bp, Proteus mirabilis
gaaagtcacatgtctgacaaaatgaaaggtcaagttaagtggttcaacgagtctaaaggctttggttttattactccagcagacggaagcaaagacgtattcgttcacttttctgccattcaaggtaacggtttcaaaactctggctgaaggtcagaacgtagaattcacaattgaaaacggtgcaaaaggtccagcagctgctaacgtaacagctctgtaa

SEQ ID NO: 137 - DNA, 801 bp, Proteus mirabilis
aagagcaacattaagatgacaattgaacaacaaaaagagatgcagtggttactctctgatccagatacggtccgttttcgtgatgagcaattgcttgcagaaactgaatttcgttatcatcaacatgagtttggtcaattgctttatgtgatctctggagtaatggatttagaagctggcgggcagcgttttttagcgccacctgaatttagtgtatggatccctgaaaaagtagggcacgcaagctacaataaaaaaaccttatcttttaaggtgctagatattgcacccagttggtgtgaaggtttattggataaaccctgtcttattcagctaagtcctattttttcgacgatttttgccgatttcttccgtcgtggcgtttgtaaaccgcaaacaaaagaagatctacgtttatctcaagtgttaatagaccaactaaaagtatctcctattcaccatacctatttaccttcctcaaaagataagctgttagcacccgttttggcagcattagagcaaaatcctgctgataatacctcattagaattatgggcaaaaaaacgttatacctcagaaagaaccttatcacgtcgttgtcagcaagagttaggtatgtcttttagtgaatggcgtaagcgattacgttttttacatgctatctctttgttagaacaaggaaaaagtgttaatgatgtggcctttgatgttggatatagctcatcatcctcatttattgccatgtttcagcaatttgctggaacaacaccagaaagatttcgtcgcttacccaatggttaa

SEQ ID NO: 138 - DNA, 666 bp, Proteus mirabilis
caattaaacatgaataaccttaatattattattgccgatgatcatccaattgttttattcggcattcgtaaatctttagaacaaattgaatgggttaatgttgttggtgaatttgaagattccacttcacttatcaataacttatctaaattaaatgcagatgctcttatcaccgacctatctatgcctggtgataaatatggtgatggtattacgttgataaagtacatcaaaagacattatcctaatttgtctattattgtactcactatgaacaataacccagctatcttaagtgctgttcttgaccttgaaatcgaaggtattgtattaaaacaaggtgcacctgctgatctacctaaagcacttgcagcattgcaaaaaggcaagaaatttatgcctgaaagcgtggctaaactgttagaaaaagtgaatgccaatggttatggtgataaacgcttatctcccaaagaaagtgaagtgttgcgcttatttgccgaaggtttccttgtcactgagattgctaaaaaactcaatcgtagtatcaagactatcagtagtcagaaaaaatcagccatgatgaagctcggtgtcgacaatgatatcgctctgcttaactacctatcatcagtcactattgataaggaaattaacggagaaagctaa

SEQ ID NO: 139 - DNA, 1218 bp, Proteus mirabilis
aggagtgacatgaacctaaagccccgcaacaattcttggaaacgaaatctctacattgtctggtttggttgttttttaacgggtgccggctttagcttgattatgccttttctaccattgtatgtagaagagcttggcattaaagatcatgagtccttaaacctatggactggtgtcgcttttagtattacttttctcttttctgccatagcggcacctttttggggaaaattgtcagatagaaaaggacgcaaattaatgctattacgttctgccttaggtatggcgatcgtcatggtactcattggttttgctcaaaatatttggcaactgttaattttacgcgctttattaggggtattagggggttttgtgcctaatgctaatgctcttatcgccacacaagtgcccgttaaaaaaagtggttgggcattaggaactctttctacgggtgcggtaagtggtgcattaattgggccattaattggtggaatacttgccgatctctacggtttacgtccggttttctttattacagccgcggttttatttatctgttttatagtgaccctattttttgttagcgaaaattttacccctgtttctaaaaaagatgcattatccacccagcaagttttttcatcactcaaaaataaaagattagtcatttgcctgtttttcaccaccatgattatccaagtggcaacaggctctgttacgcctattttaacactttatatccgtgatctagccggctctatcagtaatcttgcctttattagtggtgtgattgcatctgttcccggtattgctgctttaattagtgcccctcgttttggcaaattaggtgatcgcataggccctgataaggtgcttattttcacattgggtttatctatttttatgcttattccgatggcgctcgtcagtaattattgggaactaggcgcattacgttttttattgggtgcggtaaacgctgccatgttacctgcggtacaaacacttattttatacaatattacccctgcaattgctggtcgaattttcagctataatcaagccttacgagatgtaggaaatgttactggaccgttaatgggcgcgtttgttgcggccaattatggatttagagctgttttttatttcaccgctgcggtggtattttttaatcttatttactcatggataagctttcgtaccccgcaaagaaaatag

SEQ ID NO: 140 - DNA, 2412 bp, Proteus mirabilis
gacgatagcattatgaaaatatcacatttctatcgatggatagtattcatcatactcacaatattggcgctttactttactgtactcggagggtatttagtttcattagcaggatcgcctttttatctctttaccggtgtcatgcttcttattattgcagcttgctttctaagtcgaaagaaaagcaccctattactctttaactttctatttttaataacgattgtctggagtatctgggagtcaggatttgatttttgggcactcgctcctcgcttagatattatttttattctaggcttactccttattcctttcacactcaataataatgtttacacttgtcgtaccaataaaattggcttattcacactattagccacaacacttatcattatattaggtagttcactaaccgatcctcatgccattaatggtcaatttacacaacaacagcccaccaactctatatctcctatcggagtaaatgataatgactggcccgcttatggcagaacgcaagccggaatacgctattcaccattaactcaaatcaacagtgataatgttgataagttagttgagaaatggacttttcataccggtgatgaaaaaagagctaatgatgccgttgagataaccaacgaagttacgcctataaaaattgaagataatctctttctatgtacacctcaccaatatttaattagcttagatcccgcaacaggtaaagagaagtggcgttttgattctaaattgcaatataacaaaagcttccagcatatgacttgccgaggggttgcctattataatcaaaataatagtgccgaatttgccaaaagcctcgacgttcgccaaccaagcatatcagatgaatgtcctgaaaaagtctttcttccagtcaatgatggccgcctaatcgcagttaatgcgcaaacgggtaatgcatgccgtgattttggtcagaatggagaaatcaatctgttagcttctatgccttatgcttatttgggtggatataacccaacatctccccctatcgtcaccggtaatactattattataggtggctctgttactgataacttatcaactcaagagccttctggtgtgatccgtggctatgatgttaatagcggaaaattaatatgggtatttgatactggcgcagaagatcccaatgcgatgccaggtaaagagactcaatttgttcataactcccctaatgcatgggcgcctttagcttatgatgcacaaacggatgtggtctatattccgacaggagtaggtacacccgatatttggggaggcgatcgtcatccattaaaagagcgttacgctaattcagttttagcactaaaagggtcgacaggcgagctattgtggcatttccaaaccacccatcatgatttatgggatatggatgttccttcgcaaccatcactggttgatatcaaaactgataaaaatgaaacaatacctgccatttatatcgtcacgaaaacagggaatgtgtttgttcttgatagaagagacggtacacctattgttcccgtaacagaaaaacccgttcctaccagtgtcaaatatggtccacaaacacaaggtgagcattactcacccactcagcctttttcagcacttaatttagcacctaaaaataagttgcaaggttcagatatgtggggcggcacaatggcagaccagctgttatgtcgtatcgccttccatcagttaaattatgagggaatttatactccaccatcagaaaacggtacgcttgtttttcctggtaacctcggtatttttgaatggggcggtatttctgttaatcaagatagacaagtcgcggtaatgaactttattaccttgccttttatctcaaaactttatttaaaagatcctcaagataatcaagcaattgacgcaggccacggagagcaaggtttacaacccatgacgggaacaccttatagtgttgatattcatccattcttatcaccactaggattaccttgtaaacaacccccttggggatttgttgctggtgttgatttaacaaaaaatgagcttgtttggcaacaacgatttggcaccattagggatagtttgcctaatttagtggaattaccaccattaaaaattggtgttcctgggctaggaggcgctatctcaaccgcaggtaatgtgatgtttgttgctgcttctcaggataattatattcgagcatttaatgtgacgaatggcaaaatgttatgggaagcacgattacccgcaggtggacaagcaacgccaatgacctactctattggaggcaagcaatatgtggtcattatggccggcggacatggttcatttggtactaaaatgggcgatagcttagtggcttatgggttacctgataatttatag

SEQ ID NO: 141 - DNA, 606 bp, Proteus mirabilis
aattgtttaataaatttgctgtataattataagttgggaaaattatttgctggggtaatcataatgaaaaagtttttattattaggagcaatgagcgcattgcttatttctgctaatgccaatgccatatcgatgaatgtgcaagcgggtaaacattataccgatgtacaagcaggtttaggtgatgccgattctggactttcttttaacggtaattgggcacgtagtgatcacgatggtcaattaggtagtttaggtgcaaaatttgcgttacctcttggcccattctcagcaagcgttggtggtaaagcactttacctctcccccaaaaatggtgatgacggcgcggcattagctggtggtgttggacttaattggcgtgttttaccttcactgagtgtttatggtgaagcttatgcttcgccggaaggattaacctcaggaagtaaatcctattatgaagcggatgttggtgctaaatacacggtatttaaaccacttcatgttaatgcgggttatcgggtgattgaaattgaaaacgcgcataatcacagtaacaataaacttgctgatggtttctatgtaggagctggtttaagtttctaa

SEQ ID NO: 142 - DNA, 705 bp, Proteus mirabilis
acgagcttaattatgagtaaacccaataacgatattgcgagtgttggttcactggcaggggctttctcgtccgcatttcgccatttgatgatgaatacggatgatatgttgcccgcaacagtcattgattatgatgaaaaaagcaatcgagccgtgatcaaaccactggtgatgatgttaaccacggataatcaaactatttcacgagcacccgttgcaaatattcccgtatttcgctttggtggcggaggtttttttattagagcaccgattaaagcgggagattttggttggttaaaagctaatgatcgtgatattagccttatttttcaacgcggtggtctagaggatagacctaataccacccgattacatacctttagtgatgcgatgttttttcctgacaccttaaaaggttgggtgatcgacggaaaaaatattgatgctttggttattcagtcaatggatggttctgtctgcttttctcttcataacgataaagttgtactggaaacccccaagtatgaaatcaatgcccgagaaacgatatttaccggcaatgtcacagtaaatggtaattatgcggtaaatggaaatagtgattctcaagggggcgtgatgcgtcacaacgggaaagatatcggttcaacccatcgtcatagtggcgtacaagcaggcaaagataacacagggagtccaatatga

SEQ ID NO: 143 - DNA, 870 bp, Proteus mirabilis
aggaacctaattatgctttacccgagcgaagaaaagctatatgcaccgattgaatggcaggattgttctgaaggttttgaagatatcctctaccacaaatctgtcgatggcattgccaaaattacgattaaccgcccgcaagtgcgtaatgctttccgtcctttgactgtgaaagagatgatccaagcattagccgatgcacgttacgatgactcaattggtactattattcttactggtgcaggcgaaaaagcgttttgtgccggtggtgaccaaaagatccgtggtgactacggtggataccgtgatgaaagtggcactcaccacttaaacgtattagatttccaacgccaaattcgtacttgtcctaaacccgttgttgctatggtggctggctactccattggtggtggtcatgtcttacatatgatgtgtgatttaaccattgctgcagacaatgccatttttggtcaaactggtcctaaagtaggctcatttgatggtggatggggtgcttcttatatggcacgtattgtcgggcagaagaaagctcgcgaaatctggttcttatgccgccaatataatgcgcaagaagcattagatatgggattggtaaataccgttgttccttatgcttctcttgaaaaagaaacggtacgttggtgtcgtgaaatgctagaaaatagcccaatggcactacgttgcttgaaagcagcattaaatgctgactgtgatggtcaagcgggtctgcaagaattggctggtaatgcaaccatgctgttttatatgacagatgaaggtcaagaaggacgtaatgcttttaatgaaaaacgtcatcctgatttcactaaatttaaacgtaacccataa

SEQ ID NO: 144 - DNA, 930 bp, Proteus mirabilis
gatagagtaatcaggaggatggtgatgaacatacttatcacaggtggaaccggattaattggcagagcacttatctgccaactcgcattagataaacataatattaccgtactttcccgttcgccacagaaagtctactctcatttctgtaatgaaatggcgtgttggactcatttagatgataaagaaaacttaaaccaatttgatgcagtgattaatcttgctggagaaccaattgcagacaaacgctggacaccggagcaaaaacaaacgttagttaatagtcgatgcaaattaacccaaaagctggtggatttaataaaagccagcgactctccccctagtgttttaatttctggctctgcagtgggtttttatggtgatcaaggtgaaaataatgtcactgaagagacgccacctaaggatgaatttactcatcaactctgtgccaaatgggaaaatattgcactcgatgcacaaacgccattaacacgggtgtgtttgctacgtactggtattgtactctctacaaaaggaggggcattacctaaaatgagcccgccttttaaattaggtttagggggaaaattaggtaatggtaagcaatatatgccatggatacatattgatgatatggtcaatgccatcgtatttttacttaataataacaatacccaaggcgcctttaatctgacagcccctcatccagtacaaaataaagcatttaccacgactttagctcacgtactgaaacgccctgcatttatgacgattcctgccacaatattaaaattaatgatgggagaaagtgccacattagttttaggtgggcaacaagcgtttcctaagaaactgctcgatgcaggattcagctttcgttacccacaactggaaggcgctttagaagatattattcgccataaaaaatag

SEQ ID NO: 145 - DNA, 495 bp, Proteus mirabilis
ttattatccttaatacagagatcaaaaaagcaccttactgaggttataaatatgcttaaaacattattaacaccggatgtggtacaagtgatcccacaagtcaaagattggcgtgaagcaattaaaatcgcctgtcagccattaattgacaaaggttgtattgagcctcgttatgttgatgcgatttataaatcacacgagcaaataggcccttattatgtattagggccaggtattgctatgcctcatgcacgtcctgaagaaggggttaatcagctctctttagcattaactatcatcgaaaaaggggtggaatttggtgctaatgaaaatgatccggtgaaacttttaattgttttagccgcaacagataacgatagccatattaatgccattgtgaaattagctgaactttttgataaccaagatgatatagacactttgttgcaagcaaaaagtaaggcagaagtattggctgttattaatcactattaa

SEQ ID NO: 146 - DNA, 267 bp, Proteus mirabilis
atgataacaatctatttaaacctttcttcttttaaggaaaacattgtgataactcactcagttttccgtcgcttcttaacaaatttaacactcatttttaacacccaattactggccaatgctaaaacgtgtcagtcaacctacaaattttctgctaacacgcttagtctaaccgataattcgattttactacaccagtatctcaggaaaaacctgactctatataggcaaatgtgccttatttttttgatcaaactcacaaaatag

SEQ ID NO: 147 - DNA, 666 bp, Proteus mirabilis
aatatgacaatcacctgtaaaggctttctttttgatttagatggtacattagttgattcattgcctgttgttgaatactgttgggcactatttggtgagcgagtaggggtatcaacacaagaaattaataactatatccatggaaagccggccattgagtcgattcgccattttatgcctaatgctacgcaagcacagattgaagagacttttcgttggctagaaaagttagaagcgacacaaacagaaggattagcccctcttccgggggctatcgaactcattaatcgcttaaacgacttagcgatcccttgggcaattgtcacctcaggcacagtaccaattgcctctactcgtcagtcagttacaggtattcctgagcctaaacattgggtgacggcagaatgtatcactcaagggaaacccaaccctgagccttatcttttaggggcaaaaaaattaggcttggctcccgaagagtgtgtggtttttgaagatgctgctgcaggtatttattctggtttagatgccgggtgtcaggttattgccgtacatgctccgatttcccttcctcgtcgtaatgaaattgatttaatcattgattcattaaatgatttacaaattgacaaagaaaatcagcaagtcgttattaagcataaatgttaa

SEQ ID NO: 148 - DNA, 1245 bp, Proteus mirabilis
ctaggtaaaatagtttggaaaaacgaggactttgtgaaaaatcgcactataggcagtgtatttattgttgcaggaacaacaattggtgcaggaatgttggcaatgccacttgctgctgtgggtattggctttagtaccatggtgttattgctggtgggcttatggctattaatgagttacaccgcgcttttattagtggaagtctatcaatacaacgatccccatacaggccttggctctattgcgaaacgttatctgggtattggaggacaagtcgttacaggtttagctttgctacttcttatgtatgctttaacaacggcttatatcagtggtgcgggtgaattattagcttcgactttatcttcttggattggtcataagataaccatcacacaaggtatcattatctttacagttattggtggtgcggtagtcggtattggtaccacttctgtggatatgattaaccgcttactctttacagcaaaagttattttcttaatttttatgctggtagtcatgttaccccatgtggaaaaagtcaacttaacctctatgcctatcgctcagggactcgttctttctgcaatcccggttatttttacctcttttggtttccacggtagtgtacccagtattgtcagttacatggatggcaatatcaaaaaactacgcctcatatttatcgtaggtagcgcaatccctcttattgcttatattttatggcaattagcaacattaggagctattcccaccaccacctttatggggattttagcccaagaatctggcttaaatggcctactcaccgccatccgtgatgtggttgctacaccgcgagtcaatattgctgtcaaccttttcgcagcccttgcactcgccacctctttcttaggcgtagcattaggattatttgattatctagctgatttgtttaaacgcagtaatcgcgcatctggtcgttttcaatctggtttattaacctttgttcccccgctattctgtgcgttatttttccctaactttgtgcaagccttagcctatgcagcaattgctttatctattctcgcactattattaccagcacttctggtatggaaagtaagacagcaaaagcagactacagagcattataaagttaaaggcggtaagccagccttagccatcgtatttatctgcgggttagtagtgattggtattcaaattgcgattacctttaatatattgccacaagtgggttaa

SEQ ID NO: 149 - DNA, 414 bp, Proteus mirabilis
gagttaaaaatggctaaaatagcgcggggtgaacgtaataataacccaggtaatatacgccatggtgcaaaatggcaaggattagcaagcacgcaaacagataaagatttttgtcaatttatttcaccagaatatggcatcagagcgatttataaattaattcaaacctatcaaaaaaaatatggtttaaatacaattaaaactattatttatcgctatgcaccacctaatgaaaataatacattaggttatattgagcgcgtatcaaaagaaatagggattgaaagtaataaccctattgatacccaaataaaaaatgtttgtatatctttatctatagccattattaatattgaactgggttatcaaccctatgcaaaaaaagtatttgaagatgcttggttgttattatga

SEQ ID NO: 150 - DNA, 564 bp, Proteus mirabilis
gagatgaaaatgagcagtaaaaaactaacccctgctgaagttaatgatgcacataaactccaaacccgtcctctatctacccctacagatttagcacctaaagcaacaaaagaagttagtgcagcgatgaatgctattcttgcggatgtgtttgctttatatctaaaaacaaagaacttccactggcatgtgagcggtcctcattttcgtgactatcatctaatgttagatgaacaaggtgatcagctctttgccatgacagatcctattgccgagcgtgtacgtaaaattggtggcatgacattacgctctatagggcagatctcaaaaatgcaacgtattaaagataatgatgctgaatttgttgagcctttagatatgttagctgagctatgtcaagataatcaattacttgcagcagaactgagaaaagcacatgttgtctgtgatgaaaataacgatatctctaccgcaagcttaattgaaaattggatcgatgaaacagagcgtcgtacttggttcttatttgaagcttgtcgacgtgcagaaacatcagggcactaa

SEQ ID NO: 151 - DNA, 1626 bp, Proteus mirabilis
cagaatgaaataattctgtattgcctcctactgatattttgttctttttacttgcaaacgacctgcaaaggttttttttgggaatttaagatgcaatctactcactcaaaatcaagccgaaccttttttggccatccataccctttaagctctctgttcttcacagaaatgtgggagagattttctttctacggtattcgcccattattaatcctatttatggctgcaaccgtttatgaaggtggtatggatattcctcgagagcaggcatctgctattgtgggaaattttgctggtggtgtttatttaacatcattgacaggaggttggctggctgataattggttggatcaacgtcttgcggtttggtatggctctatctttattgcactagggcacctttctatcgcactttcagcgttttggtctcagaacctattttttatcggtttattgcttatcgtattaggtacaggcctatttaaaacctgtgtcactgttatggtgggaaccctgtataaaaaagatgatacacgccgcgatggtggtttctccttgttttatatggggatcaatatgggctcgtttatcgcaccgctgatcaccggcttcttagttcgtgattatggctggcattggggctttggtattggtggtattggtatgctagttgcactactgatcttccgcttttatgccgtaccgacaatgcgtcgctttgataaagaagttggcttagattcaagttgggatcgccctactgttgtgcgtcgtaatgtcggacaatgggtattagcacttgctgtgatattaattgccattgttggtttaattatttcaggcactattccatttaatccggttattgttgccaattttatggtttatgtgatctccggcagtgttatcgcctattttatctatttattcctatttgcaggattaagtagtagtgaccgttctcgcctgtttgtttgcttcctattattagtttcagcggcactgttctggtctgcattcgaacaaaaaccaacctcatttaacttatttgctaacgactatactgatctaaattttatgggctttgagatccctgcggtttggttccagtcagtcaatgcgctatttattattattcttgcccctgtatttagctggttatggccaatgctagcacgcaacaatatgaatttaagtagcatgagcaaatttgtgattggtattttattcgctgcaggtggctttaccgtcatgatgtacgcctctgaaagcgtgcttgcaacaggtagcggtgtttcaccattatggttaatttccagtattttattgctgaccctaggtgaattatgtttaagccctataggacttgcgacgatgaccattttagcgccagcaagaatgcgtggacaggttatgggcttatggttctgtgcgagtgcattaggtaacttagccgcaggtttaatgggtggaaatattcgtcctgataaacttgatgttatgcctgatttcttctctcacgtctctatagcattggttatttgtgccgttgttcttgcagcattaattattcctgtgcgtaaactgttacaaagtgcagatgataaagagaatgcgcaagcataa

SEQ ID NO: 152 - DNA, 648 bp, Proteus mirabilis
aaatcacccttattttccccaataacaataattagaggaagaaaaatgccaacaattcatctggttgatgacgatctcgccgtcaccgatgcttgccaatttctattagaaagcttaggttatgcggcgcaggtttggaatgacagcgaatattttctccataatattgacctttatcagcaaggggttgtgctgttagacatgagaatgcctaaagcagatggtagacaagtacatcaatatttaattgaaaaacacagtacgctagcagtgattttcttaacgggtcatggtgatattccgatggcggttgaagaaataaaaaaaggtgccattgattttttacaaaaacccattgatagcaatgcattactctctgcactgaaatccgcctttaccgaaactgcaacacgctttacggctgatgatatccgtcgccgttatgcctcactgacaccaagagaaaaagatattgcatattatgttattcaaggcctaatgaatcgagaaattgctgaaactgcctgtgtttctatcagaacagttgaggtacatcgagcaaaagtgatggataaaatggccgttaaaaatatcgcagaattagttaccgcattacaaggaattgatattgtagcgccaaatttatga

SEQ ID NO: 153 - DNA, 1278 bp, Proteus mirabilis
tttcggagaataaatcctatgactaaaatatttaaaatcccctttgccacgcaaggggataaaacagttgtgcctgtagagatccaaacagatggctcagtatcttatactcaaggttacggttatgattatgagcgtgaccaagtcactgatccggcggcaaaagatattgaacgtgaaaaaatgaacagcctatttcacgatatcaccgagtctattggtgaaatgcaattacaaggttttgctaaatggtcagaagcgggcaaaccctatgctattcgtagtgtggtttatcataacaataaggtatggcagtctaaaattgagaataataatattgagcctattgccggtaatgcatgggctgagctaaaagctgatatcaccgcgaatgaagtgggtgcttataacaaagctgaggctgataagcgttttcagccggtgggtaaatatcaagcggaaggttatagctatgcaaaagcggaatctgatactaaatatcaacccaaaggcaattatgctcctgcgggaaattatgcgaataaaggcgatagttataccaaagcggagtctgatgggaaatatcaacctaaaggcaattatcaagcatcgggagattatgccaccaataccaatttaaaaaatgagcttaataagaaatttgataaaggtaatattgctcaagcgaccggaacctcaacggctcatgttattagccaaaaagccgctactgatgcttttcagccaaaagggaattatcaacccaaagggaattatgcattagtgggtgcatcctatacgaaaacggaatctgataataaatatcaacctaaaggcaattatttagcgacaggttatagttattctaaatcagagtcagatggtaaatatcagcctaaggggaattatcaacccaaagggaattatcaacccaaagggaattatgcagttattgggagtagctatactaaagcggaaagtgatagtcgatactcgaaacaaaaagtaacaggttggaaagaactatataatggtaattggctaagtggtgagggtgttaatataaatgaagatattcgaggtaaaatagtatgggttgatcttggtggtaatcaatggagttcatttactatgcctcctatagatgatattccaatgtggtgtggtcactctgataataattggtgtgcattcaaaacatctaataatggtaaaaaaatacatcgcgcttttggtaaagggaatacgggaatagtaagagtttgtgttattagttaa

SEQ ID NO: 154 - DNA, 1614 bp, Proteus mirabilis
aagacaggaattgtcatgaatattattaatcaaccttggttgccttttcgttttcgtgatggcgagattaaaacacttccaatatcagctatttcacatcctgatattattgatttctcattaaatagagccgattttaaaggtgctgcttatcaatttgcaatagggttattacaaacgatatttgcaccagaggatgaagatgaatgggaagaatattttgaaacaccaccttcaagtaaaaaattacaatctgcatttgataaagttgcacatgcttttaatataatgggtgatggccctttatttatgcaggatttttcaactttagaagagcaaaaaaatattcctatagctcagttgctaatagatgctcctggtgaaaatggaataaagcaaaatacagaccattttattaaacaaggtattgctgatgtaatgtcattagagatggctgtgttagctttatttaccttacaaataaatgcccctagtggtggcaaaggtcatctagtcagtctaagaggaggtggacctttaacaacattagtttatcccgcagaagaaaattcaacattatggcaaaaattatggcttaatgtaattaatagagaattttgggaatatgatgaaccaaattttgatgatggtagtgtttttccttggttaataccactaaatttaaaagaaggaaaaggtgaaaaagtttcacctgatgatgtacatcccctttatatgtactgggcaatgcctcgtagaataagattaaaagtagaaaataaatctgtcacttgtcaaattagtgatatgaaaagtaatttttcagttaaatattatgttactaaaaattatggattagactatcaagaaggttggttacatccattaacgccatattattgggatcctaaaaagccagaaatgtttcctaattctattaaaggaagacaaggaggtattcactataatttgtgggatcgattatttttatcaagtaatgaaaatggacaaaaaagcgctactgttgtcagtcattacttaaagctatatcaattattagaattcacaagaaagcctagattacttatttttggttatgatatggataatatgaagccacgtggatggtataatttagaaatgcctattttccatgtaaaagatgagtataataataaaattattaatgaaataaaaattatccaaaaattaactatagattgcttaagaagtgtaaaagaacaggtaaaaaaagcgtggtttagtagtcctaaggatatgaagggcgatattagttttattgatttaactttttggcaaagaagtgaaaatatattctttgaagtggtacaaaacattatcgttcaaatacaaaaaaatgattttctaacccatgaacaagccaaaaaatggttaaactctattagaaaaataagtatttctatttttgatgaatatgctttatcagcattaggaacacaaaaatcagttagtgggtgtattaaagcaagaaatggtttaattaaagatctttatagtaataaaagaataaagaagtttgctgaagactttaaaattactaaggaaaatggagaacaatatgggatcttataa

SEQ ID NO: 155 - DNA, 477 bp, Proteus mirabilis
aaaaaattgattgaggtcattatgaacgaaccgacagtgactcccccaggtttcttcaaaaagttacgcctagggaacgagtatctaaaaacctggccggttgagaagcaattagccccagtttttcctgaaaatagaatgataaaagcaacgcgttttggcatacgttatatgcctcctatcgctatttttacattaacctggcaaattgcattaggtggcgatttggggccggcgatcactactgcactttttgcctgtagcctgccaatgcaaggattatggtggttaggaaaacgcgctgcaacgccattacccgcggtgttactcaattggttttatgaaattcgtgaaaaatttgagcaagcgggtatagcattagccccagtagaaaagacgccaacctatctctcattagcgcatttgcttaaacgtgcttttaagcaacttgatcgctcttttcttgatgatgtgtag

SEQ ID NO: 156 - DNA, 747 bp, Proteus mirabilis
tactttctgatgaatgataaaacaacctctttgcatgctaacgtagatcagcatgaaatcgacaaatttgagagtgtcgcatcaagatggtgggatcttgaaggtgaatttaaacccctacatcgcatcaatccactaagacttaattatatccaagaacgtgctgatggcttatttggtaaaaaagtactcgatgttgggtgtggtggcggtattttatctgaaagtatggcccgtgttggtgcagaagtcaccggactcgatatgggtaaagagccattagaggtcgcacgtctccactcactggaaaccggtatccctgtcacctatatacaagataccgttgaaaaccatgccgcagaatatccacaacgctatgatgtggtcacttgtatggaaatgttagaacacgttccagacccttcctccattgtaagatcatgtgccaaactggtgaaaccaggtggacatgtattcttttctaccatcaaccgtaataaaaaagcgtggtttatgctggtggtaggcgcggagtatattctgaatatggttcctaaaggcacccatgatgcgaataaatttattcgtccctcagaattattaagctgggtcgacgaaaccaatttacgtagcaaaaatatgattgggttacattacaatcctattacagacaaattccgattagcgccaaatgttgatgttaattacatggtgcacactcaagcgaccgataattcggatttgtaa

SEQ ID NO: 157 - DNA, 612 bp, Proteus mirabilis
ttaacaaagatatatattctgaggattataatgaaaaagctgattgtcgggctaacaggtgccagtggcgcaatttatggtattcgtttattagaaatacttaaatccgtgccaaccgtagaaactcacttggtgatcagtcaagcggcgcgtcgtaccatttcattagaaacggattattctctcaaagatattcatgctttagctgatattatttatgacgatcgagatataggggcgactatctcttcaggctcgtttcgggtcaatggtatggttattttaccttgttcaattaaaagcctctccggtattgtacatagctatactgatacgttagtgacacgtgctgctgatgtcgtgttaaaagaaggacgtaaattagtgctatgtgtacgcgaaacaccgttacatttagggcacttacgtttaatgactcaagctgctgagcttggtgccatcattatgccaccagtacctgcattttattttcagcctaaaacgatcgatgacattgttaatcagacagtaaatcgagtgcttgatcaatttgacattgatttgcccgatgatctttttcagcgttggcaaggggataaacctgcccgttga

SEQ ID NO: 158 - DNA, 1845 bp, Proteus mirabilis
gatgcgcggatgaatatactctatttaacctttgtgctaccactgctgggatttttactgctcgcattctcaggtggtcgttggtctgaaaatgtatcagcatggattggcacgggcgctgttggtttatcagctttagtgacactttgggtggggatagatttctttgctcacggacaagaaacagaagtcttaacactctggacttggatgtcagcggggaactttactatcccatttacgttggtgcttgatggcctatcattaaccatgctaggtgttatcactggcgttggttttcttattcatatgtatgcatcttggtatatgcgtggtgaagaaggatattctcgcttctttgcttataccaacttatttatcgcgagtatggttgttttagtattggctgataatatgatgctgatgtatatgggttgggaaggggttggtttatgtagttacttattaattggtttctactataacaacccagctaatggcgcggcagcaatgaaagcatttattgttacccgtattggtgatgtcttcttagctatcggtatgtttatcctgtttgatcaattaggtacgctaagtttccgcgaaatggcggtactggctcctgaacaactgaccgcaggatcaagcatcattaactgggcaatgttaatggtcttagggggtgcggtaggtaaatcagcacaactgccattacaaacttggttagcggatgcgatggccggtccaacacctgtttctgcgttgatccacgccgccaccatggttaccgctggtgtgtacttagttgcccgtagtcatgcgctattcttaatggcacctgatatcttagaattagtcggtatcgttggtgcagtgacattagtattagcgggttttgcggctttagtacaaaccgatatcaagcgtattcttgcttactcaaccatgagtcaaattggttatatgttcttggcgttgggtgctcaagcatgggatggcgcaattttccacttaatgactcacgcgttctttaaagcattactgttcttatctgcaggttcagtgattattgcctgccatcatgaacagaatatctttaagatgggcgggttacgtaagaagatcccatttgtttatgcatgctttttaattggcggaggtgccttagcggcattaccactgttaacagcagggttcttcagtaaagatgaaattttatggggtgcgtacgcaaacggacatttcaatttaatgttagcaggtttaattggcgcattctttacgtcactttataccttccgtttaattttcatcgtattccatggtgaaaccaaaaccgaagcacaccaagttaaaggcttcactcatactttcccattagcggtattagcgttgttatcaacctttattggggcgttaattacccaaccgttaggcgatgttttcccagaaagcaccgttactcatgaaagtaagtatgtattagaaatcctttctggtgtggtagcgattgtaggcgttgccattgcagcatggttatacctgaaacagcgtcaacttgtttctcaggtggcaaataccaaaacagggcgtttcttctcaacatggtggttccacgcatggggatttgatgcactgtatgaggtgctgtttgtcaaaccttataaaggtgcggcatggcttatccaaaatgatcctgttaaccaattctttaatctctttggttgtctctttaaaggcgccaataaaggcttgagtttcagtgaaaacggattagcgcgttggtatgcggcttctctcggtttaggtgcagtgctggttatcgctctgctgcttctggtttaa

SEQ ID NO: 159 - DNA, 264 bp, Proteus mirabilis
attagaaatgttaaagtacaacaccagttttttcggcaacggcgggagccaaaatttccttcaatacctattaggcaagctcagcggttctctcccgtcgattataaaaacgctgatggcttctttgccgtcatcatctcagccggcttcgcctctttcacagaactcaaaacaaccatagatttagaggaagcttttgatctgtgggaaattgcgattaccaatcgttataacgaggcgctagcggcgtccaaggagagataa

SEQ ID NO: 160 - DNA, 309 bp, Proteus mirabilis
atctttttcgtccttgcaactgacttgacaggttttacagccagtgcatttagtggagtcaaaataaaaaccatattgcttcatgagttaactccttatgcacgtttcacttcaacaaggttagtatgttgtggatttcctttagcaaacggcgatgggtgccagcttgttaatgtattaatacatccaccggtatctacacctgttgtatcaagtgaacgccatgcaccttgtggtactgcaatcacaccaggtaatacacgatctgtcactttgacacgaatatgcaagcgaccacgttcgttataa

SEQ ID NO: 161 - DNA, 1137 bp, Proteus mirabilis
gataacaccgtgaaaattctggttgatgaaaacatgccttatgcgcagcagcttttttgccaattaggcgaagtaaaagctgtatcgggtcgccctttacctattgaagagcttgatgatactgatgcattgatggtgagatcgattactaaagtcaatgcatcactattagcgggcaaaccggtaaaatttgtcggcaccgcaacggcaggttttgatcatgttgatacagcatggctagagcaacaaaaaatagcgttttcatctgcgccaggttgtaatgcgatcgctgttgttgaatatgtcttctctgcgttgatggtgtttgctgagcaagaaggatttcaattaacagataaaaccgttggcattgttggcgttggcaatgttggagggagactggcaaaacgcttacgcgcattaggtgtgaatgtactactttgtgatccgcctagagctgacagaggggatgatgaacaatttcattctttagaaacgctattaaagcaggcggatatcctgactttccatacaccgctaaataaatcgggtcgttataacagttaccatttaattaatgagagcaacctcgatattttacctgaaggtcgtattttaattaatgcaagccgtggcgaggttattgataatgctgcattattatcagccttaaaccaaggtaaaaagttacgcgttgttctagatgtttgggagccagaacccgatctttctcttgagttattaaataaagttgatatcgcaacaccacatattgccggctataccttagaagggaaggcgagaggaacaacgcaggtttatgaagcttattgtgattttattggtcaacctcaacacgttgaattatcaacactgttaccaaaaccgttgatctccacaatttctgtacaaggtgaattaactcaaacattactcaaacagcttattcatcttgtctatgatgtacgtcgtgatgatgcaccattgcgcaaagttgccggtatcaaaggggagtttgataagctacgtaagttttaccctgtccgtcgtgaatggtcttcattacaggtggtatgtgataacccgataacggcgagcttactcaatgctattgggtttaatgcaacacataaataa

SEQ ID NO: 162 - DNA, 309 bp, Proteus mirabilis
agaaaaatagtaatgagtatgattgttgttgtaactgaagctgttcctcctcgattaagagggcgacttgctgtgtggctattagaagtgagagcgggtgtatatgttggtaatgtttcagctcgaataagagaaatgatttggcaacaaattaatgagtttgctgaagatggtaatgtcgttatggcatggggaactaatactgagtcaggttttgattttcaaacctatggtgagaatcgacgagagcctattgattttgatggcttgagattagtgttatttaagccatataaagaagacgtataa

SEQ ID NO: 163 - DNA, 189 bp, Proteus mirabilis
cgaaattcagtttctgcaagcaattgctcatcacgaaaacggaccgtatctggatcagagagtaaccactgcatctctttttgttgttcaattgtcatcttaatgttgctcttttatcgttttgtctttattggcctatcggttgtctgcttttcattatatatatctaatcagacaggcttacaatag

SEQ ID NO: 164 - DNA, 846 bp, Proteus mirabilis
gtcgtgacagtaaatcaaagggaatattgtatgagattagctgacttacctaagtatttttctccaaaaagtgttgtattaagtgatgttaggacgcctaaagctgttgattcattatccattacggatgtaatggcttcaataagcttagcgacccgtaaagggcgaatgggaatagagctatttttagcgaaacaccacattaaccgtcccgaagaagcgatagaaagcctgtatcaatgtgcattaactcaagttaaccaatataagatgattgataagttagctgaacatgataaagctaaagttttacatattatcgctgaatatgcttttcaggattatgccagaagtgcagccagcaagagagcatgtcctgattgtgatgatggctttatcgaagttgaagtttttaccaccaaatgccatggtcgaaaaacaacccagcaggttactcaaaatgccaaacctcatctaaaaacaacctcatcaaataaaccttcttttcgagaggtaagggaagtaacacgcgttatttgccctacatgcaaaggtaaagcggaaattcgtttagcatgccgttgccatggacgtggaaaaattgttgataaaaaacagactgaattacaaggagttgccgtatttaaaccttgtcgccaatgtgctggacgcggttatcctcgccttaaattcagcgaagtcttacaacaattgcaacatgtggtgagtatttcaaaaacggctgcttatagtcattataaaccgctatttgattttttagtggcggaatgctttaaagaagagtctttatcagataaatttctacaagaagttactgtaaaataa

SEQ ID NO: 165 - DNA, 1338 bp, Proteus mirabilis
gtatttagagtggaaaaggttaatcctgtgttttcgacactgtacgaaaaagttaaaaatataaatctgacagcacaagatgatcttttacatttgaaagttatcttgccatcagaggtgtcattttccttactttcatggctagcagcacaaacgtattacccgcaattttattggcaacatcgtgatgaaagcgaagaagtagccgcttgtggacaagttaagtgctttaatcatatccgtgatgctcatcgatttttagcaacacatcggcattcattgcatgctgatgatgtgcgtatttggggattaaacgcgtgggataccattattccagggcgtattgataaagaaaagggggatgatgcttacctttttttacctcgtatcgaaataagacgtcagcaacaactgtctatccatattaatttattggcagaagaagataagcaaagtgcgcttgcttttattcgctcacttaacaatgcactgaatattgcacctttatctgtcaaagtaacatctgtagagcactcgttaacgcaacagcaatggactgactatcttaatattgctttagaggaaatcaatcaaggtgtatttgaaaaagtagtacctgcacgggcaacctgcttaagcttagataatccgttaaaagctattcaatttatgaaagcaagtcgagatgttaatcatcattgctatcattatatgctggctttttcacctactgatgcttttatgggctcatcaccagaaagattgtataaacgcgatgaatttgtgctttataccgaagcgttagcgggcactgtggcaagttctgataatgaacaacaggccagagcatttgctgattggctaatgaacgataaaaaaaatcaacatgaaaatctggtggtagttgatgatatttgtcagcgattacaaggtgggatagaagggattgatgtgtcgtcagcagatgtgatccgcttacgtaaagtgcaacatctgcgtcgctatatccacggtaaacttatccatgctgatgatgtggattgtttacagcgtttacaacctaccgcggctgtttgtggcttaccgcgctctattgcgcgcacttttattcgtcaacatgaaccttttgaacgccgttggtatgctggctctgcgggctatttgtctttgcctcatgccgaatttgcggttagcctgcgttgcggtgaattgcatgatgatgcattaacgctttatgcgggcgcaggggtggttgcgggatctgatcctttgcaagagtgggctgaaattgaaaataaagcagcaggtttgcgcactttattagaaaaagagtgttga

SEQ ID NO: 166 - DNA, 831 bp, Proteus mirabilis
tgtattggagtgaggaagatggatcttcgacgaataaggctcggaattgaagtcggagaacggcttcaatggtatgaaggattacgtatttcagccagtggaacaaagtatgccaatccattacaaaatgaatgtaatgtcactatctcagggctaaatgcacaaacaagagattatctgctgacagaaaccagtccctataataacaataagcaaacgcgacgactctatttggaggtcggccgagttaataccggattactctctttgtttattggcgatattgtcagtgctgaaatagattcacctcctgatgtgacgttaactttatcggcaaaaaccagtcatcaaagcgcgggaaaaattatttcttccagtggcggcacaatgcgcaggctgagtgaaatagccttggctattgctgatgactgtggggtgaaattagattttcaagctaccgataagaatattgctaattggtattattgcggctcagcattgcatcaaatagaacgtttacaggaagctggggacgttaaagcctttattgatgatgatacgttatttgtaaaagatgacgacaaagcactaaaaagccgtttgcgtattttaaatatgaattcaggcatgattggcattcccaaagcgacagaaagtgggttaaccgtaagttacttgattgatagcacctctgagcttggtggaatgcttcgccttgagagtaaattaaacccttcattaaatggtgattacatcattgagcaattggcgtttagtgttgcctcacatgaggctgatttcaactataccgcaatttgtaaacgagcttaa

SEQ ID NO: 167 - DNA, 468 bp, Proteus mirabilis
agatgcttggttgttattatgaactatcttacaaaaatcataataatcattatgttatgtttaattgctggacttttttgggttattgatagaaataaaatattaaaacaaaaatatgtgaaaattaatgaaacactgacgcaacagattgtagaaaacaaaaactatcaattaagaataaagcaattatatcaaatggatactcaacgtttacaggagttagccagtgccaagagtgaaattaaccggttgcgtagttatgctgagcgtgatcctgagcgggtgtacatcagagccagttgtgcaaaaaacgacgccaattccaccccccgcgtggatgatgcaacccgcgccagacctactgacgccgctatccgaaattattggatactcagagaaagaattgctcagtcagagtccatcatcttaggtctacaagattatattcgccaagagtgtattaattaa

SEQ ID NO: 168 - DNA, 498 bp, Proteus mirabilis
agatttatggtctggatagattacgccattattgccattatcggtttttctgcattagttagcctgatccgtggctttgttcgtgaagcattatcacttatcacctggggttgtggtttttttgttgcaagtcagttttatccttatttagccgtctattttactcggtttgaagatgagctggttcgtaacgggattgcgattgtcacactgtttattgcaacgctaattgttggtgcggtgattaattatgtgattagctctcttgttcaacgcacagggttatcaggtacagatcgtgtgttggggatctgtttcggggctttaagaggtgtgctgattgtatcagcgttactttttgtcttgggtgcttttactcctatggcagacagtgccgattggcaacgttctgagcttattcctcaattcaaccatattattaggtggttctttgactacctacaaaatgcgtcaagtttcgtgtcggagaaaatgtaa

SEQ ID NO: 169 - DNA, 561 bp, Proteus mirabilis
aagagattatttatgaccaacgcatcaaataaaatcgctactcacgagatcacgattcggccaactcaattggctgatgccaaccaactaccgaagattgaacaatcggcaggagagttatttagcagcataaaagaattaagttggatcagcgaaagtggtgtacaaagtgttgaggcgcatattcaatttatccatcaacatgctcactgggttgctgttaatcatgacaatcatcccgttggttttatcatgacgcaacaattacctgaaagtgtatttattcatgaattatcggtaagtaaagattggcaaaataaagggattggtaaattgctgatccagacagtaaaaaatgaagctaaattacagcaatttaatgcggtaacgttaacgactttccgcgatgtcccttggaatgctccctattatcagcgtttaggtttccatatcttacttgagcatcaaataccctattctttacaacaaattttagataatgaagtagagcatgggggatttgcgagagaaatgcgttgtgcgatgaagtgtgaaatttaa

SEQ ID NO: 170 - DNA, 546 bp, Proteus mirabilis
ggagcgatattcatggaatttgcattctatattgcaggactgatttcaatccttgccactttgagagtaataacgcataccaatccggtacacgcactgctgtatctgattgtttcattaattggcctttcagtggtgttcttctcgttaggtgcctattttgcaggtgctttagagatcatcgtttacgccggcgcgattatggtgctattcgtattcgttgtgatgatgcttaacttaggaaaatcggtcgttgagcaagagagaaaatggttacagcctagattttggatagggccggcgattttgtctctggtactgttaattgtattggtttatgcaattagtagtgtcactcatggtgagattagtggcgagattattggggcgaaagaagtcggtattagcttatttgggccttatattctggctgttgagttagcctccgttctcttattgtcaggattaattgttgcttatcacatcggtcgtgatcagagccatgacgatctcgtcgaaaacgaaaaagtaggggagccaaaatga

SEQ ID NO: 171 - DNA, 1875 bp, Proteus mirabilis
attgacgtattaatctgttttcacttattgctgatcgaggccattttgaatagcgaattattatgggttttaagcctgctattgatagctattgtcctttttacgaccaacaaaatccgcatggatgtggtcgctttacttgtcatcgtcgcttttgttcttagcggcacactctcattaaatgaagccacggtaggatttagcgatccgaacgtattactgattgcggccctttttgttattggggaaggattagtaagaacaggtgtggcatatcaaatgggagattggctagtacgagttgcgggtagtagtgaagtaaaaatgctggtgctattaatgatctgtgttgcaagtttaggggcttttatgagctcgacaggggtggtggctatttttattcctgtggtgctcagtgtggcggcacggatgaaaacttctcccagtcgattaatgatgcctcttggctttgcggggttaattagtggtttaatgaccctagttgcgacaccgcctaatatggtggttaatagtgaattagttagggaagggctacccagttttcagtttttctctattacccctatagggatcgctgtattagttgcgggtgtgttatatatgctggtggtacgtcgttggttaggttcaagtgaagggggtaagcaaaaagaggtttatcgtcgtacttttcgtgatcttatccgtgattaccaattagcagggcgtgcacgtcgcttagccatacgtaaaggttcaccactgattggtcactctctagatgaattacatttacgctctcgctatggagcaaacgttgtcggtattgaacgctggaggcgttttcggcgtgttatggtcagtgcgacaggaggcactgaattaagagagcgagatgtcctattagtggatatgtcagcaagtgaggtagatttacgagagttctgtcgtgaacaaatgttagagccgatggtgttacgtggagagtatttttctgagcaatctcgtgatgtgggattagcagaagtctctatgaaccctgactcagaattattaggaaaatcattaagagaaatcaaattccgtacacgttatgggctaaacgttgtggctattcgccgtgaagggagtgctttaccggggaaaattgttgatgagccattacgtctgggagatgtgttactggttattggtgattggaaattaattcgtatactttcgacaaaaccgcgtaattttattgtattaaatttagcggctgaaattgatactgttgcaccggcctcatcgcaagcaccacatgcacttttttcattagcattaatggttgcattaatggtgaccaatgaagtacctaactttattgccgcgttaattgcttgcttattgatgggaaaatttcgctgtatagatatggaaagtgcttatcgttctattcattggccaagtattatcttgattgtcgggatgatgccttttgcggctgcattgcaaaaaactgggggtatcgagcttatcgttaatggacttatggatgtagcagggaatgctgggccacaggttatgttagtctgtttatttgtactttgtgccactattggtttatttatctctaatacggcaacggcggtgttaatggcaccgattgcaatagcagcggcccatcaaatggatgtctctccgttaccttttgcaatggtcattggtgttgctgcatcggcggcgtttatgacacctgtatcatccccagttaataccctgatccttgagcctggtggttataaatttgctgattttattaaaataggggtgccttttaccatcattgtgatgttgattagcgttttcttaataccgctattattcccattttaa

SEQ ID NO: 172 - DNA, 204 bp, Proteus mirabilis
tgtacaccattatttgtggttaggttaattacaacaaaacctatccaaaaagcgatgagaataaaaccacagattttatgtagtagtaccatcgatggaacattaccgatagaaaaatggcctaacaatccactgattaatagaagaatgaacagtaaggcattaccccaatgccaaaaacgaatggctttagagtataagtaa

SEQ ID NO: 173 - DNA, 276 bp, Proteus mirabilis
ataatgctttctgagtatgaaacgtacttattagataaaattgatagccgtgttgaacatgctacggatgatgaattatttgctggtggatatttacaaggccacatcactttagcgattgcggagcttgagcaagaaaacaatacgcaattatcagcattaaaatcccgtgtagaagagagcattcaaaaagctatcaaagcaggagagctttctcctcctgatcaaatattggttttatcgacgtggcatgatttagttaactcgattaattag

SEQ ID NO: 174 - DNA, 816 bp, Proteus mirabilis
attgtttcttcttcctctttccgattaaggtactttatgaacacgcttcccatttattatgttaacgcttttacttcaacacctttttccggaaatccggctgcggttattttgttagataaatggctacccgatgacacactacttaaattagctaatgagattggtttacctgaaacggcttttttagttgccaatcatattcgctggtttacgcctaaagtagaagttcccctatgtggacatgcgactttagccacggcttttgtattaaaaacgattaacaaagcacctgcgacaagctttaaattccattctttgtctggagagctcacggtatcttgtcactcttcaagttttactctcgattttcctcaagtacctgcatcattaaatccaactataaagccatcattagaaacggcactaaacatagatattgaagaagtttggcaatctcacgacagatatacctgctttgtggctgatcctaacagggttattgattatcaacctgactttaatgctataacacaactaccacttcccggtgtaatattgaccgcgaaaggtcatgcgccttttgattttatttcacgcttttttgcaccacgtaaaggggttaatgaagatccggtaactggcacttcacattgtgtattagctccaatttgggcaaaaaaattaaacaaagataaattaaatgccagacaagtttccgcgaggggaggcaatatacagtgtgaactcaaacaagagcgcttattgcttactggtgatgctgtactatttttaaccggtgaaataaccttttaa

SEQ ID NO: 175 - DNA, 3129 bp, Proteus mirabilis
ccattatattcagagaaagtattcgttgggttgtcaggagagtacagcatggctaagtttacaagacgtcaatggcttaaaggtggattggttatcggtggtattgccgcatttgctgccagttatcgcgatgttgctaagcgtgctgtcgacggtctcgttgatgggacatctggtaaggttactttggataggatcaacggtaactctttattaccagaaggtaaaatcacggcgaaagcgaattggcaacctaataccaatcaagctgtttgtatgactcagtgctttggctgctggactcagtgcggtgtgcgtgcgagagtcgatcgtaacaataatcaagtattacgtattgcaggaaatccttatcacccattatctcaggatatccattttggttataacatgccaataaaagaagcctttgaaaaaatggggggcgaaagtggtttagctaaccgctctacggcttgtgctcgtggtgcgacgatgatggaaagcctcgatagtcctactcgtattcttgaacccatgaaacgagtgggtaaacgaggtgaggggaaatggcaacgaattagctttgagcaactgatcaaagaagtggttgaggggggcgatttatttggtgaagggcatgttgatggcttacgtgctatccgcgatttagcaacacccattgatcctaaacagccagccctaggacctaaagcaaatcagttattagttactaatgctggggatgatggccgagatagttttattcgtcgctttgcacaaaatgcctttggtagtaaaaattttggggctcatggctcttattgtggattagcgtatcgtgccggctccggtgcattaatgaatgatctggataaaaacgctcatgtgaagcctgattgggatcatgttgaatttgcactatttttaggtacctcacctgcgcaatcaggtaatccatttaaacgtcaaggtcgccaattagcgaatgcgcgtattcgtggttcgtttaactatgtagttgtggcacctgctttgccattaaccaccacgttagcgaatgatcatggccattgggtacccgtacaaccgggaacagatgctgctttagtgatggggatgatccgctggatcattgaaaacaaacgctataatgctgagtatttatcggtgcccagtgaagtgtcgatgaataatgttggagagcgaagctggactaatgcgacacatttagtcattagtgatgaaaatcatccactgtcagggcagatgttaaccgccgcgcatcttgaggatattgccgatggcgaagcgcaaaatatggttatagcccttaatggacagcttacagcagcgacgcaagtagacaaagcacagctttttgttactcaaaaagtgacattaaaaacaggtattgaggttacagtaaaatcaagtttccaattattaactgaggcagcaaaccgcatgtcattggcggagtatagtgaacgttgtaaagtacctgaaagcactattattgccttagcgcgtgaatttactgactacggacgaaaagctgcggttatctcacatggtggcatgatggggggaaatggtttctatacggcgtggagtgtcatcatgctaaacgctttaattggaaatctaaacctgaaagggggggtatctgtcggtggaggtaaatttaatggtgcgatagatggccctcgttacaacatggatagttttaaaggtaaaattaagcctaaaggaatggtgctatcgcgcagtaaagcggcttatgaacaatctgatgaataccgtgaacggatcgcaaaaggggagtctccttatcctgctaaagcaccgtggtatccgtttgccgcagggcaattaacagagcaactgggatcggcattagcgggttatccttattcattaaaagcatggataaccaatatgacgaacccgctatacggtattgcaggtattcgccaagttatggaagcgcgtcttaaagatccacagcatctaccattgattattggtatcgatgcttttatgaatgagaccactgcactggcggactatattgtgcctgatacgcataactttgaaagttggggatttagtgcgccgtggtctggtgtacaagtcaaagccagtacggcacgttggccgattgtagagcctcgtgtggcgaaaacagccgatggtcaacctatatcaatggaaactttctgtattgcggttgctaaagcattagacttacccggctttggtgaaaatgcgctagaagataaagatgggcatttccacgcaattaatagtgctgaagattattatctgcgtgtagcggctaatattgcctttatgggcgagcagcctgtagcacctgccagccatgaagatattttattaagtggtgtcgatcgtattcttcctgctattactgccactttaaaagaagaagaagttctaagggtggcgaatatttatactcgtggtggtcgttttgccccttatgataaagcatggaatggtgatgcgacaggcccgcaatggaagaaaccattacagatctggaatgaaaatgtagcgaagaatcatcatgctattaccggtgagcgatatagtggttgcccaacttattatccaccgcgtttatctgacggtagcgatatacatcaacattttccacaagagcaatggccattaaaactgatgtcctttaaatctcatgtggtaagtagctcaacgggcatgatccaacgtttaagaatggtaaaaccaagcaatttagtcgcgattaatccgctagatggtgaaaaatgggggatcaagcatggtgataaagtgcgcatagtgacccctggtggagaggttgaggctgaaattagtttattagagggggttatgcctggagtgttagcgattgaacatggttatggacataaagagctaggctcacgtcaacactatttagatgggcaaccattagctatggataaagcaataggtagtggtattaacttaaacgacttaggctttgctgatccaacacgagaaataacgaatacttggttagattgggtttctggtgcctctgtacgtcaaggattaccggcaaagattgagcgtatcgcctaa

SEQ ID NO: 176 - DNA, 1215 bp, Proteus mirabilis
ataggtaattccatgtcaagtaagctggtgctggtactgaactgcggtagttcttctcttaagtttgcaattattaacccagaaaatggtgaagaattcctttcaggcttggctgagtgcttcaaccttcctgaagcccgcctgaagtggaaaatggatggtcagaaacatgaagcggctttaggcgctggtgctgcccacagcgaagcattaaactttattgttaatactattctggctgaaaaaccagaactttcacaacaaatcgcagcaattggtcatcgtattgttcacggtggcgagaaatttactaaatctgtcgtcattactgacgaagtcatcaaaggtattgaggcggctattccatttgccccattacataacccagctcaccttattggtattgaagaagcgcgtaaagccttccctcatttaattaataaaatggtggcagtatttgacactgcattccaccaaacaatgccagaagaagcttatctgtatgctctgccatacagcttatataaagatcacagcatccgccgttacggtgctcacggaactagccatttctttgtttcccgtgaagcagctaaaatgttaaataaacctgttgatgaactgaacgtaatcacttgccatttaggtaatggtggttctgtttctgctattgttaacggtaaatgtgttgatacttctatgggtttaacaccattagaaggtttagtcatgggtactcgtagtggtgatatcgatcctgctatcgtgttccatttacatgatactttaggtatgagcgttgaagatattaataaactgctcactaaagaatctggtttattaggtttaacggaagttactagtgactgccgttatgttgaagataactacgaaacaaaagctgatgctaaacgtgcaatggacgtttactgccatcgcttagcgaaatacatcggttcttattgtgcactgatggaaggtcgtttagatgccattatcttcactgggggtatcggtgaaaatgcagcaatggttcgtgaattatcactgaaaaaactcgctctattaggttttgaagttgatcatcagcgtaacttagatgcacgtttcggtaaatcaggcaccatcactaccgataacagccgtcttgctgttgttatcccaactaacgaagagttagttatcgctcaggatgctagccgcctgaccgcttaa

SEQ ID NO: 177 - DNA, 558 bp, Proteus mirabilis
aaagtaagttcgcttactttttatataggaccgatcatgagcaaattaaataaatcactctgtgcattaggagtgactctttctatattctcagcacctgctgctttagcatcaggcacaattaactttacgggagaaataaccgatcaagcatgtactgttgatggctcttctaaaaacttaaccgtcgacttaggcaaagtttcttctaaaagcttagcaaccaaaggggaagttgctggcctgaaagattttaccattaaattaatcgactgccctgttgataccacggtagccgtacgttttggcggtactcgtgatgcaagcgacagagatatcttagctatagagcaagtttctggtggcgcaactaacgtaggtatcgcgttatttgagaaagatgctgtttcccaaatcaaactgtatgacgattcacaagatgtacagatcacaggtacggaaattaacctagactacgttgctcgttataaagcaactgatgcggcaacaccaggccctgccaatggctctgctgtatatagcatccaatataaataa

SEQ ID NO: 178 - DNA, 951 bp, Proteus mirabilis
gttattaactcgctggatcgcaagacaatgagccaaattattgacgtccctgaaacactctcattagccattgatagcttcttaagttatatcgaagttgaacggcgattaagtccggtaacggtagaaaattaccagcgacaattaatgaccattgcacaaatgatggttgcaataaaaatcaaccaatggtcgttactagaaagccaacatgtgcgtatgttattggctaaaagccatcgcagtggattacaacctgcaagtttagcattgcgcttttcagcattgcgtagcttccttgattggcaagtttctcaaggaatgttagcagtaaaccccgccaaaggggttcgaacacccaaatcaggtcgtcacttgcctaaaaatatggatgttgatgaagtcagtcagttgatgaatatcgacttaaaagatcccctctctgtaagggatagaacgatgctggaagtgatgtatggcgctggattacgtttatctgaactgactaacttaaatatcaatgatattgatctccaagaaggcgaagtccgagtattaggtaaaggcagtaaagagcgtaaagttcccttgggaagaaaagctgtagagtggttacagcattggtttgccatgcgggagctgtattctcctgaggatactgcggtttttatctcaacgaaaagcggtaaacgattatctgttcgcagtgtgcaaaaacgttttgaactttggggggtgaaacaaggactcagtagccatgtcaatcctcataaactgcgccactcttttgccactcatttacttgaatcaagtggtgatttgcgagcagtacaagagctattaggccacgctaatttatcaaccacacaagtttatactcacttagattttcagcatttagcgaaagtctatgatgctgctcatccaagagctaagagagaaaaatcataa

SEQ ID NO: 179 - DNA, 294 bp, Proteus mirabilis
agttttactttgtataatattcaaacaaatatggaggtgtatattatgagtataaaaagcgaattaatagccactaaagttgatatagagctcaaagaggcttttgttgcaatagctcgaaataaacacagaccagcctctcaaatcttaagagatctcattcgagtttatgtggaaagtaatcaaacacaaccaaatgaaaaaacattaaacacttttgcaaaaacagataaaggtgatgatgttttttatgctgaagatgcccatgatttattcaaaaaattggatatctaa

SEQ ID NO: 180 - DNA, 585 bp, Proteus mirabilis
aatatcatgtctcactctaagaaacagctaggatatattatgtcaaaaagcgagaacaatcttatctggatagatctggaaatgactggccttgatcctgaacgcgatcgtattattgaaattgccactatcgtcaccgatccccaacttaatattttagctgaaggtcccgttattgccgtacatcaatcggataaattactcgcctcgatggatgaatggaatactacaacacatacggcaagtggtttagttcagcgggttaaagaaagtcagtatgatgatgcggctgcacaacaagccactatcgaattccttgaaaaatgggtgccacagggtgcatcaccgatctgtggtaatagtgtggggcaagatagacgttttctatttcgctatatgcctgaattagaaaaatattttcattatcgttatctcgatgtcagtacactaaaagagttagctcgtcgctggaaacctgaaatccttgaaggatttaagaaaaataatactcatcaagcgttggatgatattcgagaatctattgcagaattagcctattatcgccaaacctttattaaagagtag

SEQ ID NO: 181 - DNA, 1113 bp, Proteus mirabilis
ccaagttacccaaaaatggattgtcgatacaaaaggagtatggcgttgagacgtattttagtcacaggtggcgccggttttatcggctccgcagttgttagacatattattgataacaccaatgacagtgtcgtcgtggtagataaactgacttacgcgggaaatttagagtcacttgccccagtggcaaatagtgaacgttacgcgtttgaacaggttgatatttgcgatcgcgctacacttgatagtttatttgcgcaatatcaaccagatatcgtgatgcatttagccgcggaaagccatgttgaccgctctattgatgggccggcagcgtttattgaaactaatattgttggtacttacaccttattagaagctgcacgtcatttctggtcagtattacctgaagataaaaaagcggcatttcgtttccaccatatttcaactgatgaagtgtatggcgatttagaaggaacggatgatttctttactgaaacgacaccttatgcaccaagtagcccttattcagcttctaaagcatccagtgaccaccttgtacgagcatggttgcgtacctatggcttgccaacattgatcaccaattgttcaaataactatggcccttatcattttcctgagaaattaatcccgctgattattttgaatgcaatttcaggaaaaccactgcctgtttatggcaaaggtgaacaaattcgcgattggctctatgttgaagatcatgcccgtgcattgtatttagtggcaacaacggctcaaccgggtaaaacatataatattggtggtcataatgaacgccgtaatattgatgtagtgacaactatttgtgaattgctcgaagagttgcatcctaataaacctgctggtgtggcgaaatatgttgatttaattacccatgtaaaagacagaccgggtcacgatctacgctatgctattgatgccgctaaaattgcagcagagttaggttggaaaccacaagagacctttgagtcaggtattcgtaagactgtattgtggtatttaaataaccaaacttggtggcaacgagtactagatggctcttatgcaggagagcgtttaggactgggtgattga

SEQ ID NO: 182 - DNA, 702 bp, Proteus mirabilis
tcaccattaccctctcacctctcctcaaacttatggccacttatgaaaaagaatatttccctaatattatttttactattttccctcataacggctagccaagctgctggaataagtgtgggaggaacacgttttgtctatgacgataatctacgtgaaatcagtattccaattatgaatacagataaggaaaaaccctatttaattcaaagttgggtttcagcttatcaaggtgatgaaaaaacaccttttattgcaacacctccactatttcgtattgagccagatagttcaggcacggcgcgaatttcatataccggagcacctttggcgtcaaaccaagaagtggtttattggctcaatatcaaatccattccaccgatggaaaaaagtccagagaatcaactccaattagtgattaattctcaatttaaattgtttctccgtgcccatgatattgaaccacttgattttgataaggtgaaattatctaaacaaaataaagggttagtaataaataacgatacgccgtatcacctgacaattaaacatatcttagtgggtgataaacgctacccatttaatgattttgttaatcctcaccaagaagtggtcttgctaaaagaaaatcatattccgcagaaagttaccgttcaatttatcaatgattacggtgcgactgtagataaagtattaaattaa

SEQ ID NO: 183 - DNA, 981 bp, Proteus mirabilis
aaaaacatgcctaatgacacattagataatgtcattgggtatgataaccccgtcacatatttcatttccatcaataccagagatagcatgagccagaaaaacactttaaaaggcgttttatgtgccctaggcgcctatttgatctggggtattgcccctgtctattttaaaagcattcaagaagtgcccgcagaagagatcttaacacaccgtattttatggtcattcttctttatgttgcttttaatgtcgatcactcgccattggccctatttacgccaacttgttcgccagcccaaaaaagtactaatgttagcacttactgcggtgattattgccagtaactggcttatctatatatgggcggttaaccacggatttatgttagaagccagccttggttactttattaatccattagttaatgtgttattcggtatgatttttttaggcgagcgctttcgccgtatgcaatggttcgccgtaagcttagcctttactggcgtctttatccaattatggcaattcggctctgtacctgttatcggccttagtttagcagtcacattcggcctatatggactattacgtaaaaaacttggggtagatgcacaaacgggtatgacaatagaaacactgtggctgtttcctgttgctttagtttatatcctcttttttacccattcacccaccagcaatatgttagaaaatagctggtcgctaaatacattactgattgctgcaggggttatcaccaccgtacccttactgctctttaccgaagcagctcaacatttgcgtctatctaccctaggatttttccagtatataggacccacattgatgtttattctcgccactatggtgtatggagaacaaatcgatgcggagcgtttagtgacctttgggtttatttgggtcgcccttatcttatttactttagatgcactctacactcagcaacgtttaagacgaagttag

SEQ ID NO: 184 - DNA, 393 bp, Proteus mirabilis
ctccctaatactccgcgccataagtatgacgatagagaattaggagtgtgtcagatggcagaaagttttatcacgactaatcgtttttttgacaataaacattatccgcgtggtttttctcgtcatggcgatttcactatcaaggaagcccagatattggaacgtcatggtcaagctttcaatgaacttgatttaggcaaacgagagcctgcaactgaagcggaaaaattatttgttgccatgtgtcgtggcgaacgagaagcagctactgttgaagaaaaaatttggaagaaatataccagtcgtataagtcgtccaaaacgttttcataccttatcgggtggaaagccacagctcgatccatctgatgactataccgattctgatgattaa

SEQ ID NO: 185 - DNA, 2052 bp, Proteus mirabilis
tattcttggttaatgaagtttggaaaaagtatgcgattaaatcccggtcagcaaaaagcagttgaatatgtgtcaggtccttgtctggtcttggcgggagccggctcgggtaaaacacgagtgataaccaataaaattgcttatcttattcgtcaatgccgttattctgctaagcagattgctgcggtgacttttaccaataaagcggcgcgtgaaatgaaagagcgtgttgctcaaacattgggaaaacaagaggcaaaaggattaatgatctcgaccttccatacattaggattggagattattaagcgagaatacaaagcattaggcataaaatccaacttttctttgtttgatgatcaagaccaatccgcattattaaaagaattaacggtagatttattagaagaagataaagatttgctatcacagttaaagagtcaaatctctaactggaaaaatgacatgctcacacctgagcaagtgattggtagagcacaatcgcagcaagatcatacttttgccgagtgctttcgacgttatgagcaacatttactaagctgtaatgtattggattttgatgacttaatcagtaagcctaccttgctattacgtactaatgaagaagtaagggcgcgctggcaacagcgtattcgttatctgctggtggatgaatatcaagataccaatacaagccaatatgagttggtgaaatggttagtgggtgaaagagcccgtttcactgtggtgggggatgatgatcagtctatttattcatggcgtggtgcgcgtccccaaaatctggtgctattgcaaaaagatttcccacagctaaatgtgatcaaactggaacaaaattatcgctcatcagggcgtattttaaaatcagctaatattttaattgaaaataatccccatgtatttgaaaaacggctgttttcagaattaggttatggggatgaactacgagtattaaccgctaataatgaagagcatgaagctgagcgtgtagcgggggaactgattgcccatcattttattaataaaactaattataaagattacgcaatactctatcgaggtaatcaccagtcgcgtatttttgaaaagtatttgatgcaaaatcgcattccttatcgcatttcgggtgaaacctcgtttttttcccgtgaagagatcaaggatattttggcttacttaagagtgatcactaatccggatgatgatgctgcattcttacgtatcgtcaataagcctcgtcgtgaaataggcccgatgactatccaaaagttgggggagtgggctaaagtccgtgataaaagcttatttaatgcttgttttgacttgggattaagccaaacgttaacagggcgaggtttaagtgcattacaggctttttcacagtggatggcgcgaattgtacaacaatcagagcgtgagcctttgctcgctgtacgtgatttgcttcatgaaatggattatgaaagttggttatatgaaacctctagtagcgcgaaagcagctgaaatgagaatgaaaaatattaaccagctcttttcttggatgagtgaaatgcttgagggggatgagctacatgaacccatgacgctctctcaagtggtcaaccgttttactctgcgcgatatgatggagcgtggcgaaaccgatgaagagttagatcaagtgcaattaatgacacttcacgcctcaaaaggactggaatttccacatgtttttctggttggcatggaagaggggatcttgcctcaccaaagtagtatcgatgaagataacgttgaagaagagcgacgtttagcttatgtcggtattactcgagcacaaaagacattaactttcacattatgtaaagagcgacgtcaatacggtgaattaattcgtccagagcccagtcgttttctatatgaattgcctcaagacgatctccattgggataccaataaaaagaaagtgttaagtgctcaagaaaagcaagaaaaagggcaaaaaggggtcgctgggcttaaagcgatgctggccagacataaaccttag

SEQ ID NO: 186 - DNA, 204 bp, Proteus mirabilis
aggatattaaccaaattaatgataggcagatttcgaatgaaaacgtatttacgttgcacccttgctataataacactgatttctctttctggttgtggcttgaaaggccctctctatttcccgcctgaagatactcaggcaaatatgactcagtcatcccagccaacccagcaagttgagacttcctcaacacaaaacaattag

SEQ ID NO: 187 - DNA, 1926 bp, Proteus mirabilis
ggtagcataacacgacaagtggtgatggcacctttatactggtgccttttcttttactcctcattatcgttcttaccagcttttcagaggaatggcgtgtccacagcagaagttcttaattcaatgccatcagctcaggttattttgcgcgaaacctttggttatcagcaatttcgaccaggccagcaagagattattgataccattatcaccgggcgcgactgtttagtcgtcatgccgacgggagggggaaaatcgctttgctatcaaatacctgcgcttttgcttgatggcttaaccgtagttgtttctccgttgatttccctaatgaaagatcaagttgatcaactctgcttacatggtattgacgcggcatttcttaactcaactcaaagccgagatgaacaactgcaagtacaaatgcgttgtcaacggggtgaaataaaactgttatatattgcacctgaacgcctaatgatggagagttttcttcaccatttagtgcaatggcagcctgctttattagcggtggatgaagcacactgtatttctcaatggggtcatgattttcgccctgaataccgaggaattggcttattaagacagtatcttcctgatgtccctattattgcgttaacggcgacagctgataatacaacacgtcatgacattattaatcagctcgcgttacgcactcctttagttcatattagcagttttgaccgcccaaatattcgttatactttagttgaaaaatataaaccgctcgatcaactttggctgtttattcgtgggcagaaaggaaaatcaggcattatctattgtaatagtcgcagcaaagtagaagagaccgctgaacgactaggtaagcgaggattaagtatcgcggcttatcatgcgggtatggatattgccacacgagcaaaagtgcaagatgcttttcaacgcgatgatttgcagattgtggtcgcaacggtcgctttcggtatgggaattaataaacccaatgtacgttttgtggttcattttgatattccgcgtaatattgaatcttactatcaagaaacgggacgcgcaggacgcgatggtttacctgcacaagcggtactgttttatgatcccgcggatatggcttggctacgtcgttgtttagatgagaagccagaaagtgaacaaaaagcgattgaatcccataaattaaatgccatgggggcttttgccgaagcacaaacttgtcgacgtttagtgttacttaattactttggtgaacaccgccaacaagcttgtggtaactgcgatatttgccttgatccacctaaacaatatgatgggttagtggatgcacaaaaagcgttatcttgcatctatcgtaccggacaacgttttggtattggttatattgttgaaattttacgcggtgccaataatcaacgcattcgcgataatggtcatgataaattgccagtttatggtattggtaaagcccatagccatgaatattggatgagtgtgatccgccaattgatccatttaggtatggttgcgcaaaatatcgttcatcgttctgcattacaattgactgagatagctcgaccgatattgcgtggtgaggtgtcattacccttggcagtaccacgactattaagcccaacaaaaagccgttatcagcaaacaaaaaatagtcatcgacagtacgataggaaattatttgcgaaactacgcaaattacgtaaatctattgctgatgaagaaaatattccaccctttgtggtatttaatgatgtcacactgattgaaatggcggaacaatgccctgtctgccctgatgaattgttgttgatcaatggggtaggacaacgaaaactagaacgatttgggccagcatttatgacacttatccgtgatcatattgaggggttcgaatag

SEQ ID NO: 188 - DNA, 225 bp, Proteus mirabilis
ccacatgaaacatatagctatttttatctctccataacgcatcagaatataacactgcttaataattatattgcagtggttaataccgaaagaaaaaccattaatttactatttattctgttaatagaaataattaaattcaaaaataaaaagtttcgtataaataataattttttatccaataattattttttaactttatttattttctatatttttcaataa

SEQ ID NO: 189 - DNA, 303 bp, Proteus mirabilis
cacaatgaaactattttatcgatatataattatacaatattggaatatgaacatcataaaatgttacttagttttctatttacttatagagatctcttttattaccaaagatccttcttactaagtaaagaattaagaaataatagcgaccatcttagttgcttactgttttctcttattttaatgtttatcaatttttgcaatataaaaagccatctttgttctgtattcttcaaaaatttgtgcaaacacgcctatctttttttattgctaaagatcacaaaaatacgtttttatacttaa

SEQ ID NO: 190 - DNA, 1065 bp, Proteus mirabilis
ggatcggtgacaaaacgtaaattatctaaaggccagcaacgccgagtacaagaaaatcataaaaagcgtttgcaaagcaaagagaaaaaaaatcacgttgaattagacgatacacaattaggcgaagcgaccgaaggcctcgttatcagtcgctttgggcaacatgcagatattgaagctgtagatggctctattacccgttgtaatattcgccgtactatttcatccctagtcacaggcgatagagtggtgtggcgccctgcattacaaacccaagaaaatgtgcgcgtcaatggcattgtagaagctgttcatgagcgtacttctgtactcactcgcccagattattatgatggtattaaacctattgccgctaatatcgatcaaattattattgtttcagccattttacctgagctttcacttaatattatcgaccgctacttagtggcttgtgaaaccttaaatatcgacccccttattgtattgaataaagtcgatatgttagatgcagaaagccgagcgatggtaagtgagtggatgcaaatttataaagatattggttatcgagtgcttgaagtctcaagctataccaaagagggattagaagcattaactcaagcattaattggccgcatctctatttttgctggccagtcaggtgtgggtaaatcgagccttctcaatactctcttaccaccaatggaagaaagtattctggtcaatcaagtctctgacaactcagggcttggacaacataccaccaccgcatcgcgcctttaccatttccctctaggaggcgatgttattgattcaccgggggtacgtgaatttggtttgtggcatttaacacctgagcaagtgaccaaaggttttattgagtttcgacctttcttaggaggctgtaaattccgtgattgtaagcataatgacgatccgggttgcttgatcaccgaagccgtagataaaggtgaaatcgcaccaacccgatttgaaaactatcatcgtattttagaaagtatgagtcaggtgaaagtgcgtaaaaatattaatttagactcttaa

SEQ ID NO: 191 - DNA, 243 bp, Proteus mirabilis
atagataatgcagattatgtattagatgagctgcttaaggtcactaatacacaggctaactttcctatgaaaggcagtattccaaaggaattacaaagtttaggtattcgtgaatatcagcaaatcttttttaaaccttatcgtgtcatctatcacacaatagcaaaacaagtggttatctttattattgcggatggcagacgagacatgcaagccctgcttactcggcgacttttagggtaa

SEQ ID NO: 192 - DNA, 1578 bp, Proteus mirabilis
ctcatggcagcctttagacctttaacttcagcacccagtagtgctgaatatttaaaagccgcattaagtgcgcctgtttatgaagctgctgtcgtgacacctttgcaagagatggcaaaaatttctcagcgtttagaaaataccattttagttaaacgagaagaccgacaaccggtgcatagctttaaactgcgtggcgcttataacatgattgcagggttaacgccggagcaaaaggcaaaaggggtggttactgcatcagcgggaaatcatgcccaaggggtggcattatcagctaatcgaatgggcgtaaaagcattaattgtgatgcctattgcaacggcggatatcaaagtggatgccgtacgccagtttggtggtgaagcattgttgtatggggctaactttgatgaagcaaaagcaaaagccatcgctttggcaaaagagatgggatatacctttgtgcctccttttgatcatcccgctgtgattgccgggcaagcaacattagcaatggagctgttacaacaggacgtccatcttgatcgtatttttgtacctgttggcggcggcggtttaattgctggggttgctgtattaattaaacaactgatgcctgaaataaagatcattggtgttgaggcagaagatgctgcttgtttaaaagcagcgttagaagcaggacatcctgttgagttacctcgcgttggattatttgccgaaggtgtcgctgtcaaacgtattggcgatgaaaccttccgtttatgccaaaagtatgttgatgatgtgataaccgttgatagtgatgcaatttgtgccgctgtaaaagatctgtttgaagacgtacgcgctattgcagagccttctggtgctttagcattagcagggctaaaaaaatatgttgaggagcatcagatcaaaggggaacgtttagctcacgtactttctggcgctaatgtgaatttccatggcttacgttatgtttcggaacgttgtgaattaggtgaaaaacgagaagcgctatttgccgttacaattcccgaacaaaagggtagttttttgcgtttttgccaaattttaggacaacgtgttgttactgaatttaactatcgttatagcgatgccgatccagaaaatgcacgtatttttgtcggtgtgcgtttaagccaagggctacaagagcgtaaggaaatcgtgcaacagctaacggaggcgggttatcaagtctccgatctctccgatgatgagatggcaaaattgcatgtgcgttatatggtcggtggtcgccctaaccagccattaaaagagcgtctgtttagctttgagtttccagaagcaccgggtgcattaatgaagtttcttaaaacattagggacttactggaatattacgctatttcattaccgaagccatggtactgattatggccgtgtgctggtggcgtttgagttacctgaaacggaagggcgttttgaacggcatttagatgcgttaggttatgaatatcatgatgagacaggaaatccgtcttttcagttatttctttcaccacaaacagccagcttagtggtggagtag

SEQ ID NO: 193 - DNA, 2538 bp, Proteus mirabilis
gagtatacggcgatgactttttctatgatagcagtatctacaaaacgattacccatcaacatggcagataatctttatcgtcgtggagtgttagctattgctatcacgactgttttattcccttatactgttcttgctgaagatatttttaatcctgaagcacttaatttaggtatcgaaaatcacgttgcagatattaacagcctgaattacctgtcctatgcaggaggacaacttcctggtgtctattctgtcgatatttatcttaacgataaacttatcgataatcgtcaaattcgttttatttttgatgacgataaaaaagtgctggcgcctgaaatcagtaaacaggatttactcaattggggagtcaaagggtccgttacagacgcgtttagccaacaacctgatagtagtaaaataacggatattgctcgtgttattcctaatgctacatataaatatgatttttcacgtgcgcgattatcattttcgatcccacaaattgcattatataactatgggcaaggttatatatctcccacagaatggaatgatgggattaatgcagcctttattaattacacctatcgtcagaataaatattggtatcgagaccaaaaagacagtgacaatatctttttaggattgcgcagtggtattaatctaggcgcttggcgtgtacgtaatcacagcacttacaacaaaaatagtgataacgccgcagaatggaacagtctacaaacttacgttgaacgcgatatccgccgtttaaaaagtcgattaacactaggtgaaaccgcatcaagtaatgatgtgttagaaagtgttccttatcgtggtattaaattagcctcagatgaaagcatgttgccacaaagtcagcgtggctttgctcctgttgtgagaggaattgcacaaagcaacgcaatggtgactatccgccaaaataatagtgttatttatcaaacctctgttccccccggtgaatttgaaatatcagatctctatcccacctcttatagtggtgatttacaagtgactgttgaagaagctgatgggagcaaacgtacattttcccaacccttctctgcagtccccatgatgcaacgagctgggaacttaaaatatagcctcgacttggggaaatataatgctgatagcgcagagcgaaaaccgacctttttacaagcttctgccatttacggcttaccttataatttttccctttatggaggtacgctactttcagcagattatcaagcttatgcgataggtgccggcgtaaatatgggttatttaggggcgatttcagccgatataactcatgcaaataccactcttatcgataaccataaagcacaagggcaatcttatcgtgtccagtattcaaaatatttaccggataccaaaacaggattttcattagcgtcttatcgctactcaactaaagattattatgatttttcaaccacgaatgaacgcttttcacagctttatcgtaagaaaaaacagtttcagatctcagtatcgcaagcattaggagagcttggttacctctctttaaatggttatcagcaatactattggtatcaagatagagtcgatcgcaatatcaacctaagctttaactctaattatcgctcactcagttatagtatttcttatgcctataataaacggcaagaaagtgaattaaccgatcaaattttatcgattaactttaacctgccgttcaatatgaccagcaataacaattggttaagttatcgttataacaccagtaaacaaggtgattcgataagttctgtgagtttaagtggtactcgtctcgaagataacaatcttcagtatgatatttcgcaaaactataaccatactcgccaagaatatagcggtgctatcaatggtagttatagtgcttcgggcggcgaaatcagtgctggttataactatgataaacgtttccagtcagtgaattggggagcaactggcgcgttattaatccatcaagatggaataaccccatctcgcactatctatgactccgctattttaatcaaagcggaagatattgatcatttgaaaattagcagtgcgcaaagtttatataccaatgctcaaggttatgccgttatccctaacgtttcccgttatgaacgcaatagagtaacggttgatcccgcatccttaaagggaaacaacgatgtggaactcacttcaacaacagtgatcccaacgaaaggcgcgattgttttagccgattttaaagctcgcaagggtgcaagagtattagtgaacctctcttataacggtaaacctttaccatttggtagccaagttgaaattagccaagatggacaagtgatttccagtgggattgtggctaatgatggtgaggttttcctaaatggtgtacctgcaagtagtcaactacaagccaaatgggggaatagtgctacggaacagtgccaagcaacattaaacgccgatctatcgctcgagaaaattcaatttttacaactggactgcagatag

SEQ ID NO: 194 - DNA, 927 bp, Proteus mirabilis
atgcaacgttatttttactatttacctaggcggctgaccatggatattcgcgatctcaaactcttcttacatcttgctgaaagttgccatttcaccaagactgcgcaagccatgcacgtcagtccatccacactctcacgtcagatccagcgtcttgaagaacaactagggcatccactttttttgcgtgataaccgccaagtcacactgactgatgcaggggagcaacttaaacgttatgctcaacacaccttattgcaatataagcaactcaaacatacgctaaaccagaacagtcccagcttatctggagagctacgtctattttgttcagtcactgcaacttatagtcaccttccgccgatccttgaccgttttcgtgcggaaaatcccttagtcgagataaaattgactaccggtgatgccgcagatgctgtggataaagttatctcagatgaagccgatttaggtattgcaggaaaaccagagaagttgcctgaaaatatctgctttgagaaaataggcgagatccccttagttcttattgcccctgctctaccgggtaatgttcgacaccttgctacacaagaaaaaccggattggctcaatattccctttatcattcctgaacacggcccatcacgacagcgcattgctttatggtttaaacgccatcgaattcaaaatcctcttatttatgccactgtttcagggcatgaagcgattgtttcaatggttgctcttggttgtggtatcgcacttattccgcaagttgtcgtcgataactgccctgagccggtacgaaaccgtatctctttgctcgataatatatcgctggtagaaccctttgaacttggcgtttgtggtttacacaaacgccttcaagagcctgtgatcagtgcgttttggcgcctactccaccactaa

SEQ ID NO: 195 - DNA, 1317 bp, Proteus mirabilis
ctgatattctattacattatgagcaaaacatatttgacagaaaagaagttttccgacttcgccttgcatccaaaagtgatagaagcccttgagaaaaaagggttctctaattgtacacaaattcaggcattgacgttacctatcactgtgaaaggtcatgacattgctgggcaagcccaaacaggaacaggaaaaacgttggcgtttttaacctcgacgtttcattatcttttaactcaccctgcaaaagaagggcatgaaaagaatcaacctcgtgcactgattatggcgccaacgcgcgaattagctgtgcaaatttatacagatgcacaacctttagcacaaagcactggtattaaaatgggtctagcctatggtggagatggctatgacgaacaacttaaagtattaaataacggtgtagatatcgttatcggtaccacgggtcgtttaattgactatgtaaaacaaggtcacattaatcttaacgctattcaagttgtcgtacttgatgaagcagacagaatgtacgatctgggctttattaaagatattcgctggttattccgtcgcatgccaaatgccgcagagcgtatgaatatgctcttttccgccacactctcatatcgtgtcagagagttagctttcgagcagatgaataaccccgaatatgtagaagttgaacctgaacaaaaaactgggtttagtataaaagaagagctgttctatccttctaatgaagaaaaaatgcgtcttctacaaaccttaattgaagaagagtggccagagcgctgtattatttttgctaacaccaaacatcgttgtgatgatatttgggcgcatcttgccgcagatggacaccgcgtaggtctattaacaggtgacgtgccacagaaaaaacgtctgcgtatcctagaagattttacccaaggtaatattgatattcttgtggcaaccgatgttgcagctcgtggtcttcatataccttctgtaacacatgtctttaactatgatttacctgatgactgtgaagattatgtacaccgtataggtagaactggacgtgcgggtaaaagtggtaactcaattagcttagcctgtgaagaatacgcgttgaatttaccggcgattgagacctatattcaacatgctattcctgttagtaaatataacagtgatgcattattaactgatttacctgagccaaaacgtcgtcatcgtcctcgtcaaggtcagcctcgtcgtaataattcggcacctcgtagaggaaataatactcaacgtaataaccgtaataaacgcccgagtcactcataa

SEQ ID NO: 196 - DNA, 483 bp, Proteus mirabilis
ccattgggtcttaactggaatttaaaggcttgtagacgtttcatattacctattatactttggtctatgaaaaatgaaactaatattcgccgtggcaaacattgtgtattcctgatacacgtccatttggtctttgtcacaaaataccggcaaaaaatatttgatcaggatgcaattgaaaaatggcgaggctactttgccagtgtttgtgctgattttgatgttgaacgggttgaaatggatggggagcgggatcaggttcatttactgattaattacccgccaaaactggcgatatctaatctggttaacagccttaaaggggtatcgagccgattacttcgacgtgatcgtcctgatattgcccaacgtgattactacaagggggttctttggtcgccgagttatttcgcggggagttgtggtggcgcaccaatatccattatctgccagtatattgagcaacaggaaacacctagttag

SEQ ID NO: 197 - DNA, 1008 bp, Proteus mirabilis
actcttaagcatagattcactgacaaccctattaagggtgggtacaatagaccccttttgtcgattttttatcgttcgatcccagaggttgccattttggacaagctaaaaattaaactacagtatctattgcctaaattatggctaacacagctagctggttggtttgccaataaaaaagcgggtagcgttactcaatttgctatcaaaatgtttgctcgcgcatataaagttgatatgaatgaagcgaaagagagccaatttcaggcttatgcaacatttaatgagttttttattcgtgcattaaaagatggcgctcgccctattgttgaaggagataaccaactggctctccccgcagatggcgctgtcagtcagcttggtcagatccaagacgatcaaattttacaagccaaagggcactcttacacccttgaagcgttgctagcaggtaattttaccttggccgaccagttccgccatgggcaatttattacaacctatctttcaccacgggattaccaccgtgttcatatgccttgcgatgggttattaaaagagatgatttatgtccccggcgatctcttttctgttaatcctttaactgcggcaaatgttcctaacttatttgctcgtaatgaacgtattatttgcctttttgacacccaatttggtcccatgatacaaattcttgttggagcgaccattgtagggagtattgaaacggtctggtgtggcatggtaacaccaccacgtgaaggtattattaaacgttggacttatcctcaagcggataaagttggcgctatatttctgaaaaaaggtgaagagatgggacgctttaaattaggctcgaccgttattaacctcttccctgaaaatagtgttcaattaaataaagatctgatgaacggctctgtaacattaatgggagaactactaggctctatcattaatgccacaggcactgatcataaggcctgcgataataataccattaatgaataa

SEQ ID NO: 198 - DNA, 219 bp, Proteus mirabilis
aattattttaaaaataatcattgtcaacatgaaaatatcatggtaactctaaaaggacagagtgaaagagaacacaacacagactattttttactacagaaaaagaattttaatattatgaatactatcgtcctagtgattagcctaattattgtcagcgtggtggtgattattaacccactgtgcggggctgcactaggacgaagaaaggctaactaa

SEQ ID NO: 199 - DNA, 1689 bp, Proteus mirabilis
attaatattaaacaagaagttaagacgcagggtgaaagaatgaatggagcacagtggttagttcaagcattacgaaaacagcgagtggaaacggtctttggttatcctggcggtgcgattatgcctgtgtatgacgcactctatgatggcggtgtcgaacatgttttgtgtcgtcatgaacagggagccgctattgctgctatcggatttgctcgttctaccggtacaactggtgtctgtatcgcgacatcaggcccaggcgctactaatgtcatcacaggtcttgctgatgcattgttagattctgtgcctgttgttgctatcacagggcaagttgcttcaaatttaatcgggacagatgcttttcaagaggtggatgtacttgggctctctttagcatgcaccaaacatagttttctggtttctgatgtgaatgaactgccaagagtcgtatcagaagcattttcgatcgctaagcaagggcgtccaggccctgtgttaattgatattactaaagatgtgcaattagcagatgcttcacatttagctgattatccattgccacaagagcaagagtttccctatcccgaacacgaaatcgcgcaggctctgcagatgttagcacaagcgaaaaagccgattttgtatgttgggggcggtgtagcaatgagccaaggtgttgaggcgctaagatcttttgtaaaacagacgcaaatccccgttgtttcgacattgaaggggttaggttgtgctaatgcatttgatgccaattatttaggtatgttgggtatgcatggtacaaaagctgctaattatgccgttcaacgtagtgatttattaattgctgtaggcgctcgttttgatgatcgcgtaacgggtcgtttaaatacttttgcacccaatgcaaaagtgatccatatcgatatcgattacgcagagcttaataaattaaaacaagcccatattgctttgttaggtgatgccaaagtgttattacctaagttatctcaaccgttagctattgaggcatggcaagaagaggtacagcaattaatcgctgaatatgcttggcgctatgatcatcccggtgaagcaatttatgctcctttgttgttaaaacagttatctgatgctaagcctgaaaatagcattgtgacaacagatgttggacagcaccaaatgtggtcagcacagcatatgacatttgatgcgccagaaaattttattacttctagtgggctaggcacgatgggatttggtatccccgcggctattggtgcgcaaatagctagacctgatgcgtgtgttatctgtgtctctggtgacggctcttttatgatgaatgtgcaggagttaggcaccattaaacgtaagcaattacctattaaattggtgttattggataaccagcggcttggtatggtgcgccaatggcaagagctgttttttgagcaacgttatagtgaaaccattttaacggacaaccctgattttgttgctttggcaaaagcttttgatattccggggcagcgtattacagaaaaagcacaggttgctgaagcaattaaatgtttattaaccagtgatggcccttatttattacaggtatctatcgatgatgcagagaatgtctggcctttagtcccgccgggcgcaagcaatgatgagatgatggagaaatcaaaatga

SEQ ID NO: 200 - DNA, 1854 bp, Proteus mirabilis
aaaatgcctaaataccgttcagcaacaacgacacatggtcgcaacatggctggcgcccgcgcattatggcgtgcaacaggaatgactgacgctgattttggtaaacctattatcgcagttgtaaattcatttactcaatttgtacccggtcatgtgcatttgcgggatttaggaaaactggttgcagagcaaattgaagctgcgggtggtgtggctaaagaatttaatactattgcggtggatgacggtatcgcgatgggacatggtggcatgctttattcgttaccttcccgtgagttaattgctgattctgtggaatatatggtcaatgcacattgtgcagatgccatggtatgtatttctaactgcgacaaaatcacaccgggtatgctgatggcgtctttacgcttaaatatcccagtcatttttgtttctggtggaccgatggaagcaggtaaaaccaagctttctgatcaattgatcaagttagatctggttgatgcgatgatccaaggggctaatcctaatgtcagtgatgctgatagtgaacaaattgagcgttctgcttgccctacatgtggatcatgctctggtatgtttacggcaaactcaatgaattgtttgactgaagcgttaggattatcgcaaccgggtaatggttcattattagcaacccatgctgatcgtaaaacattatttattaatgcgggtaagcgtattgttgaattaactaaacgttattacgaacaagatgatctatctgcattaccacgtaatatcgctaaaaaagaagcatttgaaaatgcgatgatcttagatatcgccatggggggatcaacaaataccgttttacatctattagctgccgcgcaagaaggtgatgttgattttaagatggaagatatcgacagactttctcgccaagttcctcatttatgtaaggtggcaccaagtacccaaaaatatcatatggaagatgtgcaccgagcaggtggggtgatggggattttaggtgaattagacagagcaggattacttaatcgcaatgttaataatatcttaggcttaagtttgcctgaaacattagcacaatatgatgtgatgctaagccaagatgagcaagtgaaatcaatgtaccaagccggtcccgcaggtattcgtaccacaaaagctttttcacaagattgccgttggccgactttagataccgatcgtgaacaggggtgtatccgaagtaaagcgcatgcttatagccaagatggtggtttggccgtgttatcaggtaatttagcgcaagatggctgcattgttaaaaccgcgggtgtggatgaagataatttagtgtttagtggccctgctaaagtatacgaaagccaagatgatgcggtagaggcaattttaggtggcaaggtcgttgcgggtgatgtggtcattatccgttatgaaggcccgaaaggggggcccggtatgcaagaaatgctctatccaacctcatatttaaaatcaatgggattaggcaaagcgtgcgcattaatcacggatggacgtttttctggtggaacctcggggttatctatcggacacgtttcaccggaagcggcaaatggtgggatcattggtttagtggaagaaggggatattgttgatatcaatattccaaatcgcgaaattaacttacgggtagatgagaaaacactagcagcccgtcgtgaagcacaacttgctcgtggagataaagcgtggacacctaaagataggcagcgccaagtctcttttgctttacgtgcctacgcgtctttagcaaccagtgcagacaaaggtgctgtacgtgacaaatctaaactagggggctaa

SEQ ID NO: 201 - DNA, 498 bp, Proteus mirabilis
cctaataataaaatgtcgaggaactttaaaatggagaaaatattaacactggaagaagcacaagcgttgattggacatgtttttgtctatcaaatgccttttaatcaactgataggtttagaattaattcgcttcgaacaagattatgctgagatccaatttcgctaccaagacaaactggttggcaatatcgcacaacgcattttacatggtggcatgatagcctcggtgttagacgtaagtgcaggtttagtctgtgtaggtaatgccctaacacgtctagcccctatatcccaagagcaactcgaacaaaaactggccaaaatgggcactatcgatctacgtgttgattatttacgcccaggacgaggggaatgttttaccgcaagtagtcatatactacgtagtggtaataaagtttctgtggcaagggttgaattacacaatgaaaaacaagttcatatcgccagcggcacagcaacttatattgttggctga

SEQ ID NO: 202 - DNA, 1584 bp, Proteus mirabilis
cacctcaataaaaataaattaaaaagagagaaaataatggagaataaaaaaatggcattagcagtaatatatacgcgagcctcattagggatctctgcaccacttattactattgaggctcatattagccagggattaccaggactcactttagttggtttacctgaaactgtcgtaaaagaagcgaaagatagggtaagaagcgcattaataaatagtggatatagttatccagcaaaaagaattacaattaatctttcacccgctgatttacctaaagaaggagcccgctatgatttacccattgcgttagctatcttaattgcctcagagcaattaatctctgataaattaaatagttatgaatttatcggtgagcttgcactttccggtaaattacaaaaagtgaatgcggttattccctcaattttaagcgccaacaaagataatagaatatctatcatttctattgaacatcaatcagaagtttcgctcttacctaataaatccgcgttattagctagccatcttttggatatttgtcatcatttagaaaataacaccccattaattgaagctaaaaacaatattaatcacaaaacaattgaaaaccaaaataataaagatattagtgatattattggacaaaataacgcaaaaagagctgcagaaatcactgcagcaggaaatcacaacattttatttcttggccctcctggcacaggaaaaacaatgttggcacaacgcattaatactctcttacctccacttacagctaaagaagcccttgatgtattaattatcagtagcctatcaaatacgatacatcatgatggtaaatggcctttacgtccttttagagcacctcatcatacggcatctgccgttgctttaaccggaggtggatctattcctaaacccggtgaaattacacttgcacaccatggcattttatttttagatgaattgccggaatttgatagacgtgtgttagatgcacttagagagcctcttgatgcgcgcaaaattaccatttcacgtgctaaagccaaaattagctatcccgcaaatgtgttacttatcggtgcattaaatccaagtcctacagggcactatcaaggtactcataatcgaacgcccgtaaaacaagtattacgttatttaagcaaagtatcgggaccttttttagataggtttgacttatccgttgaaatgccattattacctcaaggtgcattactacaatcgacccatacaaatgaatcgagtagcatcatacgagctcgagttttacaagccagagaacgtcagttccagcgaagtggcaagcttaatacttatttatcaagtaaagagattgaacatttttgtcaattacataccgaagatgcactctttcttgaagagacattgaataaattaggcttatctattcgtgcatggcataaaattttaagagtttcgagaactattgccgatcttgagaatgagcaaaaaatacaacgaaatcatcttattgaagcgttgagttttcgcgccatggatagactgatgatctatttacaaaaacagttagaagggtaa

SEQ ID NO: 203 - DNA, 1089 bp, Proteus mirabilis
gcattaaataagcagaggtcttttaacgtgatgaactcggaaaataacgtctcccgacaggggttttcacccgataatgaactcgatattcgaggtctttgttgtgcactatggtcaggaaaacgctggataatagggttcgcgctgctttttgcgctgattgcattaggggcatcttacttgatgcaacctaaatggagcgctattgcgatgacagagagacctactgtgaataatttaggtagttattattctcagtctcagttcttacgtaatcttgatacgcaaattaatccgtctgtaactgtttctcagttaagtatccctgatgaagcttatcaagagtttgtaacacagatttcagcttttgatacacgacgtgagttttggctgcaaacggattattacaaacaacgtaaagaaaatgatgcgcaagcagacgcggcattattagatgagctcatcaataatattcaatttacaccggctgatgagaagaaattggttaatgatcaattgaaactcattgctgaaacggccaacgattcgagtcaactgctcaatgaatatatcgcttttgcgaataaacgtgcggcagagcatctaaatgaagaagtgattgccgcatgggcaactcgaacacaatcgatgaaagccttagtgaaacgccaagaaatggccgctcaagctgcttatcaacgacaaattaatttactcaaacaatcgattaaagttgctgagaaacaaggtatttctcaaaaacagacctcgattgcgatagatgaattaccggattcgaagctgtttctactcggcgtgcctttattgcaatcacagttagaaacattaatggcaacagggccagattttgatagtgattatgatcaaaatacggcgatgttatccaccctcgcggtaggtgctaaattacaagataacttccaaacttaccgtttcttacgtacacctgaagatcctgtgaaacgagatagtcctcgccgtgcctttatgatggtgctttggggtgctattggtgttttagtgggcgcgggtgtggcattagtcagacgtagttcattaaaaaaataa

SEQ ID NO: 204 - DNA, 891 bp, Proteus mirabilis
gacttcctcaacacaaaacaattagtcaatattagaaacgggacacccgtttcaggcagggttaagatgcaattttcaaaaatgcatgggttaggcaatgactttatggttgttgatgctgttacccaaaatgtttatttttcaccagaattaatttgccggttagccaatcgacatactggtgttgggtttgatcaactgttagtagttgaagcaccttatgatcctgaattggactttcattaccgcatttttaatgctgatgggagtgaagtcgcacaatgtggcaatggtgctcgctgttttgctcgatttgtaagactaaaagggcttacaaataaaagagaaataaaagtcagtacccagtctggcagaatgaccttacatgttatggataatgaagatgtttgtgtcaatatgggagagccagagtttgaaccacaaaaagtaccgtttcgtgctcaaaaagtagaaaaaacctatattatcagagcgatggaacgaacggttctatgtggtgtggtgtcaatgggaaatccgcactgtgtgatccaagtggaagatatcaaaactgcggaagttgagtcattgggctcagtattggaacaacacgaacgctttccagagcgcgccaatattggttttatgcaggtggttgatagaaatacattgcatttacgggtatttgaacgtggtgctggagaaactcaagcttgtggaagtggtgcctgtgccgctgtcgcggtggggatctcccaaggtttattagatagaaaagtgaaagttaatttaccgggtggatcattatcaattgaatggaaaggtacaggaaacccactttatatgacaggacctgctgtgcatatttatgatggaacaatccagctataa

SEQ ID NO: 205 - DNA, 789 bp, Proteus mirabilis
ctgacgaacaagtcagagaaagcgcaaaatcactcgccaaaacaggttatggccgctatctattggatttattacatgtccgtcctcgccaatattaattatcttgagtgggagagcgattttttctccctcaatacaggccgtcttgagtttagtgctcaagcgcctgttttaacacaagataggcttgagcaatttacggttgttcatgccaaagttgcttcctatgatcttctactgattgataacttaacgcaattaggatttcaattcgctgaaggtgaaatagatttcaaattgccaattggcacagaaaatgcttgtgaaaatattgctgaaatacattttcgcactgccaatgaaactgatatcccattattaatgacaacggcttctgcggcttttgtacaaagtcgctttcgagcgccatggtatcaagaaggtgatagcagccgtttttatgcattatgggtaaaaaaagcggttttaggcactttcgatgatagctgtttattgacgatggatcgcgaaaataaggttacagggtttgtaacattacgtcggatttctgagagtgaagcaagagtgggattacttgctgtaatgcccaatagaacaggacaaggcattggtaagcaactgatgtcggtggcgaagtattggtgtcaacagcaaggtctatcaaccctctatgttgcaacacaaattagcaatattgcagcttcgcgtttatatacacaaagcggtgctttaattgatagcactacttattggttatacaggggataa

SEQ ID NO: 206 - DNA, 426 bp, Proteus mirabilis
caagggtgcaacgtaaatacgttttcattcgaaatctgcctatcattaatttggttaatatcctctataatcgcagttagatctcgaaaagcaaataggaaaatgaagatgaacgatagtgaatttcaccaattagctgacgaattgatgtcagaaatagaacaaaccattgataattatgaaggtgatgcggatattgattgtgaaatcaatggtggcgtaatgacattaacctttgaaaatcatagtaaaattatcattaatcgtcaggaagcctttcatcaagtatggttagcaacgcgttctggcggttatcattttgattggaaaggtacacagtgggtttgcgatcgtagtggcggggaatttttaaccatgttggctcaagcaatcagcgaacaaagtggtgaagcattttctttttaa

SEQ ID NO: 207 - DNA, 3351 bp, Proteus mirabilis
ttcggagtaaaccttgtgcgcctgataatcagtctactttttagcttttttctgactatctcattcaatacttcggtgtttgctgcggatgttgataaattacgtcaagatatcaaacaacttgaaggcagtactaatcctcaagatattgaaactgttcaggcgctacaaggcaccatcaattggataaatgatggtgaaaaagctcaagttaatgcggataattatcaaaagactattgatgaatatccgcagatcactcaagagttaagggctaaattactcgaagagagtcactcagttccaacaattccagaaaaaattactattcctgagcttgagcaaaaaatcattcaagtgagtagccaactgatggaacaagctcggctacaacaacaagagcaagataaaagccgtgaaatcagcgaatcactcaatttactccctcagcaactttcagaagctcgtcgtttactaagtgatgcaacggcgcgtttagcggcaataggggcatcaaacaccccactagcagaagcacaaaataaattaacccaagctgaagtcacagcacgaaaagcgatggttaatgagctggaaatggcgcaactttctgctaataatcgtcaagaaattactcgactgcgcttagagctatttaaaaaacgttatcaacgacttgatgtacaactgcaacaattgcgtagtttactaaatatcaagcgccaagaagtggcagatctcgctttagaaaagacagaaatgctcgccgagcaagggggcgaactccccgagtttctgactaagcaaatcgagacaaaccgtcaactttctcagatcctcaataaacagacgcaagaaatgagtgagttaaccgaaaaacagcgtctaacaacacaacaaacccaacaagtaagacagacactcacaaccattcgagagcaagcccaatggttaagtggctctacggcattaggtgaagcattaagaacacaattggctcgcttacctgaaatgccccgctctcaagagctggatagggatatcgttcagttacgtgttgaacgattaggctatgaagagatgctagaaaacctaggcaaaatccaacctcctgaaactgccgatggctcaaagctaccagaagctcagcaatatatttttgactccctcattcaagcgcgccaagagttactcaattctcttttatccggttatgactcccaaatcctagagttaaccaaactcaaagtagccacaacacaacttgcggatgccttaaaagagacaaaagatgccacaaaccgctatatgttctgggtggccgatatcagcccaatgaaactcaattatccggttttattaattaaagatattactcgcctactctcattagatactttctcacaattagggcatgctgcggttaacatgctcaaaaaccaagatacctttatctatctactggtcaccctatctattgtcggttttagtcttcgtacccgtaagcattacaatgcgtttcttgaaagagtcagtaatcgcattggtaaagtcactcaagatcatttctcattaacggtgcgtaccgtattttggtcaatattaatcgccttaccactaccgctattatggtctgccgtaggatatggtttacaaagtgtcgaatggcgttatcccatggcgggagcgattggttatggtgtgactgccgcagcccctgtgctatggctatttatgataagtgctacctttgctcgccctaatggattatttatcgcgcaatttaaatggaaagagagtcgtgtgaaaaaagcgatgcgcttttatcaactgtcgattttcgtcattgtgccgttaatgatgtcgcttatcacctttgaatactatagtgacagagaatttgcgccaacggttgggcgtttttgctttttattattgtgcattgctttaagttttattacctcaagcctaaaaaaggcacatgtgccgctttacttagataaacatggctctggtgataatgtgataaataccattttatggtggttcttacttgttgcccctgttcttgcagccctcgccgctatcttaggctatctctcaacctccatcgtattactgggtcgcttagagatgtctgtggcgatttggtttgccttgctgattatttatcatattattcaacgatggatgctgatccaacgtcgtaagcttgcctttgaacgagccaaacaaaaacgggcagaaattttagctcaacgagctaaaggggaagatgagaataccattgttggcagcagtggtgagagtaccgctaacttagagttggaagatcaagccattgaccttgatgcgattagtgcacaatctattggtctagttcgttctattctgaccatgattgcacttgtgtccatgattttactctggtcagagctcaatacagccttctcttttgtcgataatatccgactatgggatgtgacttcctctgttaatggcgtcaatactatccagcccattaccatggggtctatcttagtcgctatattagtgattattatcacggcacaattggtaagaaacctgccagcactgcttgaactggcaattttacaacacttagatctaacacctggtacaggttatgccattaccactttaacgaaatacagcatcaccctaataggcagtattgttggtttctcattattaggtattgagtggtcaaaactacaatggttaattgcggctatgggggtaggtcttggttttggcttacaagaaatttttgccaacattatctcagggttaatgatcttgtttgaaaagccaatccgtattggagataccgttactatccgtaacttgactgggaatatttctaaaatcaatacgcgagccaccacgctcaccgattgggatagaaaagagatcattgtgcctaataaagcatttattacagagcaatttattaactggtcattatcagactctattacacgtatcgtaatgaccatccctgcgccagctgattgcaatagtgaacaagtgaccaatgtattattagaagcctctaaacgctctaccatgattttagacaaccccgctcctgaggtttacttggttgacctacaacaagggatccaaatcttcgagttacgtgtttatgccgcagaaatgggacatagaatgccagccagacatgagatccatcaaaatattctgctagcctttgcagagcatggcattccattaccattcccgccgttccaagcacgggtagatatggtgggtaataccattagtacttcaatgcgtgcaacaccaagagaagtaggcggattgtag

SEQ ID NO: 208 - DNA, 1152 bp, Proteus mirabilis
caaagaaaaaagagagccactgtgaaagtgttgactgtttttggcacacgccctgaagcgatcaaaatggcacctttagtgcacgctttagcaaatgataattcgtttgaggcgaaagtttgtgttacggcccaacatcgagaaatgcttgatcaggtattaaatcttttcgagatcaaaccagattatgatctcaatattatgaaaccaggacaagatttaacagatataacctgtcgcattttagaaggtttaaaacctgttctagcgtcatttcaacctgatgttgtgttagtacatggtgatacaaccaccaccatggcggcaagccttgctgctttttatcaacaaatccccgtcggtcatgttgaagcgggattacgtaccggtaatctctattctccttggccagaagaagcgaatcggacaattgccggccatttggcgatgtaccattttgctcccactgaaactgcaaagttaaatctggtgcgagaagcggttgcggataaaaatatttttgttaccggcaataccgttattgatgcgctattttgggttagcgagcgagtgatgggaaatcaaaccctgctcgatgaacttgctgtgcaatatccctttattcagccagaaagaaagatgatcttagttacgggacatcgcagagaaagctttgggggtggttttgagcgcatttgccaagcattagcagagattgcattggctcaccccgatgttgaagttgtctatcctgttcacttgaatcctaatgtaagtgaacccgtaaagcgtattctgcatggaattaataatattaaattaattcaaccgcaagattatctgccttttgtttatttaatgaaccacgcttaccttattttaactgattcaggtggtattcaagaagaggcgccttcattaggtaaacctgttcttgttatgcgcgatacaacagagcgccctgaagcagttgaagccggttctgtgcgtttagtaggtacagatactaaacgtattgttagcgaagtaacctctttattgacagacgaaaacgcatatcaccaaatgagtaaagcaacaaatccttatggtgatggtcatgcctgccaacgtattcttgaagcattgaaaaataatcaggtgacattatga

SEQ ID NO: 209 - DNA, 1512 bp, Proteus mirabilis
attatgctgaaatcctcatcactttatgctgctatcgatttaggctctaacagctttcatatgttagtcgttcgtgaaatcgcgggatctatccaagtattatctcgcgttaaacgtaaagtcagacttgctgctggcctaaataaagaaaacgagctgtcagagcaggctatggagcgtggttggcaatgcttgcgactgttttctgaatatctcagagatattcccgcagaacaaatccgagtcgttgcaactgcgaccttacgtattgctaaaaatgcagatattttcgtcgctaaagcgtctgaaatattaggcaatacggttcatgttatcagtggtgaggaagaagcacgccttatctatcgtggtgttgcccatacaacgggtggtgcagaacagcgcttggtggtagatattggtggcggtagcacagaattagtcaccggtacgggggctaaaacaacacagctaatgagtttgagcatgggttgtgtaacatggctagagcgctattttagcgatcgctcattaacagaagaaaactttgctcaagcacaacaggcagcaaaagctatccttgcacctgtggcagaaaaacttatccaacaaggttggcaagtttgtgtgggggcatcgggcaccgttcaagcattacaagagatcatgattgctcaaggaatggatgaattaattaccttacctaaattagagcgactgaaacaaaaagccattgagtgtggcaagcttgaagagttagaaatcgaaggccttactttcgaaagagcgcttgttttccctagcggattagccattctgatcgctatttttgaaaccctgcatattgaaaatatgatcttagccggtggtgcactacgtgaaggcttagtctacggtatgttgcatttacctattgagcaagatattcgtcaacgtactttgcgtaatattcagcgccgtttccaaattgatattgagcaagcccatcgtgttcaacaattagcagagcattttttcattcaagtcagtaaaagttggcaattagataatcgctgtcgagagctactttccagcgcttgtgccttacatgaaatcggcttaagtgttgattttcgccaagcgccttcacatgccagttatttagtttctcaccttgatttacctggttatacacccgcgcaacgacgtttaatcgcctcatttttaagaaatcagaaggggattatcgatctcgcacctttgaatcagcaaaatgcgctaccgataaatcaagcataccgcttggtacgtttacttcgcctagcaattatttttgccagtcgtcgtcgtgatgatactttacctgcactgcgtttacgtacggaagatgaaaaattaatcattaccttgccacatcaatggatcgctgaacatcctttacgtgcggaaaatcttcatgaagagatacagttacaaagctacgtccattggccattaatgcttgaagagcaaaataactcacgcataggttaa

SEQ ID NO: 210 - DNA, 204 bp, Proteus mirabilis
agcgctgccctccggaggcagaggtctcaggttcgaatcctgtcgggcgcgccattaaagcgtgctaagagttacggtgaagagcgttgttgtagaagtagtaagatagctgttatggtggctatagctcagttggtagagccctggattgtgattccagttgtcgtgggttcgagtcccattagccaccccatcttatcttag

SEQ ID NO: 211 - DNA, 273 bp, Proteus mirabilis
accatacacctgtttaaacacatcactcatcgatgcaaatgcacgttccagcctgagttgattaatcgcatccagccgttgcttcagtgtttcaatataaagatacaagagtttcgcctgaacaatactaagaaaatagtagaatctgagtttataaattaccgagctttaattattcaattattaatagataaaactttactaacaaaatctcggaaacgtgatcaatttaacaccttgcaagcaaggcgtaaagaggatctcaaaatatag

SEQ ID NO: 212 - DNA, 219 bp, Proteus mirabilis
gacctctgcctccggagggcagcgctctatccagctgagctacgggcgcttcacgccgttgcgggagaggatagtacggatttacgcactgtctgtctagtgctttttgaaaaaaaaagtttgtttgacgatagtttgtgcatttcgtcgataaatggagcgtttttacccactcaacgccccattagtataataatcaaacaatcaagataccagtaa

SEQ ID NO: 213 - DNA, 297 bp, Proteus mirabilis
gatgatggagaaatcaaaatgaaccaacacaatatcacaattgaagcccgtttttgtccagagatcttagaacgtatcttgagagttatccgccaccgtggttttcatatatgctcaatgaatatgaatatcacagaaagtaactatattaatttagctctgactgtgagcagtcaacgacctgttgatcttttatgtagccagttaacaaagttagctgatgttgcaggtattcaggtcttacatcaacaacaaaaagaaaaattacaattcataagtgcacttagtgccatgtaa

SEQ ID NO: 214 - DNA, 1251 bp, Proteus mirabilis
caccacaaggagaataaatttatgttcaagatcttactcctgtttgtggtattgattgcagggataatcttcggccctgtattagcgggtcatcaaggttatgtctttatacaaaccgataattgggatattgaaactagcgttaccagtcttgtgatcatgtttgtcctactgcaactgatattgctcttgcttggctggtgttatcgtcgttttattggtacaggctctaaagcctatagttggttctctttgcgcaaacgcagccgagcacgtaaacaaacacggttagcattaatgaaacttgcggaaggtgatttcaaacaagtagaaaagctgatgagccgcaatgccgattatgcggaacaacctgtagtaaactatttactagcagcagaagcagcacaacaacggggtgatgagtttagagtacagcaacatctggagcgtgcttctgaacttgctgataccaatcagttacccgttgatattacccgagtgcgtattttactggcgcaaaatgaaaaccatgctgctcgtactggggttgatgaattactcaatcaagtgcctcgtcatccggaagtattacgcttagcagaaactgcgtatatacgtacagaagcttggcaagcactacttgatatcatcccttcaatgcagaaaatagccctacatacagatgatgaattagagcaattacgtcaacaagcctatattgggctgatgggacagaagatgtccgaaaatggttgtgatggactgaaaaattggtggaaggcacagcctcgtaagatccaacatgataacggactacgatttgtattagcagaacaccttattgagtgcaacgatccgcaaactgcgcagacgatcattttagatgggatcaaacgtcactatgatgaacgcctgatcttattgttaccgcgcttaaaaaacagcgatccagactcaatattaaaagtgcttaactcactaattaaacaacatggtccgacaccattactcaatagcaccgtcggtcaaattgccatgcaacaagggcaatgggcacaagcagaaacagcatttcgcaatgcattaaaacagcgtccagatgttcatgattttgcgtggttggctgatgtgctagataaacagaataaatcagttgagtcagccaaagtacgcaaagatgcgctattaatgacgttaaaaaaagactctgttatttttgacgagcctaaaacaaataaagcactgcaataa

SEQ ID NO: 215 - DNA, 1167 bp, Proteus mirabilis
ttgatagcactacttattggttatacaggggataatatgattccgtttaataaaccacccgttgttggcacagaattagagtatatgaaacaggcgatggaaagtggcaagctctgtggtgatggcaacttcacaaaaaaatgtgaaaagtggttagaagaacaatttcattgtcataagacgctgttaacaccttcttgtacagcatcgttagaaatggcggctatccttctggatatcaaacccggcgatgaagtgattatgccgagtttcacttttgtttcgacttcgaacgcctttgttttacgtggtgcgactattgtgtttgtcgatattcgtccagataccatgaaccttgatgaaacaaaaattgaagcggcgattacggagaaaacgcgtgcgatagtgcccgttcattacgcaggtgttgcctgtgaaatggataccattatggcgatcgccaaaaagcataacctgtttgtcgttgaagatgctgcgcaaggggtaatgtcgacttataaaggtaaagccttaggaactatcggtcatattggttgctatagctttcatgagacgaaaaactattcatcaggtggtgaaggtggggcaacactgattaacgatccggctttaattaatcgtgcggaagtgatccgtgaaaaaggcaccaatcgtagtcaatttttccgtgggcaagttgataaatacacttggcgtgatattggctctagctatttgctgtctgatttgcaagccgcttatctttgggcgcaactcgaacaagccgataaaattaatgaacgtcgtttagcattctggcaaatctattacgatgcattaacgccgttagccgaacaaggtttgttaacattgcctgttgtaccagacggcttagagcataatgcccatatgttctatattaaacttaatgatatagagcagcgtacggcttttaatgagtatatgaaagcacagggcgtcttaacggtattccactatgtatcactgcatacgagtcctgccggaatgaagtttggtcgttttgatggtaaagatattttcactacacaagagagtgaacgcttggtgcgcttaccgatgttctacaacatgactgaagaagagcagcaaaccgttattcatcatattcgccatttctttgcttga

SEQ ID NO: 216 - DNA, 813 bp, Proteus mirabilis
tcaggaatgtgtatgtattcgatagttgcttctgatcttgatggcaccttgttatcacctaaccacttattaactccctataccaaagaaacgttacatctgcttattgaaaaagggatccattttgtgtttgccacaggacgtcatcatatcgatgtggcacaaattcgtgatgggcttggtattgacgcgtatatgatcacttcaaatggggctcgagtacacaatacgcaaggcactcttattttcagtcaagatcttgaacctgaaatcgtttatgacttagccctaatggtgtttgatcacccagatattgcaacgaatatttatagcagtgatgactggtatatcaataaagaaacgcctgaattaaaagaattttttaaagaatcagtatttaattaccgtctatttgagaaaacaggcttcccaacaacgcaggtgtgcaaagtcttttttacctcagaagatcatgaattgttagttgagttagaaaagaaaattaatcaacgttggggcaataaaattaacgcaagtttttcattgcgtaattgcctagaaattatggcgggtggggtatcaaaaggagaggcactacaaaaagtcgctaagttgatgcaacattcagtaaaagacgccattgcatttggtgatggtatgaatgataaagagatgctacagatggcgggtaaaggctgcattatgcaaaatgcccaccagctactaaaagatctattaccggatatggaagtgattggctcaaatgttgatgatgctgttgcacactatttgcgtaagttgtatcaggtttaa

SEQ ID NO: 217 - DNA, 1116 bp, Proteus mirabilis
ttctgttttcgtgatttattgcaggcgcaaatgacaactttgatttacgtactaggttcagacattgtgcatcataacaacacaatgttacgcttttttaacgaccacctcgtgactgaggcggcattaacgtataaacctcgttttatcgttgccagtaaagataactcgttatcatcactttatcctcatttagagattgagtgtttagcggataaaaaacaagtcgcgcagagagtggtagcattagctaaagcagatagaaaacaacgttttctatttctggggcaatttaatgcgcctatttggcttgctttattgatgggcaaaattaaacgtcatcaattctggtggcatatttggggtgctgatctttatcaggatgctaagcaattaaaatttagactgttttatctgttacgtaaacttgcgcaaaaacgggttggacgtgtgtttggtacacggggtgatctaaattattttgctcaatcaaatgttaatatccccgcgaatttgctctatttcccaacaagaatggatccggcgctgacgcttacagaaaagaaggccgttgatcctcagcatattactattgtattaggtaactcaggcgataaatctaaccgccatatcgatgctttaaatgcgattgctgaacaatttggtcataaagcaaaagtgatcattcctatgggatatcccgctaataacgaggattatattcagcaagtatctgatgcagcgacaaacttatttccaacagaacacgttgagatattacgacataatcttgcctttgatgattatctcgcactcttaaaaacctgtgatttaggttattttattttccaacgtcagcagggtattggtacgttatgcctgttgatccaatttgggatcccttttgtgattagccgtcaaaatccattttggcaagacttaacagagcaaagtgttcccgttttcttctctggtgataaacttgatgtggcgttaattgaagaagcgcaacgtcaattattgctactggataggaagaatatcaccttctttgcacctaactttatccaaggttggaagcaattgattgagatgagcacaggagacacccaatga

SEQ ID NO: 218 - DNA, 882 bp, Proteus mirabilis
ttaactatgcgttacatccgttctttactcacggtgattttaacctaccctgtatggggagtggcggcggagatatcacctgtatcatctccaacaccgttggttcagggcagtattatttccggtctattacaagagtatgattcaccctttgtactttacccttatgaatctaattatattatttacacaaaaacctccgatatgaataaagaggcgattgccagttatgattggggtcataaggctaaaaaagatgaagttaaatttcagataagtcttgcattcccgctgtggcgtggcattgccggggaaaattctgtattagcggcttcctatacgcaacgctcttggtggcagctaagtaataaaaaagagtctgcgccgtttcgcgaaaccaactatgaaccacaactatttttaggttgggcgacggattatcaatttgccggttggacattaagagaaattgaaacgggatttaaccatgaatcgaatggccgcgcagagcctacttcacgaagttggaatcgtgtttatgcacgttttatggcgcaaaaaggtaatttccaactcgatctgaaaccttggtaccgttttaatgaaagtgctaaaaatgatgataatcccgatattaatcgctatatgggatattaccgcttaaaagcgggttatcgtttaggcgaaagtacgtttactttaacagggcgttataactggagtagcggatacggtgctgctgagctaggctggagctatcctattaccaagcatgtacgcttttatacccaactatttagtgggtatggggagtcgatgattgattataatttccgtcaaactcgtatcggtgtcggcgttatgctcaatgatatgctgtaa

SEQ ID NO: 219 - DNA, 1329 bp, Proteus mirabilis
tcaaatattttttgccggtattttgtgacaaagaccaaatggacgtgtatcaggaatacacaatgtttgccacggcgaatattagtttcatttttcatagaccaaagtataataggtaatatgaaacgtctacaagcctttaaattccagttaagacccaatggtcagcaagagcgtgagatgagacgctttgcaggggcttgtcgttttgttttcaatcgggcattagcacgtcagaatgagaattacgaagcagggaataaatacattccctatacaaaaatggcttcatggctcattgagtggaaatctgacacagagacacaatggttgaaggaagccccatcacaaccgttacaacagtcacttaaagatttggaacgggcttacaagaattttttccagaagcgtaccgcttttcctcgattcaagaaacgcggtaaaaatgacgcttttcgttacccgcagggcgtgaagctcgatcaatctaatagtcgtatatcgttgccaaagttgggatggatgcgctaccgcaacagtcgtgaagtcgtcggagaagtgagaaacgtcacggtcagtcagtcatgcggtaaatggtacgtcagcattcagactgagtatgaagcgacagaaccacaacatgaatcaacctcaatagtcgggcttgatgcaggcgtgacaaaacttgccacgctttcagacggtacggtatacccgcccgtcagcagttttaaagtaaaccagcgaaagctggcaaggcttcaacggaaattaagccgtaaaatcaaattcagtgccaactggcaaaaacaaaagcgcaaaattcaacgtctgcattctcatattgccaatatcaggaaagactcccttcacaaagtcaccagcgaaatcagcaaaaaccacgcaatgattgtcattgaggacttaaaggtcagtaacatgtctaaatcggcaaaaggtacgacagaacggcatggacggaacgtaaaagcgaaatctggtttaaaccgcgcaatactggagcagggctggtatgaaatgcgccgtcagtttgagtacaagcagctctggcgaggtggtcaggtactggcaataccccctgcctacaccagtcagaagtgcgcttgctgtggtcatacagcaaaggaaaaccgccagtcacaaagtcaattcgagtgccttgaatgtggatatacagcgaatgctgatatcaacggggcacgtaacattttagcggcaggacatgccgtgcttgcctgtggagggagggtgcagtcagaccgcccgtcgaagcaggaacccgccgaggtgattcagacatcagtctga

SEQ ID NO: 220 - DNA, 765 bp, Proteus mirabilis
acctcgtttagaacaaaaggaaaagtaatggatacaaattcaattccgaagtattccatccgtgggcacaatatctggggatttaaagatatggcgcattttttggattatctttatcaaggtgcgcaaattaaaagtggctctttaattgcgattaatgcagaaaaaatcttaaccgcagaaacagataaaggcctaaatcagttattagatgaagcggattatttgtacgccgatggcattagtgttgttcgcggcattcgacgtaaatatcctgatgcacaagtgtctcgtattgcgggagccgatttatgggaagctttaatggagcgtgccgggaaagaaggcacaccggtctttttggttggtggcaaacctcaggtattggcgcagacggaaagtaaattaaaggcacaatggaatgtgaatattgtcggtagccaagatggttactttacgccacaagatagagatgcactttttgaacgtatcaaagcttctggggcaaagattgtgaccattgccatgggctcacctaagcaagagctatttattcgtgcttgtcggcaagtacacccagacgcgttatatatgggcgtaggtggcacttacgatgtttttacaggacatgttaagcgtgcgccaaaagcgtggcaaaatttaggcctagagtggttatatcgtttactgtcacaacctagccggatcaagcgccaatttaagttattaaaatttgttggttattactattccaataaattgtaa

SEQ ID NO: 221 - DNA, 336 bp, Proteus mirabilis
atagggggtagcatcacgatgataaataactcaaaagcgtatcttgcgcaagaaaggctctttttgatagataagtttggcccattattgttttttttgatcccgctgatcatgctgattatcggtggaaaatcatgggcgaagtatgtcgcttttctgtgtcaggggatcgcactgatttatatcgtggtgttttaccaagcaagaaaatattatttgtcatttcaacatgaaaataacaaagggataccttatcgtttttatcgtatcgcttgggtctatttatttttaattttgtgtcttgaagtagtactactggttcaacacgctttttaa

SEQ ID NO: 222 - DNA, 1386 bp, Proteus mirabilis
gatgagcacaggagacacccaatgacattggcgcaattggggggattaacccttgtctactttatctcgttggggtttattttattactgacctaccaagagtttcgtcgggtacgctttaattttaatgtcttcttttccatgctttatttgctgacattctattttggctttccattaacttgtttattagtctttcagtttgatgtggcagttgttcctgtcgatgccttattacacgctctattagccgctactagcttttatgcgatttattatgtcacttataaggtaagattaagaaaagcctctagcgagccttctaggccgttatttacgatgaatcgggtagagaccaacctaacttggatactgttagcgttaattgctatcgtcactgtgggcatatttttcttacaaaatggcttcttactctttaagttgaaaacatatagccaaattttttcaagccaagtatcaggtgtggcgctaaaacgctttttctatttttttattcctgcaatgctggtggtctatttcttaaagcccacacaacaacgttggctttttttcctttgtgcgacggtcggctttggcattttgacctatgttatcgtcgggggaacacgcgcaaatatcattattgcgtttgcactatttttatttattggcatcgtacgtggttggataaccttatggatgttaatcgctgcaggtgtgatgagcattgtcggtatgttttggttagcactaaaacgttacgggcttgatgtcagtggtgccgaagctttttatacctttttatatctgactcgcgataccttctctccttgggaaaatcttgcattattgttgaataattacgacaaaatcgagtttcaaggactcgcacctattattcgcgatttttatgtgtttatcccttcatgggtttggccacaaagaccagatgtcgtactaaattcagcaaactattttacttgggaagtgcttaattatcatgcaggacttgccatttcaccaacgttaattggctccttggtggtgatggggggcgttgtatttatccccttaggcgcggtggttgttgggcttattattaagtggtttgattggctctatcagcaggggttaaatgaacacaatcgctacaaatctgccattcttcaagcattttgctttggtgctatttttaacatgattgttttagcgcgtgagggcgttgattcgtttgtgtctcgcgtggtctttttctgtttagtatttggtgcctgtttaattgcagccaaactcctgtattggttatttgaaagtgcaggattagttcgtcactatgttattaatcaagtgcgcaataaacctcgtttagaacaaaaggaaaagtaa

SEQ ID NO: 223 - DNA, 1311 bp, Proteus mirabilis
ctgaagaagagcagcaaaccgttattcatcatattcgccatttctttgcttgatatgtcgttagctaaagcttcaatttggacagctgggtcaaccttgataaaaatcggggctggcctgttggtcgtaaagttattggcggtctcctttggcccctccggagtgggacttgcgggtaacttccgccaattaattaccgttcttggtgtactgtcaggggcgggtatttttaatggtgtaacaaaattgattgcgcaatatcaagatgatgcagtacaacgcaaaaatgtgttgggtacatcatcatcaatgatattgctgttttctacactacttgccattttatttcttatttttaccacaccaattagtcgcgttttatttggtgatgactatctgcaatatctagatattgtcagaatggttgcctttattcagatggggattgcctatgccaactattttctggcgatattaaaaggttatcgagatgcatctggaaacgctttagcgattattgcgggaagtttaattggtgttattgcctattatctctgttatctcgttgcaggttatcatggtgcattaattggcttagctttagtacctgcactgattttattgccagcgatggttatcttaataaaacgtaagcgttttgctctcagtgaattaaaaccaagttgggataaggctatcgccagtcatcttggtaaatttaccattatggcgctactgacttctatcactttacccgtcgcttatatcatgatgcgtaacttgttagcagaacattatagctgggatgatgttggcatttggcaaggggttagcagtatatcggatgcttatctacaatttattacagcatcattttctgtttacttattacccacactttcacgattaacgcaaaaaagtgagatagccaaagagataaccaagtcactgaaattcgtcttgccagcggtggcagtggctagttttatggtttggttattgcgagattttgccatttggttgctattttctgaaaaatttatcgctatgcgagagttatttgcttggcaactggttggtgatgtgttgaaagtaggggcttatgtttttggctatctggtgattgcaaaggctgctttgcgtttttatattctgacagaagtgagccaatttgccttattaacgcttttttcacgctggcttattcctgaacatggtgccttaggtgcagctcaagcctatatggcaacctatattatttacttccttctctgtagttctgttttcgtgatttattgcaggcgcaaatga

SEQ ID NO: 224 - DNA, 723 bp, Proteus mirabilis
gaggtgcttggtatgacggataagaatgagcagttttgttaccctgagaaaaacgaactcaacgatcaaaccatcattgattatctcaaggagcatcctggtttctttatccgtaatgccagctatattgagcaaatgcaagttcctcacccagtaagagggagtatctcattagttgagtggataatgtcacgtcagcgaacacgtattcattatcttgaagaggatatgcgtttgttgattgagcaagcagcagaaaatgaatctctatttagccaattactaaggcttatctctgagttatcccgctgtaattcattaaaggaaatgctggaacggttaaatctttgggcgaaggagttagggctttactcagtacaactgcgtcttttcaccgatcgttggcaattacaacctcctttagatgctcaaacactcgcactatctcgtcaaacatttgagcatttccgtattcagcgtatgggcgataataatcactatttggggccattaaatggccaagaaatgatgttattaatgcctaatgttcgtcgttctggctctgtggcactctcattattagggcattatggcgatttaggggtgatcatttttaatagtcgagatagccaacattttcaagaaggtatgggaacggcaatgttggataaactcgcacagatattacctgagttattaactcgctggatcgcaagacaatga

SEQ ID NO: 225 - DNA, 369 bp, Proteus mirabilis
tgttacactggtacggtcaatattattctttggagtagaacaatgagcgataaaatccttcacttatctgacaacacattcgatgttgatgtattacaagcaaccggccccgtgctcgttgatttctgggctgaatggtgcggcccatgtaaaatgattgctcctattctagatgaagttgcaacagaatacgcgggtaaattaacagttgcgaagctaaatatcgatgaaaaccctgcgacagcaccaaaatacggtattcgtggtatccctacactgattttattcaaaaatggtgcagttgctgcgactaaagttggtgcattgtcaaaaactcaattaaaagagttcttagacgaaaacatctaa

SEQ ID NO: 226 - DNA, 210 bp, Proteus mirabilis
agaataagcggagcggtagttcagttggttagaatacctgcctgtcacgcagggggtcgcgggttcgagtcccgtccgttccgccaactatttaggggcgtagttcaattggtagagcaccggtctccaaaaccgggtgttgggagttcgagcctctccgcccctgccagttaccaattaagtaataacaaaatttatactactttgtag

SEQ ID NO: 227 - DNA, 885 bp, Proteus mirabilis
atgatgaaaggtattattttagcgggtggctctggtacacgcttacatccgataacgaaaggggtatcgaaacagctgttacctatctatgataaacccatgatctattatccgctctcagtacttatgttagcgggaattcgtgatattttgattatcaccactcctgatgatcttacctcatttcaacgtttattgggtgatggctctgcatttggtgtccatctgcaatataaagttcagccatctcctgatggcttagctcaagcctttattttaggggatgagtttattggtgatgagcactgttgtttagtcttaggcgataatatctattttggtcaagggtttagccccaaactaaaacaagttgctcaacgtcagcggggcgcaacagtatttggttatcaagtgatggatccggagcgcttcggtgttgttgaatttgatgatgatttcaaagtgctgtcaatagaagaaaaacctcaacagcctaaatcgaattgggcggtcactgggctttatttctatgataaccgcgtggttgattttgcgaaaaaggtgaaaccttctgttcgtggtgagcttgagataacctcgattaatcagatgtaccttgagtgtggtgagcttaatgtggagctattgggacgcggttttgcttggttagatacggggactcacgatagtttaattgaagccagtacttttgtacaaaccgttgaaaaacgtcaaggttttaaagtggcgtgtctggaagagatagcttggcgtaatggttggttaactgacgaacaagtcagagaaagcgcaaaatcactcgccaaaacaggttatggccgctatctattggatttattacatgtccgtcctcgccaatattaa

SEQ ID NO: 228 - DNA, 849 bp, Proteus mirabilis
cgacaaatttttttggagatagatgtggataccgaattactgaaaacctttttggaagtcagtaagacaagacactttggccgagccgctgaatctctttatttaacacagtctgcggtcagttttagaatacgccaattagaaacccaacttgggacaaatttgtttactcgccatcgtaacaatattcgcttaacactcgctggagaaaggcttatcccttatgctgagtcattaatgaatacctggttacaggcaaaaaaagaaattagccacgcctcccaacactcagaactttcaattggtgcgacagcatcgctctgggacgcttatctaacctcttggctacaagaggcttacttaaaaagaaatgagcttagaattgaatctagagtctctacaaggcaatctctagtaaagcagcttcatgctcgtgagctagatctgctttttactacagaagcaccaaaaatggatgagttggaaagtaaagtaattggtaatatcacatttcaactaatgaaaagagcatcacatctgaaccagcaaagcgcacaatttatcaaaattgagtggagtgctgatttgtcaccactttcacaaaatagctctgcaccaaaaacagaacctattttgacaacaaattcagctatgattgcctatcagttaatgaaaacaacaaatgccgttgcttttttacctactcattggctcgatttatatcccgatctctcaccagcagcagtagagatcatccaaaaaccgctatttgctgtatggctcaataccagtgatcaacaagtgttaattcagcaactactttctcaacctgtctccaaccatcagtag

SEQ ID NO: 229 - DNA, 2166 bp, Proteus mirabilis
ttggtaattatggacgtctcatatctgctcgaaggccttaacgataaacagcgcgaagccgttgcagcaccgcgtgtaaatatgctggtacttgcaggtgctggtagtggtaaaacacgtgtattagtacatcgcattgcttggttattatctgttgaacaagcctctcctttttccattatggcggtaacatttactaataaagctgcggcagaaatgcgtcatcgtattgaggacttgattggtactagtcaagggggaatgtggataggtactttccatagtctcgcccatcgtttattacgggcgcattatcttgatgctggtttacctcaagacttccaaatcattgatagtgatgatcaataccgtttaattcgtcgtatcgtaaaatccatggctctcgatgataagcaatggcctcctcgtcaaggtatgtggtatatcaatggaaagaaagatgaaggactccgcccacaacatattcagacctatggtaaccccgtggaaaccacatggttaaaagtctatcaagcttatcaagaagcttgtgatcgtgcaggcttagtggactttgcagagttgttattacgtgcccatgagttgtggctgaataaaccacaaatcctagaacactatcaacaccgttttaccaatatcttagtggatgaattccaagacactaaccgtattcaatatgcttggatcaggatgttggcaggacagactggtaaggtgatgatagtcggtgatgatgatcaatctatttacggttggcgtggggctcaagttgaaaatattcaaaactttttaaatgaatttcccggcgctgaaaccatccgcttagagcaaaattatcgctccaccagtaatattctaaaagccgctaatgccttaattgctaataatagcgatcgtttaggtaaaaacctatggacagaaggggctgaaggcgagccgatttcactctattgtgcatttaacgccctagatgaagcgcgttatgtagtagggcgtattaagcgttggcatgaagagggaggcgcccttgcagattgtgccattctttatcgtagtaatgcccaatcgcgcatcatggaagaagcgctattacaagcgaatatgccttatcgtatttatggtggacagcgtttcttcgagcgtcaagagatcaaagatgccctctcttatatgcgtttaacagcgaatcgtcacgatgatgcttcttttgaacgtgttgtgaatacgccaacgcgtggaattggtgatagaaccttagatgtggttcgccaagtagctagagataaccaaatcacattatgggaaagtgcattacaggttattgagcataaaatgctagcaggccgggctattgcggcaattgcgcgctttttagaattaattgagacgttagcaaatgaaacagcggatatgccgttgcatgtgcaaacagaccgtattattcgcgattctggcttaaaagcgatgtatgagcaggaaaagggtgaaaaagcacaagcgcggattgaaaacttggaagagctggtgacggcgactcgtcaatttagctatcaagatgaagacgaagatttaatgccattgcaagcttttctctctcatgcggcattagaatcaggagaaggacaggctgatgcgtatcaagatgctgttcaattgatgacactgcactcggcgaaagggctagagttttcacaagtgtttattgtcggggttgaagaaggcatgttcccaagccagatgtctttggatgaaggtgggcgcttagaagaagaacgtcggttagcttatgttggtgtgacgcgcgccatgaaaaagttaacacttacttacgctgaaaaccgccgtttatatggtaaagaagtgagccatcgaccttcgcgctttattggcgagttaccgaaagagtgtgttgaagaagtacggttacgggcgacggtttcacgtcccgtgaatcatcatcgtttaggtacaccgattgttagtaatgatacaggttactcccttggtcaacgggttaagcaccctaaatttggtgaaggtactattattaatatcgaaggtagcggtgaacactgccgattacaaatagcctttaatggtgaaggtattaagtggttggttgctgcttttgcacgattagagtga

SEQ ID NO: 230 - DNA, 1029 bp, Proteus mirabilis
gtgataaatatgaataaatatataactttgggttgtctgtctgcacttttgtatacatcaaccgcttttgctgaatatcgtgccgatacaaccactagaacggtgagttataacaatccaatttatgtttcaagaaccgcgcctattttaacagagctggcaacgattgacttaggcactatgtatggctggacttggtggaatatcacaggcccagtacaggcggggatctacttgcccggctatatttcagcttccagccctaaagtaggcagtgcctatgtgcgtgaattagggactagtggtatcggttataccctacacgggactattactgtcggttgcaccggctctgcttatgtcgatggactatataatgttgatggcaactacagtaatcgccttatttgcacaagtaacttaaaccgtagtagttataccgcttctttaaaaatgacgttatataaactgcgtaacaatatcaaatcacaaaccattccaagcacatgggttgctatgctgattttgtatcacaatgggggatttatcaccagtgacaatactggccgcactgaaccaaaggtttaccttaatccccttaatattgtttccagtggctgtgaagttatcaataataatattaatgttcctttaggatctgtggcaaaatcgagctttaatggtgttggctctgttagccctgatagcctacaagatgtgaatatcgatttagattgtgatcccgtttcacccattaagataaaattcgatggcacccctgatgctagccaaaccgccggcacaattagccttaataatgccaatgatagcaatacagccaaaggctatggcattcaggtgaaataccaaaaccaacctattgagttaggaaaattgataacggtgagcgaaaagaataacagtggtaatttttctattcctttagaagcgggttatatacaaacttctgagactaccaccgcaggcaaagctgatggaacactgcaatttaccctgcaatatcattaa

SEQ ID NO: 231 - DNA, 1260 bp, Proteus mirabilis
gacgccgatatgacggaacagaaaaatacgaatgaaaatgacttgcagaatggtacatcaaaggctgatgacgatatccgctatcaagaagtaaaacctgtaaacaataagcgttcaggtttgatagggagtgccgttgcgatcctcgttattctggcaatcggtggtggtctttattattacaccactcagcaagcgactaaactaagtacagaaaaccaatcgctaaaatcacaattggcacaattacaacaattgcaagatacttatcaacaacgttttgacaatattgacagtcagtttaactcacaaaaactcactattgataaactgcaaaatgaacgccaagttactgagcgtcaaatccaaaatttacaaacgcaatttgctgctatctcaagtgcagatgtaaagagctggctattagcgcaagctgattttatggtaaaaatggcgggccgcaaattatggaatgaccaagatgtcgtcacagcggtaagtttattaaaaggtgcagatagtagcttagcagaaatgaatgacccaagcttattggccatccgccgcgccattaatgaagatattggcaacttagccgcgctgagcaaaattgataatgatggtactattttacaattaaatcagttagctaatcaggttgataacctacgcttatctggatttgagcgtgatggctcaccgatggataaaaatgatgaagccatttcaggctcgctttctgactggaagcaaaacctcagtaaaagctggaaaagctttatggatgactttattactatccgtcgtcgagacagtaccgctattccactattagctccaaaccaagatatttatctgcgagaaaatatccgctctcgtttattaattgcatctcaagcggtgcctcgccatcaaacagagatttatcaacaatcattagaagcggtatctacttgggtacgcgcctattttgataccaccgatccgaatacaacggctttcttagacagtattaatgagcttgaaaagcagcctattactcttgcaatgccaacagaattaaaaagcctctctctgttagaaaaacgagtagaaaagcagatccgtaatttgctgacccaaaacgagacatcacagccagaagcggttgaagccaaagatgccgaagctacacaagccccttatgcggttgatgcagcacaagatagtgcaacatcaggaacaacgacatcaacaaccgtagcaccacaaggagaataa

SEQ ID NO: 232 - DNA, 747 bp, Proteus mirabilis
tacagcgatatgagtattttaatcactcgtcctagcccagcaggagaacaacttacgcaacgcttaattgatgcgggaaagcatgcttttcatgcacctttaatagaaatagccgcgggtaaagagctttccatattagaaaacaaattaaataagctaagtacgggtgattacctttttttactttctaaaaatgcggtgtggtacgcaaactggcaactaaatcaattacaacaatcgtggccagatacgctattctattatggaataggtcaaagcaccgcagaagagtttcagcaattaacaggacattctatacgttatccagaatttggagaaaccagtgaagacctactggccttgtcttcacttcaacaaatagaaaacaagcgagtactactactaagaggcaatggtggtcgcgaactacttgccacaacattacgtcaacgcggtgcaattgttgatgaatgtgaatgttatcagcgtctatttattgattatgtatctgaagagtttgcgctaaagtggaaaaatgcccaagtggatacctttgtggtcaccagtggcgaaatgttgcaacaactcttttatctagtcgctggatctgaaaaagcatggctgttagacagtcatttagtggtggtcagtaaacgattagcaacaatagctagcacattaggctttaaaaaaataaccgttgctgaaagtgccaataatgatgctttatttcatgcattaatatag

SEQ ID NO: 233 - DNA, 1272 bp, Proteus mirabilis
gaacccaccattatgaatcttaccgaattaaaaaatacgccggtatcagaactgatagcacttggcgaaaatatggggctagagaacctagctcgaatgagaaaacaagacatcattttctctatcttgaagcaacatgccaaaagtggagaagatattttcggtgatggagtgctggaaatactacaggatggctttggcttcctacgttcctcagacagttcctaccttgctggcccagatgatatctatgtttctccaagtcaaatccgtcgttttaaccttcgcactggtgataccatagcagggaaaattcgcccacctaaagaaggtgaacgctattttgccctccttaaagtgaatgaagttaactttgacaaaccagaaaacgcccgcagtaaaatcctctttgaaaacttaacaccattacatgctaataaccgcttacgtatggaacgtggtaatggttctaccgaagatttaactgcccgtgtactcgacttggctgcacctattggtcgtggacaacgtggtttaatcgttgccccaccaaaagcgggtaaaacaatgttgctacaaaatattgcggccaacattgctcataactatcctgattgcgtattaatggtacttcttattgatgaacgtcctgaagaagtcacagagatgcaacgtttagttaaaggtgaagttattgcctctacctttgatgagccagcatctcgtcatgtgcaagtagcggaaatggttattgagaaagccaagcgtttagtagaacataaaaaagacgttatcattttattagactctattactcgtttagcccgtgcttataacaccgtagtaccttcttcaggaaaagtattaaccggtggtgtggatgcgaacgcgctacatcgtccaaaacgtttcttcggggctgctcgtaatgtagaagaaggtggtagtttaaccattattgcgactgcattggttgatactggctctaagatggatgaagttatctacgaagagtttaaaggtacaggtaatatggaattacacctgtcgcgtaagattgcagaaaaacgagtattcccagcaattgattacaaccgttcaggaacacgtaaagaagaattactgacatcgcaagatgagttacaaaaaatgtggatcctgcgtaaaattatccatccaatgggtgagattgatgcaatggaattcctcattaataaattagcgatgacaaaaacaaatgaagaattcttcgactttatgaaacgctcataa

SEQ ID NO: 234 - DNA, 1275 bp, Proteus mirabilis
tcaggtgacattatgagttttgaaactatttctgttatcggcctcggctacattggattaccaacagcggcagcttttgcctctcgtaaaaaaagtgttattggtgtggatgttaaccaacacgctgttgataccattaataaaggtcaaattcacatcgttgaacctgatctggataaagtggtaaaacaagccgttgaagaagggcatttaaaagcctataccacaccacaacccgcagacgcttaccttattgcagttccaaccccctttaaaggcgaacatgaacctgatctggcttatgttgaagctgctgcgcgttcaatagcacctgtacttaagaaaggtgatttgattattttagaatcaacctcacccgttggaacaacagaacaaatgtcacagtggcttgcgcaggcacgtgaggatttaactttcccacatcaacaaggtgaaaatgccgatattgatatcgcttattgccctgagcgtgtattgccaggacaagtgatggttgaacttatccgcaatgaccgtgttgtggggggcatgaaccgtaaatcatcagagcgtgccagcgagttatacaaaattttccttgaaggtgaatgtgttatcactaatgcccgtactgcagagatgtgtaagctaacagaaaatagcttccgtgacgtgaatattgcatttgctaatgagttatccctgatttgtgccgaccaagatattaatgtgtgggagctaatcagtttggctaatcgtcatcctcgcgtgaatattttacagccgggtcctggtgtcggtggacactgtattgccgttgatccttggtttatcgtgtctcaaaatcctaagcaatcacgcttaattcatactgcccgtttggtcaatgatggcaaacctgtatgggttatcgaccaagttaaagccgctgtggcggattgtttaactgaaaccggtaaacgtgctaacgagatcaaaattgcctgctttggtttagcctttaaacctaatattgacgatttacgtgaaagtccagcaatgaatatcacccaacaagttgctaactggcatagtgggaaaacatttgctgtggagccaaatattcatgaattaccgactaaattaaaaggtatcactgaattagtctctacagagcaggcattaaaagaggcggatattgttttaatgttagtcgaccatcaacagtttaaagcgatacctggtagccaagttacccaaaaatggattgtcgatacaaaaggagtatggcgttga

SEQ ID NO: 235 - DNA, 2658 bp, Proteus mirabilis
agctcggtaatttataaactcagattctactattttcttagtattgttcaggcgaaactcttgtatctttatattgaaacactgaagcaacggctggatgcgattaatcaactcaggctggaacgtgcatttgcatcgatgagtgatgtgtttaaacaggtgtatggtttaattcctgttttactgcattaccaccaccctcagttgccaggctatattcaaggaaatgtccctcatggtacatgtttctttgaacctgatgacgtgcaacgtcaatgggtcaataagctgactaatgcatcatgtgatgagccaatgaatggatacaccagcggagagttacctattacgggtatctattcgatgggaagtacttcctcgattgggcaaagtcactgctccgatattgatatttgggtctgtcaccaatcttggctggaccaagatgagcgtgcgcgtttacaacgtaaatgtttactgatcgaacaatgggcgggagaattaggtattgatgttacttttttcttaattgatgagaaccgcttccgtcatcatgcaagtggtagcttaggtggggaagattgcggctcaactcagcatatcctgttacttgatgaattctatcgtacagcggttcgccttgcaggtaaacgtttgttatggacgatggtaccagtagaggaagagtaccattacgatgaatatgttaattcactctatgcccaaggtgtattaacgcccaatgaatggcttgatttaggtggattgggtgagctttctgccgaagagtattttggtgcaagcctgtggcaactctataagagtgttgattcaccttataaagccgtattaaaaagtattttattggaagcctattccgcggattaccctaatggcaaattgttggcattagaaatgaaacagcatcttcatcgtggtgaaatcgtaaattacggtttagatgcatattgtatgatgcttgagcgcgtaacccgctatttagtttcgattaatgatttaacccgccttgatttaatccgtcgctgtttctacctgaaagtttgtgaaaaactatctaatgaaaaaaatgagaatgaacctgcaggttggcgacgccaagtattatctcagttagtcacgcagtggcagtgggatcacgaacgtttggcgatattagataatcgtgatagctggaaaatagagcgcgttcgtaacgcacataatgaattattagatacgatgatgcaaagctatcgtaatcttattcgttttgcgcgccgtaataacttaagtgtcagtgctagtccacaagatattggtgtattaacacgtaagctttatgccgcttttgaagcgctaccgggtaaagtaaccctggttaatccacagatttctcctgatttatccgagcctcatttaacctttatctatgtgccaccgggacgcgctaatcgtagtggttggtatctttataatcgggctcctgattttgcacatattgttggtcatcaaccgttagaatataaccgttacttaaataaattagtggcttggtcttattttaatgggttacttactaaagattcacaggtttatattcatcaaggtgactcctcttgtgatgaaattaaacttcatgaattagtgcgggatatctcgagtcattttcctattcgtttacctgccccgacgcctaaagcactgtatagcccttgtgaaattagacatttagccattattgtcaatttagaagtcgacccaacagagcgtttttctgatcaagtagtgcattttgattttagaaagttggatgtatttagctttggcgaggaagagcaatgcttaattggcagtatcgatttactctatcgtaactcttggaatgaagtgagaacgctgcattttaacggtacgcaatcgatgttggaatcgttaaaaactattttaggtaaaatgcaccaagatgcggccccacctgcatcggttgaagttttttgttatagccagcatctacgtggtttaattcgcacccgtgttcaacagttagtctcagaatgtattgaattgcgtttatcaaccaatagattagagccagggcgttttaaagcattacgtattgcagggcaaacatggggattgttctttgaacgtcttaatgtttctgtacaaaagttggagaatgccattgaattttatggtgctatttcatacaacaaattgcatggattacccgttaaattaggcaaagatgcccgttatctgcccgctgtgattgatggttttgcttgtgaagggattattcagttcttctttgaaacaacagaggataataatgtctttaatatctatatcttagatgaagctaatcgagtggagatttattctcactgcgaaggtagtaaagaagagctagtaaaagatgtcagccgtttttactcttcatctcatgatcgctttacttatggctcaagctttatcaacttcaatttgccacagttttatcaaatcgtgaaagtggatggagcaacgcaagtactgccttttgctgggggatcgtttggtaagctaagtgatctaggtaaaacagcgccaaaagaagagatgagtactaagcctattcaaggatttaatgactatcaggctgtacatcatcactga

SEQ ID NO: 236 - DNA, 732 bp, Proteus mirabilis
gagagaaaaatcataatgcacttttatcgcactctgatgccgattgcagcgatgacttttgatttagacgatacgctgtatgacaatgttcctgtgatggataaaacagaagaagagaccttagcgtttatccgtcagtatgatgagcgttttcaccattttactgaacatgatgtagatgcttacaaacagccactattagaaaataatcctgatatttttcacgatatcactcagtggcgttggttagcggctaaaaatatgttgttagactatggctatagtgaaactaaagcacagcaaggtgctgatgaaattatggctcattttgcttattggcgtagccgtattaatgtccctaataatacccatcacgtgttgacacaactggcggaaaaaatcccattaatcgctattactaatggtaatgctaatccattaagctgtgggttggggcaatactttacacatattttaaaggcagggcctgatgggcgctctaagccttatcctgatatgtttgataaggcggcttcgttacttaaactccctcatcagaatattttgcatgtaggcgatcatctagtgacggatgtagaaggcgcggttaaaagtggattacaggcgtgttggattaatttagataatcgcagtttgtttaccgaaggtgaaacgcgtgttatgcctcatattgagatcactgaattagctaaactggttgaattaatttaa

SEQ ID NO: 237 - DNA, 408 bp, Proteus mirabilis
ctgatgaaaattacttctgtattatttgatacttattattcaattaagcctgtgacaaaaatcgctgaggatttctctgttgataaaatgcctcccgtggagcctatttatgagcagcgttttgatacttaccatcctagtgctcctgccaacccgtttgaagaagatctctattgtcgattattacgacatcaacgtgattttgtgccacgcatgaatctgtatttaagtggggtgatcggtgctatccgtattgcaactaattctacatcaacattctttagacgctcacaacgccgtatagaagcgatagcaatgggttgtaatacaaaagaagagcactcaagccctgccagaaaggggtatctttctggcgctttcattagtattgataatttagctcaatag

SEQ ID NO: 238 - DNA, 1038 bp, Proteus mirabilis
ggggttcgaatagcgccaacgaggaggagccgaatgacaaccacactttttcagcacatgtggttatctcgtgaaaagcaattctctgcttttacgaatggtatcttattggacttttggaaccaacgacaggaaggcgaatttaccggagtcgatggcgtgagcattcgctatgttcattggcgctcttcatcacacaaaaaagcgttggtgatctgctctggccgtagtgaaagttatgtaaaataccctgaagtggccttcgatttttatcaccttggttatgatatttttcttctcgatcatcgggggcaaggattatcagggcgcttattagatgatccgcaaaaagggcacgtagaaaaattcagtgattatgtcgatgatttatcgacatttattgatactatcgttttgccttatcactatcagcactattttgcgttagcccattcgatgggcggcgctattttagccagctacctattacgtaaaccagatactttccaagccgccgcactgtgtgcgccgatgtttgggattaatttaccaataccacgctgggtggctaattttttagttaaccgtgcagaacaaagtgtttcagaacgaaataattacgcggtatcaacgggcaaatggtttcctttgccatttatcttgaatgtattgactcatagccatgaaaggtatcgtcgatacttacgttactatgccgatttccctcaattacgtttaggtgggccgacctatcattggatgaaagagagcctagaaacgggggattggctgattgaacatgcaaaagagattaacacccctttgctagtacttgaagctgagctagataaagtggtggataatcggggagtaagggctttctgtgatggttatagtcagtccagaacaagagaagaaaagcaaaaattgccacttgtgattgaaggtgcgcaccatgaaatcttgttcgaaatagataagctacgctcacaagcattaattgaaatctgtgagttttatgataagcatttattttaa

SEQ ID NO: 239 - DNA, 1002 bp, Proteus mirabilis
aacaaagccttatttataaacagaaattatgctaactcgctcggaagagataataatattatgccaaaaagtaccatccgtattgctacacgccaaagccctcttgctatgtggcaagcgctttatgttaaagaacaactacaaatcgctcatccgagcttagtcgttgaattagtaccgatggtcacgaaaggcgacatcatcttagataccccattagcgaaagtgggtggtaaagggttatttgtcaaagagctagaacttgcactactcagctctcgtgctgatattgccgtacattcaatgaaagatgtccccattgattttcctgaaggtctgggattggtgacgatttgtgagcgagaagatccccgtgatgcctttgtctctaatcattatgattcattagaacaactgccagccggaagtgtcgttggtacctcaagcctacgccgccaatgccaattaaaagcactgcgccccgatttaattattcgtgatttacgcggtaatgtaggaacccgtttaagtaaactcgataatggcgactatgatgctattattcttgctgtcgcgggcttaaaacgtcttaaattaactgagcgtattcgttcttctttgtctgcggaacaatctcttcctgcggtaggacaaggtgccgttggcattgagtgtcgcttagatgatcatgatactcaagccttattagccgcccttaaccacgcagatactgcaacttgtgtaaaagcagaacgtgcgatgaacactcgccttgagggggggtgccaagtacctattggtagttatgcaatttggcaaaacgacaaaatttggctacgagcattagttggctcccctgatggtaaaactattttacgtggcgaacgcttagtatcacctgaagatgcagagcaagctggtatttctcttgccgaagagctactagataaaggagctagagagattttaaccgctgtatatcaaggtaatacagcgatatga

SEQ ID NO: 240 - DNA, 243 bp, Proteus mirabilis
aaaacatttgtgctcatttttagtatatccacagtactgttctctataataaatatagctggttatttacccatccatgtgttttttattctttctccagcttgtaccacgacgagtttactcagtaacccaccaccctttatcaataataaattttccttaactatttttattgatgttatcgctatttttattaaaactataaatatgcaatatacataccaaattatcattttgcgatga

SEQ ID NO: 241 - DNA, 192 bp, Proteus mirabilis
aaagcatctgtcccgattaaatttgaagcaacttgccctgtgatagcaacaacaggcacagaatctaacaatgcatcagcaagacctgtgatgacattagtagcgcctgggcctgatgtcgcgatacagacaccagttgtaccggtagaacgagcaaatccgatagcagcaatagcggctccctgttcatga

SEQ ID NO: 242 - DNA, 957 bp, Proteus mirabilis
gtgcacttagtgccatgtaaggatagaagaatgacaaagcaagctgattatatttggtttaacggtgaaatggttccatgggctgaggcaaaagtacatgtcatgtctcacgcactacattatggaacgtctgtatttgaaggagtacgttgctacgattcccataaagggcctgtcgtttttcgccatcgtgagcatatgcaacgattgcatgattctgccaaaatttatcgtatgcctgtcgcgcaaagtgttgatgagttaatggaagcttgtcgcgaaacattgcgcaaaaaccagttagtcagcgcttatattcgtcctttagtttttattggtgatgtcggaatgggggttaatccaccagaaggttataaaaccgatatcattattgctgcattcccatggggggcatatttaggtgaagaggcgttagataaagggattgatgcgatggtctcttcttggcatcgagcagcacctaatactatcccgacggcggccaaagcaggaggtaattatctctcttcattgttagtgggcagtgaagctcgtcgccatggttatcaagaagggattgcattagatgttcatggttatctttctgaaggggctggtgagaacttatttgaagtaaaagatggcgttatttttactcctccatttacctcatctgcgctaccggggatcactcgcgacgcaattattaaattagcgaaagatctcggttatgaaattcgtgaacaagtactgtctcgagaatctctctatcttgctgatgaagtgtttatgtctggtaccgctgcagaaattacaccagttcgtagcgttgatggtattcaagttggtattggtcgctgtggtccagtaacaaaagctattcagaaagctttctttggtttgtttacgggggaaaccgaagacaaatacggctggttagatcctgtcaatccataa

SEQ ID NO: 243 - DNA, 270 bp, Proteus mirabilis
acgcgaaaagtgagttattcaggacaatttaaaaaagacttaaaactcgcagaaaagcgaggaaaggatattaataaactaaaagagattatattactattagtgcaaggaaaacgactacctgctcaattgaaagatcatccattaacaggaaactggaagcctcgtcgagatcttcatatcgaacctgattggctacttatttataaaatagacaatgatactgttcattttgacagaactggctcacattctgatttatttaaataa

SEQ ID NO: 244 - DNA, 903 bp, Proteus mirabilis
aatgcattattaataaacaataataagaaggactccattatggaaaaatcccgcacaacattagaccaatggatcaccttacaagctgttgttgattacggtggctttgctcaagccgctgatgtgttacataggactcaatcatcaattagctatactatcaataagttagaacaaaccttgggtatagaaatactttctttagaaaaaagacgcgcagtattaactactgagggagaactattgctaacactttctcgagaagtgacagaaaaagcattatctctagaaaaaaaggcaaaaaacatcaagattaacaataagttaaaaattaacgtactgatcgacccaatgtatgtcgctgatctttttttaaataaaatctcacaatttattaagcagaataaacagtatgatattaatatttataggaattctctcagcaaatcagaaattttagcgcaaaaagaatatgatttaattgtgtcaccttattatattaaatcactgcaacctattgttttagaaagcattacaactaccttagtatcacatccagatagcccattacagaaactacaagatgaggaattattacaggaattacaaaggcatagctgtatttctctttctcctgattcacccgatactgataatcaggcccaagtcattcaagttggctctgtagagacagcaattagcttaattcagcatggtttaggttatgcacgtctctcccttatttttattcaagatgaattgaataaaaaaacaataaaacaattaataacgcataaaaaagagaaggaatataaattctatttatatttgaataaaaattcatttattaatgaaaacttgcaaagtttattatcaacaattagctattcaacaaatatctaa

SEQ ID NO: 245 - DNA, 1122 bp, Proteus mirabilis
ccagctatatttattatagagaacagtactgtggatatactaaaaatgagcacaaatgttttttacgtgttcctattttctttcgctttcctatttgtagctcgtaaggtggcaaagaagattggactcgtagataaacctaactatcgtaaacgacatcatgggttgatcccccttgtaggtgggatttcagtctattttggtattgttttcgctttttatgtttcagatatctacattcctcacaaagagctgtatttgatttgtgcggggatacttgtttttatcggtgcgcttgatgatcgttatgatatcagtgtcaaaatcagggcaactatccaagcgttagtgggtattgctatgatggtattcggtggtttaaaacttgaatcacttggtcatgcttttgggccttgggatatgcatttagggccttttggttatatcgtcacgctatttgctgtttgggctgcaatcaatgcctttaatatggtggatggtattgatggtttattaggcggtctttcttgcgtttcgtttggtgcgctgggtattttactttaccaaagtggaagctctgcacttgcgttttggtgcttctcatttattgccgcgattttaccttatatcatgttaaaccttggtgtttgtggtaaaaaatttaaagtctttatgggcgatgcgggaagtacgctaataggctttactattatttggctattaatttcctctactcaagttgatcctcatccaatcaatgcggttactgcattatggatcattgctattcctcttatggatatggtggcaattatgtaccgccgtttacgtaaaggaatgagtcctttttcaccagaccgtcaacatatccaccatttaattatgcgagcaggttttacccctcgccaagcttttgttttgatcacgcttgcagccgcggtgttggccgctattggtattattggtgaaaacttatcttttgtaccagaatgggtaatgttggcattgtttttgcttgcttttgttatgtacggttattgcattaaacgcgcgtggcgagtcgctcgttttattaaacgatataaacgtcgcctacgtaaagcgacacaacttaagcattaa

SEQ ID NO: 246 - DNA, 1587 bp, Proteus mirabilis
atatatcaatttaagcaatggctttcatcccctatagtaaagtcatgcaatacctcaccgagagtggggataacaatagcaaacatatacacaacgatttgggagtcgctcatggccaattattttaatacattgaatctgcgtcagcagttgtcgcaactgggtaaatgtcgctttatgtctcgtgacgaatttgccgatgaggctaattatctaaaaggtaaaaaagtcgttattgttggctgtggtgcacaaggtttaaaccaaggtttaaatatgcgtgattcaggactggatatcgcctacgcattacgccaagaggctattgatgaaaagcgtgcttcatggcgtcgtgccactgaaaatggttttgaagtaggaacctatgaagcattgatcccgcaagccgatttagtggttaacttaacgccggataaacagcactccgccgttgttcaagccgttcaaccactgatgaaatcaggcgccgctttggggtattctcatgggtttaatatcgttgaagtgggtgaaaaaattcgtgacgatattaccgttgttatggttgcgccaaaatgtccaggtactgaggtgcgcgaagagtataagcgtggttttggtgtacctaccctaattgctgttcacccagaaaatgatgctaaaggtgaaggtatggccattgcgaaagcatgggcggcggccacaggtggacatcgtgcgggagtgttggaatcatcttttgttgcggaagtaaaatcagacctgatgggcgagcaaactatcctgtgtggtatgttacaagccggctctctgctgtgttatgacaaaatggttgctgaaggtgttggaccgggctatgcaggtaaacttatccagtttggttgggaaacgattacagaagccctgaaacaaggtggtattaccttgatgatggatagattatctaatcctgccaaaatgcgtgcttatgctttatcagagcaattaaaagagattatggcaccactgtttgctaaacatatggatgatattatttcaggtaaattctctgaaaccatgatggcagattgggcaaatgatgataaaaacttgctgacatggcgtgaagaaacgggtgcaagcgcatttgaaaattatcctgaatatgaaggtaaaatcagcgagcaagagtattttgatcatggcgtattgatggttgcgatggttaaagcgggtgttgagctggcgtttgatacaatgattgaagctggcattatcgctgaatctgcctattatgagtcactgcatgaattgccattaatcgcgaatacgattgcgcgtaaacgtctgtatgaaatgaatgtggttatttcagataccgcagagtacggtaactatctgttctcttttgccgccgtgccgatgttaaaagagtttatgacgacgttgcaaagtggcgatttagcgaagcatgttccagatagtgggacagataatgctcaattgcgtgatatcaatgaagccattcgtcagcaccctattgagattgtcggtaagaaattaagagggtatatgacggatatgaaaaagattgctgttgccaactaa

SEQ ID NO: 247 - DNA, 591 bp, Proteus mirabilis
gggtttttctctgttttttctcttaggttacttatcatggtgcttttttccgcaattcctttcttaaataacttaacgcaagagcttcctctatttgcaaaaaatttaactctactggcgaataaactatccctcgaccttgatgcttatcaaaccgatcatatatcgttacgttgtcacgatttggcgttagcagaacagtggcgtaatggcttaagtcaatgtggcgagtgtatttcagataatatgattaatgggcgacctatttatctctttaagctagcctcacctttaacactgttaggccagcaaatatctattgttgagttaccttatccaacagataaaaaataccaatatcaaggttgggaacatattgaacaggtaataaatgttgctcctgaaaaattagttgaaaaggtgatgacattattaccccatcctttacctgaagggattaaaattaaaataagtgaacctaaagctgaaaaagaacgtttacctaatccaaccgttgccataaccgatggtatcgttaccataaagtatcacccatattccttactgaaaattgtagaaagtgagtgttga

SEQ ID NO: 248 - DNA, 1011 bp, Proteus mirabilis
ttttggctctctgttagccatcaaaggcgaataatcatgataaattttagctcattttatcaacatattgcgcaagatgaacggttatttcattggcttgatacgctgccggcacaattatcagaatggcgcgcccatgctttacatggccattttgcttcatgggaaagaatgctggaaaacttacctgagattactcccactgaacttaatttaaagcaaggcgttatcgccaataaaaccccagcattaagtaccggtgaacaacttggtttaacgaatattctaaaagcgttaatgccatggcgcaaaggccctttttctctttatggtgtcaatattgatactgaatggcgttcagattggaaatgggatcgcgtattgccccatctttcgcctcttaaaggccgattagttttagatgttggttgtggcagtggttatcatatgtggcgaatgcttggtgaaggggctgattttgttgtcggtatcgatcccactcagctctttttatgccaatttgaagcagtcagaaaattattaggtaacgatcagcgtgcccatttaattcctgtcggcattgaacaaatgccagaactaaatgcttttgatacggtattttcaatgggggttctttaccaccgtcgttcaccacttgatcatctttggcaattgaaaaatcagctcgtttctggtggtgaattagtattagagagtcttgtgattgatggtgatgaattccaatgtttaattcctggtgagcgttatgcacagatgcgtaatgtgtactttataccgtcagccaaaatgctcaaagtatggttagaaaaatgcggttttaaagatgtacgcattgttgatgaaaatgtcacatcactcgaagagcaacgtaaaacggattggatggtgactgattcattagaagcattcttagatcctctcgatcacaccaaaaccgttgaaggctatccagctcctaaacgggcaattttaattgcgactaaaccttaa

SEQ ID NO: 249 - DNA, 1851 bp, Proteus mirabilis
gccattatctcttcacgcgactttttgatgaatgcgcgaaaaagtaattcagataagaggaaatcaatgaacggaaaaagaataataaaatggatgcctggattaggcttattgtttaattatcagcgtgaatatcttggatatgatattaaagcagggctttctgttgctgcggttgcattgcctgttgctatcgcttataccgaattactcggtatcaatgccattgtgggattatacgcctgtatcttacccatgatcatgtatgctttatttggcacttcacgccaattaattactggccctgatgctgcaacttgtgccgtgatagccgcagttgtcatccctctttctgcgggggatgaaaatacccgttggcaactggccattataatgactgcaatgaccggtttttggtgcattcttgcgagtcattttcgctttggcgcatttacggactttctctctagacctatattacaaggtctattaaatggcgttgccatcactatcatggtggggcaattgagtaaagtatttggttttaccacctccccagaatatttaattgaaaaattacttgaagtaccttttcgattaaaagaagcacattggccaacactgttgatgtcggcgctaaccttagcattactattaggtattcgtcattttagacaacgttggcccgctccgttaattgctatggtggtgatgacctatttaagttggcaatttgatttagtcaattatgggattgctattgttgataaagaagcagacaacggtgatctctttttacccatcgtttcaatgagtggctttcatcttgggtcacttcgtgaattaattgttccttccattaaccttgcggtgattagttttgttagctttatgatgacggcaagaagttttgctagcaaaaatggttatgatgttgatgccgaccaagaattaaaggcattaggcattgctaatatcgcatcggcactttcgcaagggtttgcagtaagtgccgccagtagccgtactgcggtgaatgattctgttggcggtaaaacacaattggtctctattgtggcagcgttagtgattttagttgtgttgctttttatgaccgactttattgcctacattccgttatcttctttaggcgttgtgctgattgtttcctcttggtcattgctaagtattcgtcatatttggtcttatcgtaaacgaaatcgacaagcttttaccttagcaacgtttactttattagcggtgttgttagcgggattgattaacggcattggttttgctgtgttacttgggttattgcaatttttacgtattgtattccgcccaagtgatcagttattaggtgttgatgaacaaggaatgatccactcaatcaaccaaggtaacggcattgaatcgatatcaggattgatgatgtatcgttttaattcccccttaacctatttcaatgttggctattttaaaaagcgggtactacagctagtggacagcgcgccacaacgtcctgcatggttagcggttgatgctaccgtaagttttacttatgacgatgtgagtgtttttgctgttattgatgagctaattagagagcttaggatcaaaggcgttaaattggtattggctgggcgcagaacagaattaaatcgttggattgcacgtaacaagatcactatcaatgatgatgatttaattattgcacccgatctctattttgttattcgtttatatcaaagtcgacaacaaataaaagaaaaacacaaacagcaacaacaagagccgtttgctgaagataaccaagccactttcatcagagatacggaaacgaggggatag

SEQ ID NO: 250 - DNA, 732 bp, Proteus mirabilis
actctaatctctgtcatttttcgtaaacctgatttatctgtcataacggaagtaaattatatgttaacacgcttgtttgttacggggacagataccaacataggtaaaactgttgtcacccgagcacttcttcagtcaataaatcgtggcgggacaacagcagtgggctttaagcctatcgcaaccgaattacatgaaacggttgagggtaatcgtaatcgtgatgctcagattattcataattcctcacctattgacgctcgctacgacgaaattaaccctattttgctagaaaattgttatgtaagtgaaaatgcaatagacttccatcaaatttcaagtgaactaaataatttgggccaaaaagctgaatgcgttgttatcgagggaaatggtggttggcgctatttacttgatgataatactttttattcagactgggtggctaaagaaaaaattcctgttgttctagtggttgggatccaacctggttgtgtcaatcactcaattctaaccgcgcaatctattattaatgatggtttagaattagttggttgggtggctaatagaattaatcctgggttaccgcactatgcaaaaattgtagaaaggttatctcaacatattccagccccattgattggtgaaatcccgtatttattacgccctgaagaacgtgatctctcttgttatcttgacttaagtcagttagaaatcgctcaacccgcttag

SEQ ID NO: 251 - DNA, 1188 bp, Proteus mirabilis
ttttattactcacaaaaacgtgctctgtgtgtgctattaggtaattttaagagtatagtagacaatctttctgcctgtttagatattatagtttttattatggaatcaacgctttctgctcaaaatatacgccgactccttgccaatgaaacaccgattattgatgttcgtgcgccaatagaattcaatcaaggagcgatgcccaacgcaataaatctacctttaatgaataatgaagagcgtgcggctgtagggacttgctacaaacaacatggctctcaaaaagcggtagagttggggcatcaattagttaaaggcgagataaaagcacatcgtgttgctgcttggcgcgaggcttgcgagcgttttccttccggatttatttgctgtgctcgtggcggtatgcgttcacacattgttcaaaaatggttagctgaaataggcatcgattatcctttaattgaaggtggatataaagcgttaagacaagcgacgatcgaaatgaccaatgagctagtacaacgccctattatcttaattggtggttgtacaggtaatggtaaaacaaccttagtacgctctttaccagagggaattgatttagaaggattcgctcatcatcgaggctcctcatttggtcgcactgttgaggctcagtttgctcaagcgactttcgaaaactaccttgctgtcgatatgttaaaaaaatccccttatcattcgcgttgggtactcgaagacgaaggccgtgctataggtgctaatggtttaccggaaagtttgcgtatacaaatggcaacagcccatttggttgtggtggatgatccatttgagcggcgtatggcaagactcaaagaagaatattttgatcgtatgactcatgactttattgaagcgtatggtgaagaaaaaggttggcaagaatacagtgattatttgcatcatggattgtatgctattcgacgtcgattaggtgctcaaagagccgcggagttaactcaattacttgataatgctttagccgcacaaaaaataagtgcgaatacagaagtgcatttttcatggttatcgcctttactaaaagaatattacgatcctatgtatcgttaccagttaagtaaaaaacaagataaaattatctatacgggtagctatgaagaagttgaacaatggtttgctaaccattaa

SEQ ID NO: 252 - DNA, 255 bp, Proteus mirabilis
tacgcttttttgcaacaaagaacgaatgtaaggaatatctcagctatgcgctcacgcatttttccaaccaaatcacttttgcgtctccttccgctagctgcgctgctactaagtgcatgtaatttaaataatatacaaacacaaggttcagcgtcagataacgatgttcaatggcaatcgcgtcaacaagcattaaataagatttcacaatatgagacacgtggcgcattcgcttacattgaagcgcacctataa

SEQ ID NO: 253 - DNA, 828 bp, Proteus mirabilis
aaggatagctcaatgaaaaaatggcttcttttgatcctgtgtagtttgatgacattcaccagcctcgctaaacaacgtattgtcactattggtggtgatattactgaaattgtttttgcattaggtgcaggcgatcaggtcattgctagagatagtacgagtttagtaccagagcaagttaaatcattacccgatgtgggttatatgcgcatgctcaatcctgaaggtattctttcggttaaaccgacgctgattattgctagcgaattagctcgcccttcttttgcattacgtcgtatcgaaaaagcaggtgtacctgttgaaactattacgggtacacgttcattagaagccattaatgaaaaaatcgatgccattgcaaccctcttacaaaaagaaacagagagtcagcaattaaaagaaaagctcactcaatctattaatcaaattgccacgacgcctattgataaaaaaattatttatatcatgagccatggtggtgttgcccctatggctgccggtcaaaatactgctgcagatacgattatcacactggtaggcggaaaaaatgctatgcaaggttttagtagttaccgcttactgtcacaagaaggggttattgccagccagcctgatattttgttggtcactaaagagggaataaaaggtattggaggtatcgaaaaactgtgggacttgcccggcataaagtacacccccgcaggtaaaaataagcgctatatcgttgttgatgatatgggtttattaggctttaccttatcaacccccaaagttatgcaacaaattcgtcaagcattggagcaataa

SEQ ID NO: 254 - DNA, 927 bp, Proteus mirabilis
ataaaaggctcttacatgaaaaaattatttggcgttacagtggcgatggttactccgtttgattcaaatgatcatgtggacatcaacgcgttgtctgcattaactaatatgttgatcactaaaggtgttgattgtctttatccttgtggcacgaccggagaaatgttgcgtttatccgcatcagagcgtaaaagtgtggcgcaaaccgtagtagagacggcaaataaacgtttacctgtttttattcatgttggcgcaatgacggtaacagaaaccattgaactcgccaaacatgctgtagaaattggtgccgatggtattggtgtagtgacgccacaattttttgctgccacagacagagaattagagcactattttgtgactatcgccaatagcgtaccagagaatttcccaatctatctttataacattccacaatgtgcggctaataatatcaagcctgaattagcggctaaaattcagcaacaatgcaaaaatgtgattggtataaaatacagttttgccgataacaatacgacacttggctatttagcggttgcagataatttttcagtacttcatggctacgataaattattccttggtttattagatgcaggctgtgatggcacagtttcaggatgtgcctgtgttttccctgagccatttgtgaatatgtatcaagcctatattacgggtaattatcaagaagcgaagcactggcaacaattttgtgtgaaatttagtgatgctttgaaatcaggcgcgaacatggcgatatttaagtcagcattaactatgcgtggcttaaatggtggtcatatgcgtttacctcaacttgatttattacctgaagaaaaccaacaattgaaagaagatctaacgcaattatgcaaagaagcggggatcgctttttcaattaattaa

SEQ ID NO: 255 - DNA, 432 bp, Proteus mirabilis
cataatttatcttatgttatttttttattagttgagttatcaatgttaaaattaaataaaattcatcatgtggcgattatttgttctgattataccgtcagcaaacatttttattgtcaaatactggggcttaccctattaaatgaaaaataccgtgaagaaatacaatcttggaaagctgagcttgcgttaggtacagtctaccaaattgaattatttagcttcccagatgcgccagcacgtttaagttacccagaagcacgtggtctacgccatgtggcatttgcagtggacgatcttgatgcttcagttgcttatttacaacaaaacaatattcaatgtgagccaatacgtattgatcctagtagccaaaaacgttttaccttttttcaagatcccgatggcttacctttagagctttattcaatatag

SEQ ID NO: 256 - DNA, 657 bp, Proteus mirabilis
  unsure (15): Identity of nucleotide at the above locations are unknown.
aatttattatccaanatcctgtgttcaccttttttacacaaagcaaatgtaatttatagtggaacagggtttatctataatgaagacgataatgatattattattaatataaaaaataaaaactccgctactgattatttaatacaaagctggatcacaaaggatgaaaatgataaaaatacaccttttatgattaccccacctttatttaaattaaataaagaacaatctgcaattttgcgaattgccaaaatcacatcaatagctcaaacagatcgtgaaagtcttttttatataaatagcaaagcgatccctatagctgaatcaaaacataatagtattcatatatcaattaagtcagtgtttaaattattttaccgaccacatggcttaacagaaacagttgaagaagcgacaaaaaaaattattttttctataaataataaaaaagaaatgataataaaaaacaactctgaatactacttcactattataaatattttttctaatggggaaaaaaaagagatctcagtcatgctatccccttttagtgaaattaatataggaaaaaatcattttggtacagctaaagtaggctggagctatataaatgattttggtaatgaagttaatatcaacataaaaaatagcgaatag

SEQ ID NO: 257 - DNA, 717 bp, Proteus mirabilis
ataaacctatcatttgaggttaatatgcatttaatatctaaacactttattgcgttattttttctcttcagtttttcatcgctatcatatgcgggaggtgttgcattagctgcaacacgcatagtctatcctatggatgcaaaacagacgtcaattactcttaataatacagataaaagattacgctttttagtgcaatcatggattgatgatagccaagatcaaaaaagtaatgaatttattgttacaccaccactgtttgtcagcaaaccagaaagtgaaaacaagctaagaataatttatgctggtaaggcattaccaaatgatagagaaagtttgttctggttaaatacaaaagcaatccctgaaattgagcgagaagaaataaaagataaaaatatattacagctagcagtattatctagaataaaaatttttattagacctcaaggattaaattttaacatagaggatgtacctaatagtcttgagtttaaaaaatcacaaggaaacataatagtaaataatccttcaccttattatgcgacattaattaatttagaagctgataatgaacagctaaatagtattatggttcctcctatgggaacagtaatgattaaagtcagcaagcctaactatagtcaaatatcttatcaaactattaatgattatggtgctagtacacccaaagtaacgaaacagattggtaagtaa

SEQ ID NO: 258 - DNA, 1017 bp, Proteus mirabilis
ataaaaatatcgggtgtttttatgaaaaagatattaaataaaccagaaaattatgttgatgaaacattagctggcttatgccttgcacataatgatatttatcgtcaaccacaaccacgtttaattacgcgagctaacagctcagataaagctaaagtgggaattgttactggcggaggatcagggcaccttcccgttttcaccggatatgtaggtgaaggtttattagatgccgccgcagtcggtgatgtatttgcctcaccgtcagcagatctaatggctgatgcgatacgcgctgcggataatgggcagggggtattactgctctatggtaattatggtggcgatattatgaattttgatatggcctctgaaacggtagattttgaagataatattcgatgtacaacggtgttagcgacagatgatattgcttctgcaacaccagaagaagcgcataaacgtcgtggtgtggctggaatgatttatggttttaaaatggcaggagccaaagctcaagaaggggcaactcttgatgaggtgacccgcattgctcaaaaaaccatggaaaacacacgaacaataggctgtgccttaacatcttgcaccttacccgctgttggacatcctacttttgaaatagctgacgatgaaatggaaatgggaatggggatccacggtgaaccaggaatttggcgcgataaattacgtagtgcagatgatattgctgaagaaatgtttcaacgtttacaaaccgaattatcactaaaaaagggtgataaagtctcagtactagtcaactcgttaggtgcaacgcctttagaagaactctatattttatataataaagttgttcaacttattgataatacaggggtgactatcattcatccattagtcggccgttatgcaacatcaatggaaatgaccggtgctagcttaactttttgtaaacttgatgatgagcttgaagctttattgaatgcacctgctcactgtgcattttggagagtgtga

SEQ ID NO: 259 - DNA, 327 bp, Proteus mirabilis
ggattagtatctggccaaatattataccgccggcaattagttttatcgatgcatcagcaccaccggaaagccaaggttttatgctcgttggtgcgctatttatcattcccattattctcgtttatacattctggagttattacgtattcagaggaaaaaccaattatgaagaaggctatcactgatccgaaccctgaaacaaaaccctcattactgaaaaaatggggttggttaattaccatttggttttgtagtgttttagcgctatttgccgtttcttcgctatttcgttttttaatgacggcagcgggaatgaaagtaaagtaa

SEQ ID NO: 260 - DNA, 453 bp, Proteus mirabilis
gttaaaacatccactacaggcgcttttggagattatgcaatgatatggaaacgaaaaacaacattaggacaacttaatcatattagcccaaataatatggtggggcaccttggtatagaactcaccgcactgggtgaggactatcttgaaggcaccatgccagtagatcagcgtactaaacagccttttggtttattacatggtggcgcctctgtggtattagctgaaaccttagggtcaattgctggctatttatgcacagaaggtgaacaaaaagtggtgggtttagaaattaatgccaaccatatgcgagcagtaaaagaagggtttgtaaaaggtgtctgtaaacctattcatttaggtcgtacacatcaagtatggtcaatagaaatttttgatgacgctgaccgtaaagtctgtatttcacgtttaacaactgcggttattgtttaa

SEQ ID NO: 261 - DNA, 840 bp, Proteus mirabilis
tttagagcatcgacaaggaatcactccatggcacgcattattgttgttacgtcaggtaaaggtggggttggtaaaacaacttccagcgcggccatttctaccggcctcgctcaaaaagggcataaaacggttgttatcgactttgatatcggattacgtaatcttgacctaattatgggttgtgagcgtagagtcgtttatgactttgttaatgttattcaaggtgatgctactttaaatcaagccctgattaaagataaacgtacagaaaacctttatatcctccctgcttcacaaacaagagataaagacgctttaacccgtgatggtgtagagcaagtgttagatgaactggatgaaatgggttttgattttattatttgtgattcacctgcagggattgaaagtggcgcacttatggcactctattttgcagatgaagccattatcaccaccaacccagaagtctcctctgtacgtgactcagaccgtattttaggtattttagcctctaaatcacgtcgcgctgaacgaggcgaagatcctattaaagaacatcttctattaacacgctataatccaggccgagtaagccgtggtgatatgttaagtatggaagatgtgctagaaattttatgtattccactgctgggtgttattccagaagatcaatccgttttacgttcatcaaaccaaggtgagcctgttattcttgatagtgaatctgatgcaggtaaagcttatttagatacagtaaatcgtttattaggtgaagaacatccattccgttttattgaagaagagaaaaaaggcttcctaaaacgcctttttggggggtaa

SEQ ID NO: 262 - DNA, 1224 bp, Proteus mirabilis
ctctaccaatctgcattatcctttcttgcttcatgcctcaaaacccgcttagtttacgccggagagtatatgagtacatcttgtgtagaagaaggccgaaagacctccaatgatccttatcaacggatcgcatcagagctgctcgctcaagcagacattcatatcaatggttctgaaccttatgatatccaagtgcataataaagatttttataaaagagtattacaacaaggctcattaggtctcggtgaaagctatatggatggttggtgggactgcgaacgtcttgatatattctttcataaagttttacgagcaggtcttgaaaataaattgccaagtaactggcgcgatattttaaaaatagccatggcacgcatttttaatttacaaacacaaaaaagagcgtggatggtgggtaaagagcattacgatttaggtaacgacctctttaccgcaatgttagatccttatatgcaatattcctgtggatattggaaggatgcggatagcttagaagttgctcaacagcacaaactcgaccttatttgccgtaagttagagctaaaaccaggtatgacattgcttgatattggctgtggctggggtggtcttgctgcttatgctgccaaaaactatggcgtttctgttacaggggtgaccatctcagttgaacaacagaaattagcacaagagcgctgtaaaggtcttgatgtcaatatcatcttagaagattaccgtgacttaaacgagcagttcgaccgtatcgtttctgttggtatgttcgagcatgttggcccgaaaaactatgccacttactttgatgtcgctcgtcgtaatatcaaagaagatggactatttttattacataccattggttctaatcacaataaagttaatgtcgatagttggataagtaaatatattttccctaacggttgtttgccgtctattcaaaaaaccgctgaggcaatggaaaataaatttgttatggaagattggcataattttggtgccgattatgacaaaaccttaatggcatggtatgagcgttttttagctagctggcctgaaattgaatctaactatacacctcgttttaaacgcatgtttagctactacttgaatgcttgtgcgggtgctttccgcgccagagacattcaattatggcaaattatgttaagcccgaaaggtagaataggtggattacgcacacctcgctga

SEQ ID NO: 263 - DNA, 984 bp, Proteus mirabilis
atggataaatccagccctaaagaggatatagcaatggaaaaatatcaaaaccttctcgttgtcattgatcctaaccaagatgaccaaccagcactacgtcgtgctgtttatatcgttcagcgtaatggtgggcggataaaagcttttctacctgtttatgatctctcatatgacatgaccacccttttatctcccgatgaacgtaatgcgatgcgcaaaggcgtgattaatcaaaaaaccgcttggataaaacagcaagctcgctattatcttgaagccggcattcaaatcgacataaaagtgatttggcataaccgaccgtatgaagccattattgaagaagtgatcaccgataagcatgacttactgattaaaatggctcatcaacatgataagttaggctccttaatttttactcccctagattggcaattgttaagaaaatgccctgctcctgtatggatggtaaaagataaagagtggccagaatacggcactattgttgtcgccgctaatctgtccaatgaagagtcatatcatgatgcattaaatttaaagttaattgaattaactaacgatttatctcaccgtatacaaaaagatccagacgttcatttactcagtgcctaccctgttgcacccattaatattgcaattgagttacctgactttgatcctaacctttataacaatgctttgcgtggacaacaccttatagcgatgaaagagcttcgccagaaattctctattcctgaggaaaaaacacatgtcaaagaaggattgcctgagcaagttatccctcaagtatgcgaagagctaaacgcgggtattgtcgtattaggtattttagggagaaccggactttctgccgctttcttaggcaatacagcagaacagctgatcgaccatataaaatgtgatttactcgctatcaaacctgatggctttacctgtcctatcactgtcgattcagacaacgaataa

SEQ ID NO: 264 - DNA, 933 bp, Proteus mirabilis
cacacgggatcaacaatgaagaaatggttaaccttattgggtgcatcgctgttagggatgagcagtcacttaacttatgcacatgaatacctgctacctacggatggttcacgtatcattggggaaaatgtttcttacaccgttcctgatgataaacgttctttagaaacgatcgctgcacaatatcaagtgggtttgctaaatatgatggaagccaacccaggtattgatcctctattacccgaagcgggcaaaacactacaaattcccttacagatgatcttacctgataccgtgcgtaaaggtattgtcattaatctggcagaattgcgcctctattactatcccaaagaagggggaaccgttgatgtctatcctatcggtattggccaattagggcgggaaacgcctgaaatggtgacatctgtttctcaattgattaaagatccgacttggacgccgacagccaatattcgtaaaaattatgcggctaaggggatcacgttaccggcagtggtaccagcagggccagataatccaatgggtgcatatgcgttaagattagcacacagtcgtggtgagtatcttattcatggtactaatgccgattttggtattggcttaagagtgagttctggctgtattagattacgtcctgatgatattgaaacactgtttaatgtggtacccaaaggcagtcgggttcaagtgatcaataaaccaattaaatttactgagactgcagatggtaagcaatttattgaagtgcaccaaccactctcacaaaatgaagatgacgatccccagacgatgcccctaacgtttactaaacaatttacggcttggtatgaaagtggcaaagtggataaagcaaaagtggatgcagaaattattcgtcgttcaggtataccggtcgatgtaaccgcatattga

SEQ ID NO: 265 - DNA, 474 bp, Proteus mirabilis
tctttgatgtcaataaaattggataagatagacaagcatattttgcaagtgttacagcgcgatggcaaaattcaaaacatcgaactggcaaaagaagtgggactctcaccatctccttgtttacgtcgtgtacgtttacttgaagagtcaggtgtgatcacgcgttatgttgccgtattagatggtagtaaagttgatgcaggattatctttatttgcgcgaatttggttcagagcacaagatgctgaaactattgaagaatttgtaaaggcgataaaagtattacccgaagtggttgaatgccatctaatggcgggagaatgtgatgcacttattcgcattgtgacaaaagatctcgccacttatcgccgttttcacgctgattatttaacacaaattcctagcattcaaagcataaaaacagaagtacccatggagacggtaaaagtgagttttgctttaccattgcagtaa

SEQ ID NO: 266 - DNA, 219 bp, Proteus mirabilis
tttaacgtgtctcaattaatggggagtggacatggtcatgccacgcatattcgtagtagtcaacaaatatcttccaataccaaagaacgttataaccagtgccagaatatcaattgtggcgcgacgttcgtcagccatgaaaccgtaacgcggtttattttaaagcctaaattgattgaacgagtagagccacattgccagcagatactggggatctga

SEQ ID NO: 267 - DNA, 669 bp, Proteus mirabilis
ttatacccgtcctcgggtttatggacattaatggagataatgatgatcgagatactaaaacgtcatgggttaacattagctatctttgcggcctgtaccacagggttaacggctgtcgtctatcacttgacggcgaatactatcgcagagcaagcggctttagaaaaacagaaattattagaccaagtgatcccaacctctctctacaataaccatctcgcgcaagattgttatattttgacagataaagcattaggtaatgaaaaaccacataaactttatgttgctcgttttaatggtaaacctgtcgccgccgcattagaatcaacggcaccggacggttattcaggggcgattgaattattggttggtgctgattttagtggcaaagtactcggtgttcgcgtgacaacacataatgaaacaccggggctaggtgataaaatagaaacgcgtatttcagattggatttactcattaagtaacaagtttattaccagtgctcatgactcacattgggcggtaaaaaaagatggtggtgattttgaccaattcaccggagcaactatcacaccaagagccgtcgttaatgcatcaaaacgcactgcatggttaatacaatctttacctgaaaaattagataccctttcagcttgtgaggcgaattaa

SEQ ID NO: 268 - DNA, 573 bp, Proteus mirabilis
aaggaaaagtcaatgcttaaaaaaaagatgttagttaaagctctatttacagtatctgttttatcactgagcggtgttgcttctgcagcgactattgttaatggtggtaaaattaattttactggagaaattgttaatgctgcatgtgttgttagtacaaaatcaatagatcaaactgttaatattgggcaatatcgtaccgcacaatttgatagtgtagggaaaacagttggtaatactgatttttatatcaatttagaagcttgtgatacgactgtcgcacagaatgcctcagtttcattttcaggtgtaagtgattcaaatgataaaacagtattagctgtaagcaatattacaacaggtggtgcgggtgctgcgacgggcgttggtattgaaattacagaccatacaggaaaagtgttaccaccagacggctctgttttttctacagcaaaacagttaattgatggatcaaatacacttaactttgttgcacgttataaatctacattagataccgttacccctggtcatgctgatgctgatgtaactttcaaaatgcaatatgaataa

SEQ ID NO: 269 - DNA, 618 bp, Proteus mirabilis
aattatgagtcaaaaataatgaaattaagacgtatcgcagaagcaaaactccctactccttttggtgagtttttaatggtgggttttgaagaaattgccacaggaaaagatcatgttgccctcgtttttggtgacatttctggcacaaaacccgttttatcccgtattcattctgaatgtttaactggcgatgcactatttagcctgcgttgtgattgtggttttcagctagaagctgccctttcacaaattagcaaagaaggccgtggtgtattactttatcatcgccaagaaggtcgcaatattggtttacttaataaaatccgcgcttatgcattacaagaccaaggattagatactgtcgaagctaatctaaagttaggatttaaagccgatgagcgtgacttcaccctttgcgctgatatgtataatctattaggcatacatgaagtacgattattaaccaataatccaaagaaaatcgaaataatgaaagaagctgggatcaatgtggtagagcgtgttccattaatcgtaggacgtaatccaagtaatgctcattatcttgatactaaagcggataaaatgggacatatgttatttaaaaaagcgcaataa

SEQ ID NO: 270 - DNA, 585 bp, Proteus mirabilis
aaccaaactttatggggtaaaaatagaatgaatgaattttcgattgtctgccgtctattaggtacattatttcaacgagcaccgagtgatgctattttagcaccgatcataaccatgatagcggaagataaactaagccaattatggccattagagcaagatgaactattcaaaacgttaaaaagtagcgtagctgatttagcggcagtagaagctgactaccaatcgctttttgctgacccaatacccgcagtatctctttatgcacatgattacggtgatataaaagagcaagatattcgtcaattcttagtcactcgaggtatgcctgtcaccggatcagcgacagatagctttggtgcgttgttacttgccgcttcttggcttgaagataatgccgcacaagatgaagtattagcacaaacacagctatttgataactatctattaccttgggcgggaacctttttaggtaaggttgaagcgcatgctaaaacaaatttttatcgtactttagcagcaattacgcgtggtgcactttctgcattacgagaagaattatcagatgaagaaaacgaaaaataa

SEQ ID NO: 271 - DNA, 216 bp, Proteus mirabilis
atattattgttagcaatagaaaagaaagggtatgcatttaatatcaatagcaaagatgtttttagtctaaaacttatcttactcataaataagttcctttggggttgcaatgatagtctgctcatactcatcgactctcttccaatgtacttttttatctttaatatttttagttatttttttattttttatactgtaatttttaaatggcgatag

SEQ ID NO: 272 - DNA, 864 bp, Proteus mirabilis
aggatttatccatacatgcaacaccaaaatactcaaaagaaaatactacgtactatttgtccagatgcgaaaggacttatcgcaaaaattactaatatttgttataaacatcagctcaatattgttcaaaataatgagtttgttgatcatcgcactggccgcttttttatgcgtactgagctagaaggcatttttaatgatgaaacctttttagccgatttagatgatgcacttccacaaggctcacagcgagagcttaatactgccggtcgccgccgtatcgtcattatggtcactaaagaagcccattgtattggtgacctcttaatgaaaagcgcttttggtgatctggatgttgaaattgcagcagttattggtaatcacgacacgctaaaacaccttgttgagcaatttgggatccctttccatctcattagtcatgaagggttaacccgtgatcagcatgatgaaaaactgatagcacaaattgaccaatacaaacctgattatgtggtattagctaaatatatgcgtgtattaacccccgcatttgtacaacattacccaaatcaaattattaatattcatcactctttcttaccggcatttattggcgcccgcccatatcatcaagcctatgaacgtggtgtaaaaattattggcgccacagctcactatgtaaatgataatttagatgaaggccctattattactcaaaatgtaataaacgtagaccacactttttcagcagaagatatgatgcgcgcaggacgggatgtagagaaaaacgtactaagccacgccctctattgggtgctctcgcaacgtgtttttgtctatggcaacagaacaattattttgtag

SEQ ID NO: 273 - DNA, 1230 bp, Proteus mirabilis
aaaaagcatccggtgaaaacagaagcacccgatattgaagacaaacagctacaattgcctgcctctagtgaagaaagtgcggaaaaagcgttaaaacaacgatttagtttacgccgtttatttagttatagcattcgtgaagggatggaattacgccgtgacccagtacgccttaccttagcattactaggcacggtaatattgatgtttattatgggttacggcatcagtatggatgttgaaaacctacgctttgccattatggatagagatcaaacagggctaagtcaggcttatagtcaaaatctatcaggctctcgctattttattgaaaaagcgccgattaccgattataaccaacttgagcgtcgtctccgcagtggtgatattactgttgcgattgaaattccgcctaattttgctcgagatgttgctaaaggacataaagtaaaaataggggtttggattgatggcgcgatgccaaatcgtgcagaaactgtccgtggatatattcaggcaatgcatctaacttggatgttagatatggccatgcgtcaacctaccaatatggttgatcaattttcccccattgatatcgaaacccgttatcgttataaccctgatgtaaaaagtttacccgctatagtacctgcggttattccgttgttgttgatgatgatccccgcgatgttaagcgccttgagtgtggtacgtgaaaaagagctaggctctattattaatttatacgttactccggtcactaaagccgagtttttattaggcaaacagatcccctatattttattgggaatgtttaacttttttatgctctgtgcgctttcggtatttgtttttggtgtcagttttaaaggaagcatgttaacactctcattaggggcgttgctttatatcactattgctacgggaatgggattactgatttcttgttttatgaaaagtcagattgcggctatttttggtacttcaattattaccttaattcctgctacgcaattctccggcatgattgacccagtatcatcattagaaggtattggtaaatggatagggcatatttatccgacttctcactttcttactatcactcgaggaacgttttcaaaaggacttaacttatttgatttgccttggtcttttattccgttacttatcacgatccccattgtgattgggctgagtgtctttttcttgaaaaagcaggaggcttaa

SEQ ID NO: 274 - DNA, 912 bp, Proteus mirabilis
aatttaatcccgtactgggtatataacggtacatggcaaaataagataggaatagatatgcaacataaagtggtgagtattggtgatatcaaggtagcaaataatttaccctttgtgctctttggtggcatgaatgtattggaatcgcgcgatttagccatgcgtatttgtgagcattacgtcacggttactcaaaaattagatattccttatgtatttaaggcctcttttgataaagcaaaccgctcatctatccactcttatcgtggaccgggtcttgatgaaggaatgaaaattttccaagagctaaaagagacttttggggtaaaaattatcacggatgttcatgaaccttcacaagctcagcctgtatctgaagtcgttgatgttattcagctaccggcattcttagcgcgtcaaaccgatttggttgaggcaatggccaaaaccggtgcggtaattaacgtgaaaaagccacagtttgttagccctggtcaaatgggaaatatcgtcgagaaatttaaagaaggcggtaacgaccaagtgattttatgtgaccgtggtagtaattttggttacgataatttagtggtcgatatgctaggttttcatgtcatgatgcaagcctcagaaggggctccagtgatttttgatgttacccactcactacaatgccgtgatccattcggtgcggcttctggtggtcgtcgtggacaagtcgctgagttagctcgtgcaggtatggcagtgggtctggcagggttatttcttgaagctcatcccgatcctgatcatgcccgctgtgatggcccatcagctttaccattagctaaattagaacctttcttagctcaaattaaagcgattgactctctggtaaaaagcttccctgagttagataccagtaaataa

SEQ ID NO: 275 - DNA, 3060 bp, Proteus mirabilis
caaatgatcccacgtatatcgcaagcaccgcaagtcagtgaactcacaaccgaatttttaaatacactccgacaaaatggttttacaggtgatatatcgagcacttatgccgatagactcactatggcaacagataacagtatttatcagttgctaccacaggcggttatttttcctcgttccacagcggatgtgactattgtagcacgtttagtggatgaacctcgttttcattccctctctttgacaccaagaggtggcggaaccggcactaatggtcaagcgttaaccgaggggatcgtggtggatttatctcgttatatgaaacgtattattgagataaacccagaacagcgatgggtaaaggtagaagccggtgtgataaaagatgaacttaatctgtttttaaaaccctatggcttcttttttgcgccagaactgtctaccagtaatcgtgcgacattagggggaatgatcaataccgatgcctcagggcaaggctctatggtatatggcaaaacctccgatcatgtattaggcgtcagagccgttttactaggcggagaattgcttgaaacacgcgcgatggacagcgctttagctgaaactattgcgaaagaagattctgctgttggtcggatatatcaaacggtattatcccgttgcaaagcacaacgtcagcttattctcgaaaaattccctaaactgaatcgctttttaacgggctatgatttacgccatgtgtttagcgatgacatgaagcattttgatcttacgcgtattctaaccggctcagaagggactttggcctttattaccgaggcaacactcgatattacccccattccaaagcagcgcagtttagtgaatgtgaagtatgactcatttgattccgcattgcgtaacgcgccgtttttagtaaaagcaaaggcgctttctgttgaaactgttgactccaaagtattaaaccttgctcgagaagatattgtctggcattccgttaatgcattgattacggatgtgcccgataaagatatgcaagggctaaatattgttgagtttgccggtgatgataaaacactgattgcctcacaagtggaggatttatgtcagcgcttagataagctgatgaataatggcgaagggggcgttatcggttatcaggtttgtgataacctcgccgatattaaccgtatttatgccatgcgtaaaaaagcagtagggctattaggtaatgctaaagggcatgctaaacccattccttttgttgaagatacttgtgtgccaccagagcatttagcggattatattactgaatttagggcattacttgatagttatcagctcaattacggtatgtttggtcatgttgatgctggcgtattgcatgtgagacctgctttagatatgtgtgatccgcaacaagaacaactcatgaaaaccatttctgatgaaattgttgcattaacggcgaaatatggtggcttactatggggggagcatggaaaaggctttagagcgcaatatagtccagaattctttggcgaaaccctttatcacgaattacgtcaaataaaaacggtgttcgatcctcgaaatagacttaacccagggaaaatatgtcctcctctcgaggttgaggcgccaatgaaacaggtcgatgctattaaacgcggcacatttgatcgcaccattcctgtatcggttcgcgaagattttcgcggtgcgttagagtgtaatggtaatggattatgttttaactttgatgttaaaagtccaatgtgtccttctatgaaaataactgggcaacgtattcattcacctaaaggcagagcgacattagtcagagagtggttacgtctacttacagagcaaggtgtaagccctcagcagttagaaacaagtcttacaaataacaaacctagcttacggggattgattgaaaaaacacgcaatacatggaaagctaaacgtggagaatatgatttctctcatgaggtaaaaatagcaatgaatggttgtttagcctgtaaagcgtgctctacacaatgcccgattaaaattgacgtgccatcatttagagccaaatttactcagttatatcatcaacgctatctacgtccgctaaaagatcatattgtggcaaatgtcgaactcaccacaccgttaatggcaaaagtaccaagtctgtttaatttctttattaagcaaccattggtgcaatcgttgagtaaacgtactattggtatgatagatctgcctctattgtcatctccgacattaaagcagcagttagctggacatagcgcgttaacgatgaccttggaagagttagagcagttatcagaaaagcaacgaagccattatgttatcgtggtacaagatccatttaccagttattacgatgctaaagtagttgctgactttattaaattgattgaaaaaattggttttaaacctgtgctattgcctttttcacctaacggaaaagcacagcatattaagggatttttacagcaatttagtaaaactgcacaaaaaacagcaacgatgcttaatcgagttgcacagttgtccattccaatggtaggagtcgaccccgctttagtcctttgctaccgcgatgaatatcgggagatattaggggataaacgcggtaactttaaggttcaactggttcatgagtggctaaatcagttagtcagtgagccgattgagatctgcgaagatgctgaaaaatggtatctttttagtcattgtactgagtcaacggcattaccgcaaagtatgcaacagtggcaagcgatattccaacgttatggtcaaccacttgaagtggtaactacggggtgctgtggtatggcgggcacttatgggcatgaagtgaataactataaaaattcattgggaatttatcaactgtcatggggaaatgcattgaaaacactccctacagcacgttgcttgtgtaccggatattcttgtcgtagccaagtaaaacgtattgataatattgagttaaaacatccactacaggcgcttttggagattatgcaatga

SEQ ID NO: 276 - DNA, 330 bp, Proteus mirabilis
tttatttcccctatgaaaaaacatttaactcctattatcatgttattaatattactacctgtgttttctgtaaatgcttattatatctatgaaactagctgtgaatacataatggataataataaatcaaaagaaaaccaagaagttatattgaagatatcaaactgtccatcaataataaaaaacgctaatagtatattgaatattaaaaagaacactgctatttcaataaaaaatagcgtaaaaacatcttttatcttagatagtaataaagtggttttagctgacaatattaatgatcaatttaccatttcagtacattatcaataa

SEQ ID NO: 277 - DNA, 543 bp, Proteus mirabilis
ataggtaacccttggcgaagcacattaggtacttttccttccccttggctagttgtcgcaacaggcttttcctcacctttattactcggtgtagcgttgggattaagatttttcatctcatttcccttgttcagcgccaatggctgttgctgtggccgttcgacaggtggctttggtttttccaccggttttggcttaggttttggtttgggttcgggcttcttctctatcggtttttcaatcaccggttttacatctgggatcggttctggttctggctcaggttctggctcgacaacaggctcaggctccggtggcgtcacctcttcaactacaggctcaggctctcctactggctcatctgcagcaaaggctagcatctgtatagagataggttctggtgcaattggcttatcttctacaacatacagtatggcagccgcaacaagcgaggcatgcaaacacagtgatataaatacccaaagcttaaagcgcataactgatcttatttcacctaaacaaaaaataatgcctctagtttaa

SEQ ID NO: 278 - DNA, 1992 bp, Proteus mirabilis
aactattgcccacttttattattaaaattgccgactttccggaaaaatatgtttcaagacaatccgctgcttgctcagctaaaacagcaactccatgcccaaacaccgcgcgtggaaggccttgtaaaagggacagataaaggctttggcttccttgaagttgatggtcagaaaagctattttatccctcctcctcaaatgaaaaaagtgatgcacggtgatcgcattattgctgccgtacatactaataatgataaagagtccgctgagcctgaagagctggtagaaccctttttgactcgctttgtcggccgtgttcagaaaaaagaaggtgataatcgtctatggattattcctgatcaccctctactcaaagatgccattccttgtcgtcctataaaaagcttaacacatccatttgccgatcaagattgggcagtggcggaaatgcgccgacatcctcttaaaggtgataaacattttcaagctgaattaactgattttattaccgataaagatgaccattttgcaccttggtgggtgacattaatgcgtcatcaattagagcgaaatgcacctgaagtagacagtgaaacattaaccttacatgatgatctaccacgtgaagatttaaccgcgctctcctttgtgaccatcgatagtgcttcaaccgaagatatggacgatgcgttatatattcgtaaagaagaaaatggccaactttcactgtatatcgctattgccgatccaacggcttatattcagcctaatagcaaattagataccattgccgcacaacgagcgctaacaaactatctaccgggctttaatatcccgatgttacctcgtgagctatcagataatctctgctcattgcgccctaatgaaaaacgccctgcgttagtctgccaagtgggtatcatggaggatggtgcattaaccgatgagatccacttctactcagcatgggtagaatcaaaagcaaaactggtttatgacaatatttctgattggctagaaggtgaagaaacaccgtgggcacccgaaaatgagattgttcatgaacaagtcatgctgttaaaagagatgagcgagaaacgtcatatatggcgtgaacaacatgctctcgtctttaaagagcgtcctgactatcgctttattcttgatgacagtggcaacgtattagatatcgtggcggaaaaacgtcgtactgccaaccgtatcgtggaagaagcgatgatcaccgccaatatttgtgcggcaaaggtacttagtcgtaatctcggttttggtatttataacgttcatactggttttgatccgctctatattgatcaagtctcacaaaccttaaaagagcacggtattgaaactaacgcagatgagttattaacccttgaaggtttctgtcgcttacgtcgtgaactggataatcagccaaaccaattccttgatagccgtattcgtcgtttccaaaacttcgctgaaataaaaacagagccaggccctcactttggtttaggccttgaagcttatgcgacatggacatcaccgatccgtaaatacagtgatatcttaaatcaccgtttattaaaagcgattatcagcaaaagtgcggcagaaaaaccgcaagatgaagattgtgttcgtattgccgaacgtcgtcgtgctaaccgtatggccgagcgcgatgtcggtgattggttatatgcgcgcttcttaaaaccttttgctggcactgagagtacctttaatgccgaaattattgatattactcgtggtggtattcgggtacgtttagttgaaaatggggctattgcctttattcctgcaccatttttacatgcggtacgtgacgaaattcaatgtagtcaagaaactggctctgtcattattaaaggtgaaacagcctataagctcaacgacattattccggtacgtattgaagatgtgaaactagaaacgcgtaatattgttgctcgtccgatttaa

SEQ ID NO: 279 - DNA, 204 bp, Proteus mirabilis
cggagtcgcccaataaaactttcttgctcttttcgttgcatctcttgcagcgattctaacaattctgatgtcacgggcgggttattacaggggattttattgctttcaatcggctccgcagggggtgcaacattagtgattaaagtccctaatgtattgttattgttcattgcgactaatgaaccatcttgtgcagctggttga

SEQ ID NO: 280 - DNA, 195 bp, Proteus mirabilis
caacgtatacctaaaagtgataatcacaaggcggctctctcatctatcttgctggacgtcatattaaatacaaggaagaaaaataaattgagagataaggggattagaacattattgttatccattgatagacaaaataaaaccagccttgtggctggttttatagtaaagcaatcatcgaagattgaaggctaa

SEQ ID NO: 281 - DNA, 1926 bp, Proteus mirabilis
aatattccaccattaagccttgatttaggtttggtcagcatttttatactttttttacatccgtcagagcgcttttatcaacatctttacacctctttcagtagctttactcaatctaaatcgcaaaaggatagttcaaatgttgatattcggtgctgtggcattagttattgtgctcactgcttatcttatttatgtgttgtttcatgcagaggcattttaaaaatggcaacaacaacgttgatctatattgccgtttttctcaccgtcttactgattatgggaaaagtgattggcaattatcttgctcgtctcatagaaggtgatttacctcattgggtaacaaaaacagaacaggttatttggcgtagctgtggttttaaacctgccggcaaagcgattcagtctatgagttggtatcactatatgttcgccctgttaatttttaactcaatgggagcacttttattattggtaattttacttaatcaaggttatttacctttaaatccacagtttgcacctaatatgagttgggatttagcattaaataccaccattagttttattactaataccaattggcaggcctatagcggtgaaacagccgttagctatttaagccaaatgatggggcttacagtacaaaatttcttatcagcaacaacggggatcgctgttgcctttgtattgatcagagcattaacacaatcttcttgccattccattggtaatgcttgggtagatatcggtcgtattaccctatatctgttactacctttagccattatttggtcactgttatttgttagccaaggcgtgatccaaaatttccatcccgcgctattaagccaaggacttgaaaatcagcaatggttaccaatgggccccgttgcttctcaagaggcaattaaactgttaggaaccaatggaggaggctattttgcagcaaactctgctcatccttatgaaaacccaacctctttcagtaactttttgcaaatacttgccatattcctgttacctaccgcgctatgcttcgcctttggccgactgagtggcacacaacggcaaggctataccttactttgggtaatgacattgatttttattgttgcggttagcgtgattgtttgggctgaatggcgaggtaacccacaatttactttaatgggtgcggatagttcattaaatatggaaggtaaagagagtcgctttggtttaataggcagtgcgttatttgttgccgtcactacagccgcttcttgtggtgcagtaaatgccatgcatgattcattaactgcattaggaggtatggttcctatgtggttaatgcaaactggagaagtcatcttcggcggtgttggttctggtttttatggcatgatcttgtatgttttgttagctgtttttatcgctggattaatggtgggtcgagcacctgaatatctcggcaaaaaaattggtgtagcagaaatgaaatgggttgctgtcgctattttaatatcaccagcaatcaccttattaggtacaacacttgccctctttagcgaagtaggtcgcgaagcgattttaaatcctggtcctcatggttttagtgaagttttatacgcttttacttcagctgccaataacaatggcagtgctttcgccggactgaatgctaattctgttttttataatctgttattaggtatcactatgcttgtcggacgttttggtgtcatgttgcctgtcttggctatcgccggtagtttggcaataaaaaaacgccaagctgaaagtttagccacattgtccactacttcaccgctatttatttttctattgttcctcacagtaataatgattggtgcgctcacctttgttccggcattagcactaggccctattgctgagcatttacagttgttatgggctaaataa

SEQ ID NO: 282 - DNA, 903 bp, Proteus mirabilis
gtgacaccaccgggcatctggctaacccagaggaggtttaagatgggcatgggattacatgaatggccactgatgttctttaccgttattggtcaaagtgtggctggcgcctttattattatgggttgcgccattctttcaggcaaactgcctgaagcgttaaatcgcaaagtgcattacagcatgtttggtttgtggttattaatggggattggttttttactctccatgatccatatgggaaccccaatgcgtgcctttaactcttttatccgttttggtcattcatcattaagtaatgaaattgccagtggtgccacattctttgctttaggtggcttatattggctaattagtgtgttaaataaaatgcccgctgcattaggtaaattgtggctagtggttgtcatgatacttgcagtgctatttatcacggctatttcgcgagtttatcaaattgatactgtacctacttggtataatggctataccacagttaacttcgtactaaccgcatttattggcggccctattttagcggcactgttaatgcgtattgccggttttaacttaaattgtattagtgcattaccgctattaagtgtcatcgccattattatcagtgctattgtggctacctctcaaggctttgaattgggttcaattcaaacctccgtacaaaaagcggttgatttagttcctgattacggttttttaatgggcattaaattgattgccctaacattagggttagcttgttggatagcaccgttattacgcaaaaataatccttctgtttctttaatggtgttaggttttattttggtgtttgttggtgaatttattggtcgtggcgtattctatggcttacatatgacagtaggaatggctgttgtaggttaa

SEQ ID NO: 283 - DNA, 192 bp, Proteus mirabilis
acatctgcacctttacaaaaaacaaaaggaagcaccttctcttcaaaaatcttgaaggcccaaggtttaaaaagttcaactgcattttcaatagttatcatttatatacctagattactagcgtctaatcagactttagataaaatgaacataacacaattatacgtatttaatgaaaaaaaagtagtttaa

SEQ ID NO: 284 - DNA, 618 bp, Proteus mirabilis
ggcacaaaacccgaaaatgataggataaaggagtacgcaatgtctttcgaattaccaaaattaccttatgcgttagatgctcttgagccacatatctctaaagaaacattagaataccactacggcaaacaccaccaaacttacgtaaccaacttaaataacttggttaaaggtactgatttagaaaataaatctttagaagagctcatcaaaactactgaaggtggtattttcaataatgctgctcaagtttggaaccatacattctactggaattgcttagcaccaaacgcaggcggtgcaccaacaggtaaaattgcagaagcaatcaataaagcgtttggctcttttgaagagttcaaaaaacaatttaatgatgcagctgcaaaaaactttggttcaggttggacttggttagtgaaaaaagcagatggctcattagccattgttaatacatctaacgctgcaacacctgtttctggcgaagataaaccactgttaactgttgacgtctgggagcacgcttactacatcgactatcgtaatgcacgtgtgaaatacttagaagagttctgggcactggttaactggtcatttgttgaagcaaatcttgcttaa

SEQ ID NO: 285 - DNA, 1266 bp, Proteus mirabilis
gatatgacgttattagcattaggtattaatcacaaaacagcccccgtagcgttacgtgagaaagtctctttttctcctgataccatgggtgacgccttaaataacttgttacagcaacctgctgtaagaggtggtgtagtgctgtctacttgtaaccgtactgagctttatctgagtctagaagataaagaaaatagccatgaacaactgatcagttggttatgtcagtatcaccaaattgagcctcatgagcttaaaaatagtgtttattggcatcaagataatcaagcagtgagccacctgatgcgcgttgctagtggtttagattctttggtattaggtgaaccgcaaattttagggcaagtcaaaaaagcgtttgccgattctcaaaattatcactcgctctcttcagagctggaacgtctgtttcagaaatccttttcagttgcgaaaagagtgagaacagagacccaaattggtgctaatgctgtttctgtcgcttttgctgcctgtactttagcgcgccaaatctttgagtcattatcatcattgactatcttattggtcggtgcgggtgaaacgattgaattagtggcgcgtcacttacgtgaacatcaagtcaaaaaaatcattattgctaatcgcaccaaagagcgagcgcaacgtttagcgaatgaagttgacgctgaggttatcactttatctgatattgatgagtcactttctcaagcggatattgtgatcagttcaacagcaagtccgttgcctattattggcaaaggcatggtagaaagggcgttaaagaaacgtcgtaatcaaccaatgctactcgttgatattgctgtgcctcgtgatattgaacaagatattgaaaaactgagtaacgtttatctttatagtgttgatgatttagaagctatcattcagcataaccgtgaacagcgccaagccgcagccattgaagctgaacatatcgtgcaacaagagagtggccaatttatggattggttacgtgctcaaggtgctgtcggggcgattagagaatatcgcgatagtgcagaaatgttacgtgcagaaatggcagaaaaagcgattgcattgatacaaaatggcgctgatgcagaaaaagtgatccaacagctttctcatcagttgatgaatcgccttattcatacaccaaccaaatctcttcaacaggctgccagtgatggtgatattgaacgcctgaatctcttacgtgaaagtttgggtattacccataattaa

SEQ ID NO: 286 - DNA, 1428 bp, Proteus mirabilis
catgtgacgttctttcctcccttccgtcttattataatgaataaaggtgtatgcgtgcagaagtatataaaagaagcgcgtagcttacttgctcttggtatccctgttatcatcgctcaattctcccaaactgctatgggagtagttgataccgtgatggcaggtgctgtcaatgccacagaaatgtctgcggttgctgtaggtacgtcgatttggttgccaacgattttattaggtcaaggtatattaatggcattgacccccatcgttgcacaattaaatggttcaggacaacgaaagcatattgctaatcgtacacagcaaggtttttggcttgccacttttttatccatcatggtcattgccattctttataacagccgttttattattgaagcgcaacatgatatcgagcctgagcttgcagaaaaagccattggatttattcatgccattatgtggggggctcctggttgtctctattatcaagtgctaagaagccaatgtgagggattatcaaaaacaaaaccaggcatgatcatcggctttattggattattaattaacattcctgttaactacgcctttatttacggtaaatttggtgccccacaattaggtgggattggttgtggtgtggcaaccgcctctgttttttgggcgatgttcttaatgatgcgctactatgtgcgtcgagcaccaacacaacgggatgttatgcccaaaaaacgcctagtgttacctgaattccacacaataaaacgtattacattgttagggttacctgtagggctagcactattttttgaagtaacactgtttgctgttgtggcattattagtttcaccattaggtgtaacggctgttgcaagtcaccagatagcccttaattttagctcattaatgtttatgttccctctttccttgggaatagctgcaacaattcgtgtgggttataaccttgggcaacgttctacagagcaagctcgtacttcagccattacagcccttgctgtcggattaatgctggcaagttgtaccgctattttctctattatttttagagaaaaaattgctttaatgtataacgataatattgaagtggtgacattagcctctcatcttatgttattcgccgcactttatcagttgtcagattccgtacaggttattggttcaggggtattacggggttataaagatactcgctctatcttttttattacctttatcgcttattgggtaattggtttgccttccggatatctcttgggacgaacggattatattgttgaagcaatggggccggcggggttctggattggttttattttaggtttaaccgcttctgcaattatgatgggaacacgtatttggtggatccagcgtcaatctgatgaggttgtcttattacgctcggagcgttaa

SEQ ID NO: 287 - DNA, 273 bp, Proteus mirabilis
aagatggctttattagatttttttctgtcgcgtaaaaagtcgacagcaaatattgccaaggagcgcctacaaattatcgtagcagagcgtcgacgtggcgatactgagccagcttatttacctgatatgaaaagagatttattaggtgttatctgtaagtatgtgcagatagatcccgatatgctatctgttcagtttgagcagaaaggcgatgatatctccgtactagaattaaatgtgacattacctgaaaatgaagaatcacctaagtga

SEQ ID NO: 288 - DNA, 846 bp, Proteus mirabilis
tccgaggttacgctaatgtcactctcctttttaacaaaaatagcgcgttcaccttcagcgtttatcggtctgtcattgttgcttcttctgctactaattgccatttttgccccttggctagcgccttatgatccaaattggcaacacgctgcacaacgcttattagcccccaatgccgcacactggttaggtactgatagttatggtcgcgatattctttcacgcttaatttatggtacacgcccaatgttaggtttggtgggccttgttgccttgataacactaccattagggctatttattggcattttatccggttattacggcggttggacagagcggattttaatgcgttttaccgacatcattatgtctatgccctccttaattttagcttttgcctttgtcgccatgttagggccgggattacttaacggtgcattagcccttgcacttacagcatggccggcttatgcccgccaagcccgtagtgaaattcaacacttacgtaatagtgattaccttgcagccgctgaaatgatgggaattaacggtattagattattatgggggcatattcttcctttatgtttaccttctgccattgtacgtttagcccttaatttagcggtgatcattcttgctgcagcaggtttaggtttccttgggctaggtgctcgccctcccatggcggaatggggagcaatgattgccgaagggatgcccgttatttttgatcagtggtgggtggccgctattccgggtacggcaattttaatcagtagccttgcttttaacttattgggtgatggattacgcgatgtattaggagaaagccatgaataa

SEQ ID NO: 289 - DNA, 1170 bp, Proteus mirabilis
atgcttgagttgctgtttctgttattaccggtcgctgcggcttatggctggtatatggggcgtcgtggtgcgcaacaggataaacagcaaaatgccgatcgcctgtcacgtgaatatgtggcaggggttaactttttactttctgatcaacaagacaaagcggttgatctgttccttgaaatgcttaaagaggatagctcagcctttgaagcacatcttactttaggtaatctatttcgctctcgtggtgaagttgaacgtgcgattcgtattcaccaatcgttaatggagagcgcggcactctcttttgaacaacgtcttctcgctattcagcaacttggccgtgattatgtcgcagcaggggtttatgatcgcgctgaacatatgtttttacagctgattgatgagcaggattttcgtcaaagtgcattacaatccctcctagccatttatcaacttaccagtgactggggtaaggcgatagaaaccgcagagaaattggtaaaactgggtcaacatgaacttaaagagcaaattgcccatttctattgtgaactcgcattgcaagaaatgagcagtgataatcttgataatgcgctaagttttctacaaaaagccgggcaaatggatccactttgtgcccgtgtttccattatgtatggtcgtatctatatcgcgcgcgatgaaaaaaataaagccattgatgtattaatgaaagtaattgagcaagataaagagatggtcagtgaaaccttgccaatgctttttgaatgcttccaatctcaaggtgatcccgcacgttgggaatcctatctacgtcaatgtgtcgagagtaattgtggtgccattgcagagctttatcttgccgatattattgaagaaaaagagggcattgaagctgcacagttatatattaatcgccaactagaacgtcatcccaccatgcgacttttctatcgtttaatgcgctatcatttagctgaagcagaagaaggacgcgcaaaagagagtctgatcttattacgttatatggtcggtgagcagatccgcacaaaacctgattaccgttgccataaatgtggttttacctcccatgcattatattggcattgtccatcctgtcgctcttgggataccgttaagccgatacgtggcttagatggtcagtga

SEQ ID NO: 290 - DNA, 1656 bp, Proteus mirabilis
aacccgcctaccgcgggtttttttatatgccaattttgtgcttatcagcaccagaaaaaagaaaatagagcgataataatgaacacttcacttgcattcccattaacaactaaggtaacggcattgccttatcacagcgagccggcgttacttttcaatacgttgtgtgaacatcgtcatcacaccttattgttagaatccgcacaaattgataccaaagccaatttaaaaagtttgttaatcgttgatagtgcattacgtattagtgcaaacaaaaatcaagtgactgtcgatgcgttaagtctcaacggccaacatatcttagcgttattaaaaaacgcactaaaagaaaaaagcacactctccgtagagcgagcggaacaatgtgtatttacttttgcatcatcatctttccctcaagatgaagagagcaagttaaaagcggctagcgtatttgatgttttacgttttttcctagcaaatagcgctgcaaaagaagccaatgctatttttgtgggagggttatttgcctatgatttagtgaacggatttgaatccttacctgatttagaagcggttttttcttgccctgactactgtttttatttagctgaacagttaattgtgatcgaccatcaacatcatcatagccaattaatttccgttgcctttacggataatccacaagagtgtcagcgtcttgataaccgtcaggcacaattagttgcactcgcacagcaacctttaaaacaaccacaacgtcaaccattaacacctcagcaagcggttgtaagtagcaatatgaatgacgaagagtatggtgctattgttgaagcgatgaaaacctatattcgtcgtggcgatattttccaagttgttccatcacgtcgttttcaaattaactgcccttcaccactggctgcctatcaagttttgaaacaaaaaaaccccagtccctatttgttttatatgcaagatgcgttatttaccgtttttggtgcgtcacctgaaagtgcgttgaaatatcaagcaagtgatcgccaaattgaaatttatcctatcgcaggtacacgcccaagaggtcgcaatgccgacggctcaatcaatgctgatttagatagccgcattgagcttgaaatgcgcacagataccaaagagttatcagaacaccttatgttggttgatttagcacgcaacgatttagcgcgtatctgccaagctggaagccgttatgtcgctgaattaaccaaagtagatcgctacgcttttgttatgcacttagtatcaagagtggtaggaacattacgtcatgacttagatatttttcatgcctatcaagcctgtatgaatatggggacactctcaggagcaccgaaggtcagtgctatgcaactgattgcacaatatgaaaaaaccaaacgaggcagttatggcggtgcaattggctactttactggtaacggtgattttgatacttgcatagttattcgttctgcttatgtagaaaaagatattgcaactattcaagtgggcgctggtattgtgctcgattctgatcccaaaatggaggcagaagaaactcgcaataaatcacaagcggttatcaatgccattttacaggcgcatgctgaaactcacatgcaggaggcttgctaa

SEQ ID NO: 291 - DNA, 348 bp, Proteus mirabilis
aataaggctactaatatgaaaaagtttctcaccattcctttatttttacttttagcaggatgcaatacagcgacaggaaccaacacccaagttatgaacgattcgacaaaaacactacttattgactctcagctttatgattgtgttggtgttgcgccaatgaaatgcatgaaagtaaaagaattacctgctggtgaatggtctctcttctatcaaaatatcgaaggatttgattaccaagcgggaacgcagtacaaagtaaaagtcaaagttacagatattcctaatcctcctgcggatgcaccaagcatcaaatatacactggttgagatcttagataaaaagtaa

SEQ ID NO: 292 - DNA, 891 bp, Proteus mirabilis
ctgggatatacagcaatgacactaagttggccctctcctgccaaattaaatctttttctctacattaccgggaaacgccccgatggttaccataatctacaaaccttatttcaatttttagattatggcgatacgctaacttttacgccccgtaatgatacgcagttaaccatcttaacccccgttgaaggggttgcagatgaagataatctgattattaaagcagccaaattattacgtcaatactgccatcagcaccatattcccctacgctatcaaggggcagatattagtattgataaaaaactgcccatgggaggaggtttagggggaggctcttccaatgctgcgacaacactgatagcccttaattaccattggcaagcaggcctaagcgatgaaacattagccacactcggcgtgacgttaggcgcagatgtgccggtatttgttaaagggcatgccgcttttgctgaaggtgttggtgaaatattaaccccagcatcacccaaagagtgttggtatttagttgctcaccccggaatttctatcccaaccccgacaatcttcacagatccagaattaaaacgtaattcgcctattcgctctctgggcgcattattacaggctccgtttgcaaatgactgtgaaatgatcgcaagaaaacgttttcgtgaggttgaatatctgctttcgtggctgttagaatatgcaccgtcacgcttaactgggacaggtgcttgtgtattcggtgagtttgaatcgcaagaggccgctagtgaagtgttaattaacgcccctgagtgggtgcacggatttgtggcgcaaggcgttaacatttcccctgtgcatttattccgctcaaggatacctgtgttattgcacccgtaa

SEQ ID NO: 293 - DNA, 1128 bp, Proteus mirabilis
atgtggcataccgtacaaaatatttttaatttaggaataaaagagttacgaagtttatcccgtgataaggcgatgctggcattaattgtgtttgcctttaccgtatcaatatactcatcggctactgtaacaccaggctcattacaccatgcgccgatagcggtggctgatcaggataaatctcaactttcggctcgtattgtcaatagcttttatatgccttactttttaccacctgcagatattacacccgagcagattgatggtttattagatagaggaacttatacttttgcgttagatattccgcctaattttcaacgcgatctactcgcaggacgtaagccagaaattcaagtcaatattgatgcaacacggatgagtcaagctttcttaggaaatagctatattcaaaatatcgttatgggagaagcgaaaacttttcttgctaaagagcgcactaacgatccactgcctgtggatttagaagttagaatgagctttaacccaaacttaacacaatcttggtttggctctgttatggcgataatcaataacattaccatgctatctattgtattaaccggggcggcactaatacgagagcgagagcatggcactattgagcatttattagttatgcctgtcacaccatttgagatcatgctttctaaaatatggtcaatgggattggttgtattgttagcgtcggccatgtctttagtactagtggttaaatcactgctacatgtgccgatcgaaggctctgttttgttatttatgtgtggggtggcgttaagtttatttgcaacgacatccattggtattttcttaggcacaatggcgcgctcaatgccacaatttggtttattgatgattatggtattgttgccattaaatatgttgtctggagggatgacctcaagagagagtatgcctcagtttgtacaagatgtgatgcaaactatgccaaccacacattttgtcagccttgcacaagcgatattatatagaggcgcagatttctcgattgtttggcctcaatttatcgttttaattattattggctcagtcttttttgcattggcactgttacgttttagaaaaacgatatctgcaatggcttag

SEQ ID NO: 294 - DNA, 537 bp, Proteus mirabilis
gaggaagatactatgaaactgatacctttgttactctctggactactctttacatcggttgccagtgcggcgagcttagatgttacgttaaaagaagccttacctacaggggcgggtgatgatattggtgttgtcactattaccgaaaccgattatgggctgttatttacgccaaaacttactgggttaacaccgggtgttcatggttttcatatccatgctaatggctcttgtgagccagatatgaaagatggaaaacctgttccagcattaaaagcgggtggtcatcttgatcctgaaaataaaggtgttcacttagggccttataacaaagaagggcatttaggtgatctacctggtttggttgccaatagtaaaggtgacgctgattatgccgttcttgctcctagactgactaagcttgatcaaattaaagataaagccttaatggttcacgttgggggagataactactcagataacccagaagcgcttggcggtggtggtgctagaatggcatgtggtgtgattaaataa

SEQ ID NO: 295 - DNA, 516 bp, Proteus mirabilis
aacacctgtacaaatagaggaccaatggaatatttaaatacaaaaattattatcggtagttcaatcatcgctttagcaacactgtattttgctatttatttaatactatatcttattaaatgcgttaggactcaaacgccttttactttaagaaaaatatggaaacaatggttattgagtagtgttattggtctaattggtgcttatattgtacaacttggtgataatcaaagaagaagcgaatttaccaaagaagaggttagctttatgaatgaaaataaagcatatagccaatttacctcagcagacaaagatctcgcgtcaaaaataacccataaatgtacttacaattcagatgctgtatttgaacaatgtttaccaaaaatactgacttgggaagcaaaaatttatcaatcatataatgcacatcgtaaaatttctgatagtgaagcgataaaatatacagaagaagaattacgcgataagcataattactggatcaacaaaaaacgctaa

SEQ ID NO: 296 - DNA, 216 bp, Proteus mirabilis
caaaactgtaccatcgccggcgatacacctcaaagggcagtggttcaggatacaaggtttgatacggatttcacttttacggtgaatattttaaatgagtgtttggtattgataccggacagcgaagacacccgagcgattaagcagcaaaaccaacagcagcaagcgcagttgagtgagataaagttacgcttgcaggcgttggttatcgaataa

SEQ ID NO: 297 - DNA, 402 bp, Proteus mirabilis
tgcattatcactgattattggccctatccttggtggtgcattagttcatgccagtggttgggcatggcgtctgcaaccatgaatgcattaagacaaaccggtatgacaatgggaattgcgttattaggtacattaatgatacagcaagcaattaattatatgatgatacaaagtcaagcattaggaatagtggcagaaccgattaatattattacgttagtaacagaaaataaaaccgcttccctagataatcagttggttgccctattacctgaagcatttaattcaggatttgcctatgccatgctaaccgcaggactttcctgttttattactctgtttattatgctttttccttgcaaagagaaacaaggtgcactttctcagcagatagcggattaa

SEQ ID NO: 298 - DNA, 738 bp, Proteus mirabilis
aataaatacactgccaactcaacactaaatcacgttagcagtgacataaaacacagcgatttacctaataaggaaaatattatgtatcaacatagagattgggaaggttcgttgcttgattttcctgttaataaagtgatttgtgtgggcagtaattatgcaaaccacataaaagagatgggctcggtgcgctctgaagagccggttatctttattaaaccagaaacggcgatgtgtgatattcgccaacctattgcgatccccaaagagatgggggcagtgcatcatgaaatagagttagcggtattaattggtcagccactgaaacaagccaatgaagatagggttgatcgtgctattgctggttttggtgttggtttagatctcactttacgtgatttacaaagtcaattaaaaaaagcgggacaaccttgggagaaaagtaaagcgtttgatggttcagcgcctttgtcgggatttattccggtgaactcttttggtgatccccaaaatgttgacttaatgttgaaagttaatggtgaaattcgtcagcaaggcaacagtcgtgatatgctaacgcctgttttaccccttatcagttatatgtcgcgcttttttacccttcgcccaggtgatgtcattttaacgggaacacctgaaggtgtcggtcccttagcatcgggtgatatgttggtattaagtgtcaatgaacatcagctgaccacacgggttatttaa

SEQ ID NO: 299 - DNA, 702 bp, Proteus mirabilis
atgtcaaacacgcccattgagttaaaaggcagtaattttaccctctcggtacttcatttaaatgatggatcaccgaaggttattcgtcaggctatttcagataaaattgcccaagcgcctcaatttctgaaaaatgcgcctgttgttatcaatgtctctgctatcgcagatcaaacgattgattttaaaaaactgaggcgaatagtagaagatgctggcttacgtgttgtgggaattagtggtagtcatgacgctcaacaaaaagaagcgataattgccgcacagttacctattctaaatgaaggtaaaataactaagccagcagctcaggcaaataacgataaaacgaatgaagtaccgataaatgtacgacaaaaaaccaaaatcattcatacaccagtgcgttcagggcaacgtatttacgcaccaaatagcgatttagtcgtgttaagcaatgtcagtgctggcgctgaattaatcgcagacggtaatgtgcatatttatggtgtattgcgtggacgggttcttgccggtgcatcaggcgaccaagagagccatattttttgtacacatttatctgcagaactagtttccattgctggtcaatattggctaagcgaccaaattcctacagattttgttggcaaatcagtccaacttagtttgcaagagaatgaattaacaatcgagaacttaatttag

SEQ ID NO: 300 - DNA, 1746 bp, Proteus mirabilis
gctatgagcacattattatctacacaaaacctctcttttcataataatcacggtatattgctgagtaatatttctttggccctcactaaaggtgagaaaattggtttaattggctacaacggttgtggaaaaagtacactattaaaacttttatcacaccaattaataccaacagatggctctattactatcgccaatcaagtcattatggcttatgtcgaacaacagttaccaagtgagctacagtcaatgcgtctcattgatgcggttcttcataaattacctgaagagctacgcatatctgaaagttggcgtagtgaattgttattaagtgaaatgggatttaaaaccaatgaaatcaatctattagtctcacaattaagtggtggtcaacatactcgtttattacttgcgagagcattgattttgcaaccagacttactgctattagatgagccaagtaaccacttagatctaccgactatcttgtggttagaaacatttttaacacagtggcgaggaagttttattcttgtttcacatgacaataggttgttagataaagtgaccaattgtacgtggatcattcgtgataaaaccctatctgtttttcgcttgccctgctctcaggcaagacaagagcaagaagcacaagatatcagtgcgcaacatcgttgtgatgcacaacaaaaagagatagatcgtattgcacaaagtgcgaagcaattggccatctggggaaaagtgtatgataacgaaagtttgtcacgtaaagccaaacaaatggaaaaacaaattgttcgtttaaaagacgaacaagtcgatgtaacagaaggcaatcaatggacgttacagttatcaggaacaatattacgggcagatagattgcttgagctgcatcagctttcagtgatccctgcgccagatgcaccgattttatataccatcgataatcaacggatcaaaagtggtgatcgagtcgctattgttggtgctaatgggacaggtaagtcatcattattaaaaatgatttggtcatcatttcatggttcaaccacatcaacagaaaatgtgatcaggctgcatcccagagttgagttaggttattacgatcaaagtctcgcacaacttaatgataatgatacccttgccgatgcactaaagccctttgcaccgctattagatgagcaaaggaaaatggcattaataaatgcaggttttgtttattctcgccataatcagcaagtaaagtcattaagtggtggtgaacgagctcgtttactttttattggtctcagtttggcaaaatattcattattaatgctagatgaaccaacaaaccatcttgatatggaaggtaaacaggcattagctgagcaaattcaacaattttcagggggaattttactcgtcagccatgatagagaattgatagagaaaagctgtaatcgtttttggtatattcacaatggtattcttagcgaacatcatgatattgaaacaatttatcagcttatttctcaacaagatatgtcatcggtctctaatgagcaaaatggccatcatgctccatctgttgaaatagtaaaacatcataatgaagatgaattgctaatgaaattgatagcacttgaagataaattgaatgctgatttagcaagaaaatctgctcatcaaaagcctatattacaggctcaatggcaagcagaaatagagatcttaaagcagcaacttgatttagcttaa

SEQ ID NO: 301 - DNA, 762 bp, Proteus mirabilis
atgggattaactatgttaatgacaatgattaaatcacttatttttatcccttatctattattaagtggatgtggcgagtatatcaatatatatcttaataataaattccccgtcaatatgaataatgatggcaaaaaaatcacggtttattcaactatttcccctgaaacagcagtggaagttattggtacttatacatctaataagtgtgaacgttctcattttaatgcttcttatactaaagtcacttattcctctttaacaaaaaaagtggagatagagcgtaaaataactgaggataataaaactgcgacctacactgtgcctattgatggagggggatggtgtaattggaagctagtagaaataaaactagcgccagtctctaatattcataagatatatacgcgaattagtgaaattattccaattaccgatgataagcattcaaaaatagagctgtttatcactttagctcctgtcatagtggaaaaatataatggtaaatcaatctattactcatcatcaataatggagggtgaacaaaatctatccaataaatcaaatggggaaatctattttaattataaagttgaacctaaactaaccacgattatttcaaaggataataaagctattttccctaacggcaatattaaaacactgagtggatcgacttatagtaaaatgattggttttaatgaaataatcgagaatagtgatgaaaaagcgtttacttcttttgttcgatatattgattaa

SEQ ID NO: 302 - DNA, 801 bp, Proteus mirabilis
cgttggttaaccattaaccaaattctgggtataaaaataccgaaggcatatattatgttagatattaaaaatttacatgtcagtgttgaaggcaatgaaattcttaaaggattagatttgcaagtacgtgccggcgaagtgcacgctatcatggggccaaacggttcaggtaaaagtacattatccgcaaccttagcaggtcgcgaagagtatgaagttgatgaaggtagtgtgacttttaaaaacaaagatctactggaattagagcctgaagagcgagcgggtgaaggtatctttatggcatttcaatacccagtagagatccccggtgtcagtaaccagtttttcttacaatcctcagtcaatgcggtaagagaatatcgaggccaagagccgttagatcgctttgattttgaagattttattgaagataaaatcaaactattggatatgcctcaagatttgttaactcgttctgttaacgtaggtttttctggtggtgagaaaaaacgtaacgatattttgcaaatggctgcccttgaacctgaactgtgtatcttagatgaaaccgactcaggacttgatatcgatgcgttaaaaattgtcgctaatggtgtcaatagcttacgtgatggtaaacgcgcctttatcgtggtgactcactatcaacgtatccttgattatattaaacctgattatgtgcatgtgctttaccaaggaaaaatcattaaatcaggtgatttttcattagcacaaaaattggaggaacaaggttatggctggcttattgaccctcaatga

SEQ ID NO: 303 - DNA, 228 bp, Proteus mirabilis
tatgagctaaccttcgatggtgatcatcttctatgtatgtacattacgttaaatatgattctgttgctcctgaccgtttactgtactttccaacgcttactaggtaatagtacagtggttttaacagcaaatcgaatcagtaaattgttattatcacaatacaatcaagaccatccagagacagcaagatttctaccgatttttatagcttataactattcgatataa

SEQ ID NO: 304 - DNA, 4998 bp, Proteus mirabilis
gcgtttgggttccagcagaaacaaaaggagcttgttgtaatggctgataaacatgttggtgacggtgaaaaccaattcaaagttgttgcaaccacccctgatgtttgtcaggtagggtgttctgctattccttttgatagttttcaaagcttagatgcacaaaagcaatatgccttgagtgttaaagcacgtggatattgtaccctgaatgttgggtcaataatcaaaggaacgcaaagtaacacgggggccggtgtattatctggaacctcattaggcggtggagattgccaaattattacaggaagcccttcggtccgtattgaaggtcaaccagctgcacaagatggttcattagtcgcaatgaacaataacaatacattagggactttaatcactaatgttgcaccccctgcggagccgattgaaagcaataaaatcccctgtaataacccgcccgtgacatcagaattgttagaatcgctgcaagagatgcaacgaaaagagcaagaaagttttattgggcgactccgtcaacaaaaacaacaagcggataaaaaaagagatgattctctaaatgatattgacaaagaattaactggatatattgataatattcgagttgatcacattaatacagattattcatggtggaacagtttatataatacttcaatggatggaataactggcctgactcgtggtggtcttggttttgttgaaagtataacaaagtcagctgtggaagcttatcattacataaatccaactgttctagttcaaaacgtggctctaaatgcgagcaaaaaaaccatcgagggacttattgaagcagaaaactggaggttggggaataactgtattgaaggtgttaaggaagacgttaaagccaaatatcgtgcattaggtaaacttattgatgaagaaaaagaaaaattagagaataaatggaaaaaaagtgatagcgataaagtcgaaatagtaacaagaggtgggcttgaaatagcgactattgccgctgcttttttaaaagtggggaaagtcgctgaaggtgctaatgctattaataaagtagcagaaggaactaaaataactgaaatatctgaaggcacttctgcggtaaataaagctactgacgtaataaaagcgacagagaccagtaatatatccaaaggaagtgaggcaatcaaaggggcagaaatctccgccacagagaaaggaagtaatgccgctaaaggtactgaggtgatccaaagtccagaaacaccgaaaataacctcatcagataatggcattaaaattgaaggaaaaacggaaagcgtatctacagaaacgccacctaataaagtcaataatagccaaacggagaacaagtcgacatccagcagcaaagagtccgatggaaacagtacttctagtgcaacctgtaaaggtgaacctgttaatgtggctactggtgattttatccaacagtggccaattattcagataccgggcttgttgccgttatctctacatcgtacatataaatccacatcaaatgcaaagggactttttggaccgaagtgggcagacgaatggtcacgctgtttacatatacttgatggaaacatcatctatcaagacagtgatggtgctaattttacatttataactcccacagaggagatccgtgcaagaaatgcccatgctccccattttttactcaccggacaacgtgatggcgatttaaccctttttgatagtacgcaacaacagtttctacattttaatcacagacaaggaaaatatcgtcgattaagtgcaatcactgatttaaatcagcatcgtattgattttatatataacgagcaaagtcagcttgtcagtgtgaagcgtcatgatggcatagcgttaatactcgaatatcaacaggataaattagttcgcatttgctctgaaagcacaacctcatctcctcgagattttgtacgttgcgaatacgatactcacggttatcttagtcaatgtcatgcctatcaacaaaaccacttatggcatcgttattctcctgagggactcatggtcgcttggggggatactgacagcacagaactgacgattgattatgatgaacaagggcgtgttgttgctacacattcaccgtctggtttttggaatgatcgctttatctatgatgattatcagcgcatgacaacctacattgacgctgagggtggattttcacgttattattataatgatgataatctggtgactcgcactatcgatccattatggcgtgaaacgtatacggaatgggaacagcggaaaaagatagcagaaatcaatgagattggtgagcgcacagagtatggttatcactataatggactgcttgcctatatctatttacctgatggtaaagccatttactatgattataatgactatggtcaacttacccatttcacatcggcctttggcgacgaatggcagctaagctatgatgaaaatggcaatttaaccatagtgacagatccgcaagggcgtcagcaggtctatgaatatagccaacatggtgaattgctcaaagccattacgcccaatggtgcgcaatggcaataccactataaccctgcacatcaactgattaaaaccaccaatccttatcaacacagcacagaatatcatagtgatgaattggggcgtttactgcactacactgatgcgttaaatcacaccacacgctatcaatacagcactgagcatgccagtaccaacggcagtctcagcaagattttattacccgatggggtcgagcaacagatagactatgacagtgagcgccgagttatcgcggtgacggatggtgaaggaaaaaccacccgttatcgttatgggccttttgatgtcttactggcaatgatacgccctgacggcagtgaaattcgctttgaatatgattcactgacacgacttaaaaaagtagtgaatgcgaacggggaggtttatctttacgaacgggataaagcgggacaaatcattcgtgaagttgattttacggggcgtgagatttgttatcgctatgaccgactaggacgtcgcattgccactcgctatccggataaccatgaactgcgttggcgctataatgaaagtggcttagtggttgaacaaagcgaatggtttgaagatgagcaagaaagccgctgtttatcgacggctcaatatagctataacgcacgtcaacaattgataaaagcgactaatcctgactcggtggttgaatttgagtatgacgaccaaggccgtttatgcagtgaacgtattaatgaacaagagattgttcatcaatggaatgaagctgataatacgctggcattgactcgttttggtgagcgggagttgcattatgcttttggggcactgggggagttaacttcactgcaagtcaatcagcatgcaccacttcaattcagctacaacgcggtaggacaagagtatttacgccgtagtcgcgccggatttgtcaattccagtcactatacggctaccggtttactggctcatcaacgagcagggcgaggcaccgaacagtttttacaatcgatacaagcccatccccaacaaccgccattttgtacggatgtgcaccgcagttatcaatatgatcgcgcttataatgtggtgggtattgaagatgatcgctggcgacagacacgttatcactataatgccaatgaccaaatcactgagacacaatacagtccacaatggggtaatcaggacgaaaagttccagtatgataacaacctcaatatcacggagcacttaacaacgccgtcctcgtcgatggtgccttcagatgcacaaggggcgatgctacagctatttcagcaacagcaagcaggacgggtgactcgccgttacacagcgaagggatatcaagattaccattatgatgttaatgggcgattagctaaaaaaattgtccatacacgcggttttcgtcccagagaatggcgctatttatggaacacacaaaatcagctgaccgcatgctttacgcctaaaggggattgttggcactatacttatgatgcttttggtcgacgtctgagtaaaaccaaaactgtcgacagtgacttagcccatattgacccattatttccgcagattaagcctaaaatcaccacgtggcgctatttatggtcgggagaccaactgatagaagaaacgccgatatatgccgatggcactcttgctaatgcgcaacaagttcaatggctgtatcaacccggagaaataacgcccaccgcgcgttatcaacagggcaaactgcactatgtggtcaccgaccaccaaggcaccccgcgagagatattcagtgaaggcgggcaagccagttgggcaggacgattgaatacgtggggccaaatgcagttttggcgttaccgcgacggtaaagctgagaatgatcctaattataccgaatgtccttttcgctttgcggggcaatatgaagatgaagaaagtggcttgtattataatcgctttcgctattatgatagggaaacagggcagtatctttccccagatccgatagggttattgggtgggctgaatccctatggatatgtgcattgtccgacggggtgggttgatccgtttgggttggcgggtgattgttgtgatgagttactagttcttgctactaaccctagaagtaaaacagttcaagagatggctgaagatttagctaatcgaattaatagaaatacagtgacattttccacaccaacaagcatgggacatattgatttaagaggaagatctcactttgataaagtgacacaagctgatattccaacaccacatgttcaagtttcaccaattaacgttgctcctaatggaaatcgcttccctcttaaaaaactagaagcggcaaggccagccacaaaacaagatattagaacagcggaaaaactagcagaaagacaagggcttttaaaatga

SEQ ID NO: 305 - DNA, 558 bp, Proteus mirabilis
tttagttcaacattgacgtttattattcctaatcgctatttttctgatggggatcgttgtataaaaatggatcaggacattaccttgtcaaatttatgcccctgcaatagccaattgccttatagtgagtgctgtgagccttacttattagggacaaaaaatgcccctacagctcaagcgttaatgcgctctcgctatagtgcttttgtgactcataatgcagatcacctaatcaaaacatggcacccttcgtgtcgtacaccttctttacgggatgagttaatcgccacgtttcccaatacacaatggctagggttacatattatatcggcacaagaaaaccctcgtgataacgaagcctttgttgaattctcagcttgctttattgaaataaatgctgatgataagcagtatctacatgaacgctctcgttttctaaaaatagacgactgctggttttatattgatggtgtacagcctaaagtaggacgaaacgatccctgtccttgtggctcaggccgtaaatacaaaaaatgttgtgaacacaatagaaaataa

SEQ ID NO: 306 - DNA, 429 bp, Proteus mirabilis
gtggaatcaacattaggagctgatttagcgcgtttagttcgattatggcgtgccttaattgatcaccgactcaagccattaaaattgacccaaactcattgggtaacgttgtataatattagtcaattgcctccagaacaatctcaaatccagttggctaaagcaattggtattgaacaaccatcattagtgagaactctcgatcagttagaagaaaaaaaactgatttgtagacatacttgttcaagtgatcgcagagcaaagcgtataacgttaacaaaagaatcagaaccttttatttcagaagtttatgcagttattgagaagacacgtcaagaaatattaagtggtataaagaaggaagaaatagacaacttgatttatcttattaaaaagctagagaaaaatataattagattacatgactaa

SEQ ID NO: 307 - DNA, 582 bp, Proteus mirabilis
cataatgaaacatacgttataacagagctaaattgtatgaaaaaattacaaacagaacgattattattacgtccatggcgaatatcagatgcagagagcctctattattatgcgagggataagcgagtaggccctatcgctggctggccagcacataaaagtgttgctgaaagtaccgaaattatccagactatatttatgcgtgatgaagtttatgctgtcacattgctcgatgatgataaagcgattggtttaattggcttatctttttgccatgagagcaatttccctataggggataatgatgccgaaatttcttattggattggtactcctttttgggggaaaggacttattcctgaagcagtgaaagcgcttatttgtcatagctttgagactctacaattagataatctatggtgtggttattttgcagacaatgtaaactcgaagcgagtacaagaaaagtgtggatttaaatatcatcacataattaaagatcagtatgtggagtatttagacgaaataagaacagaagttatttgtcgtttaaccaaaagtgaatggcaaaaacaacaataa

SEQ ID NO: 308 - DNA, 1422 bp, Proteus mirabilis
gtaaatatgactcgatatgaacagcttgcggcacagatacgccaacaaattgaagataatatttggcaatcaggcgatcgtttaccctcattacgggatacggttaaacaatcaggtttaagtttaatgaccgttttacaatcttatcaactgttagaaagtcaagggtggatcaccgctcgtccgcaatcaggttattatgttgcacatcgcaatacaggttttgctcaagtaactgccagcaaagggctacatatgagtgaaaatgttgagataagcgcctctatattcaatgttcttcaagcctgtaaagatcccaatatcattccgttcggttccgcctttccagatcccagtttattcattcaacctaaattaagccgagcattagcctctgccgctagacatttagcccctcaaagttcagtgattaatttacctcctggtaatgaaaaactacgtcgtaatatagcccaacgctatgcactgcaaggtattcatgtatcgcctgacgatattgtgatcaccgcaggtgcgatggaatcattaagttttagtttacaagctgttactgagccaggagattgggttgtcatagaatctcctgctttttatggcgcattacaggcgatagagcgtttacgattaaaagcgattgccatcaaaaccgatccggtgacaggcatttgtttagatgagttagagaaggtggtagaacaatacgacattaaagcgtgttggttgatgagtcattgccaaaatccattaggtggcactatgcctgatgaaaataaaatcagactagtagaaattttagcggcaaaacagataaccttaattgaagatgatgtctatggtgaactgtataatagtccaaaagcgccaatgcctgtgaaaggctttgataaatccaatagcgtattgcactgcgcttctttttctaaatgtttagcgccaggatttcgagtcgggtgggtcgcagccggaaaacatgcgactaaaatacagcagttacaaatgatgagtactgtatcagcgagtatgccaacacaacaagctatcgctgactatttatcacaaggggggtatgacgggcacctacgtcgcttaagattattattagagcagagacgttatcgtatgttacaggccatacaaacgcatttacctaaagatgttaaagtgaatattcctgtcggaggctatttcctatggttagaattcgagccaagctttgatgctaattcattgtaccattttgctctcgaaagaggggtgagtattgcaccaggtgctatgttttcgaccagttcacagtttaatcatgcttttcgtttaaactcttcttttcaatggaatggtcagactgaaaaaggaatgcaaattattggtgaagggtgtcgaaaattacgtcgtaaatag

SEQ ID NO: 309 - DNA, 618 bp, Proteus mirabilis
gaaaaaatgacatcaaccattctaaattataaaagcgtttttattttaatcggtagtttattacttacagcatgtgataacgaatcaactcacaataagagtgaagagataataaattatcctgtacgtactatgtcggggtttaatatcgcgtatccaacttcattctcattaaatagagatgatacagaacactattttcaattattacctgatcatgtccaagatgtcacatcacagatgttagtttatcaagccaaaccagtatgccaattatcagaagttcgtttagtttattttaaacttgacgatatgatgagctatgatattgattcaggagcacagggtatcgttgataatatttccactattgatggcatgaaagaaacttcaacaacaataaagcctttcacagtgtcagaaatgccagctcgacaaattttctttgaaggaaagttgtctaatcagaaagtgagctatgaaggggtattaattgcggatactaacacaaatcgtgtatggcaattacaatttattgctgaaaataaaagtaataataatcaagaagttattgattgcactaataggtatgtgaactcaattagtatcaatcaataa

SEQ ID NO: 310 - DNA, 2058 bp, Proteus mirabilis
cggagatcgacctgtatgtctcaatcatcgcgatgcataaaggtgagtgttttagttgttgcaacagcgattagcagtgcattcgctgaaaataaaaatcaaatctatggagaaaaaaatagcggggagagaaacacacaaataataacggtttatgcaacaggtaacgagcgagatagctttacattaccaatgatgtcgaccatcataaaaaataacagtgctttgacagaaacggctggaagtgccacggagttgttgcgtcatataccgggcatttcaatatcaggagctggccgcacaaacggtgaaactattagtatgcgtggctacagtagtaacggtgttttgacactagtagatggcatacgccaaggtactgatacaggtcatattgacagtatttttgtcgatcctctactcattaaacaagttgaagtggttcgtggcccttcagcacttttatatggaagcggcgccctcggtggggttgtggcatatgataccgttgatgccagcgacttgcttgcaaaaaatgaacatggtggtgtgcgtgttacagcccttggtaatacggcacaacagagtcaaggatttggcattaccgcttttggtcaacaagacaatttcgatggattactcgccctctccgctcgtgataaaggtacaactcgctatggaggcggttatcgtgcgcaaaacgatgaaacaatcattaacttattatctaaaggacgttggtttattgatgatagcaatacgttaagtggccaattacgctattatcataacaacgcacaacagcctaaggatccacaactcgccaataacccaacaccggctaatgtagcgacaaatcgtactacaacacaaaaagatgcacagttaacctatcaatatcatcctagtgatatgtcatggattaacctaaaaacacaagcctattacagcgaggtagatattaatgcgaaaacacaacaaaaaggatttgaaggtagagagcaaaaaacctatggcattaaaattgaaaatcgcactcaattagccacctacccctttgctgctcacgctttaacttatggcggtgagatctataagcaaaagcaatcacccagtgcaaatgccgaaagcttccctaaagcagatattcgttttatgtcaggctggttacaagatgaaatgactttacgtgatgtacccatttcattcatcgtcggtacaaggtttgataaatatagcagtcaaaatgatcgttatgatgacatcagcgctgataaatggtcatcaaaaggagccgttagtattacacccacagattggttaatgctttatacctcttatgctcaagcttttagagcaccaacaattggcgagatgtataacgatgctaaacattttgatgccccattccccggagcaccaaccaattactggcgccctaaccctaatttaaagcccgaaaccaattcaacaactgaatacgggttcggttttcaattcgacgacttattatctaataatgataatctgaaaattaaagctgcccatttcaatacgcgtgcaaaagattatattgatacagatgtcgctatttttcagggatatacacaatcgacgaatattccaagagcaactatttggggttgggatatcgagatgaattatcaatcgaagttctttagttgggatttggcttataaccatacaaaaggaaaagataatgccagtaatgcctctattacctctattgagccagatacattaaccagtcgcctcgatattcccgtacccaatagtgatttttccgtaggttgggtgggacaatttactaaaaaaacagattttacaaaacatgatcgctttaatcgcccgaccaatcgccaacaagcgggttatggtgtcaatgatttctacctccgttatgaaggtagtgcttcattaacagggctaacaacctcactggtactgggtaatgcatttgataaaaaatactactcttctgcgggtattcctcaagaggggcgcaatgcaaaagtactggtgagttatcaatggtaa

SEQ ID NO: 311 - DNA, 252 bp, Proteus mirabilis
atgatgtcgacacaaactacacctatttccgcagagatgctacttgaaaaagcgaataaaatcatacgtgaacatgaagactatttacaaggtatgtacgcagattctgttgaacaaaaaggcaatgtactggtatttaaaggcgaattttttttagatgagcagggtttacccacggctaaaagtaccgctgcattcaatatgtttaaacatttagcacatgtgttatctgaaaaataccatctagcgtga

SEQ ID NO: 312 - DNA, 192 bp, Proteus mirabilis
gtattgattgcaatgagacatagcaggaatgaagtggcacgttggcgaatgatgagacaagcgttacgtcgccgtcgccgttggttagagggtcaatcacgccgtaacttacgtatttaccaaatgcgtaagcttgatacttctagaaaacatagagcgctgttgttcgtgcaatacaccgaactaaattga

SEQ ID NO: 313 - DNA, 2715 bp, Proteus mirabilis
tttgtgattgctgtcagcataaaaataagaaggagaggagctatgtcgttacgtctgaaaaaggagagtctttctactctctctgtaggtactcatcaatatgagtattaccgtctttctgaagttgctcgtcaattaggggatatcactcgtctccctaaatcgttaaaggttctgctagaaaatttagtccgctatcttgatgatgatacggttgttgaagatgatattaaggcattggtggattggcaaaaaaatgcccacgcctcccgtgaaattgcctatcgcccagcaagagtattaatgcaagattttacgggtgtacctgccgttgttgatttagccgctatgcgtgaagccgtaaaatctttggggggaaatgtagaaaaagttaatccactttctcctgttgacttggttatcgaccattcggtgatggttgataaatatgccagtgatgatgcttttgagaaaaacgttgaaattgaaatgcagcgtaactatgagcgttatctctttttacgttgggggcaacagtcgtttgaacgttttcgtgtagtacctcctggaacgggcatttgccatcaggttaacttagaatatttaggtaaagcgatatggtctgaacaacaaaatggccgacatattgcttaccctgatactttggttggaaccgattcacatactactatgatcaatggtctgggcgtattgggttggggcgttggtggcattgaagcggaagctgcgatgttaggccaaccgatctcaatgctgatccctgatgtggtaggttttaagttaacgggtaaactacgtgaggggatcacagcgactgacctagtattaaccgtaacgcaaatgttacgtcaacatggtgtggtagggaaatttgttgagttttatggtgatggactagcatctttacctcttgctgaccgagcgacgattgccaatatgtcacctgaatatggtgcaacctgtggcttctttcctattgacgaaattacactagattatttacgtcttactgggcgtgaagagcaagaaattgcattagttgaagcctatagtaaagagcaaggcttatggcgtcatgccggtgatgaacccattttcacctcaaccttatcgttagatatgggtactgtggaagcaagtcttgctggccctaaacgtccacaagatagagttaatttgctgaatgtaccaaaagcatttaaagctgcagtagagcttgaaacaaataaaaaacctcttgctcaatatcctcaggtcaccattgataatcagccaccttttaccttaacggatggtgcggtagtaattgcagcgatcacctcatgtaccaatacctctaaccctaatgttttaatggccgcaggtctactggctaaaaatgcggtagaaaaaggcctgcagcgtaagccatgggtcaaatcgtcgctagcccccggctctaaagtggtgactgactacttagcactggcgggattaacaccttatttagataaacttggttttaatttggttggttatggttgtaccacatgtattggtaactcagggcctttattagccccgattgaagaggcgattaaagataatgatttaactatagccgctgtactatcgggtaatcgtaactttgaaggtcgtatccatcctttagtgaaaaccaactggcttgcttcccctcctttagtcgtggcttatgcgctatctggtaatatgaatattgatttgaccaaagagccattaggtgaagataagcagggcaatccagtctatttaaaagatatttggcctgacagtaaagccattgccgatgcggtggaaaaagtaaaaacgcagatgttccataaagagtattctgcggtatttgatggtgatgaaacttggcaatcactaaaaatacaagatacccctgtatatgcttggcaacctgattctacctatattcgccatcctcctttttttgaaggtatgacaaaaacacctgaggcgattaaagatattcaccaagccagtattttagccatattaggtgactcggtgaccaccgatcatatttcacctgctgggaatattaaagccgatagtcctgctgggcgttatcttcgagagcatggtgttgaaccaaaagactttaactcttacggttcaagacgtggtaatcacgaagttatgatgcgaggaacttttgcaaatatccgtattcgtaatgaaatggtgccggggatcgaagggggctttacaaaacatattccaacgggagaaacgttagccatttatgatgcggcgatgcgttatcagcaagaaaatacgcctttagccattattgccggtaatgaatatggatcaggctctagccgtgactgggccgccaaaggtacacgattattaggtgtgcgagtggtgatagccggatcgtttgaacgtattcaccgttctaatttgattggtatgggagtattacctttagaatttcctaacggtgtatcacgccagactttagggctcaaaggtgatgaaaaaattgagataacggggcttaattcgctaacaccgggtcaagatgtcgctgtcaatattacttttgcagatggtcgccaagaaactattatggcttgttgtcgtattgatacgcaaactgagctggcttattttgaacatggcgggatcttgcattatgttattcgtaatatgttgtaa

SEQ ID NO: 314 - DNA, 198 bp, Proteus mirabilis
aattacgttgccttaaaagaaaaagttcatatccaatcgaatgacaaaatatttttctttctgaaatatattcaaaattcaatgagaaattatttatttccaaaattcacttcctcaactgtatttgcatttaatttactttatgagattaataaaatcaattattcaaaaatttctaacgaattaaaaacctcataa

SEQ ID NO: 315 - DNA, 753 bp, Proteus mirabilis
tttacttatttatctttaaatataagtttattgttttacaaaaaaattaatatcgatatgatagcccacatatacagcatattattttttaaaaaaaggcgtcatatgttagaaagtattggtatttcaaatatttggacataccttttaggcgttatttttattacactagtaccaggtccaaattcaattttcgtcctaacttcgagtgcgaagcatggcgtgaaaggggggtataaagccgctcttggtgtttttacgggtgatgcattattaatctttttggcatttttgggggttgcttcattagtcaagacttcacccgttttctttattgtgatcaagtatgccggtgcactttatttaacctatttaggtttaaaaacactctatgcgacattccataagaaaaaagagcagccggaacaggttgcagtagaggttgtaaaagcgaaaaacggcttatatatcaaagcgcttttcttaagtttgttaaatccaaaaatgatcatcttttatgtgtcattttttattcaatttattgatcctaaatatgaaaatgcaggggttcccttttttgtattaggtgtaatattagaaatatgtagcatgctttacttatctgtacttatttttggtggcgttgctattactaataaggttaagcataacaaacgattagcatcattatcgaatagttgcattggtgctgtgttcttattatttggtgccaaactcgctttaacggcttaa

SEQ ID NO: 316 - DNA, 618 bp, Proteus mirabilis
aactcacatgcaggaggcttgctaatggcgacgctcttactactcgataatatcgactcttttacttataacttagtcgaccttttacgcagtcaacatcatcaagtgatcatctatcgtaatgatgtcagcgcttcttttatcgaaaaacaattaaacctgttagataaccctattcttatgttgtctcccggccctggtacaccatcacaagcgggttgtatgcctgagctacttaatcgcatgttaggtaaattgcctattattggtatctgtttagggcatcaagccattattgaagcttatggcggtaaagtctcttcttgtggggaaattttacacggtaaagctacgctcgccacccatgatgggcaggcgatgtttgaacatctgccaaatcctctgcccgtcgctcgttatcattcactctctggcgaaattgtacctgagcaacttatcgtcaatgcgtggtgtgataacaccgtgatggccgtgcgccatcgccaacatcgaacttgtggttttcagtttcatccagaatcaattttaaccactaaaggcgcacaacttttacaacaaaccattgcatgggcacaagcaccaagaggagacgcataa

SEQ ID NO: 317 - DNA, 981 bp, Proteus mirabilis
gcctgttattttatttggtactctgattttttcttagcgtcattaagtgctgggctttcgataacggaaaaacagttcttgatttcacgattttttcaaggtagtgggtcaggtttttgttacgttgttacttttgcgatattaagagacacattaacagaacaacaacgtgctaaagtactttctatgataaatggtattacttgcattattccggtattagctcctgttctaggctttattattttattatattgtgaatggtcaatgatgttctatcttatgggggcttattccctattggtttttatcttttgttttttggggataaaagagacctaccataaaaaagaaattaaaaataaaaaagtaaatctatctgtaataaaaccaacaacagactcttttttcactcgctattttttaagtcgtttacttatttcatgcttaggaatggccgttattcttacttatgtcaatatttcccctattgtagtgatgcaacaaatgaattattcaacaggagagtattcaatattaatgacatcattagcaatgataagtatgaccatttcttttttaatgccaaaaatattaatgaaataccgctataagcatattttatcagtagggtttatatgttttggaataggtattattttcctttttatagggaaaaagagtgacattcgttggttttttattacctttgcattatgcggctcaggatttgcgttattatttgggattattatgagccaagcactttctccatttagccaacgagccggcgttgcgagctctgtgctgggtatttcacaattaagtttttcttcactttatatttgggtaatggggtggattgaagtatcctcaataaatatgttggtggttattttatttatcagttgtattgtaggtactctttttctatgctttcctcggttcacagaacaaaaaaaggttaaatataatgtctaa

SEQ ID NO: 318 - DNA, 1617 bp, Proteus mirabilis
cgtagttatttatcgggtgtttcggcacccgattttattgagggtgcaaaaatgttagataataatttaaaagctcaactgaaagcttacctagaacgattaacccagccagttgagttagttgcaacattagacgacagcaaacattctgctgatatccaagccttattaaaagaaattgaaccgttatctgataaagtcacataccgtgaagataacagtgctaatgtgcgcaaaccatcttttcttattaccaacccagggaaaacaactggcgttcgttttgcaggctcgccattaggtcatgagtttacttctttagtattagcattattacaaaccggtggtcatccatctaaagaagccccagaattacttgaacaaattcgtcagttagacggtgagtttcatttcgaaacctattattcgctctcttgtcataactgccctgatgttgttcaggcattaaacttaatggcgattttaaatccgaacatcacccatacggcgatcgacggaggcatgttccaaaatgaaattcaggaacgtaatatcatgggcgttcctgcggtattcttaaatggcaacgagtttggccaaggtcggatgactttagctgaaattgttagcaaagtagatagcaatgcagaaaaacgcactgtagagttattaaataaaaaggatgcctttgatgttttgattgtcggaagcggccctgcgggggcgtcagcggcagtatatgctgcacgtaaaggcttaaatacaggtcttatcggtgaacgttttggtggacaagttcttgatactgttgatattgaaaactatatctctgtacctaaaacagaaggcgcaaaattagctggggctttaaaagctcacgttgatgattatcaagttgatgtcattgacagccaaactgtcagccgtttaattccgggagcagcagaaggtgatctacaccaaattgaaaccgcatctggtgcgattttaaaaacccgtagcttaattattgccacgggtgctcgctggagaaatatgaacgtaccgggtgaaaacgagtaccgtactcgcggtgtaacatactgcccacattgtgatggtcctctatttaaaggtaaaagagtggctgttattggtggtggtaactcgggtgttgaagctgctattgacttagcgggtttagtggagcacgtgaccgtactagaatttgcctcagaaatgagagccgatgctgttttacaaaagaaactgcgtagcttaagtaatgtcgatgttatcttaaatgcccaaacaacagaagtatatggagatggtactaagttaacaggactgaaatataaagatcgcactaacgattcaatgcatgatattgccttagcgggtattttcgtccaaattggtttactgccaaacacacaatggttagaaggaactgttgagcgtaataaaattggtgagatcgtggttgatccacgtggtgaaaccaatattaaaggggtatttgctgcgggtgactgtacaactgttccttataaacaaattattatcgccgcgggtgaaggtgcaaaagcctcattaagcgcctttgattacttaattcgcacaacggcaaaataa

SEQ ID NO: 319 - DNA, 990 bp, Proteus mirabilis
agggatcgtgcttctatgaaattacaacagttgcgttatatcgttgaagtggtgaataacgatttaaacgtctcaacgacagcagagcgtttatatacctctcagccggggatcagtaaacaaattcgtatgctagaagatgagttgggtatacaaatattctctcgcagtggtaagcacttaacacatgtgacgccagcgggggaagaaattgtcagattatctcgtgagatattatccaaaacagaagctatccgctcggctgcaggggaacacacttatcctgatcgcggttcgctttctattgccaccactcatacacaagcgcgttatgttttaccccctgtgattaaaggttttatagaacgttatcccgaagtgtcattacatatgaatcagggttcaccgacacaaattgcagaagatgtttgccgtggtaaaagtgattttgctatagcgacagaatcactacatctgtataacgatttagtgatgttaccttgttatcgttggaatcgtattgtggtggtaactaaagatcacccattggcgcaaaagcgtgaagttaccttacaagagcttgcaacttacgatatcgttacttatacccatggttttactgggcgttctgatcttgacgaagcctttggtaaagtgggtttaaagcctaaaattgtttttactgcaacggatgcggatgtaataaaaacttatgtcaggctacacttaggtattggtgtgattgcgagtatggcatttgatccgatgcttgatagcgatttagtcgctattgatatgcgtgataaatttagttatagcaccacaaaaattgcatttcgacgtagtggttttttacgcggttatatgtatgactttatgtggcgttttgccccacatctaacacgtaatttggtggaacaagcgacagctttacgcaccaatgaagaaattgaagagttatttaaagatatcgagttacctttagtttaa

SEQ ID NO: 320 - DNA, 1077 bp, Proteus mirabilis
gtggtctattttttgcgatttcaaggctgttgccgtatgaatacactcacgatatccactcgcctaaaaagccagttgtttaccttggttcaaggtatattgacattggcgctaacacttttagggttactggttattacttttacgctttctgcgttttcccctgtggatcctgttttacaaattgttggtgatcacgccagtattgaaacttataatcaagtaaaacatgagttagggttagatttacccatctacatgcaatttttccactatgtagaagcactattgcaaggaaatttagggacggcgacgtcaacgggtcaaccggtatttgatgatttaattgccacctttccagccactttagaattagccactgtcgccttagtcattggcgctagtttgggggttttatttggtgtgttatgtgcgcgttttgttggcaccccctttgattttatcttacgctttttaacgctattaggtagctcagtccctattttctggttaggtttaatactactccttattttttatgccacattgcaatggactgcaggcccaggacgtttggatgatatttatcaatttaccattgagcctgtaaccggctttgccttgattgacaccctactggcaggtgataaagatgcctttctaaacgccctatcacatctcatattaccggtttctctgctagcctattttgcgctggcatctattacccgtttaacacgctctgcctgtttaaatgagatgaataaagagtacgtcactctcgccagagcaaaagggattggcgaattacgtctcttatttacccatgtattacctaatattcgcggtgtgttgatgaccattatcgccttgtcttatacagggatgttagaaggtgccgtattaacagaaacggtattttcttggccggggattggccgttatctcacaacggctctctttgcgggtgataccaccgcaattatggggggcacacttgttattggtctatgttttgtgctgattaataatatgacagatatcgttattcgtttgactgatccgaggttacgctaa

SEQ ID NO: 321 - DNA, 1041 bp, Proteus mirabilis
aacttatccgcaaaggtgcgccggaggttcaagatgggaattgatttacccgttatttggttcatcatcatcgtatttagcacattaatgtatattgtgatggatggcttcgatctcggcatcggcatgctctatccttttataaaagagagagaagatcgcgatttaatgatgaatactgtcgccccggtatgggacggcaatgaaacatggctagttttaggtggtgcggcgctatttggtgcgtttcctttagcgtattcagtgatccttgatgctttagccatgcctttaactatcatgctagttgcgcttattttcaggggcgttgcttttgaatttcgctttaaagccgatgatactcataaagttttttgggataacgcctttattgtcggctctctattaaccacctttatgcaaggtatagtcgtcggtagtattgttcaaggtttacccattattgaccgtacttttgctggaagctattttgattggctatcaccctttgccctgttttgtggctttggtctagtcattgcctactcactgttagggtgtagctggctcattatgaaaactcaaggccatttacaacagagtttgtataaagtgatcttgccattaacgttcgttatgctagcagtgatagccgtagtcagtttatggacaccattagcacaaccggcgattgctgaacgttggttttcactacccaatattttctttttcttacctgtaccactgctagtgttatatagcgcttggttgattattcgcgcagtaaagaaaaaaggtcattacttacctttctttgcttctctagcgattatatttcttggttttactgggctagggattagtatctggccaaatattataccgccggcaattagttttatcgatgcatcagcaccaccggaaagccaaggttttatgctcgttggtgcgctatttatcattcccattattctcgtttatacattctggagttattacgtattcagaggaaaaaccaattatgaagaaggctatcactga

SEQ ID NO: 322 - DNA, 234 bp, Proteus mirabilis
agtgactatttcctgataatgaagcatttacaacttgcaacccaaacggatcaacccaccccgtcggacaatgcacatacccatatggattcagcccacccaatagccctatggggtctggggaaagatactgtcctgtctccttatcataatagcgaaagcgattataatacaagccactttcttcatcttcatattgccccgcaaagcgaaaaggacattcggtataattag

SEQ ID NO: 323 - DNA, 987 bp, Proteus mirabilis
cccgatttagctaagaggcaaattatgtctattattcatcttgaatttgaaaagcctattgttgaattagacgagaaaatagatgcattacttgcatttaaacagtctcaagatgaaacaacggcagttgatatagacgaagaaatcgccaaacttcgccaaaaaagcctttcattaacacgctctatattttctgatttaggggattgggagatagtacagttagcacgtcatcctatgcgcccttatacattagattatatcaaagctatttttactgatttccaagagttggccggcgatcgtgcttatgctgatgataaagcgattgttgcagggttagcgcgtttagatagaaaaccagtgatgattatcggtcaacaaaaagggcgagacactaaagagaaagtaaaaagaaactttggtatgccatcaccagaaggttatcggaaagcattacgcctgatgaaaatggctgaacgcttccatttaccagtgattatttttattgactccgcgggtgcttatccgggggttggtgctgaagagcgggggcaatcagaagccatagcacgaaatattcttgaaatgtcccgattaaaaacaccgataatttgtacaataacaggggaaggtttttctggtggtgcattagcaataggtgtgggggatcgagtaaatatgttgcaatatagtacttatgctgccatatcgcccgaaggctgtgcctctattttatggaaaaatgctgataaagcacctattgccgcccaaaccatgggaatgacggcacctaaattacaggcattgggtattatagactcaattattcctgaaccattgggaggcgcacatcgccactaccagcaagcggctgaattcgtaaaaaaacagctcctcgcagatttaacagaattgaatagttattctaaagaagaactgcttgagaaacgttatcaaaaattaatgtcctatggttattgttaa

SEQ ID NO: 324 - DNA, 195 bp, Proteus mirabilis
gtttggtcagcatttttatactttttttacatccgtcagagcgcttttatcaacatctttacacctctttcagtagctttactcaatctaaatcgcaaaaggatagttcaaatgttgatattcggtgctgtggcattagttattgtgctcactgcttatcttatttatgtgttgtttcatgcagaggcattttaa

SEQ ID NO: 325 - DNA, 336 bp, Proteus mirabilis
attctgtattttcttataactgtgccatacttactagtggcttcatacaaaatgctacttgttcctttaaacaaactaataatagaggttgtcacaatgaaagcaaaaattgtactaggtgcggtaattctggcttcaggcctattagcaggttgttcttctagcaacaacgcacaattagaccaaatctcttctgatgtaaaccgtttaaatacgcaagttcaacaactaagtagtgatgttcaatcagctaacgctcaagcaaaagccgcttatgatgaagcagctcgtgctaatcagcgtctagataaccaagtaactacttataaaaaataa

SEQ ID NO: 326 - DNA, 210 bp, Proteus mirabilis
gtttatagagcaataaacgagtgtctgccagtaacagaaaatggataccaaaacggtattgagagaattttctggcagaatttagttcattgtagggaagtacctcttggagagaaaaaagataaaatcatgaagaattataatgacaaaaaaaccttaatcaatactcaaataaaatttattgtttatagacacggggattttatataa

SEQ ID NO: 327 - DNA, 426 bp, Proteus mirabilis
cctaagtatttaactaataaagtggcactacgaaacagtaaccaacaacaaaaagcaaaaaagatactggtcgcagcaagacctaagaaattagtcaccccttcccaacgtgaactccaaacaatacaggagctaattgcgccaggacctgccatcaatggcaatgctaaaggcaccaccgcaacactgctacgtactgctgattcatttttttcttggttattttgtttatcttctcctaagcgcccatttatcatggtcattgcgattgtcactatcagcatccccccagcgatacgaaatgagtcaatagagatgccaaaaatactcagtatcgaatcacctattaatagggaaataaccaaaataatcgcaacggagccattggcaattaagtttgttttattacgtcctgcatccgtttga

SEQ ID NO: 328 - DNA, 336 bp, Proteus mirabilis
aataaaatggcatcaacagcgattgtaccaacagatattacattttttgagcgtttaatcccttcaattttagccggtattaaagtgatcacaattagggatgaagcagaaagccactataaaccaaacactattgttgatttattatctaatgaacatggcacttattatggaaagttacaaattatttctgtatcacccttaaattttaatgagataaatgaatttcatgctcaacaagagggcatgaatttgcctactttaaaggccttaattaaagacatttatcctacaacggaaaatctttatttaatagaatataaattaatacaataa

SEQ ID NO: 329 - DNA, 3903 bp, Proteus mirabilis
caaaaggtggcactatcatctgcgatgctctacaaagaggtagagcaactctcgttgcgggatcagcaacgattgagaaaacgcttacgtggcgttgataaaataagtaaagaaacgtcgaaacacgcggtattaagcgagattgagcaggatattattgttgcaaaacagcgtatattaaatcgacaagctcactgtcctaaaattgtttatccagaaaacttgcctgttagccagaaaaaagaggctatctacaatgcaatcaaagataaccaagtggttattattgcaggggaaacgggatcgggtaaaacaactcagatcccgaaaatttgtctcgaattagggcgaggcgtaaaaggttatattgggcatacgcagcctcgacgtttagctgcacgctctgtcgcagagcgaattgctcatgaattaaacacaacattaggtgagtctgtcggttataaagttcgttttagtgatcatgttggtgataacacgctagttaagttaatgactgacgggattttattagctgaactacaacaagataagctgttattacaatatgatactattattatcgatgaagcccatgaacgtagcttaaatattgactttattcttggttatttaaagcagcttttacccaaacgcccagatttaaaagtgattattacttctgccactatcgatcctgagcgtttctctaagcattttaatcaagctcctattattgaggtatctggccgaacttatccggtcgaagtgcgctatcgtcctattggtggtgatgctttggatagtgataaggatatgactgagggcattattgatgcaattgacgagttaagtcgagaaagtgcgggtgatattcttatttttatgagcggtgagcgcgagataagggataccgcagaggcattaaataaattacaactacgtcataccgaagttttacccctatttgctcgtctttctaatagtgaacaaaaccggatatttcagcctcataccggaagacgcatcatattggcaaccaatgttgccgaaacttctcttacggtacctggcattaaatatgtgattgatacgggttatgcacgtattagtcgatacagttatcgaaccaaagttcagcgcttacccatagagcctatctctcaagcttctgcggatcagagaaaagggcgttgcggtcgtgtttctgatggtatttgtattcgtctttattctgaagatgattttatttcccgtgcgcaatttaccgatcctgaaatactaagaaccaatcttgcttcggttattttacaaatgacctcgataggattaggggatattagcggatttccttttgtacaagcgcccgataaacgcaatatacaagatggtgtacgcttattagaagagctgggtgccttacaagagggtactgataataaaggtgcttatcgtttgacgccgatggggaaacaattagctcagcttcctatcgatccaagattagcgagaatggttcttgaagcacgcaaatatggtgcagttagagaattaatggtgatcacatcggcgctttctattcaagatcctcgtgaaagaccgatggacaagcaacaagcatcagatgaaaaacatcgtcgtttccaagataaagattcagattttctttcgttactcaatttatgggactatttaaaaactcagcagaaagaattgagtcactctcagtttcgaaaacactgtcgccaagagtttttaaactttatgcgagttagggaatggcaagatgtctatacgcaactacgccaagttgtgaaggaattaggttttccaattaatagccaaccggccgattttaaaagtattcatgtggctttattaagtgggctattatcacatatcggacaaaaagatagcgataagcaagagtttactggcgcgagaaatgcgcgttttgctatttatcccggctctgggttatttaaaaaaccgcccaaatggaccatggtggcagaattagtcgaaacatcacggttatgggggcgcattgctgcacgtattgaagcggaatggattgaacctatcgcgacccacttagttaaatatcactatagtgagcctcattggtcaaaagcacagggtgcggtaatggctaatgaaaaagtcaccttatatggtttacctattgtggcctcacgattagtaaattatggcaaaattgatccactattatgtcgagagttatttattcgccatgcgttggtagagggcgattggcaaactcgacatgcttttttccgtgaaaatttaaaattacgtaccgaggttgaagagttagagcataaatcacgtcgtcgcgatattttggtagatgatgaaacgctgtttacattctacgatcaacgaataccacaagatgttatctctactcgccattttgataaatggtggaaaatagcgcaaaagaatttacctgatttgctgagctttgaaaaaagcatgcttatcaaagaagatgctaaacgtgttagtgcattagattatccaaattattggcatcaagctaatttaaaattacgcttaacttatcagtttgagccaggtacagcagcagatggcgtcactgtccatattccattaccgattttaaatcaggttaaagatgaaggttttgattggcaaattccgggtattcgtcatgaattagtcgttgccttaataaaatcattacctaaacctatacgtcgtaattttgttcctgcgcctaactacgcttcagcttttttagaacgagtggttacccctgaaggtgaattactcgataaattagaaaaagagctacgtagaatgaccggcgttacggtcgaacgtgatagttggcaacttgagcaagtggccgatcacttaaaaatgacttttcgagttgttggtgacaacaataaaacccttgcggaaggaaaagatcttaatcagttaaaagcacgtttaaaggacaaagttcaagaaacattatcagcggtagcagatgatggtattgagcagcaagatttacatatttggagttttggtgacttgccacaacgctacgaacaaaagcgtggtagctattcagttaaagcctatccggcattagtggatgaaaagaatagtgttggtatcaagctatttgaaacagaaacagagcaacaagcggcaatgtggcaggggataagacggttattactacttaatattccttcacccattaaatacttgcatgaaaaattgcctaataaagcaaaattaggtctttattttaatccttatggcaaggtgctagatctgattgatgactgtatcgcttgtggggttgataaactcattgcttcttatgggggattaatatggcaagaagagcaataccaaaaactccaagattatgtccgtgctgaattaaacgatgttgttgtcgaaattgctaaacaagttgagtctattttaactcaagtatttgcgattaataaacgcttaaaagggcgggttgatattagtgtcgcttttgcattatctgatattaaagcacaacttaatcaattagttttccccggatttgtcacatcccatggctggaaacgtcttgcggatattcctcgctatctcagtgccattgaaaaacgtatggagaaattagcgattgaccctaaccgtgatagagcacaaatgagccgagttgaaaatgtcattttgcagtggcaacagtggttagctaagttaaccgagaagcaaaaacagcaagaagaggtacaaaatattcgttggatgatagaggaattaagagtgagtttatttgctcaacagataggaacaccttatcccatctctgataaacgcatcttacaagctattgagtctatctcattaagttaa

SEQ ID NO: 330 - DNA, 324 bp, Proteus mirabilis
agatatctttttaattcattttttgatggatttactaaaacaatacaaatgaaaagtgctagaaaaaggcgctattcatgtcattgtgtaaaaacatctttgctatggtttaaagattggtattttaatggaatagataaaatgaatgagaatatgctgaatttaatgaatgagctcgtggaaataaccaaaaagcatgcgaacaatgaagatgttaaagcgcatgctaatttagagtcagaaaataaattaagaattcaaattattatttctggtaaaaacgaactggatattacattaaattcgctacaacatgcggtataa

SEQ ID NO: 331 - DNA, 978 bp, Proteus mirabilis
ttgcgcaaggcggaaggattttgtatgaagctgaaaacctcagtcatcgcagcagcggtgttatctttaactaatattactgttgcgcaggctgcacaggaactgtctccagaacaagcggcagagctaaaaccatttgaaagaattacagtcatcggtcgttttaatgcgatttatgaagcagctgacgcagtatctcgtcgtgctgataaaatcggtgctgatagtttttacattcaaggtctagatgatatcagtgatagtggcaacatgagtgtgactgccgatctgtatcgaaaagatgcaccaaaagcaactgaagaagaataccgcgtatttcatggtgtaaaagaattaccaaaacctgaagctattttgctacagccttttgataccgttactattcatggttactatccaacaacacctgatattaataacgaaatcgggaaagaagcagcaaaaaaaggtgcagcatcattctttattgtccgtaatatttcggtaaatgatggtggtaaccaagaagttactgcttatatctataaaaaagatgcccctaaaagagccatacagtcttcagaagccgtggttccttatgactctgatgcgggtcgagcgcttattgccgaaggtggaagtgcagccaataaagttgaaaaaccaggacttgcgtcaaatagtgactttgatagaaatgtaggtgtatttgctgaaacacaatcatcaggtaaaagcggacgttacactgtcaccttacctgatggcactgaaattcaagaggttaataaagcagcggctgcattaatggaaccttttgataccattactttcagtggttattttgtgaactcaccggaagtttcttatcaagttgctaaacgtgccgcagagaaaggtgcaaaatactaccatattactcgtgaatggcagagtaatggtggtacggtaacaatcaccgctgatttatttaaataa

SEQ ID NO: 332 - DNA, 1068 bp, Proteus mirabilis
ccactaaaggcgcacaacttttacaacaaaccattgcatgggcacaagcaccaagaggagacgcataatatggatactatcttcaataaattatttgcaggacaacaattaagcttagaagagagccaaacactgtttagtgcgattattcgtggtgaattaacagaatcacagttagcagcggtattaattagtatgaaaatgcgtggtgagcaccctcaagagattgccggagcggctcgtgcactattggataatgcctctccttttccacgcccagattatctgttttgcgatattgtgggtactggcggcgatggagccaatagcatcaatatttcaacagccagtgcgtttgtcgcggcagaaattggtctaaaagtggctaaacatggtaatcgtagcgtgtctagtcgctcaggatcatcagatttattagcggcatttggtattccgctagataaaagtgccaacgatgcccgccaattgttagatgaaattggactatgctttttatttgcgccgctttatcacagtggttttcgctttgccgcccctgtgcgccaacagctaagaacacgcacgctctttaatgtgttaggcccattaattaatccagcgcgtccgcctttagcattaattggtgtttatagtcctgaattattaatgcctattgcagataccttaaatgtcttgggctacaaacgtgcggcagtggtccatagtggtggaatggatgaagtgtcattacatgctcccacacaagtggctgaattacacaatggggaaatcactcgttatcaattaaccccaagtgattttggtctgcgtccttgtgcgataagtgatcttgaaggcggtacacctgaggttaatcgccaattattggctaatttactgcaaggacaaggtaaacgcgcacacactgaatccgtcgctgccaatgtcgccttattaatgcgtttacacggacaagaagatttgaaagctaataccgaagttgctatgcacgcaatctatagcggtaaaaccattaatcgcgttaatgcgctagccgcaagaggataa

SEQ ID NO: 333 - DNA, 297 bp, Proteus mirabilis
tattatttttataatgtcctaagtgtatccattacgcctgatacacttaggataattcacttattagttaactattttagtatggttatcttattattttcatcgttattacactcaacattattcgaagatggtaataataatgcaataacgtatcctaataataaaataaaacgcactatcaccattgtatctgaagaaataagtaatggatatggcgtaaggaccatggtgccaatggtaaagatcagtgcaatagtgataggatatttgaaaccaaaatctcttactcgttga

SEQ ID NO: 334 - DNA, 444 bp, Proteus mirabilis
aaaatgatttattggatatttttagttttagctattatctgtgaagtgatcggcactttatcaatgaagtatgccagtgtcagcggtggttacactggtatgatcgttatgtggttaatgattgccacttcctatatctttttagccatagccgtaaaaaaagtggcattaggtgtagcttatgcactgtgggaaggtattggaattgtcattattacaacatttagcgtgctttggtttggtgaatcactgtcagcattaaaattaggtggtttagcaatgttaattgcggggatcactctgattaagtcaggcactaaaaaatcggcggttgctaaaaaaacaaccgattcggtaaaaaatattgccggaaaagccaaacaggttgctactgtggtaaagggagttaataagccaatttcttctaatgttaaagaggcttaa

SEQ ID NO: 335 - DNA, 1050 bp, Proteus mirabilis
gagaaggtttatatgaaaaacattaactataagctcgctacacttaccctttgtactctttttgcctcttctgcgttagctaataatacacaagcccctatccgcctcgttattcatggtggtgcaggtacaataacgaaagataccatcaccccagaacaagaaaaagaatataaagccaaactgaccgaagcattaaatgctggatatgctgttttaaatagtggaggcaccagtattgaagccgtacaaaaatcgattaatgttatggaagactctcctctttttaatgcaggtaaaggtgctgtttttactcacgatggtagaaacgaacttgatgcttctattatggatggtaaaacgcgcaaagcgggtgctgttgctggtgttaccacagtaaaaaatccgattaatgccgctattgcggtaatggaaaaaagtccacatgttatgatggtttctcaaggggctgatctttttgccaaagagcaagggttaaccatcgttgatccgagttattttcgtactgaatatcgttggcaacaactacaaaaagcattagaaaaagaacaagttgtattagatcatgatggtaaaactgcggctctttttgctgatccgatgatgtatgattataaatacggcactgttggcgctgttgcattagaccaacatggtaatttagcggcgggaacatcaacaggtggaatgaccaataaacgttatggtcgtgtgggcgattcccctattatcggtgcaggtaattatgcggataatgaaacggttgcggtatcggcaacaggatcaggtgaaatgtttattagaacgctgaccgcatttaatattgcagcccaagttaaatatcaaaaactaccactagagcaagcggcacaaaatgcacttgatgaagtaaaagcgataaatggaagtggtggtgttatcgtattagacaaatctggaaactacacgatgagctttaactctgaaggaatgtatcgaggcaccattggtaatgatggcaaaccactagtcgccatttataaagattaa

SEQ ID NO: 336 - DNA, 2007 bp, Proteus mirabilis
attttttcttattattcgcaaggagaaatagtcatggatggattagtttttacctgtcaatttaaaggaattcctgaagaaacattcactgtgacagaatttcaactgactgagcatttatctgagttatttacactttctttaactgcggtaagttcattaccgtctatctgttttgatgatatgttggggtttgcttgttccttaacggttacgcgcaatggtaaacctattcgtactgtacgtgggctattagctagtgcggagcaacaaaatacagatggtaatcaaacgtggtatcactttattattcgacctgaaatttgggtcatgtctttagggcaaaacagtcgaatttttcgacaaataacggtgcctgacttacttcagcaattattatttgagtctcatattaaagcagattgcaaactctatgctgaggatgcttatcctaagcgtgattatataacacaaaagcgtgaatcagattatcagtttttttgccgtttagctgcagaagagggaataagcttttggtttgaagatgcaggaattgagccacggatgttttacagcgattctcacttaggtatgacggcagatattgacttaatctacaacccacaatatgaaacagatactaaagatcatactgcatatcattggcgttatagagagtcactgctttcagataaaattctttacaaagattataattctaaacgtccttcttatccccttgaaagtaaaatagaaggggaaatacataatcagcatccattttatgaaagttatgggcgttttcagacgcaagatgatgcggatcgttataccaaaattcgaatggaagagatacaacaacaacgttgtgtcggcaatgcattaactaattgttttgctttgatgccaggaaaaattttttcgttatcttctcacccatgctcaaatatgaatcgccgttggcaagtcattgctattactcatcacggcactcaacccttagctgataatagggaagggcaaggaacaacattatcgaataatttaacctttattcctgataatttaaattggcgcccgccttttattcataaaccaacagctgatggcgatgaattagccacagtagttggccctgaaggtgaagaaatctataccaatgaagaaggggctgtacaagtttattttcattgggatcgcatgcgagaaccagaattaggaagctcatgttgggttcgggtagcgcagggatggaatggtaacggttatggctttatggtaatacctaggattggacaagaagtgcttatcagttatctaaatggagatatagatagacctataatttcaggctgtacatataatggacgcaatactccgccactaaacctaccttatgagatgacgcgtactacgtttaaaacaaaaacgcataaaggagaagggtttaacgagttacgctttgatgataaagcaggccgagaagaaatctatcttcatgcacaacacgatatgaatgctcatattgaacataacgcacatttccatattcagcatgatgcaaaaaaacggattaataatgatcaatttaccgaaatcgcaggtaatgatcactttattttaaaaggctcacaaaaaaatcatatcgctggaaatgtatcattacatattgaaggtgatgaaaagacgaaagtaaatggaaatgcggtgcatgaaagcactctgcaaacttattttgtgagtggcggtaaaattgtgcttgatgcggggacagaaatcacccttaaagtgggagagagttttatacggatcactcccaatatgatatttacttcgaataatttggtcgtcggtggtggtagtgcaggaagtgggacttctatcgatttggagctaccgcaaggcgtccctcctttagagttatctccgtatcctgtaaaaaaatactgtgcagtagcagcacagcactcagggggaataattataaaaccaaatgaggatgaataa

SEQ ID NO: 337 - DNA, 543 bp, Proteus mirabilis
tactactattatttcaccataaaggtaataaaacttatgagttatacaaaacggttgtcacttatttgtgctatctgtttaggcacatttatggccactcttgatattagtatcgtcaatgttgctctacctactattcagaatgatattaatgccaatatggctacattacagtggattgtggatgcttatgcactatgtctatcagcttgtattttgtcttcagggccattaagtgatcgtttcggacgaaaaaaagtgtggctctggggggtgattattttcactctaggctcccttatctgtgctattgcacaacaacatgaaatattaatccttgggcgtattatccaaggtgttgcagctgcagcccttattccaggcgcattatcacttattacacatgcctttcctgttgatattgaacgtatccgtattattggtatttggtcttcggttagtgcattatcactgattattggccctatccttggtggtgcattagttcatgccagtggttgggcatggcgtctgcaaccatga

SEQ ID NO: 338 - DNA, 1539 bp, Proteus mirabilis
actatgaatttacttaaatcactggctgcagtgagttcgatgacgatgttttcacgagtactgggctttattcgtgatgcgattattgcgcgtatttttggcgcaggtatggcaaccgatgctttttttgttgcatttaaactaccaaatctattgcgacgcatttttgccgaaggcgcattttcacaggcatttgttcctattttagcggagtataaaagtcaacagggagaagaggcaactcgtacctttattgcttatgtatcgggaatgctgacgttgatcttagcgattgtcacagtaatagggatagttgccgcaccatgggttatttatattacggcacccggttttgctgattcagcggataaattccaactcacaacggatttattgaaaatcacctttccctatattttattaatttcattagcatcattaacagggtctattttaaatacttggaatcgcttttctgttccagcttttgcacctacgttgttaaacgtgagtatgatcttttttgctctcgttattgctccttattgtgatccacctattatggcgcttgcttgggctgttttagcgggaggaattttacagttggggtatcaacttccgcatctgaaaaaaatagggatgttggtattaccgcggatctcgtttaaaaatagcggagtgtggcgtgttattaaattgatgggtcccgctattttaggggtttctgtcagccaaatttcgctaatcatcaatactatttttgcctcattcttggtgtctggctcagtctcttggatgtattacgccgatcgcctaatggagcttcctactggtgtgttaggggtggcattaggaacaattctattaccttcattatctaaaagttttgccagcggcaacacacaagaatatcagaaattaatggattggggattaaggctttgttttttattggctttaccttgtaccttgggtttagctttattatcaggccctttaaccatttcgttatttcaatatggtaattttaatgggcatgatgctctaatgactcaacaagcattagtggcgtattgcattgggttaatggggttaattattataaaaatattagcaccgggcttttattctcgccaagatattaaaaccccggttaaaattgccattgcaacgcttattttgactcaattaatgaaccttgcttttgttgggagtttaaagcatgtgggactggctctttcgattggattagccgcttgttttaatgcaggaatgctattttggcaaatccgtaaacaagatatttatcaaccattagcgggttggcctatctttttattaaaacttgctattgcgttagctgtgatgagtgctgtattagtcggcatgctatgggtgatgcctgattggcaacaagggaatatgctaatgcgtattttacgtttattacttgttgttgtagccggtgccgcaagttattttgtcactttatatgctgttggatttagaccgaaacatttttctctacgagcattataa

SEQ ID NO: 339 - DNA, 189 bp, Proteus mirabilis
atattaaattatattaaagttattttttataaaataaaacagcataaaccttcgataagtctcgtagagtttatgctgcttttgttagtatttaaacgtgaagaaaaccgaataatactaaataataataaagctatttattacacattaaacaagaagttcatcacatcgccatcttgcacgatataa

SEQ ID NO: 340 - DNA, 336 bp, Proteus mirabilis
ataatgaattataaaaaatatctctttagttttgcattaatcacagcattgattagttcaaatgccgttgctttaacacttgatgaggcgcgcgcgcaaggcttagtaggggaaacttttagtggttatgttgagttagtacaaccaaaccataagcaagctcaaatattggtgaatgaaatcaatcaagccagaaaagccaaatatgctgaaattgctaaaaccaatcaagtgactcctgaatctgttgcccgtttagcgggtgaaaaattagtggcaagagccaattcaggtgagtttgttaaaggaattaatgggcagtgggttaagaaataa

SEQ ID NO: 341 - DNA, 261 bp, Proteus mirabilis
tccttggattattttggaaggagagcggctcagggttcgttttggtggtttaaaaaaagatacccaacaaatagaaatattattccttttgcccatcgggaagataatgatgatgtagcgtgttgggataaaaatagccgtcatcaggttattattattcacgattttgcaagtgaaggttatgaatatgtcggtaagtttgattcattttgggattggctcagaacggccttagaagcaactatcgaatacaatgagtaa

SEQ ID NO: 342 - DNA, 666 bp, Proteus mirabilis
aattttgtctatataaacataacagatatttaccgagagaataaaatgaacaagcttcttgtactaaaatccagtattttagaaaattactcacacagcaataaaatggcggactatctaatagaaaattggcaaaaacatcatcaaaatgatctcattaccctacgtgatctggcaaaagatcccattcccgttttagatcaagccacattatttgcttttggcaaagatacggctatgttatcagaacaacaaaaagccgctagagcactctctgatacattaattaatgaattaaaaacacatgatattattgtgatcacggcgcctatgtataatttctccatcccttctcaattaaaacactatattgattttattgcgcgtgcaggcgaaacttttaaatatactgaaacagggtcagtcggattacttgaagataagcaagttattgtattaacgagtcgtggtgggatccataaaggacaaccctctgatttaatcattccatatctaacacaatttttatcatttattggtattaataatgtacagtttattctcaccgaggggactgcgctaggcgaagaatatgcacagcagtcacatgctcaagcacaaaaagaaatagatttaataattaataaagaaataatgataaaataa

SEQ ID NO: 343 - DNA, 1500 bp, Proteus mirabilis
tttactcactataaaggagaaaatatgcaaaacccaccgttacacaagctttatattcatggtggatatgttgattgcgcacaacctgaatgtgaacaatttgccgcaattaatcctgctacaggtgaggtgattgcacatttacaatcagcctgtgaagaagatattaattgggcggtagaaagtgcaaagcaaggacaaaaaatatgggctgccatgcctgcgatggcgcgctcccgtattcttcgacgtgccgtggatattttacgtgaacgtaatgatgagttagcgcatttagaaacgttagacaccggtaaacccctgtctgaaacacgttatgtcgatattgtcaccggtgctgatgtattggaatactatgcgggtcttattccagccctagaaggggagcagatcccactacgtgacagcgcttttgtttacacccgtcgtgagccattaggtgttgttgccggcattggtgcatggaattatccaattcaaattgcgttatggaaatcagcacctgcattagcagcaggtaatgcgatgatttttaaaccgagtgaaatgacatcattaacggcattaaaattggctgaaatatatactgaagcgggtttgcctcaaggggtatttaatgtggtcacgggtgatgccactgtagggcaatggctaacgcagcaccctgatatcgctaaggtctcatttacgggggggatcgatactgggaaaaaagtgatggcgagcgcttcttcatcaagcttaaaagatgtcactatggagctaggtggtaagtcaccgttaattatttttgatgatgccgatcttgataccgcagctgatatcgccatgatggctaatttctatagttcaggacaagtatgtaccaatggaacacgcgtatttgtgccagaaaagttaaaacaagcttttgaagctaaaatcattgagcgtgtctctcgtattcgcgttggttcaccactggaaatggataccaactttggaccattagtcagcttccctcatcttgaaaaagttttaagctatatcgagttaggtaaagctcaaggtgcaaaactactttgtggtggtgaacgtttattcgctggtgcattggcgaaaggggcttatgtggcgccaacggtatttaccgattgtactgatgatatgaaaatcacgcaggacgaaatcttcggccctgtaatgagcattttaagttatcaaacagaagatgaagttattttacgcgccaataatagtgtctatggattagccgcaggcttggtgactcgagatctgacaacggcacatcgcgttatacatcaattagaagccggaatttgctggatcaatacttggggtgaatctgcagcagaaatgcctgttggtggttataaacattccggtgttggccgtgaaaatgggcttgtcacactacaaaattacactcaaatcaaatctattcaagttgaacttggggagttttcatccgttttttaa

SEQ ID NO: 344 - DNA, 210 bp, Proteus mirabilis
tctattgattttgtactaacaacacatgcagcattaacaatttctccagtaaaattaattttaccaccattaacaatagtcgctgcagaagcaacaccgctcagtgataaaacagatactgtaaatagagctttaactaacatcttttttttaagcattgacttttccttttacattacaggtaaatatacacaacaacttcacttataa

SEQ ID NO: 345 - DNA, 984 bp, Proteus mirabilis
tattgcatatattggagcgagaatatgaatggaaaatcaaataatagtttaataaataatgatagtaataaacaaatagctaaaccaataattccgccaccatctgctaaccctactttaagttcacaaatggagacaggagatggcaatgttgctttagatttagttgtggtaatagatacaagtggctcaatggctgatgaatcttctgatttaagtcaacaaatagatgatgctgttcaaaaggcattaggacgttgcccatcaagtttaagagtcacttttttaggaatagaaggtacctgggataatactaagttcgatcgctcagtgactgactatttaatgacacaaggtgtatctgctcacaaattacaagcaagagcgccatttaaagaggctgatggacgagatcatgctggaaataaagaagatttatgccgagccgtcattgatgtgtgtaaatatttcgattggcgagatggcgctcgtcgtgcaatttttgtcttaggtgatgaaggtatggaaggtggcggaggtgtattaacacaagccgctgtgcttaaaaacaatgaggcaatagtggttgctagaagcgaaaaagtaaaagtatatacttatcagggaacgcctaatgatgatccctctaatgtggatcgctttcctactattgctgatagagataacatcacgaaagagtatgtgcgcttagcgcagatgacgggaggacgctcttatatatacacaacaggtatcgctaatttttctttagttctgcaagaaattctatgtgacagtttaacattacctaaacttcctgatctgaataaagataattcaacgtgtcgtcatgtttgtgaagagctctctactattatatcaacagttaatacccttgcagaaataatgcataaagcgattgattcatgttgtaaagaagattggggcacacgcgaagtgtttaagcctcattgtgattgttaa

SEQ ID NO: 346 - DNA, 2259 bp, Proteus mirabilis
ttcactccatatacaaggacttttatggatattaatggtatgtctatgctgaaaagaaatttcaaatactccacattagctacagcaatttgtctgttatacgcgccgactacttttgctcatattgaaaaagtagagacagatacattgactgttattgggcaacaagacaatcaaataacggattttcaatctgtcgtcgatacccgttcagcacaagctcaaaccgcctctaccacggggcaattgttaaaacaaatcccggggatcaccgtatcaggaacggggatcgccaatggtggcaatattatgatgcgtggttacgatcaaagaggtgtcaaaatctttgtggatggtattcatcaacctattgataatactatgaacaagcttggtggcctttttattgaaccctcgcttatttcgcgcgttaaggtcaaacatggtggctcttcggttaaacatggaagtggcgcgctaggtggcgttgtttcgttctcaactctccatccaaatgaattattagacgccaataaaaaccttggtgctaaattatttagctcattctcctcagcggataaacatttttcttatggtggtgtgatcgcaggtagacatcagttagtggaagggttattggcttatagccaaagagagcgtggcccgatacgtattgctgatgactcaatattaaataaccacgaacgtatcaaaaattattttgcaaaagcctatgtttaccctacagaggaacaaaccgttattttttctgcccgtcaatataataatgcaggagagcaaagagaagttttaaatcgaatgggagggtttggaaaaagagacagtaataatatgtatcgagccaccaaacaaaatgatatctcactcacctatcatttaaatccaaataattatgattggctcgatctgagcactcaactttattattctcagtttaaaattgcgcatacgtttctgacggatacacgcaaagaaatatatccagacatagaaagtgtgctaggtaattctgaaaaacgtacccaatatacctatggtatgaaagtagaaaacgcctttaatttaaattactttcaagataggttgactcaatctgtgattatcggcattgatgctgaaaaacagaagatggtatcgaataataaggctaaaaatttccctttatcacatatggataatgcctcaggttgggttcataacacgttcaatacccctctattacccattactttaattgcgggtcttcgttacaactattatcaaaatgtccctgataacagtaaaactttagattactacaaagacttaaataaaaaaggagacatgacctccgccgacaaatatcaagaaacatatcaaaatatttctaaaaatattgcgttacgtctcacactgaccaaatggttacagatctattcttcttattctgttgcctttagggcgccgactttaagcgaaatgtataatgactcagtacatttcactataatttccccttttaataagaaaagctatgatgctcgttgggttccaaattccacattagaaccagagacgaatagaacatgggaacatggtatcaatttacaaaaaaatgcgttgctttttaccaatgaccagctaaacattaaagcttcatattacagcactgaatcgattgaccacattacttatcaacagtggtatcatagtcgtaagcctatccaattaaaaaatagtcatattgcgttatctcctattaaagatgctcgtgaacctttattatttcaatcagttaacttgcctaaagcgcttattcacggctttgatttaagattgctatattctcatccatacatcgctatgggggtaaattacaatcaaactaaaaccttggaactgtcgtctctagagactatttcaatggtgcgtcctgaaacattaaccacttttataaatgtacccattatcaaaacaccattttctgttgcttggtcaggaaaatttgccggtccaacggccaaaaaaggcacacataaataccctggttcagaggaagtgactactcgattaaaagaagatcttcagcaataccctggctatggtgtgcatagttttgcagtcaactatcaatccaataataaagatatacaagcctcattggtactcgataatgcattcaacaaagtgtattactcaacggtaggtgtgcctcaagaagctagaaatatcaaaatgtctgtcagttatcgctggtaa

SEQ ID NO: 347 - DNA, 186 bp, Proteus mirabilis
actatcacatatttgcttggctctgtgtttttaattatatataaactggctgaatacaaatgtgcaaatagcgctatatattgttgctattttaaacattcattaataataagttggagttgctatttattggatgatagaaggatgatagaaactcatattgggtttgagaaaatttcaggctaa

SEQ ID NO: 348 - DNA, 1128 bp, Proteus mirabilis
atgttcaaatattcgttcatcgcggtgattgtttctactgttttgctatctgcttgtgcagatagccatcagaagagtgcagaaaaaaaacctgtaacaagtgaaattgccaatattgcgacatcggcaccggctcgctggaaacagattgatgttgcctcacttgaacaggcgtttccaaaacagtcacggacacctgcacaatttcctgcttatgtagatgctttaaaacaaaaagcggctgaattgggttataaacctgaaactatcaattttgccttttcggaaattcactttattgacagagtggtgaagtcagaccgtaatcagccagaaaagaaaattactttagatgtgtatttacctcgagtggtgacgaaaggacgtatcgcagaaggggcgaaactttatcaagctaaccaacaaaccctagcgcagatcagcaatcaatatggtgtgcctgcaaattatattgttgccttatggggattagaaagtggttttggtcgagtacaaggaaaagaagatgttatctcagcactggccacattagcttttgaaggtcgccgtgaggccttgtttagtcgccaattaatggccgcacttgagataatcgaaaatggacatttacctgtaggccagcgtttaaaaggctcttgggcaggcgcaatggggcagacacagtttatgccatcttcatttttgacttacgctgctgatggcaatggtgatggcaatattgatatatggaatagccgtgaagatgcgtttgcttcagccgctaattatttagcaaccgagggatggcaacgcgatctcccttggggggaacaagtcagtttacctgctaattttaatcaacagttggaaggtataaaaacagagcaacaaaaaacggtcgcacaatggaaggcgctaggggtgcaattacccgctaatagccaattaagtgatgatatgaaggtatggctgataattcctgatgatgatttgcatagaagttatttagtcacccaaaatttccgtactatcatgcattggaatagctcttacttttttgctttgagcattgtgacgatggctgatggcgtggccaataaaataaatacactgccaactcaacactaa

SEQ ID NO: 349 - DNA, 249 bp, Proteus mirabilis
tataacaaatatgaaattttggaatgtgattttaaatattatcgtatcgataaaaacggagggttattacactataaaacgatcaaattgacaaaatcatcaattattagaataaaaaatactcacccaaattctttattaaaaaacgaatattacccaacaaaaaccatttcactacgatatgaaagcattacagttaaccacattgtggccagtacatcaggatatagcataagtaataatatttaa

SEQ ID NO: 350 - DNA, 372 bp, Proteus mirabilis
tacatgaaatattatgcagaagtagtttcattaaatccaaatgttgaagaagaagtaacgatttcacttggtgacattacacttacgtgttttatttgtaacctaaataatccaataaagttaaatgaaatttatttagttgagcttgaactcgaaattttcgatgaagtaagagctaagttggccactgatatattaccaaaacaaataggtgattcttttgcatacgaattaaatggttatttgctagaaaataaaattattatatctaatataattcttcaagatgatttgttatatgaaatttcattttatgaaaataaatatgtttgtatttatatagatagaattaatatttcatttttcaattaa

SEQ ID NO: 351 - DNA, 438 bp, Proteus mirabilis
atgatgaaatataagcacccagtatgtgttttagttgttatctatgccaaacagactaagcgggtgcttatgctgaagcgtcgagatgatcctgatttctggcaatctgtgacagggagccttgaagagggcgaaacaccttatcaggccgcattacgagaagtgcaggaagaagtaggaattgatatcataaaagaaaatcttgagctggtggattgccatcgttcaattatttttgagatattcgcacactttcgccatcgttatgcgcctaatgtgacacattgtcaggaacattggtttatgttagcacttccctctgaacgggaaattgaactgactgagcatacgcaataccaatggttagatgcgccactggcggcaaaattaactaagtcagccagcaatcagcaagcgattgaagaatttgttatttaa

SEQ ID NO: 352 - DNA, 1800 bp, Proteus mirabilis
gtaaaaggatattgtatgcgtactaattattgtgggcagttgaatagcgcccatgtgggccaaaaagtgactctttgtggttgggttaaccgccgccgtgacttaggtggacttatctttattgatatgcgagatcgtgaaggtatcgttcaggtcttttttgacccagagcagaaagaggcattttcacaggcttcagaactgcgtaatgaattttgtattcaagtcacaggaacagtacgtgctcgccctgatagccaagttaataaaaatatggcaacaggtgaaattgaactagcggcagaatcgctgtctatttttaaccgttctgaagcgctacctttagatagcaaccaaacgaatacagaagagcgtcgtttaacttatcgttatttagatttacgtcgccctgaaatgtcacaacgcctaaaaactcgtgcgaaaatcacaagttttgttcgtcgctttatggatggtgaagggttccttgatgtagaaacgccaatgctaactaaagcaacgccagaaggtgcgcgtgactatttagtaccaagtcgtgttcataaaggtaaattctacgcattacctcaatcaccacagcttttcaaacagctgttaatgatgtctggttttgatcgctattatcaaatcgtaaaatgtttccgtgatgaagatttacgtgctgatcgccaacctgaatttacccaaatcgatgttgaaacctctttcatgaccgcagaacaagtgcgtgaagtgatggagcgcatgatccacgcattgtggctagatatcctgaatgttgatttaggggcattccctgtgatgacctttgcagaggctatgcgtcgttacggctctgataaaccagacctacgtaacccaatggaactcatcgatatcgctgatttagtgaaaaatgttgagtttagcgtctttgcacaagctgctaatgatgaaaaatgtcgtgttatcgcgttacgtgtaccgggtggtgcatcgttaactcgtaaaaatatcgacgagtatactcaatttgtcagtatttatggtgccaaaggcctagcgtggatgaaagtcaacgaaaaggcaaaaggtatcgaaggggtacaaagccctattgctaaattcctgactaatgatgtggttaacagcatcttagcgacaacaaatgcaacagatggcgacttaattttctttggtgcgggtcgtcaaggtaccatgagtgatgctatgggagcgttgcgcctgaaagtcggtcgtgatctggaactaactgatcttaacgcatggaaaccactgtgggttattgatttcccaatgtttgaagaagatgaagataccggcagcctaagtgcaatgcaccatccatttacttcaccaaaagatctcacgccggcagagctaaccgcacatcctgtaggcgctgtagctaatgcctatgatatggttattaacggttatgaagttggtggtggctcagtgcgtatccatcgtaatgaaatgcaacaagcggtatttagcattttaggtattactccggatgagcaacgtgagaaattcggtttcttattagatgctctgaaatttggtacaccaccgcatgcagggttagcatttggtttagaccgcttagtgatgttattaacaggaacagataatatccgtgatgttatcgcgttcccgaaaaccacggcagcggcttgcttaatgaccaatgcaccaagttttgcaaatgaagacgcgttaaaagagctggctattcaagtgacagaaaaagaagttagcacagataacgagtaa

SEQ ID NO: 353 - DNA, 1461 bp, Proteus mirabilis
aacgtcatgtatttagggctagacttaggcacatcaagtgttaaagcgatcatcatgaatgagcaaggtgatgtcgttgccagtcattctatacctttaaccctctcacgccctcatcctcaatggtcagagcaagatccacaagcatggtggcaggcaactgatgaagcgataaaacaactgagtcgtactcaacctatggaacagatccaagccattggtctcagtggtcaaatgcatggcgcggtattacttgatgcgcagcaaaatatattacgccctgctattttatggaacgatggtcgcagtgttaaacagtgtttacgactggcaaagcagtaccctcaatttaaagaaattacgggcaatttagttatgcctgggtttacagcgcctaaattgcaatgggtcgcagaaaacgaagcggagatcttttgtcagattgctcatgtgctattaccaaaagattttctacgttggaaaatgagtggtaattttgccagtgatatgtcggatgcggcgggtacactgtggttggatatgcaaaaacgcgattggagtgatgaattattagcggcaacggggctttctcgatgtcaaatgccgaccttatttgaaggtaaccagataacgggttacttactgccagaaattgctaaaaaatggcaaatgaaacaagtgccgattatagcgggtggtggtgataatgcagcgggtgcaattggtgtaggagtatatcaaccgggtcaaggaatgctctctttgggcacatccggtgtctattttgttgtcagtgaaaagtttctccaaaacagtgacaatgcggtacatagtttttgccatgcattgccacaaacttggcacttaatgtcggtaatattaagtgcggcttcttgtctagattgggtatgccaattaacggggatcagtgatgttggtgcaatgtttaaagaaatagaacagcatgcacattctgatagttccctactctttttgccttatctttctggtgaacggacaccttataacaatgcggatgccaaaggcgtattttgggggttaactcaccaacatcagcgtgcggatttatgtcgagcggtgttagaaggtgttagttttgcgttgaggcaaggaattgaagtagcggataaggctggacaacatgcagacaatataacgttaattggtggaggggcaagaagtgaatattggcgacaattactagctgatattacaggaaaaaccttggattatcgtcaaggtggtgatgttggtcctgcgctgggagctgctagactggcgcaattagcgataaatccggctcatttatcacaaattattctttctcagccaaaacttgaaacacgtcatgttcccaatttagaaaaacataaggcatatcaagataaatataatgcctttaaaaagctctacacacttattgaaacaatgaaaatataa

SEQ ID NO: 354 - DNA, 846 bp, Proteus mirabilis
aggataatgtatatgaacaatcaacaagccgaacaactaaaaaagattatgatggctgatagttattttgcacaacctattacgcccccttttccacagcctttagcaataaaatcattacaacagacacttaatatcaaagatacagaaggacttgttcaatttattatcgcttcacctaaacgttttaacgaatcagaaaaaatgatcatgacacaactgaaagatatacaaattgccttaatctctattatgtcgaatcatctttcagtattgaaaaaagaagatagtgaagcttattatcaaccagagcattggctagaaacccttaatcatttgcctttgcttagccgtaataaagttgaaagcaaacgacttgataagcaaacatttgatttttcaattgctcaagcctttgtgcaactgttattaggtgcagccattaatgcagcgtcaccgtcattagccgagtttatcgattttttacgcaatcagggacaacaaattgaactaggaatacgccaatcctttgatagctataaaacgataactattgcaggtgtgacggaaatccttaatcataataatcagcttatttttgtacctaaattaaaaataatgagtctacgtttctcacatcgaacagccaaaatgttattagccagttgttcggggcgaaaatttacgatttcagtagaatacacaacaatcacctcaatttttgatattggtgcacttaatgatccgctgattaatcgacaattttatgcttttttaaataagtttcgtcagttgagtattactcaatctgattcattttttagtggggactttttattgcaatag

SEQ ID NO: 355 - DNA, 834 bp, Proteus mirabilis
acttatgagtatttagtaatggaaatgattttactgtttctgattgtgggatgtattactggattttttgccggattgttaggaattggtggtggagccattattgttcctattgtgatgtatgttgttagccaacaagctatccctgcagatatggtaatgaaaatcgccctctcaacctctttttctgtcattatattttctaccgcctcttctgcttattcgcataataaacataaagcgattttatggtcacaatttccgctcctcgctgtaggcactcttctcggtatgctagttgggacattcctagtacaaaaactctcaaataccctattgcaaattatcttttgtatttttatggcctataccatatatggattactgaccaagaaaaaagaagctgaacgtgttgagaatgcccaagatccggtggtttcaaaaccagcactgacaaccggtggtagcttagtgggttttatttcaagttttattggtatagctggtggcaccataacaataccgctattaagccactgggggtttaatacccgtaaatgtattgcaacatcatcaatgctgggtgtgattatcgccactattgggactgttatggggatcgtttatggttggcaacaaactgaattagcagactattatttaggttttgtctatctacctgcttttattggtattagtattaccagtatacttacagcccctatcggcgtaaaagttgcctataaactacctattgccagagtacgccaaatatttgccctattcttattaatcgtcatggctaaaatgttatataccctgatattgggatag

SEQ ID NO: 356 - DNA, 735 bp, Proteus mirabilis
ataccctttcagcttgtgaggcgaattaaaatgagtatgatcaaagaactgttttcacaaggattatggaagaataactctgctttagttcaattattagggctgtgcccattactggcagtgtcttctaccgcgaccaatgctttaggcttaggtctagccacaacattagtattagtttgtaccaatgtggcagtgtcgagtttacgtcgttgggttccctctgaaattcgtattccaatttatgttatgattatcgcatccgttgttagtgcggtacaattgcttatcaatgcctatgcttatggtttataccaatcgttaggaatatttattcctcttattgtcactaactgtattgtgattggtcgtgcagaggcgtttgcagctaaaaatgaagttttcccttcagcaattgatggctttgctatgggattaggtgcaacagcggcactttttgttttaggggcaatgcgtgaaatattaggtaatggcactttatttgatggtgctgatttattattaggtgaatgggcgcaagtattaagggttgagatagtacatttagactcacctttcttactggctattttaccacccggtgcctttattggtttaggttttatgctggccataaaatacctgattgatgaaaaacagaaaaaacgcgttccatccacgaccaaaacctatgaaaaagaacaaggttgtggcagtcatattgttaaaaactaa

SEQ ID NO: 357 - DNA, 207 bp, Proteus mirabilis
ataagatttcacaatatgagacacgtggcgcattcgcttacattgaagcgcacctataaaacttacgcacgtttctattggcaagataaagataccgatcgttatcgcttacttttaaccaatccattggggacgacagagctagacttaaatgtgatgcctggtgtgattgaagtgactgataatggtggtaaaaaagtattatag

SEQ ID NO: 358 - DNA, 186 bp, Proteus mirabilis
ccccctattcatttcaccaggccaaaaaatctgacgcattctatcggcataaaaattttatgcaaacgttttcgtactctgtttatgataattaatgggatcggtgatagaaaaaaattgatatatctcacatcaatcctgatgttatggttgttttacttgagtcactcgacttatttaaaatga

SEQ ID NO: 359 - DNA, 1044 bp, Proteus mirabilis
cgcagaaatcaattaattgggttatttgagtataatatgaaaatattagtaacaggtgcagcaggatttattggctaccatttaagccagcgtttgatagaaatgggttatcatgttgtcgggatagataatctcaatgattattatgatgtgcgcttaaaagaagcacgattagctaaacttaatcagttggataacttccaatttgataaaattgatattacagattcagtgagtattgcgcaattatttgctgatcaccgttttgatcgagttattcacttggcggctcagcctggcgttcgttattcaattgaaaacccaatggcatatatcgatgctaatattgtaggccatattaatatattagaaggttgtcgccatcataacgttgggcatttgatttattcgtcatcaagctcggtatatggtttaaatcaaaagcaacctttctctacagaagatagtgttgatcatccggtgtcactttatgctgcgacgaaaaaagccaacgaattaatgtctcatagctattctcatttatatcagctacccacaacaggactgcgattttttaccgtatatggtccttgggggcgtcctgatatggcactatttaaatttactaaagctatgttagcgggtgagcctatcgatgtttataatggcggaaatatgacccgtgatttcacttatgtcgatgatattgtcagttctgtggtacgtttaattaatattattcctgaacccaacccaaattggaccgtagagcagggggaaacttcatcaagttctgcaccttataaaatatataatgtgggtaatgggcaacctacaaagttaatggattttattacagcaatagaaaaatcactcaatattaaagctaaattgaacttaatgccgatgcaagatggtgatgtactttcaacctgtgctgattgtagcgatttagctcagacaacaggtttttcacccaacactgcagtagagtatggtgtgaagcagtttgtggattggtatgtagattattaccagcaataa

SEQ ID NO: 360 - DNA, 1443 bp, Proteus mirabilis
acttattgtcactattatagtttactgtcatatggtctacttatccacacgatttacctgctatttacagatcagcgcgatttgtatatcaaaataatgaggttgtttatgtttgggttaagtgcctttgatttggcgcgtatccaatttgcgtttaccgtttctttccatattatcttccccgcaattactatagggctagccagcttcttagctgtcttggaaggcttatggctaaaaactcgcaataaggattatttagcgctattccatttttggtcaaaaatattcgctgttaactttgctatgggcgtcgtctctggtctcgttatggcatatcagttcggtactaattggagctttttctccgattttgccggctctatcaccggccctctattgacttatgaagtacttacagcattcttcttagaagctggatttctaggtgtaatgttatttggctggaacaaagtaggtgaaaaattacactttttcgccacttgcatggtggcattgggtacattaatgtcaacattttggattttagcctccaacagttggatgcaaacaccacagggattcgaaatcgtcaacaatcaagtggttcccgttgattggctagcggttatttttaatccttccttcccttatcgtcttgctcatatgggcgttgctgcatttcttgcttcggcattctttattgccgcctcggcttcatggcatttattaaaaggcaacaagacatctgcaatgaagaagatgctctcgatgtctatatggattatcttaatcttagcgcctattcaagcacttattggtgatatgcatggtttaaacacgttaaaacatcaacccgccaaaattgccgcgattgaagggcattggcaaaataatcctggtgaggctacaccgttaattctatttggtataccggatatgaatgaagaaaaaaccaaatatgcccttcaaattccttatttaggtagcctgatattaactcatagtttagataaacaagtaccagcactaaaagaatttcctaaagatgataggccaaattcactgattgttttttggtcatttcgtattatggtcggccttggcatgctgatgattttagtgggtgtatggggcacatggttacgttacaagaaaaaattatatcaatctaacctcttcttgcgattcacttttctaatggcaccttcaggattaattgccattttagcgggttggtttactacagaagtaggtcgacaaccttgggttgtgtatgggatacaacgaacacgagatgcggtatctgctcatggtgaaatgcatatgagcattagcctactgattttctttatcgtttatggatctgtattcggaattggatatgcctatatgttaaaacttatccgcaaaggtgcgccggaggttcaagatgggaattga

SEQ ID NO: 361 - DNA, 657 bp, Proteus mirabilis
atttggcgtcaatatttttgcggaggcgttagggtgataggacgtattagaggcgttattcttgaaaaacagccaccagtggtgctgatcgaagcgggtaatggggtgggttatgaaataaatatgcctatgacctgtttttatgagttacctgatattggtcaagaggcgattatctacacacaatttattgttcgtgaagatgcgcaattactatatggttttaatcaaaaacaagaacgggcattgtttcgtgaattgataaaagtcaatggtgtagggcctaagctagcactggctattttatcaggaatgtctgcacgccaatttgtcaccgcaattgaaaatgaatccatctcctcattagttaaattaccgggagtcggtaaaaaaaccgcagaacgattagtggttgaaatgaaagatcgcttcaaagggcttaatggcgatctatttgaacaaaacggcgatattgagctaccagccagtgcatcatcgaaagcgccatctgctgcagatattgaagcagaagcttccgctgccttaattgccttaggttataaaccacaagaagctgccaagatgattagtcgggtagcaacggcgggtgctgatagtgaaacacttatcaaagaagcattacgcgcagcgatttag

SEQ ID NO: 362 - DNA, 204 bp, Proteus mirabilis
aaaataatccagccgtcaaagagcaaatttgtcctaaaatgccagtatcctattttcgacgagcgttacgaaaaacaggtagactatgataatgctagacagaggctatccatatgctatagcttctgtcgttttgagcatgctgcctcgcatatttcttttatcatgtcatcatttttttcaacgcactgttttttcaaatag

SEQ ID NO: 363 - DNA, 579 bp, Proteus mirabilis
cgtgtttaccatcaaggagtgtgtatgaaagctatttttttgactgctttatttgtattaactagtttagtgactggctgtgatcaaatcagacaatttgatgtcagtgaaaaagtaattaatgactatctgagtcaaaaatcgggattacaaaaacacattggggaagacggtgttgtttctgccgatatcacattaagtgatttagcgatccaaattggtcgtactgagcctggaaaagtgagcttttctggtagtgcttctcttaaaattgattctttgtttggcaaaactggcgcgaatgtgaatttaactttatcaggccagcccttttatcaagcagagcttggggcgatatatatcaagtcaatgaaaattgatagctataaagtgtctcctgaaaaaatggagccagttgtaatggcattaaaaccttacttagatacgactattgcgacttattttgataatcagcctgtttatgtgctcaaccctgaaaaaaatagtgcagaagcggctgcctttaaattagcaaaagggattgaagttaaaccgggtaagtttgtgatccaactttaa

SEQ ID NO: 364 - DNA, 510 bp, Proteus mirabilis
aggctataccaatatcatcaatattcttcaacaagcaggggcaaaataatgtcagataagcaatttatacagcaagccatttcgcttgccacagagaatgtgaaagttggtgggcgtccctttggcgcggtgatcgtgaaaaatggccaagtgattgctcatgctgttaatcaaattacagcgacaaatgatccaactgcacatgcagaattattagcattacgagaagccggaaaagtgttaggacgagcaaaattggatgattgtgtggtttatgccagtggtcaaccttgtccaatgtgtttggcggctatgcgtatggcggggatctcacaaatattttatgcttactctaatgatgatgcccagccttatggattatcgacagccaatattgctaaggcattaagagtcgctccggagcaacaagaagggttgcaatttgtgcaaataaaacctgaagacgaaaaacaaccggcactttatcagctgtggtctcaacaatcttaa

SEQ ID NO: 365 - DNA, 447 bp, Proteus mirabilis
tctcatcaccaaactatatcaatatttatcagtgtgcttttttattatgctgaaatggctcatcagcttttttttaatatattttcgcatgcgacgaatgccatagcattattcgatcatattaatattataagtcactactaccttgtctatctgattgttataacacctgtgtttgtttttttaaatggaaaaatgaattcactatataaatgtttgttttattttatttttccttattttttatctctatttgcatggtatacacatatctacttcgatttacccaaaaattctaacttaggaagtgggacattacttggtgaatttggctacataacagtgactatctatatcatatacggttcattcttaatcccattaattgcatgtttgtgtgagatttttattcgattgctctatcgatatctatacaggttttattaa

SEQ ID NO: 366 - DNA, 882 bp, Proteus mirabilis
aaatcatgccatgaaggagcttttcgcaaaaaagggttggtgatggctgagaaaaagtcctgtgctcaggctttaaacgaggcagggttatcagtcattaaggcttgtctgctcacgtcattgcctcgatccacgttttatcggaagactcaaaattggcgcgagaaggataaaatcgttattgatgctatccaaactgtattagctaaatcacctcaagccggtttctggaaatgctatttccggctacgctttcaaggctatctgtttaatcataaacgagtttatcgcgtttactgtcgactaggactgaacttgaagcgacgggttaaaaaagtgctttcaaagcgtgaaaaaagacccttaaaaattgaaaatgtcccgaatattcaatgggcattagatttcatgcacgatagtttatattgtggtaaacgtttcagaacactcaacattattgatgaagggacacgtgaatgtttggcaattgaggttgatacatcacttcctgcagagcgtgttataagggtgctagaacgattaagaatggaaagaggattaccaaaacagatccgagtcgataatgggcctgagctaatctcgattaatttattgaattactgcaaaactcaccacgttgagctttgccatattcaacccggcaagccacagcaaaatggctttattgaacgatttaatggctcatttcgccgtgaatttttaaatacctatttatttgaatcattaagtcaggtgcgagaaatggtgtggttttggcagcaagattataatcagaaccgtactcatgaaagtttaaatcacctcccgccggaggcatacagaaaacagttagaaaactctaatttaacgtgtctcaattaa

SEQ ID NO: 367 - DNA, 597 bp, Proteus mirabilis
aaatatcgccatctccaacaaattagatacgcgataatgaaaaaaaatcttattttatttataagctttattttacctttctctccatcactacatgcttttgagaataatcaggcaatttatggcggttacatatatggaaaaataaaaaaccacaaagcaaatggtgcaataataagttatcactatggatccgatattcactggggaatgttactttcattactgcatatcaagtcaacacatcaaagccattttatagacgctagctcacttaagctaggcacaaaagatgaacatgcaaaggtttctgcattattaatagacccaacgtatcgaattacaccttctttggctatctacgcccaaatggggcctaaaaaattaaaatatcgagttgataaaagttattcaggcgttgcggtaaccgataccattatcgtcgacaccaccaatgtgatgtttcaagcgggtattgattatagccttagaaaaaatgtaggcattaatcttggctatttacattcagatactgagtcaaacaaacataatattagactaaatagtatccaattatccttaggctatcgtttttaa

SEQ ID NO: 368 - DNA, 1038 bp, Proteus mirabilis
ataggagtacacgtgtaccgcttccaaaatgattataatgaaattgcacatcctgcggtcatgaaggcaattacagatacagtaggtcaacgttatgatggttatggtatggataccctttgtcatcaagctaaagaattaatcaaacagcgaattaaacaacccgaagcgcagatccatttttttaatggtggcactatcactaatttaaccgctatttctcactttttacgcccacatcaagcagtaatttctgtcagcaccgggcatattgcgactcatgagacgggagcgattgaggcaacaggccataaagtgatcaccactttttctgctgatggtaaattgaccccagatttattgaagccgatcctcgctgaacataacgatgaacattgggtgcaacctaaacttgtttatataaccaatgccactgaaattggtacggtatatcgtaaagccgaattacaagcgttacgcgaattttgtgatgcacataatttatggttatatcttgatggcgcacgtttagcgacagggttgatgtctgataacagcgatctaacgattgaagatatcgcacacttaactgatgctttctatattggcggcacgaaaattggtgctatgtcagcagaagcattagtgatttgtcatcctgcattaaattctgattttcgctttagcttaaaacaaaagggcggattacaggcaaaaggttggttattaggggcacaatttgcggcgttatttagcgacgatctctactttaaattaggtaaacatctcaatgagatggcctcacaattagccgcattctttactgagcacggttttgattttttagcaccagcagaatctaaccaagtgtttgtcattttacctaatgatattgcagaaaagctaacgcagcagtttgtttttcatcgcatattacttgacgatccacagctaagctgtttgcgcctttgtacttcttgggcaacaacacaacaagatattgatgattttaaagttaaatttcttaaacttatttaa

SEQ ID NO: 369 - DNA, 267 bp, Proteus mirabilis
gagcagccacattggacaatagagccttctacagcaattttttgtccatccagtatcattccttgctctccagtcactatcgtgccttcttcattgcatactggacaacgtgttgttttatctccaagcctcaatatgctaatcccttcattggtgaccgttaatatgctagcaagacaagtcgctccggtggtcgttttgtcattatgtaatccaattcttttcccaaagactgtggctctcatcattgtttccttacatatatga

SEQ ID NO: 370 - DNA, 1578 bp, Proteus mirabilis
agactaaaacacgcaagcgtatttactgcgtacacccaaaagagtacattaatacgaaattatgtaacaaaattacaaaatctcatcatgaggagacgtactatggcagcgatatcgactgctcaggcctgtgatctggttatcttcggtactaaaggggatcttgcccgtcgtaagttaattccatcactttatcaactggaaaaggcaggatatattcaccctgatacacgtatcatcggtgttggtcgtgctgattgggatgtagctgcttatacaaatgttgcccatgaagcattacaaacttttttaaaagaagagattaaccctgaaatttggcaacgtttaagtgctcgtctcgatttttgtaatcttgatgtcaatgaaactgaccactttattgagttagcaaaacatctaaaacaagacaaattaccggcgatttactattttgcaatgccaccaagtactttcagtgcgatgtgtaaaggtttgggacatgctaaattaaataaagagccaaaccgtgtggttatggaaaaaccactaggaacagatttagcgtcttcagtttctattaatgatagtgtggcgaaatactttaaagagagtcaaatttatcgtatcgaccactacttgggtaaagaaaccgttttaaacttattggctttacgttttgctaactccttatttgttaataattgggataacaaaacgatagatcatgtccaaatcacggtggcagaagaagttggtattgaaggacgttgggggtatttcgatcaagcgggtcaaatgcgtgatatggtgcaaaatcacctattacaaattttgacgatgatcgccatgtcaccacctgctgatttaacggctgatagtatccgccaagaaaaagtaaaagtactgcgctcattacgtcgtattgatatgactaatgtccgtgaaaaaacggttcgtgggcaatatacggccggttttgtacaaggtaaaaaagtaccgggctatctagacgaagagggtgcaaataaagccagtaatacagagacctttgttgcaattcgtgctgatattgataactggcgttgggcgggtgtacccttctatttaagaaccggtaagcgtatgccaagtaaatgctcggaagtggtggtctattttaaaaaaccagctctgaatattttcagtgaaacctatcaagagttaccacaaaataaactcactatccgtttacagcctgatgaaggtattgatattgaagtgctaaataaggcaccaggtcttgatcataaacaccgcttacaaactactaaattagacttaagtttctccgaaacttttaatcaaactcatttagctgatgcttatgagcggttgttgcttgaggcaatgcggggtattcaagcgctatttgtccgtcgtgatgaagtagaagaagcatggaaatgggtcgattcaattattaatgcatgggaatgcgataatgaattacctaagccataccaagcaggaacatgggggccggttgcatctgttgcaatgatcactcgtgatggccgctcttggaatgaaattgagtag

SEQ ID NO: 371 - DNA, 960 bp, Proteus mirabilis
gaaaaggtgcatataatgaaaaaaactctcttagctctgaccctatgcagttctgtttttactgttcctgcttttgcacaatggcctgaaaaacctattacgattattgttccttgggctgctggtggcaataccgataccgttgctcgtttagcagcaaaaggattacaagaagaattaggtgtgacggttaatgtcgttaataagaccggaggaagtggcgttgttggacatgatgctattaaaaatgccaagtcagatggttacacattaggtattgccacggttgaaattgcgatgatgcatcatcaggggatgactaatttaacctatcaagattataccccgatcacacgtttagcggtaatctacggtggattacaagttgcaaaatcatcgccttttaataatgcacaagaaattattgattatgccaaagccaacccagggaaattaaaagcgtcagggagtggattaaactctatctggcatcttaataatattggtatgttacgtgcagcaggtttacctgataacgcaatccgctttattccttcccaaggagccagtgcggcattacaagagttagcttcagggggcgttgatattgtaacgtcttcattaggtgaggctgacagtatggtcaaagccggattagtcaaacatatggccattatgtctaatgaaaaatcggcattttatcctgatgttcctctctttaaagaagcaacaggttatgattgggatttacaagcatggaatatgttagttgcccctaaaggacttgataaagaagcacaagataagcttaccgcagcaatgaagaaagtttatgcttcaggtgaattagctgaatttgctaataaacaaggatttgaagtcattgaattgtatggtgatgatgcgacacaatttatggccaatgaagataaaaagtttggcgaaattataaaaaaataa

SEQ ID NO: 372 - DNA, 1701 bp, Proteus mirabilis
atgaaaacgcataaagttaaccgggttcgcccctttagtgcatttattgatgcatgtgtaaaagagccttactcttttgcccgtttattaaaagatattattgcagggatcaccgtcggcattatcgcaataccactggcaatggcattggctattggtagcggtgttcccccgcaatacggtctttataccgcagctattgccggtattattatcgctgtaacaggtggctctcgctacagtgtttcagggcctactgccgcctttgtggtgatactttatcctgtttcacagcaatttggtttaagtgggctattaattgccactttgatgtctgggattattttagtggttatggggttagctcgttttggtaagctcattgaatatattcccgtttctgtcacattaggatttacttcggggattgccatcactatcgccaccatgcagatcaaagatttctttggtttagaaatgtcgcatgtcccagaaacctatattgataaagtaattgctctaggtgccgctctaccgacaatccatcttggagatacattaataggcgtaaccaccctcttagtattaatttattggcctaaattgaatttacgcctccctggtcatttaccagcattaattgccggtacggctgttatggggatagttaatttatttggccatgatgttgccaccattggttcacaatttagctatctattgcctgatggttcaacaggacaaggtattccgccgatcctgccacaatttgtgctaccgtggaatttacccagtagtggtgagtctattgcattaaattggagcacggtcagtgcgttattacccgccgctttttcaatggcaatgttaggtgcgattgaatcactcctctgtgctgtggtgcttgatggtatgacggggaaaaaacatcactctaatggtgagttagtcggtcaaggtattggtaatattgtagcgcctttctttggtgggatcaccgcaactgcggctattgcccgctcagcggcaaacgtacgtgccggtgcaacgtcccctgtatctgcgattgtgcactctttattagttttagtaactttactggttttagcgccttttctctcttatttaccattagcagcaatgtctgcattgttattaattgttgcatggaatatgagtgaagctcgtaaagttatcgatcttattcgtcatgcaccaaaagacgatattatcgttttagtattatgtttatcgcttaccgtgctgtttgatatggttattgcgatcactatcggcatcgtattagcctctttattatttatgcgtcgtattgctaatatgacgaaaataacagaatcaacttatactgatgatgataaacaattattagttgtgcgtgttaatggtccgctattctttgctgccgccgagcgtatttttaatgaattacgtgaacgtagtaaaggatataaaactcttattatgcagtgggatgcagtacctgtattagatgcagggggattacatgctttccaacactttgtggcggatgtgcaacatgatactcatattattgtttgtgatattcccttccagccattaaagacattagcaagagcacgagtaacgccaattgatggcacacttaatttttatccttcgctacaaaaagcgctggatgatatggaattaattcagtag

SEQ ID NO: 373 - DNA, 663 bp, Proteus mirabilis
attgcacagcaaaaacgatattttcttcaattgctcaatcaggtgaaaaagatggaatttaacactttgttattctttgcccttacagtactgcctttaatttgcacacctggccccgatattctttttatctcctcacaaggattagcgggaggaataaaatcagcgtggtttgccaatatcggtgtcatttcaggttatatcacacatgctattcttagtgctttgggtcttgcaacgataatggcaacttctcccattttcttttatctactaaagtggctaggtgtgatttatattacctacttagcaatcaaaatgctgatatctgcctgccaaaaaggccaactcacactacatgcagataaaaaaacacatctctttcgcaagggctttttaacgagttttcttaatccgaaaggcttactcgtctatctggctattttaccaaattttatcaataaccagaatgatatcgctatgcaatctctgcttttatctgggatatttatcactatttgtctatttatctatggctttttaggtacgattttcgcttatattggtttaaaaggcggattaagtgataaaggacgccgttataatgatggcattgccggcagtttacttacctttgcagccgttaatttagcccttaattag

SEQ ID NO: 374 - DNA, 201 bp, Proteus mirabilis
tacagaaagcaattagaaaataacgatatttctcagcaactactatcagtaattgttaataatagttgtcgaatatcgttactcattcaattccaatatcagaattttgtgctgatacaagcaatttattttctaaaaatgttgttcaacactcactttctacaattttcagtaaggaatatgggtgatactttatggtaa

SEQ ID NO: 375 - DNA, 924 bp, Proteus mirabilis
agactggagcacgttatgttatcgatgaaagaaaatagcgaagctctggggaatttctcggagcagctagatgttgaaggtcgtagtttatggcaagatgcccgtcgtcgttttatgcacaataaagcggcgatcaccagcctagtactactattttgtattttactttttgtcattttcgcccccatgttatcgccttttgtttatgacgatacggattgggaaatgatgtcaatgccacctgattttgcctcagcgcactattttggcactgactcatcaggacgtgacttattagttcgtgtagcaattggtggacgtatttcactgatggtaggtattgcagcggcatttgtcgcggtgattgttggcaccctctatggcgcgatggcaggttatatcggtgggcgcgttgactcagtgatgatgcgtttactggagatattaaactccttcccatttatgttctttgttatcttactggtgaccttttttgggcaaaatatcttactgatctttgttgccatcggcatggtatcttggctcgatatggctcgtatcgtacggggacaaacacttagtttaaaacgtaaagagtttattgaagcggcgttagtctgtggtgtgtcatcacgtaatatcgtccttaaacacatcgtgcctaatgtattaggtgttgttgtggtatacgcttcattactggttcctagcatgatcttatttgaatcatttttaagtttcttaggattaggcacacaagagccattaagtagttggggagcactactgagtgatggtgcaaattcaatggaagtttctccttggttattacttttcccagctgcatttttagttgtcaccttgttttgctttaactttatcggtgatggtttacgtgacgcgttagatccgaaagatcgttaa

SEQ ID NO: 376 - DNA, 840 bp, Proteus mirabilis
ataatttttaataggaatagcataatgccattacatttttctggtaggatttttgcgtctcttttattagctgggacactattaacaggttgcgataacaatgataacaaccgttatgcaattaaagtgggggtgattaatggtgcagagcaagatgtggcagaagtcgctaaaaaagtggctaaagaaaaatatggtttagaggttgagctggtgggttttagtggctcattgttacctaacgatcccactgcaaacaaagaattagatgccaatgtgttccaacatcgccctttccttgagcaagataatcgttctcgtggttataacctcgtcgcggtaggcaatacctttgtttttcctatggcgggttattcaaccaaaattaaacatcctcaagaattaaaacccggtgatacaatagcactgcccaatgatccaaccaacttggggcgcgcattattattgctacaaaaagagaaactgatcaccttaaaccctgacagtggcctattacccacaacactcgatattattgataatccacttaaattaaatattatgcaattagaaggtgcgcaactacctcgagtattaaacgatccccaagtaacggttgcgataattagcacaacttatatccaacaaattaatttatcaccaaccaaagacagtatttttattgaagataaaagttcaccttatactaatattattgttacaagagaagataataaagaagcagagaatgtacgcgattttattaaagcctaccagtcacccgaagtggcaacagccgctgagactatttttaaaggtggtgctattcaagggtggtaa

SEQ ID NO: 377 - DNA, 555 bp, Proteus mirabilis
atggactttaaaatgaaaaaatcattattttcactattaattctatctacacttgctttatcaacacaagctattgcacaacagattcaccttggtggttataatatagatatccaaggcagagtaattgacgagaaactaacttgtgtcgttcaagatgttgctccaattcaattggatgatgcttacgttgattctttactgcttactcctgaaaaacaatttagtgtggatttttctggctgtactaatcaagaaagagcaagaaaagtcaaaatagttgttgcacgacaaaacactactcatttaatgaatactagttcgacagcaaatgataccaatgctcgagtagcattattgggttctacaggtgaacttgttccacttaatggtgagcgagaacaacgtacattttattcggatgttgccggtgatagtggtagattagtattttcattaaaatatgatagacctgaatcgattgatgctgttaccgcaggtgctttcaaggctaccttatctcttgatgcttacatcactgataatatccaataa

SEQ ID NO: 378 - DNA, 558 bp, Proteus mirabilis
atggactttaaaatgaaaaaatcattattttcactattaattctatctacactttctttatcaacacaagctattgcacaacagattcaccttggtggttataatatagatatccaaggcagagtaattgacgagaaactaacttgtgtcgttcaagatattgctccaattcaattggatgatgcttacgttgattctttactacttactcctgaaaaacgatttagtgtggatttttctggctgtactaatcaagcaagagatagaaaagtcaaagtagttgttggacaacaaaacgctactcatttaatgaatacaggttcgacagaaaatgataccaatgctcgagtagcattattgcgttctacaggtgaacttgttccacttaatggtgagcgagaacaacgtacattttcttcggaggttgccggtgaacgtggtagcttagaatttttattaaaatatgatagaccagaatcgattgatgatgctgttaccgcaggtgctttcaatgcagccttatctcttgatgcttacgtcactgatgatatccaataa

SEQ ID NO: 379 - DNA, 282 bp, Proteus mirabilis
ctaaaatttaagcaattaattaacaatcaaaacaataaacttgcatatattacgatcataaccagtgctgctactgcggtacttaaaccaaatttcagatccgtatccatctatttctccctcaaaatgattataatactcagattaaaccataatcttgtcatggttaattattattacatatcaagttttgctaaaatagcgactagagcacaatttataacattgattaatactttcacttttgagctagatcatacaaaattcacagctaatcgctaa

SEQ ID NO: 380 - DNA, 306 bp, Proteus mirabilis
tgttatattaaagactcctttctcaatacagggtgtgattgtatgaaaaagctgactcttcaagagatgacagatgcccaacagatgcgcgttagaaccagaatcggtcaagagagaaagaaattggggcgtgaattaactaacgccgaaatgaataaagtgaaagatgctattattaccgaaatctccctcgaagtagaaaaagccagcaaaaaagccctttcccagaagaaaaaacagaaattagtctctagtgatgaaacctatagctggtctgcccaaaaccatcgtcgcgggtatcgttag

SEQ ID NO: 381 - DNA, 1101 bp, Proteus mirabilis
caggatattaatctacgaatgaagccttctattgtcgctaagttggaagctctacaagagcgttatgaagaaattcaagcacttctagcagaagctgatgttattgcctctcaggagcgttttcgtgcgctttcaaaagagtatgctcaattaacggatgtcacatcttgttatcgtcaatggcgaaaagtgcaagatgatatggaagcggcagaaatgatgcttgatgatcctgaaatgaaagagatggctcaagaagagctaaaagaagcacaaagcgtcaatgaggagctagaacagcaacttcaagtactgttattacctaaagatcctgatgatgagttcaactgtttccttgaaattcgtgccggaacgggtggtgatgaagccgcacttttcgccggtgacctgttccgtatgtatagccgttatgccgaagcacgtcgttggcgtattgaagtgatgaatgcaaacgaaggcgaacatggcggttataaagagatcattgccaaagtgattggtgatggcgcttatggggtactgaaatttgaatcaggcgggcatcgtgtacaacgcgtgcctgaaacagaatctcaaggacgcattcacacttctgcttgtactgttgcggtattgcctgaagtgccagaagctgaattacccgaaattagcccaagtgatttacgtattgatacttttcgctcatcaggggcgggtggtcagcacgtaaataccacggattcggccatccgtattacgcatatcccgacgggcattgtggtagagtgtcaggatgagcgttctcaacataaaaacaaagcgaaagcgatgtcagtattaggtgcgcgtattcgtgctgccgaagtacaaaaacgtcaagaagccgaagcatctgaacgccgtaacttattaggttcaggagatcgttctgatcgtattagaacttataatttcccacaaggtcgcgtgacggatcatcgcataaaccttacgctttaccggttagatgaggtgatggaaggtaaactagatgcacttattcaacctattgtcactgaatatcaagccgatcagctatccgctttatctgagcaagattaa

SEQ ID NO: 382 - DNA, 333 bp, Proteus mirabilis
tggttaattaaaaaacatatgattaaaaaatatattgtttatataatatcatttgtctttacattctcatgttatgcttctattcaaattaataaggatagatttttttataaagaacaagataaggaaattctatttgacataagaaataaaagcgaacaaaaaacctatattattcaaagttgggtatcacactataacaaagaagataatagtgaggcaccatttatcatttctcctagtttaataagattagcacccaatgaaaattttacattaaaaaatatcaaaacggatgatataaaagaaatcaacccagaatctgtatattga

SEQ ID NO: 383 - DNA, 684 bp, Proteus mirabilis
gagaaaattaatatggtaagttttttgagaacaaagtccgctgtcttattatcaatagttatttttcctattttctttttattatcaggctgtttttcattcgggttaatgttatcaactaaaaatgataatggttatcatcgttctcattggaaaggcgattcaattaccgcactctctctagcaaaagatagtaacggtactagcggatgggtatttattggtgatcattttgattatttattaataagaggtggagataacgcagtaaatattttaagagatcctcttatccaccatgataaattgagcgtagaaaatccagttgaatttattattgataatcaaaagaagcaatttaatgggaaaattaaaataaattataactgggtaactcaaaccgataaagaagcagcactaacttacggttttatatgtaaaaaagatataaacacctgttcactaaaaatagataatttacttggaacagttcatcaaaaaaataaagaacaaaaaaatgagtatttactaccttttaaccatccctttaatgttgaattctaccaatacaaagaaaatcttattggtgccagcacaccaagaatattattacccgttactttggcgctagatatagtcacatctcctttacaattgctgatgatcccaatactaagcaagtag

SEQ ID NO: 384 - DNA, 1749 bp, Proteus mirabilis
tactttgttaaaaagaaacataatattaaccaagaagtgcgattaatcaggagtactactttggaaaaagtctggcttaaacgttatccggcagatgttccggctgaaattgacccggaccgttttgcatctcttgcagagatgcttgaaaacgctgtcgcaaattacgcagatcaacccgcctttatcaatatgggcgaggtcatgacttaccgcaaactagaagagcgtagccgtgcttttgccgcttatttgcaaaatggcttaggattgaaaaaaggtgatcgtgtcgccttaatgatgcctaacttactgcaatatcctatagcgcttttcggcattcttcgtgccggtatggtagtggttaatgtaaacccactctacacaccaagagagcttgaacatcagcttaatgatagtggcgccacagctattgtcattgtttctaactttgcccatacgctggaaaaaatcgtctttaacaccagcattaaacacgttattttaacacgtatgggagatcagctatctcgtcctaaagcgacactggttgattttgtggttaaatatatcaagcgattagtcccaaaatataatttgcctgacgcgatatcatttcgtcgagcgatgcatttaggctatcgaatgcaatatattaagccagaaattactggagatgatttagccttcttacaatatactggtggtaccacaggaattgcgaaaggcgcgatgttaactcatcgtaatatgttggctaatctagaacaagctaaagccgcttatgttcctgcacttaatgtagggaaagagctggtggtaaccgctttacccttgtatcacgtctttgctttaaccgtgaactgcttgttatttattgaagttggcgggaaaaacctactgataacgaatccacgagatgttaaaggcactattaaagagttatcgcgttatcctgtcacggcgattaccggggtaaatacactatttaatgcttggctacataatcctgagtttcgtcaacttgatttttctaagctcaacctttctgttggtggcggaatgcccgtacaaagtagtgttgcgaaagagtgggaagaattaaccggtaagcatctattagaaggttatggtttaactgagtgttcgcctttagtaacaggtaacccttataacctgaaaaaatacagtggtagtattgggcttcctgtaccttcaacggaagtaaaatttatggatgatgaaggtaatgaagtgtctcgcacagaaggcggtgaaatgtgggttcgtggccctcaggtcatgaaaggctactggaatcgccctgatgcgacagcagaagtactacatgatggatgggttgccacaggtgatattgccacaatggatgatgaaggctttatccgcatcattgaccgtaaaaaagatatgatcttggtttcaggatttaatgtctatcctaatgaagttgaagaagtggttactgcgcacccgaaagttttagaatcagcagctattggtgtaccgagtaaaagctcgggtgagactgtgaaaatctttgttgtcaaaaaagatccctcattgacagaagatgaacttaaaactcattgtcgccgttacttaacgggttataaagtacctaagattattgagtttcgagaagagctgcctaagtcaaatgttggtaaaattttacgcagagaattaagaaatgaagaaaaacagttgaaaacatcaactggatcttga

SEQ ID NO: 385 - DNA, 1440 bp, Proteus mirabilis
ttcggaactaatcaattattctgtgtacttaaggagattgaaatggcagccactcgcattgaaaaagactcaatgggacaaatcgaagtaccagctgaccagttatggggagctcaaacgcagcgttctctagaacacttccgtatttcagtagaaaaaatgcctgttgcactgatccacgcgcttgctttaaccaaaaaagccgccgccggtgtcaatatggatctcgggttattacctaaagaacgtgcagatgcaattattgctgctgctgatgaagtgctggcaggtaaacacccaactgaattcccattagcaatctggcagaccggttctggcactcaatcaaatatgaatatgaatgaagtgttagctaaccgtggtagtgagatactaggtggtatccgtggcatggaacgcaaaattcatccgaatgatgatgttaacaaaagtcaaagttcaaatgatgtgttcccaacggccatgcatgtcgctgctgttatcgcattacgtcaggatttactgccggaattaaaatcattactgaaagtatttaaagagaaagcagaagctttccatgatatcgtcaagattggtcgtactcacctgcaagatgcgacaccacttacattaggtcaagaaatctccggttgggcggcgatgcttgagcataatatcaaacatatcgaagattcagttcctcatgtgtgtgagcttgcgttgggaggaacggcggttggtacaggattaaatacacatcctgagtacgcagttcgcgttgctaaacgtatcgctgaattatcaggtcagccatttgtcacggctcctaacaaatttgaagcattagcaacctgtgatgcactggttcattctcatggtgcgttaaaaggtttagctgcctcattaatgaaaatagctaatgatgtacgttggttagcatctggccctcgttgcggtattggcgaaatttctattccagaaaatgagccaggtagctccattatgccaggtaaagtgaacccaactcagtgtgaagcgttaaccatgctgtgcgctcaagttatgggtaatgatgttgctatcaatatcggtggtgcttcaggtaactttgaactgaacgtatatcgcccaatgattattgataacttcctacaatcagtgcgtttattggctgatggtatgcgtagctttaacgagcattgtgctattggtattgaaccaaaccgtgagcgtattaataaattattacatgagtctttaatgctggttacggcattaaatacccatatcggttatgacaaagctgcagagatcgcgaagaaagctcataaagagggcttaacgctgaaagaatctgcactgaaactgaactacctgacagcagaagaatttgatagctgggtacgtccagaagatatggttggtagtatgaaaaaataa

SEQ ID NO: 386 - DNA, 1911 bp, Proteus mirabilis
aaagagactaattatttacgtaaaataaactcaattctgattaaaattgataacaaaaatttatatataggtgcgatgatggcaaatcacaaagaaacctgtctgagtgctgcagagcgtgtgtttgatacccgaaccgtggataccctaacatgttatcatcgagagatggtaaagatgttgatggatagtgagtccttttattctagtccaaataactcacagataaatactaatgagagattagagaacaaaataaaaagcaataccattgaaaataaagctgtgaagggatcttatggtgatattttaaataatttaaaccagcagctaatgaataataaacctgagattgagccttatttctcacattacaactctcccgtcatgcgattggcgaaattaggctacctttctgcactggcctataatgctgataatgtttttaacaaacattcacccatacaaaaacagcaagagcaaaaaataactcatgatttgtgtaaactaatcggttttgaaccagataaagcatttgggcatattaccaccagtcatgtttttgcttgttatgaaattttgtgggctttgagaaatttaaaaacactgccgatggcgattgcacgtcatccaaaatcaagagatctggttgcagataaaaaagcatttgagttatttaatatgtctatcactgatattttatccatcagtgaacagctatatgagcgagatatttttgatgatgtcagccatttaacttgtcgtggcaccggcatgacaagaacgatgcatttaggtaaattactagtaccgatataccgcttcgaattttggaagaaggcgatggatatcttggggttaggttatgataatctcattgccttaccaatagatgaagagtttaaaacagatatagctaaaacgcgtcatattgtgcttcgcttaatagagcagggagagccgatactcggtattattggtgtgttaggctcatcgacatacggtagcattgacaaacttaagcctcttttcgaattacgtgaagagtgtgaaaaacaacataacaactcattctatattcacattgatgcatcccaattaggctatatgaaaagcctgtttcttgacgaaaataatagcatcatcccttataacatattgtgcgataaacttaagcaagaagcacctttacttgagttaacctcagatatttatgatagttttactcagctctcaagagctgattctgtttcttttgagccatttcaagcgggattttctccttatcctacggggattgtttgtataaaagatgctcgattaagtcgttttctcgctaacccgccaaaactgtgcccagaagaggggaatattcccgatgaaattgatgggatccaatcagcacctgcggttgcatcaatgtgggggatccatcagctatatgcttttaatcattttgggtatgggcaatgcgctcaaaatcaatgggaagctagagtaaaactggaacaacaattaaaacaagagaacgaatttgaaaaatcgggtatctcttatgctattcatattttgccagtttcagattttaataaactcacttttgccattgctcttaaaggcaaccaatgtttaaaaatacaaaatcagctaaataatgctatttataaaaatttagaaataaagagccaatataagccagatctcaacctattagtgctgtgtgctcgtaatagcgatgatatacctgcacagttttgtcaacaatgtcatttaggtaaagatgaatggaagcaagttaaccacttaagtcttttacaattaacgataaaaaacactgataaatggagtgaagagcatattaaagcagggtacgactatattaaaaaagttgtcctatctgcattaaaatag

SEQ ID NO: 387 - DNA, 252 bp, Proteus mirabilis
ccatcttataaaggatatgtaatgggctatatatttctgggaataccactgacaatttttgtgttatttattcttcctatttggttatggttgcactataacagccaaaaagggggagggaaggttcagttaacccaacaagaaatgcagcgactgagcgcgctggtggataaagctcagcaaatgcaggaacgcattaagacattagaagatattcttgatgcagaacatcctaactggaggcaatcataa

SEQ ID NO: 388 - DNA, 450 bp, Proteus mirabilis
tcaccttataaaaagggctgcctatcaaataataaagcaatagagacttttgtgatctttgaaatcgccagaacaataatacattatggtttacattttttagcgccaatagcactcgcttatctattttggggtaaaaactggcggcttgctgcgcttcttatgatgagtacgatggcaatagacattgaccatttgtttgcaacgccaatctttgatcccaatcgttgcagtgttggttttcatccattgcatactctatgggctgccattgtctatatcgttttatggtttattccttcttggaaatggaaagccattgccgttgggtgcttatttcatctattaaccgattctgttgattgttatttaggtggtttaaaacctgatatggctataacaataagctgtaataaactttattcgccagaaacgccattcgaatattaa

SEQ ID NO: 389 - DNA, 714 bp, Proteus mirabilis
agccgttataagatgaataattacaaaacaaaaacggaatatgagcatactttggagtcagcaatagccgcggttggagccgctattgcggatatttccagagtaaaaatactctgtgctttgatggatggaagggcgtggacagccaccgagttgagcattgctgcggatatctccgcatctaccacaagcagccatttatcaaaattactcagtagcggccttatttctgtgagctctcgtggtaaatatcgctattttcgattagctagtgatgatatagcaaaagttattgaaaatttgatgagcttctcaacagttcatgtatcacaagcaaaaattaccacccctgaacatttaagaaaagcacgtacatgctataaccatttagccggtgaaattgccgttaaaatttatcaggtactttgccaagaagaatggataacaaaagatggaacagaaataactgaattcggagataaacgctttaaattgatgggacttaatttccaagcaaaacattcgcgcaatatttgttgtccttgtttagattggagtgaaaggcgttttcatctaggtggacaaattggcagtgcattacttaatcatgcacagacacaaggttggataaaacgccaccaaggatatagagaagtgacaattaatgaaaagggcaataaagcttttgcccaatattttaatataacaatatga

SEQ ID NO: 390 - DNA, 207 bp, Proteus mirabilis
ttttgttgtttaattactcggaggtctttgctgtccggtatcaataccaaacacttgtttaaaatcttcacgataaaggtgaaaactgtctcaaacctgcatcttttaaccacggactctaaggtgtatcggggcggtggcacagttttgttatcgctcctccgtgtaacagagcgtggcgctatttatggtcgggagaccaactaa

SEQ ID NO: 391 - DNA, 981 bp, Proteus mirabilis
gtatgtaataatatatgggtatcagttttgtgtaaactgaacaaaatatcttttcaggaaatcatcatgtcatctcagttcaatggacttatcccttccaattctttatcttcgtttaatatagaagtgattaaagaacttctgctctggatcgaggtaaatctagaaaagccgttattacttgatgatgtagcgataaaatcaggttatacaaaatggcatttgcaacgggtgtttaagcaagcaacgggcttaacattagcctcttatattcgtggtagacgactgaccaaagccgccactgaattgcgcttaactaaacttccggtattaactatcgcactacgctatcaatttgattcgcagcaatcttttacacgccgctttaaagctgtttttggcgttactccttcggaataccgtaaagttgatgtgttgtgtagcgacaattttcagccccccatcaattttgaagttaccgacctccctattccaaatattatcgagctacctgaaagctttctttatgttattcaataccaatacttttgctctatcgaggatattggcaagctacatgaagatattcgtcatcagttttggaatgattttttgttgtacacagataaaaactttacggaaagtagtgtgttaatttcttatcagccaaatacattacgtaaagataagatccagattgattatgaaattggcctaaacaatttagatcactttaccagaccccgtggttttagaaaaaaagcgattgcaggcgggcgttatgttcgtttccaatttaaaggcacgttagaagaatataaacaatttgccatcaagatctacttttatactttaccggctttggggttatgtcgtcgtttagggccagatattgaaaactacatttgtatagaaacagatagcgacattatggaactaccaaaaacactggaaattgattattacgttccaattcattaa

SEQ ID NO: 392 - DNA, 2715 bp, Proteus mirabilis
gcgggtaataaaatggaacaagctccgcagtggcaacgcccttctcctgatgatttgctggcattaacgcgagcaccccatcgaggacgattaaagatcttttttggtgcctgtgccggcgtaggtaaaacctacgccatgttacaagaagctcaacgtttacatcagcaaggtattgatgtcttagctggggttgtagaaacccatcagcgccaagaaacggcacaacaacttgagggattaccgttattaccgccattaaaattacattatcgtggtagaaagctctctgcctttaatttagatggggccttagcaagacatcctgcggtgatcttaatggatgaattggcttttagtaatccacataaatgtcgccatccaaaacgttggcaagatgttgaagagttacttgatgcgggcatcgatgttttaaccaccattaatgtacaacatattgaaagtcttaatgatattgttggtagtattactggcattcgcgttcaagagacgattcctgattatatctttgataatgccgatgaagtagttatggtcgacttaccaccagacgacctacaacagcgcttaaatgaaggcaaagtttatctggcaggacaagcagagcgtgcaatagagcatttttttcgtaaaggtaatttgattgcattacgagagcttgccctaagacgaatggcagatcgcgttgattcccaagtaaaagaattccgtgatagccaaggtggtacgcctgtttggcatactactgatagtttaatggtttgtcttggtgctcatggaagaaatgataaattagtgcgtactgctgctcgttatgctgctgcttttggttgccaatggcatgctatttatgttgaaacaccaaagctacatcagataggtgagcataaacgccgtgctattttacattccctcaagttagcacaacacctaggggcaagaacggcgatcctttctgataatcaagcggaaaaagcggtgatccgctatgccagagagcataatttaggcaaggtgattatcggtcaacgcccctatcaaaagtggcaatggttaaaacgttgggtccgtatgcgtttcgcagaaaggttagcgcgttatgcacctgacttgcatgttatcagtgtcgctttaaatgaagaagaaccgcgttataaaacaaaaacatttgtgccacaaaatgataaatggcgccaaaatcttaaaggctatctaacagctattggtttatgtctagctattacgcttttttcacgtacttttttgttagcgttagataaggcaaatttagttactctttatttattaggcgttgttcttatcgcgctattttttggtcgtcgcccttctatttttgctgctttaatcaatgtgataagttttgatttgttctttgtgcaaccgcatttttcactggctgtattagatatgcagtatttagtgactttttccgtaatgctcattgttgggttagtggtgggtaatttaactgcgggaatgcgttatcaaacccgggttgctcgttatagagaacaacgcactcgtcatttatttgaaatgacccgagagctgagtcgggcactgactttacaagaagtggtacgtactagttatcattttttatcaagtgcttttgatgccaaagtttgtttattaatgcctaatcatcatggtgaattaacgccatacaatgctgaaggtatgggacaacttcccattgatagtggtattgcccgttggtgttgggataaagatcaaatcgcaggtgcaggaacggataccctacctagtgtcccttatcagttgcaccctattagcgcatctcaacaagtattagcgattttagcgattgagccaaataatctacgccaagtacttattcctgaacaacagcaactcctacagacatttaatggcctaattgccaatgctcttgaacggttacaacaggcggaaatggccgaacaatctcgtattaatatagaacgagaacaattaagaaatgcgctcttagccgccctttctcatgatctaaaaacaccacttaccgtcctgtttggccagtctgaaattcttcttctagacttaagcgctgaaggctctgctcatactgaacaagtcagtcagatccgccaacaaattttgacgacctcccgcttagtcaacaatttgctggatatggcacgtattcaatcagggggtatccaagtcaacttgcagtggaatttactgcaagaaattgctggaagtgcagtacgttcactctcttatttacttgataaacacccattacaaattgatattccagctgatttattactctattgcgatagtctgttaattgagcgcgtgttaactaatttattagaaaatgcagtcaaatataccgtatcacaaactaaattaggcataaaagctacggttgaagaggatcaaattcatgttgaagtttgggatgaaggcgcaggtattcccactgaacaattgcagcttatttttaataaattttcacgtgcagtaaaagagtccgccattccgggggttgggctgggtcttgctatttgcagtgctattatccacttacatgaaggtaaaatttgggctgaaaataataaaaaaggtggagccagttttcactttgttttacctttaaaatcactaccgaatattgatgagattgaaataaaacagtga

SEQ ID NO: 393 - DNA, 330 bp, Proteus mirabilis
aaaggaaataatgtgaagaaagttctactttttattttggttgttctggtgctagctattgtcgtaatagccatgacgttaggttcaaataatgatcaggtgatcaccttcaattatcttattgctcaaggtgaatatcgtatctctactttattagccacgctgtttggtgttggttttgtactgggctggatcgtcagtggcgttttttacttgcgagtacgtttatcattagtaagagcaaagcgtaaaattaagcgccttgaaagtgagcaaaccaaacaagaaagccaagaaaatcgttctacagccgtttctactgtaaaataa

SEQ ID NO: 394 - DNA, 189 bp, Proteus mirabilis
ataaggaataatgagatggtattaattctgttatcgcaaaaaaaagattttgtaactgccctctcaacattaactttctatgatcagtataacttttatctatatattttaattgttccacccaattgtttatggcgtttaagtgagccgttgaagggcgacaaatggggttttcatgcaaaaatgtaa

SEQ ID NO: 395 - DNA, 420 bp, Proteus mirabilis
ctgagagataacaatatgttgaataataacaattttacaataatgtctgttgaccaatttcccattattaccatgcaggttttcccagaaacgttagagcatgctaataactggattgctgaaatggacttagtgcttgctcaaaaacaaaactttgtattggtttacccacctatcaacaagaaaaatgaacaagaggatatggagggcatgaaagccgttagacgctggctgaaaacagggaaaatgccattaagtcaatattgtgctggaatgatcatgaccgtcaatcaacaaacaaatgataaagagcaactgatgcagttatctcccgttgtttctgcggtgtacggtgtacctatctttgttgaagaaacccttgatggggcttatctcaaagccaatagtttattagcttaa

SEQ ID NO: 396 - DNA, 1044 bp, Proteus mirabilis
actatggataaaaaaattaaaaaaagcctagcacgcgtgatcaccattattgtttttttgataacgctcattttattatggcaaagtattcatatatcggcattaaatcctcttagtgaagatgccatcattgatgcaaataaaattaatatctcagcctcggtgcctggacgcattgctgctgtttatgtcaaagaaaatagtaaagtcaaaaaaggcgatttactgtttacacttgatcccacaatgtacgcactcagggtagagcaagcaaaagagcaactacagattgcacaagcgacattaagcaataagcaacgtattattattgcggaaacatccaattcagaagtggcacaagagcaaataaaacgtgcgcaggtcaatttatcattagccacacaatcattaaatcgattagaacctttattagcaaaaggctttgtcacagcacaacaagtcgatgatgctcggacgttaaaacatgatgctgaagtgacattaaaacaagcacagaaacagaatgtggcatctgaagcacttattaataataccgattcagaagaagcattagtcaaatcattaaaaacatcgcttgccatggcagagtgggagttaagtaatactgaggtaagggcgccaagtaatggatatattgccggggtcgttttatctcccggtgaatttattttatcagggcaatctgtttttaccttaattgactctgatacttggtttgcttcggcctattttaaagagacggatttaaataatataaaaattggtagctgtgtggtgatttactccatgattgataatcaacaccccattaaaggtaaagttgaagggattagtcggggagtcatgtcgaccgacctgattaatattccaagagacttaccttatgtacctaaatcattaaattgggtacgggttgagcagcgttttcctgtcaaagtcattattactgaaccaccagaagcactcatgcgcatcggtgccactgctactgtaaatattgtacctaacgatgatgactgttaa

SEQ ID NO: 397 - DNA, 1698 bp, Proteus mirabilis
tttatatgtaaattgagtaaccccgctatagatgattatttattaggagaggtacccatgaaaaagaaagttatgttaaaaatgatgtttcctgtcagcattatatcacttgcgctgacctcttttctttctcatgcggtaatacctccagaaggtactcttcttgcgaaacaacaagatattgttattaataatggcactgaagtttcctcccttgatccacataaagtggaaggggtaccagaaagtaatattattttaaatttattagaagggctcacttatatggggcctaatggcgaaagtatgccgggggttgccgctaaatgggagagctcagaagacaataaaacatggactttctatttacgcgatgatgcgaaatggagtgatggtacaccggttactgcagatgattttgtttatagttggcgtcgattaactgatccccaaactggctcgccttatgccagttatcttgaatatgcctatgtggaaaatgttgcagatattctgacaggtaagaaatccccagagagtctaggggtaaaagcaattgatccacatactttgcaagttacgctcacacaaccggttccctatctggtggatatgctaaaccacacctcattaaaaccagttaaaaaagagattgttgaaaaatatggtgtcaattggactcgcccggaaaactttgtcggtaatggggcgtatttaattgataattgggtggttaatgaaaaaatcactttaaaacgtaatccgctttattgggataacaaaaacaccattattgaacgagcgacttttttacctattagttcagaaaccagtgatattaatcgctaccgtagcggtgaagttcaaatcaccaatagcgctattcctcctacgctttatcgaaagatgaaacaagagcaaccggaggctctacatattacgccttacctatgtactttcttttatgagcttaataataaacgtccaccttttgatgatccccgtgtgcgtgaagcggtaaaattaagtttagatagagaaattatcgcggaaaagatcatggggcaagggcaaataccggcttattcttttactccaccttttattaataatggtaagtttaaaccccctaaatgggcaggttggacgcaacaacagcgtcatgaaagagcgcgtgagttattaaaagaagccggttatgacagccaaaacccattatcttttacattgttgtacaacacatccgatcagaataagcaacaagctattgctgccgcttctatgtggaaaaagaatattggtgctaatgtcactttacaaaatcaagagtggaaaacgacgttagaaaatcgtaaccaaggtaattaccaagtagcaagggcaacatggtgtgccgattacaatgaaccaacatcatttttaaactctttcctctccactagcagtctaaatactattttatatgaaaatagtgattatgatgctgcattaaagaatgcgttactggccactgataatgaagcgcgtcaccaactgtatcaacgtgctgaagccttgttagacaaggactccgctattgtaccagtctattatcgtgtgagtgtcagaatggtcagtcctaaagtgggcggatttaccggtaaagacccctttgattatacggacttaaagcgctattttataaaggcagataaataa

SEQ ID NO: 398 - DNA, 207 bp, Proteus mirabilis
aatattcgtaatatctcatcatttagtaagaaatatttaacagatgtgtcaatttttaaacctaaacagcacaagagagtttatctaaaaaaagataatttgtcaaagcgtaagttgctagaaaatagcgtctatttttttactttatgtaaaatattacttaaagtacacaatttgtctaaacccatcacctttaaaatatgttaa

SEQ ID NO: 399 - DNA, 1104 bp, Proteus mirabilis
aaaatgagtaaattaagagtcgctattatttttggtggaaaatcaaccgagcaccaagtttcattacaatcagcaaaaaatattatcaatgaattagatcgaacgaaattcgacctttgtttaattgggattaatgaacaagggcaatggcatgaatatgccgaagacaattatttaattaatagcgataacccctcaactatctcattaagccaacctttgcgtccagtggctattattcctggcagtacccgtcagcaatttatctctttaactgatgggcaacctcttgcacaaatagatgttgtatttcctattgtgcatggtgcttatggtgaagatggcaccctacaaggactattacatatgattgatatgccatatgtaggccctaatatcatgagttctgccgcatgtatggataaagatatcactaagcgcttactggatgatgcaggattagcggttgcaccatttattacactgatggctcaccaattaaatgatatttcctataatgaagttgttgaacaattagggctccctttatttattaaaccagcaaatttaggttcttctgttggtatcagcaaagtcaataatgaagccgagtttaatgctgcattatccatggcatttgaatatgaccttaaagtgattatcgaaagtgctattgttggccgtgaaatagagtgtgccgttttaggtaatgaagagcctgaagttagcccttgtggtgaaattgttttaaatgatgctttttatgcttataacacaaaatacattgatgatgatggtgcaaaagtagtagtacctgctgatttagataatgcgattagcttacatattcgccaaacggcattgaaagcttaccaagttttaaactgtttaggtatgtcgcgcgttgatgtgtttttaactgaagataatcaagtcattatcaacgaaattaatactttaccaggtttcactaatatcagtatgtatcctaaactgtggcaaagtacgggattagattatcaatcactcatcacgaaattaattgaattagcgctagaacatcataaaaaaacagccgtattaaaaactaagtgtgagctttaa

SEQ ID NO: 400 - DNA, 927 bp, Proteus mirabilis
aaaaaattcaaaggaataaatattatgtggtcagaatactcgctagaggtcgttgatgctgtcgctagaacggggagttttagctcagccgctcaagaattgcacagagtaccctccgcggtgagttacaccgtgagacaattagaagaatggcttgccgttcctttgtttgaacgccggcatcgtgatgttgaattaaccgatgcgggtaagatctttattaaagaagcccgttctgttatcaaaaaaatgaatgacactcgccatatgtgccagcaagtctcaaatggctggcgggggcagtttagcattgccgtggatggtattgtcaaaccggctagaacacagcaacttattctggacttttatcgccattttcctgatatcgaactctatgtttatcctgaagtttttaacggtgtctgggattcactagtgaacgggcgtgttgatttggctattggtgccaccagagcttcacctattggtgaacgttatagttttaaagatatgggctttatgccgtggcgatgtgtgtgtcatgctgatcatcctcttgcaagcgcggcacatccattaaccgatgatgagttacggccttatcctagtttatgtttagaagatacctcacgtagtttaccaaaacgagatacttgggcattaaataatcagcgccgaatgatagtaccttcatgggatatggggcttgagtgtttattagcaggattatgtgttggtatggtgccttggcaccgagcggagccattaatcgaacaaggtaagttggttacccttaccttagcacaacccctgccagacagtccgtgctgtctaacatgggttgataaaagcgaatcgccggcattaacttggctattagattatctaggcgatagccaaaccttaaatgaggaatggcttcgttaa

SEQ ID NO: 401 - DNA, 1077 bp, Proteus mirabilis
gaagtcatcaaaagaaaaaggtatctattttatttcttccacatgccaatattaaaaacaagcatatttacggattttattatgattagaatagtattgtttacaataatagccattatttcaaataatgcagtcgctgtgagctgtgtcagtggttgtaatgcgaatgaatattccacgcttagtggacaactatcaaagacggaaaataaagtcggtgttactaaagatgcttctgatattactttgtccaatcgaattacattaagatggaatgcgggacaagcgcaaacatgggcgacatattccaatggtaatattcctagtgcaaataccagcaataatgactggatttattctaagatagatgactatatttctgttgcgttaagaatgactaataattgtagaacaatttatgtcccttataatgtacctacgctaagctctacttgtggttcccgtacttatactgaaaacgaagaaagcgtcgtttctgtaagaaagtatcaaaccagaataaaaattgacaaggctattatttctggtacctatgtaaaaaatatttttgtaggcgaatttggtttttgccaaccacagaattgtgcgactaaacaaactatcattacaaagctatttttaaatctttcaatgacagttccacaatcttgcgttattaattcagggcaagtgttgaatattgattttgacaatattcctgcatcaagttttaaagtagcagggaaaaaagccgaaggagttaatacggtttctagaaacttaagtattcaatgtgacaatatagatgccagtgctgatttaacaatgcgattacaagcagattcagttcaaggtaatgctattgtttctaataataaaagtgttggctttgtggttgctaattcaagtggatctgaattaacacctaatgatttatcaagttttattcctttcagactcaaccaaaatgctgatgctaatgtcacgattaatgtttatcccgtaagtattgatggaaaaacaccaactgaaggcgctgtcacatcaagtggctttctaagagttgatttcccttaa

SEQ ID NO: 402 - DNA, 183 bp, Proteus mirabilis
cggttaatcaactcgctattaagtttctatctattaagtttctataatgaaaaaccgatggtgatttcaccatcggtttttttagataaatataatggcttaattacattctatcgacagtttcaatacctaaagtctctaagccttgctttaaggttcttgctgttaaacgtgctagcttaa

SEQ ID NO: 403 - DNA, 351 bp, Proteus mirabilis
tactcaatcaataatgtcattataaggagtttgataatgaaactatgggcaaaaatttctaccgtattagcggcattacttatggccatgactttatctgcatgctctccaacggcaacatcagaaggcactgggggatattttgatgactcggtgatcaccactaaagtaaaaacagctttaattggtgagaaaaacctaaactcaacacaaattagcgttgagacatttaaaggtaaagttcagttaagtggttttgtctcttcacaggctgatgcaaatcgcgccatagaaaccgcacgtaaagtcactggcgttaaaggtgtcattaactcaatggttatccgttaa

SEQ ID NO: 404 - DNA, 888 bp, Proteus mirabilis
ccgtttgccaaggcccaacctgtgacgttgcatgagttaggcttattagatgcgcaactgggtgaactctatgcaaaagctattatggaattattagcgaaagcgcgattaagtgctgctgatatcacggcgataggatgtcatggtcaaacaatttggcatgagcctgaaagtgatatcccgtttaccatgcaaattggtgataacaatagagtggctgccttgacaggaataaccactgtcggggattttcgtcgtcgtgatatggcatatggtgggcaaggtgcaccattggttcctgcatttcatcttgcagtattaggccatcctacagaaaaacgtattgtgttaaatattggtggtattgccaatatttcgctgctattacctggcgttgcagtgaaaggatatgacacaggccctggcaatatgctgttagacagttggaactgggttcataatcagacggcttatgatgataatgggcaatgggcagcaactggaaatgtgaatacccaattattacaggaaatgctggcagatccctatttttctcgttcagcgccaaaaagtacgggacgagaatattttaatactcaatggttacattatcatttggctaaagtacccaatgtatttccagaggatgtacaggcaactttagtagagctaaccgctataagtattgcacagcaagtacaactcaatggtggatgtgagcgtttattggtgtgtggtggcggagcaaaaaacggtcaaattatgcatcgtcttgctagtttattactgggtacagaagtctcgttaacggacaaatatggtcttagtggcgatgatatggaagcattagcttttgcgtggttgggccgcacgaacaatggcaaatga

SEQ ID NO: 405 - DNA, 1305 bp, Proteus mirabilis
acaaaaaacaataaaccgatggagtcattgatgtctagcaagaacctaatcacacaattgcaggagcgtgggcttatcgctcaggtcacggatgaggcagctttagtggagcgtttggagcaaggtcctatcgctctctattgtggcttcgatcctaccgctgatagcctgcacttggggcatttggttcctttgctgtgtttaaaacgattccaactagccgggcataagcctgtggcgttggtgggtggtgcaacgggtcttattggtgatcctagttttaaagccaccgagcgcaaactgaatacccaagatactgttcacgagtgggtagaaaaaattcgtaaacaagtgtcacctttcttagatttcgaccgtggtgaaaacagtgcggaattagcaaacaactatgactggtttggtcaaatggatgtgctaaccttcctgcgtgatatcggtaaacacttctctgtgaaccaaatgatcaacaaagaagcggttaaacagcgtttaaaccgtgacgatgtggggatctcttttactgaattcgcttataatctgttacaagcttatgactttgcgtcattaaacaaaaacctcggtgtcgagttacaaattggtggctcagatcagtggggtaacattacttcgggtattgatctaactcgccgtttcaaccaaaaacaagtatttggtatgacagtacctttaattaccaaatctgatggcactaaatttggtaaaacagaaggtggtgctgtttggttagatccgaagaaaacgagcccatataaattctaccaattctggatcaataccgcggatgcggatgtgtatcgcttcttaaaattcttcacttttatgagcattgaggagattaatgcactggaagaggaagataaaaacagcggtcaagcacctcgcgcccaacgtgtgttagcagaacaagttacacgtttagttcatggtgaagaaggtttaactgccgctaaacgtattaccgatagcctattttcaggagccattgcagatttaacgcaagctgatcttgaacaattagcgcaagatggtatgccaactattgagttagagaaaggcaatgatttacaacaagcactggtcaatgcagaattagttccttctcgtggtcaagctcgtacaatgattggctctaacgcagtatctattaatggcgaaaaacaggataatcctgaatacgtctttgaagaaaaagatttcttatttggtcattattccattttacgtcgcggtaaaaaacattactgccttgttatctggaaataa

SEQ ID NO: 406 - DNA, 261 bp, Proteus mirabilis
aaatcaagcaaggagagaaatgttatgaaaaaatatctatttgcagtactggctacattgttcgcatttgcacctttagccgcaaatgctggatgtgatgaagtcgttcaagatattcaacaaaaaattgaaaataatggtgttcctgcggctaactttaccctaacagtggttgaaaatgatcaagttgcacagaccgaaggtaaagttgtaggtacttgtgaaaatgattccaaaaaaatcatttatactcgccattaa

SEQ ID NO: 407 - DNA, 678 bp, Proteus mirabilis
ttcgcatgtttattagccaagaaggggcttttcatgggggcactgctggatttatccggttatattaaattttttgtcggtctttttgctattgtaaacccgatagggatcttgcctgtatttatcagtatgacgagttatcaaacggatgcaggacgtaataaaacaaacttaattgccaatggctccgttgcgattattttggttatttccctattaataggtgattcgatactgagtatttttggcatctctattgactcatttcgtatcgctggggggatgctgatagtgacaatcgcaatgaccatgataaatgggcgcttaggagaagataaacaaaataaccaagaaaaaaatgaatcagcagtacgtagcagtgttgcggtggtgcctttagcattgccattgatggcaggtcctggcgcaattagctcctgtattgtttggagttcacgttgggaaggggtgactaatttcttaggtcttgctgcgaccagtatcttttttgctttttgttgttggttactgtttcgtagtgccactttattagttaaatacttaggtcaaaccggtatcaacgttgtcacgcgtattatggggttattgttgatgtcgttaggtattgaatttattgtcactgggttacgttctatttttccgggattattagtataa

SEQ ID NO: 408 - DNA, 1053 bp, Proteus mirabilis
attatgttaaaaacagacgaattacggacaaaggctttagccagcctagtaacgccggaaacgttagctaatgagttacccatctcacaagagattatcagtaatatcacttctgcccgtcaacgcattgaagctattctcactggtgaagataaacgactattagttattattggcccttgctctatacatgatcccaaggcagctaaagagtacgcaacaaaactaaatcaacaaaaagcgcgttttcatgaccgtctagaaatcgtgatgagaacctattttgaaaaaccgcgtaccgttattggttggaaaggccttatttctgatcctttccttgataactcttgtaatgttaatgaaggcattcgtattgcaaggaaactgctaattgagatcaacgcattaggactccccacagccactgaatttcttgatatggtcacggggcaatatattgcagatttaatcagttggggggccatcggggcaagaacaacagagagtcaagttcaccgtgaaatggcctccgccctctcttgccctgtgggatttaaaaatggcactgacggtaatatacgcattgcgatagatgccattcgtgccgctcgtgccagtcacacctttttatcacctgataaaacgggacgtatgacaatttaccaaaccagcggaaatccctacggtcatattattatgcgtggcggtaaaaagcctaattatcatgccagtgatgtagcagatgctgttgatgcactgaaacaacttgatttacctgaacacttagtcatcgattttagccatggtaattgtgaaaaaattcatcgtcgccaacttgaagttgcacgcaatgtcgctcaacaaattacggatggttcacaagctattgttggtgttatggcagaaagctttttacaagagggatcacagaaagtcacagcagataaggtgctgacctatggacaatcgatcactgatccttgtctcagttgggaagataccgaacaattactggaattattagctcaagcagttgaaagtcgatttaaataa

SEQ ID NO: 409 - DNA, 567 bp, Proteus mirabilis
agtactctaaattataaagtagcaattaaaaatagaagatatgatatgaatataatgacgaaattaggcgcagcagtattgcttacatccttatccactattgctatttctgcagatataaaactaacatacggtattaatttgattgattttaacggtgatggtgtaaaagatattgtcgttaaatctaagcgtatattaaatgatgcatcatcaattaatatggtcacggtttatataaaagatgcagatgaacaagtttatattgtaccttcaatttatgataatgctcttagcttatttgataataaagctgaaaacagcgatattaaaatctctaatttcaaatttatagagaaaaaaaatcaagtgatcttagtgagcggtgagaaaataggtaatgatatgttacaatcaacgcctatacgtttttcaagttacactatcacgaaacaagataaacaatataaatgggcattttctgcatattgcgtaaccaattctacttatcttaatgttgatgatgcttttgttgatccctgcataaataaattaattcgagattga

SEQ ID NO: 410 - DNA, 1668 bp, Proteus mirabilis
ccacagctaaacaggctcttttatttggtaataggttggagaaatagactctttttctccagccttgattatctgcacaccattatttcattgcatacacgtaggagaatgagcatggcgacatctgcaacaagttctgcctcaaaacagctcacattattaggtttttttgctataactgcatccatggtgatggcggtctatgagtatccaacttttgcaacttccggctttagtctagtctttttcttattactaggcggtttgttgtggtttattcctgttgcattatgtgcagctgaaatggcaaccgttgaaggatggcaagaagggggcgtatttgcttgggtatctaatacgctaggggagcgctggggatttgcggcgatctcttttggttatttacaaatagcgattggttttattccaatgctttatttcgtattaggagcattatcttatattcttgattggcctgagttaaataccgatccgctcaccaaaacgattgccgcattagtgattttatggggattagctttaactcaatttggcggaactaaatacacggctactattgctaaattaggtttcttcgcggggatattattaccagcaatcattttagtgcttttagctattagttatctggtcagtggtgcgcctttagcaatagaaatcagcagcaaaacctttttccctgattttactcagattggtactttagtggtttttgtggcctttattttaagctatatgggcgttgaagcctcagccactcacgtcaacgaaatgaaaaatccgggccgtgattatccacttgccatgtttttattaatgattgtggcaatatgcttaagctctattggcggtttatctgttgcggcagtgatccctcataacgaaatcaacttatctgcgggggtggttgaaacctttagtgttttagtcagccattttagtagcggattagcttgggcggttaaaattattgctgcactattattgcttggcgtcttggctgaaattgcgtcgtggatcgttgggccttcacggggaatgtttgtggctgcacaacaaggtattcttccgccaacactggctaaagtaaataaaaatggtgtaccggtagctttagtgatcactcagctaattattactactattgccatagtggtgctgactaacactggtggtgggggcaatatgtcatttcttattgctttagcgctgacggtggtgatttatctatgtagctactttatgctgtttattggctatatgcatttggtttgcaagcaagctgataaaaaacgtgcatttaatattcccggtggtaaaggtgttaaattattagtggccgttgtcggtctgattgtgtctattttagcttttgttgtttcattcttcccgcctagctctttaccgggtggcagtagtgatacaacgtatgtttcattgctagtggtgagttttattattatttttgctttaccttttattatttatgcgtgctctcgcaaaggcaataaagccaatgtatcgatgatccacattaagagtcataatgcaccgaaaggacacttttttatccatcctcgtgctcgttcaacgcattatttagtgccaatagataaaacagatcatgatagtcagcaacagaaataa

SEQ ID NO: 411 - DNA, 210 bp, Proteus mirabilis
agtattataaaccttaatcgcaatagatggatactatcatgcacaataaatagcggcagggaaaagttagcagggttaaacgtaagaaatgaaatagggggattaataaaaaaagagcaggattatttctgctccttggactctgcgcttaatcatttaaggcagtcaatggattattttttctgctcttgtaaaacagaatccatttga

SEQ ID NO: 412 - DNA, 213 bp, Proteus mirabilis
tatggtataaaaggagatagagataacgctatctccttattaatcaaactagaatatttagtgtttgataataaattattttatcgatactacttgcttagtattgggatcatcagcaattgtaaaggagatgtgactatatctagcgccaaagtaacgggtaataatattcttggtgtgctggcaccaataagattttctttgtattggtag

SEQ ID NO: 413 - DNA, 1065 bp, Proteus mirabilis
gcgcaaataaaaataagattattagttggttatttaataataaatcttattaggtttaataaaagagagtataaggtagatagcactttgagaaaaatattacactatattgttttagcgttaggtttatttattattacgctaaatgtatccgcacaggcaccggaaaatttcactaaagcaaaacagctagccagagaacgcatttattatgatcaaaatcaaaacaaccaaggtacgctgtattgtggttgtcattgggagtgggtaggaaaatcggggggacgtgttaatttagccagttgtggttatcaagtgagggcacaagccacccgagcttcacgcattgaatgggaacatatcgtccctgcttgggtttttggtcatcaacgtcaatgctggcaaaatggtgggcgagctaactgtgttaaaaacgatcctatttttggcaaaattgaggctgatttacataatctagcgccttcgattggagaggtgaatggtgatcgcagtaattttagctttggtcaattatcatctcaagcgccttatcaatatggccagtgtagcagtcgggtcgattttgcttctcgcacctttgagcctcgtaatgaggtgaaaggccaagttgcacgtgtctatttctacttacatgatcgttataacctctcaatgtcacgtcaacaacaacagctttttatggcatgggataaagcttacccaccaacaccgtgggaaagagagcgagataatcgaattgctaacattgttgggcatcataatccctttgttacgggacaaatgaagtggcagttaggacataaaaatagtggtgcaggattaactgcaacatatcgtcctacaactgacaaaatagaaatgcctaaagcgcccacagtctcccaagatgagcagatcaaaggtaatctaaatagtaaaatttatcatttttcacactgtactggttatagaaccatgtcagataaaaatgcggtatattttaaaaccgaaaatgaagcaactaaagcgggttaccgattagcaaataactgtaaagcgctttag

SEQ ID NO: 414 - DNA, 288 bp, Proteus mirabilis
atggaaataaacaaggacttatatctgctggttgttcttcttatgattcaaataggaaatcgttatcaaaataatcatagtgatgaaattttagtatattcaacagattatgatattagtcgtcatcagaatatatctcacgccccttttgtttttgaaaaagctaatgataaatcctctgccttgcttttatctagtataacaaatatgaaattttggaatgtgattttaaatattatcgtatcgataaaaacggagggttattacactataaaacgatcaaattga

SEQ ID NO: 415 - DNA, 1203 bp, Proteus mirabilis
cctttgataaattcgccggtttataccggcgtttttgtctttacgaaaaagtcattagacataaaaacacaagagaaacctgttttgaattatcaatttatcacgacaaacacagcactagaagatgtctgtaaagcagcgtctgaggtatcacaaattgcattagatacagagtttgtccgtatacgcacctattacccacatttggggcttatccaaatgtacgatgggaaacagatctctcttattgatcccctgaccattactgagtggactccttttgttgaattattaactaatcccgcagtccttaaatatttgcatgctggaagtgaagatcttgaagtgttttctcatcaatttggttgtgttccgacacccatgatagacacccaagtcgtggccgcttttctgggctatcccatttcttgtggctttgcgaccttagtagaaaaatatgaacatattgctctcgataaaagtgaatcacgaacagattggctggcacgcccattaaccgaaaaacagtgccaatatgcgagtggtgatgtgttttatttgttacctctagctaagaaattaatcgcacaggcacaagaagccggttatatggacgcgattgttgatgagtgcgaaatgatagccgagcgtcgccaagagaccgtatcaccagagcttgcctatcgcgatattggtaatgcatggcaattacgaggtcaacaattggcatgcttaaaaatgttggcagaatggcgtttaaatcaagctagagcccgtgatatggcattaaattttgttgtaagggaagagcatttatggtcagtagcacgctatttaccgacctctcttgctgaattagatgcgctttctctatcggggcaagaaattcgttgtcatggccgtcgcttgttggattttgttgctaaagccaaacagatcaaagatgaagattgtcctgagcctattggcaatttaattgaacaacctaactataaaaaagcctttaaagcaataaaaacggtgatccaagaggtaagtgaagggcagcgttataaccccgagttattagcctcaagaagacaaataaaccaattgcttaatattcactggaaaattaaaacaggggagcctgaattgctttcacgctggcgtaaagcattattagcagaaaaaattactgcaattttggcgcaatatccttaa

SEQ ID NO: 416 - DNA, 1476 bp, Proteus mirabilis
atgatgataaaatcggccattaatcataaaaaatatattctatcatcgtggttaagtttattacttgttggatgtattgatactagcgattatgggaaatactcagcacaacaaccgatgccttataataatacaaactatatggcagcttctgagcaatacctcgccacacctcagcaagagcaaaccactaaaacgagctatggattggccgagcttatcgatcttggtcagcaaaataatcctgaaacacggattgcttggttattagcgaaaaaatcagccaccgatattggtatggtagaaagcacttatttgccgattattaccgcaacggcattggcaggctatcaaagaggaaaagtagatttacccgccaatccaattgttgatgatattaaaacatcaaacagtgcttttattccagcgttaacctttagatggcttatttttgacttcggcaaacgaggagctttagccgatgccgctaaacatgcttctttggcaacaaaccttaattttaatctgatgcatcaaaaaataattcatgatgtttctgttgcctattttagttatggtgcggcccttaaaaaagtcactcttacccaagaggcactgcaaagaagcaaagatattttatatgccatagagcaaaaacgtgcgcggggattagcaaccgtattagatgttgctttagccaaacaacaagttgcccaagtagaattacaacatgtgttagctaaaggtcatgaaaaagatcagtatcagttattactgtctgcaataggtgtctctccctttgaaaagataaaagtgaattatgataatgacgcgcgcttacctgatgatatttccccattgactcacgatgtgataaaaaaagcgttatcacaacgccctgatattttagctcactatgaattagagcaagcggcattaaaaacggcacgctctgttgaatctgactattttcctaaagtgtatctcgccggtgctcttgctggtggttcggggcattttgatgttcaggggttacctgaaattagccaacgaacttcatcgtcgaatattttaattggcgtgagtattcccttatatgaagggggcatgcgtcagtcgcgaatgagcaatgctcaatcagatatccaattagcacaagaaaatttgcgcaaaagtcaagatacggcaatcaaagagatctctctcagtgagaatgcgttaagatcggcccttgaagcaaacaaagcggctaaaaatctcgttgataccgcacaattaagttataccgccagtgtcgatttttttaacaatggattaggtacagtaacggagattaatactgcagaaattgcactattaaatgcgcaactctcacatatagatgcttatacaggttcattaattgccgcagtagatttagcctttgctttaggggatattgatcagggcttacctaatatacaccttgataaatag

SEQ ID NO: 417 - DNA, 210 bp, Proteus mirabilis
agcgttgtaaatcgcctacacggatcatggtatgaagtactcgcatataaacctctcgtgtttgttaaatatgacacccgacagtataaactgatggtgttgtactataacgcgttacagccctatagttcaatttacgctttattcatcagtattgtagtaaatgggcagataatatctctttttactatactctatagtaacaaataa

SEQ ID NO: 418 - DNA, 951 bp, Proteus mirabilis
ataccagtaaataaacttgttatgcaactacacactgtagtgaatatgttcggcgctgatctccagcgccgttatcatgaaaaaatccacaaaataacccttcatggtggttttagttgtcctaatcgagatggcacattaggacgaggagggtgtacattttgtaatgtctcttcttttgctgatgagcaaacacaatatcactctattgaagagcaaatcgcctaccaagctaagcatattacccgtgctcgccgttatttagcttattttcaagcctatactagtacctatgcagaagtagaacatctacgaaaaatgtatgaaagtgcattattacaagccaatatggttggattatgtgtggggacacgccctgattgtgtgcccgttagtgtgttagatctactgcaaggctattgcgaacaaggttatgaagtatggttagagttaggattacaaactgcacataataagacattaaagcatattaatcgtggtcatgattttcaatgttatcaagcaaccacaaaagaagcgcgtcgccgaggtttaaaggtgtgtacgcatcttattatcggtttacctcgtgaagatcatcagttaaatatgcaaaccttagagcaggtagtagaaaccggtgttgatggactaaaattacaccctttacacatagttgaggggagtacgatagccaaagcatggaaagcagggcgtattagtgcattaacacaacaacaatatgtttatactgctggtgaaataatccgtcatactcctgcagaagttatttatcatcgtgtttgtgccagtgccagaaaacctactttattagcccctgaatggtgtgaaaatcactggttgggtatgaatgcactctatcaatacttattagaaaaaggcgtacaaggtagtgggataaataagccttttgtggctaattgtaaataa

SEQ ID NO: 419 - DNA, 711 bp, Proteus mirabilis
tatatggtaaaaccaaaatgctacccatgcatctatatgaataagatgatagataagataaataagatgacagataagataaacagtacctatatgccttacaaacattataaaaatagcatagcaatattattcctcgcctctgccttgctacctagattttctgtggctgaatcactcactcatttacctcaaaaagatcgtatttcttattttgctcaagcggagaaaatggccatcactggtgtggcaattaaaaccaaacccgttttagccagacctgcaaaagaaggagaagtgatcaccacttacataaaaggtgaaggggttgaaactatttcggagccagccaaagcgggtgattgggttgtacaaaatatttgtccagcaacaggtaatgaagaaattctggtcagaaaagataaatttgctcagcgctataatctggctgatgcagacaaagcgaaaagcatcacaccgataaggcaaggctatcaagtttttatccctaaagggattgaaatgaattattttattgttccaaaacaaaccgctgagtttgcaatggaagcgccttggggagagctacaacgttttcaagccggtgatgcagttgtgcaatctaccaccgataaacaagatatttatcggatccaacaggccgcttttaaatgcacttatactattttaaaaaccgccaaagagatttga

SEQ ID NO: 420 - DNA, 762 bp, Proteus mirabilis
aaaggttcaaatatgctaatgacaataattaaatcacttatttttatcccttacctattattaagtggatgtggtgagtatatcaatatatatctggataataaattccccgtcaatatgaataatgatggcaaaaaaatcacggtttattcaactatttaccctgaaatggtagtgcaagtccgaggtacttatacatctaataagtgtgaacgttctcattttaattctgattataccgaagtctcttactcctctttaacacaaaaagtagaggtagagcgtaaaatagcagaggataataaaaccgcgacctatatcgtgcctattgatggagggggatggtgtaattggaagttagtaaaaatagaattatcaccagtttctaccattcacaaaagatatatgcgaattagtgaagttattccaatcaccgatgataagcattcaaaaatagaactatttaccacattagcccctattatagtagaaggcaagaatgagcaatccatctattattcaccatcaagcacggaaggtgaacgaaagttatccaataaatcagatggagaaatctattttaattataaagttgaacctaaactaaccacgactatctcaaaagatgaaaaagttatttatcctaatgggagcattaaagatccaaccttttctatttatactggaatgattagttttaatgaaataatcgagaatagtgatgaaaaagcgtttacttcttttgttagatatattgattga

SEQ ID NO: 421 - DNA, 1608 bp, Proteus mirabilis
tatcttacaaatatacagaaaaatcaaagctgtatattttgctggaatatgattatgtttaaaaacatcagtatagaaaaaaccgttaaagttatgctggctattttatttgtacttattatgagcattatttactttagttatgatgcttcaacacgatcttatcataactttgtttcatcaaataacttaagtcagcaaatgttgctgatgggaaaagcgcgttatcaaatggcggtgatcagagcgaatattaatggcttggatgggcagttaagagtgaatgaaaaaccttctgctaaataccttcatcaaactcaagaatatataaaaatcactcgtgaagagatccaccgttgggcggatgctgaaaagttaaccatggaagggcgtcaggttgctgatgatatgacgaaacgctttgatgagcttttagatatatttaccgatgccttagctaaattacgtaaaggacaattgactacgcactctgctagtcaaaaaatggatgaactcaacgagatcaccatgacatattatgccgtcgccaatggtattgagaataattatattgatattgcgaaaacctcacaacagcgcattatgctaatggcgttagtcacagcgattattgtcattatgctctttatcattatcttacgttggttctctcatagctttatcggcaatattaaagtgcttattaatatttttagtaaaatgagccaaggcgatttaagtatgcgagtagaaaatcacggtaacaatgaatttggtaagctatttaatgaaatgaataaaatgaaagtttcattaagtcaaatgattgcttcggtaaaaaatgcagtaaacaccattagcgtcagtgcaagtgaaatagcaacaggtaatactgacctctcctcacgtactgaagagcaggctagtgcgctacaacaaaccgttgcaagcatggagcaaatcaaaaccacggttgaaaaaaatgctgataactcacgccaagctagccagttggcattaagagcgacaacgtcagcacaaaacggcgaaaaggtgatggataatgttatcgaaaccatgtcgtcgatttctgaaagtgcaaagaagatctcagatattaatgacatcattaacagtattgccaatcaaaccaatattctctcattgaatgccgcggttgaagcggctagagcgggtgaacaaggtcgcggatttaccgttgttgcagccgaagtgcgtaacttagccagtcgtagtgcagaggcagccaaagagataaatgaacttattacccattcggtaaataaagtacaggttggatcacaacaagtgagcgaagcaggacgctccatgtcggaaattgtgaccaccattagccaagttaatgattttatgcaacagattgccttagcctctaatgaacaaagtatggggattaatcaaattgctatggccgtaagtgagatggataccgtgactcaacaaaatgcagcacttgtggaagagtctgccactattactgccaatatggatgatgaagctcatcagcttgccaacttagtctctcaatttaaagtagatgagaaagaaaatactaggcaggcataa

SEQ ID NO: 422 - DNA, 300 bp, Proteus mirabilis
atctgtacaaaggaggttgctatggctcaagcactagtagaaaacagtgaacgagtgtcaattcgtatcactacagaagataaatcactgctggttcgtgctgctagtttggaaaatacaaacttaacagagtttgtacttcgtaatattgtacctgtggctcggcaagttattgaaaataatgagcgtttaaaattatcagaaaaagacacattacgtgttatggaacttttagataatccaccaaagcctaatgctaaactacttgcagcggcttttgctctaccggacaatgcatga

SEQ ID NO: 423 - DNA, 735 bp, Proteus mirabilis
ataaggacaaatagattgaataagcaaatatcagtattgatgcttttaggaagtggattgcttttgattgtacctattgtggtgcttattctgggatggcaatggcaaccatcagcacatcctctgggaggcgaaagcactttatggatagccaatagtgcggctaaaccttggggagctttaactatattactttgccttgttttgctcttttttattcttaaactacctaaaaaagcatttattcagttggcaattattatggtcgcgactttggtgttggggcagttgatcaaagtggttgtaaaaaatagcgttaaagagccacgaccttatgtggtttgggtcagtaaccaactatcaatatcaccagaacatttttaccaagtgtctcgtcctgagcgtgagcaactgttgcataatggattatctcattcgtcgctgatccctcaatggcaattaagccattggcgagcagaaaccggttatgcctttccttctggacacagcttattctccgcaacactagctttatttgtgtttgtgctgtgtatgttacgacgccactattttttagccagcttagggatattatggggtattgatgtgactgtcggacgaataatattaggtatgcactgggcatctgatgtgattgtcggtattctgattagtgctgtgttggtgtggtgtgcattttggatgattgaacgacgattgttgttaaaaccttga

SEQ ID NO: 424 - DNA, 2658 bp, Proteus mirabilis
tgtgatcaaaaggaaaatgaggtgttgttaaagaaaacaatcaaatggacagggatgatactactgggtgtcggcgcagttagcacgaccttgtggctcaccattccacgttggttacctgttgtggctaaaacctatttacctgaaggtgtttcactctctttaacacaacctaggttacaacaatggggtgtttttattgatgatatcgcattaaaaagtgatagctgtaccttggctaatgtgcagcaatttacgtttaactatcaaaaacagcaaattgatagcctatcatttaatagtcaacaacttactattaacgaagggtgtttttcacaattatcttttgcagataaaaaagagaccgcaacagttcctctcgatattcatgcgttattagctactattcctcacttatcggttgatatcaatcatgtttctttaatggataatcagcgctataacggccattttcagcttaaaagtgatacaaatgggcgattaatcagctatcagggagataatacgcagatacaagcgctgatccgtgataatcaatggttagatattaaacaattaaagattaatttacctgacgataatcagatagagctggcggctgaaatagcgttaccccttaatgttgattcattaccagaaaatggttctatcagcacaacattgttaacatcccattatgcttacccattagtctttattgctcaatggcaagggaatagcggtactatttctattgctgaacaaggtggagggcaagcgttagctgtgttgccttggaatgtaactgcagaaaatatcacgatagaaaaagggcgttgggaatggtttgggtttgatcaacccttacgtggtggtgtgaatatcaacattgcccagtggcagcaaggattaacgggattacgcttaactgcgcgcttaaatgttatgacgcaagggcatgcaggaaaagggaatttagtgataacgatacctgaaacggcgattaactggttagatgctgatatacctattcaattgacaggcattgtaaataaagatctcatgcaagccagtgcacaacttcccgttaaagtgactggtatgttgacagatcctactatcgaatttcagcccggttcactattacgctttaaagggcaactaacagaaacgctgacggtaaaagatgctcgtttaccactggctggctcaacattatcttccaaaggatttaatggtcacctaaatgcgattgtgttagctgaagatactatttggggagattatcgggtccattttgctggacgttcgaccgatttcttacctgatcagggcaattggcaatggcgttattggggagagggcaatttattgccattaaaagcgcgttgggatatcgctggaactggctcttgggtagataacatggtgagttttgagacattaaataccggatttgatgttttaacttatcagcataccagtatgttagcccccagattgacgctcttaacgccatttcgttggttaagagacgataaaaacccattatttgaaggaaaattgaagttaaccagtcaacgaatcgattttcctgcggggggattcttagatagagctgactttattgccagtgtaaaaggtcaatctccttttcgttttaatatgaaaggcgagctcaatgccaagccaactattggaccgataacgattaatacacgttgggatggtgaaaggctaagagggcagatgcgttggcctgcacaaccaatcaatgcctttcaatctttattgccagaaaaattaggtatcacattagataatggcgaattttatacacaagctgacttttctattgcccctcaacaaggtttagttgctggtggacatttagtagttaagcaaggcagcatgtggctaaaagatggcgtattagaaggactcgattttattttaccttggcgtttaaacggtgatgaatggcaactaggtgtgaagcagccagtgcaattacggattaagcgcgtcaataatttatttgaaatgacagacattaccgccgatctgcaaggattttaccctattacagaagcaaaacctttagttttatctaatgtcaaggttgccatgcttgatggcactatttctatggcaaaattagcattaccacagcatgaagcggcgattatctcattagataatctagagttaagtcggcttttcactttattgaaggtgacccaatttgccgcatcaggtaaagtaagtggcgaattacctttctttatcaataacaatcagtggatagtgaaagatgggtggctggctaattcatcgtacttaaccctcaggcttgataaagattttgttgactctattgatgatagcaatatgacagccggtgtcgctatggcatggttacgatatttagagattagccgctcttggacgcgggttaatttaagcaacctaggtgaattagtgcttgaagcggaaatccaagggaaaaatccattggaagacaaacggcgacaagtaaatcttaattatcgccatcaagaaaatatttttcagttatggcgcagcttgcgatttggttcgcaattggaagagtggttagaaaagagcctatccgatttagggagtgagtcagaatga

SEQ ID NO: 425 - DNA, 471 bp, Proteus mirabilis
ttaattaaaaaacataagattaaaatttggcaaaaacaccatcaaaatgacctcattaccctacgtgatctggcaaaagatcccattcccgttttagatcaagccatattatttgattttggcaaagatacggctatatataatttctccatcttctctcagttaaaacattctattgattttattgcgcgtgcaggcgaaacttttaaatatactgaaacagggtcagtcggattacttgaagataagcaagttattgtattaacgagtcgtggtgggatccataaaggacaaccctctgatttaatcattccatatctaacacaatttttatcatttattggtattaataatgtacagtttattctcaccgaggatactgcgctaggcgaagaatatgcacaacagtcacatgttcaagcacaaaaagaaataaatttaattatcaataaagaaataatgataaaataa

SEQ ID NO: 426 - DNA, 450 bp, Proteus mirabilis
caattaaaaaagaggttattcatggcaattgcggctttgcctgatgaagcaaaattattacgcaatttttctcgttgtcaggattgggagcaacgctatctctatatgatggagctaggagaacgcttaccaccattaacagatgaacaaagaacggcggctaattttattgaaggttgtcagagccaagtctggatagcggttgaattagatgagcataaacagctgatcttagccggtgatagcgatgcgggtattgttaaaggattagtggcattagtgattattctttttcaaggtaaaacggtagagcaagctctcgccactgatgttaaccactatttctcgacattagcactggaaagtcatttgacgccatctcgtactcaagggttacacgctatggtaacacggttaatgaaacgcttttcggaatacactgtagcataa

SEQ ID NO: 427 - DNA, 2451 bp, Proteus mirabilis
tgtatgaaaaacatcaaagagatgacgttactttccacccccctatctcgccgacgctttgtcaaagtgggagccgctggtggattagttgcaacggcaggtggattatctctcccctttagccaagccatggcttcggagcaaacagcgccgacatcttctaccaataaagaaaaagtcgtctggagtgcatgtaccgtcaattgcggtagtcgttgtccattgcgtatgcatgtcgttgatggcgaaattaagtacgttgaaacagacaataccggcaatgacgtttacgacgagttccatcaagtacgagcttgcttacgtggtcgctctatgcgtcgacgtgtttataatccagatcgcttacgttatcccatgaaacgcgtaggtaaacgtggtgaaggtaaatttgaacgtatctcttgggatgaagcctttgatactatttccgacaccatgaaacgcctgataaaagattatggcaatgaatctatttatctaaattacggtacaggtaccctcggtggcaccatgacaaaatcttggccaccaggagcaacccttattgcccgtttaatgaattgctgtggtggttatctcaaccattatggcgattatagtactgcgcagatcgcggcaggcttaaattacacctacgggggatgggctgacggcaatagtccttcagacatcgaaaatactaaattggttgttatgtttggtaataatcccggcgaaacacgtatgagtggcggtggtgtaacttattatgttgagcaaactcgtgaaaaatcagatgctcgcatgataattattgatcctcgctatactgatacgggtgcaggtcgtgaggatgagtggatccccattcgtccaggtactgatgcagccttagttaatgcgttagcttatgtcatgatcaaagaagatttagtcgataaacccttcttagataaatactgcgtaggttacgacgaaaccacgatgccagaaggggcacctaaaaacgcccactataaagcctatattttaggtgatggcgcagatggtcaacccaaaaccccagaatgggcagcacaaattaccggcattcccgcggcacgtattgttaaattagcccgtgaaatcgccggtgctaagccggcttatattactcaaggttggggcccacaacgccgttcaaatggcgaattagcctctcgcgctattgcaatgctcgctatcttaacaggtaatgtgggaataaacgggggtaatactggtgcccgtgaaggctcttacagcattccttttgtccgtatgccaaccttaactaaccctgtcacgaccagtatttctatgtttatgtggacagatgccattttacgtggccctgaaatgaccgctacacgtgatggcgtgcgaggtaaagataaactggatgtacctattaaaatggtctggaactatgcggggaactgcttagttaaccaacattcagaaataaaccgtactcatgaaatcctacaagacgataaaaaatgcgaaatgattgtggttatcgataatcatatgaccgcatcggcaaaatatgcagatatcttactgccagattgcacggcatcagagcaaatggatttctgtatggatgcttctgcggggaatatggcttacgtgattttcgctgaccaagcgattaagccacgttttgaaagtcgcaatatctatgagatgaccagcgaaattgctaaacgtatgggggtgggtgagaaatttaccgaaaatcgtacccaagaagagtggttacgccatctttatgagcaatctcgtcaaaatttaccagaactgcctacctttgaagaatttcgggcacaaggtatctttaaaaaacgtgatccacaaggccatcatgtggcttaccgtgaattccgcgctgatccactcaacaatccactgacaacgccgtcaggaaaaattgaaatttattcttcgcaattagctgaaattaaagcgacatgggaattagcggcagacgatgtgattgatccactaccaatctactccgcaggttttgaaagctatggcgaccctgctatggataaatacccattacaaatgacgggttttcactataaagctcgtacccactcaacttatggcaacgtagatgtattaaaagcggcttgtccacaagaaatttggataaaccctgttgatgctacaaaacgtggtatcaaacacggcgatttagttcgtatttataacgatcgcggtgaagtacgtatcaacgctaaagtgacaccacgtattttgccgggcgttgtgggattaagtgaaggggcttggtataacccagacagtaaccgtattgatcatgcaggttgcattaacgtgttaacgacccaacgcccttcaccacttgctaagggtaatccttctcacagtaatcttgttgaagtcgtcaaggcgtaa

SEQ ID NO: 428 - DNA, 645 bp, Proteus mirabilis
ataatgaaaaaactttctgcgcttattctagcggctgcaacacttgcaccgtctatttcttttgctcatcaagcgggtgattttttattccgtgcgggtactgcaacagttcgtcctaatacaggttcagatactatattaggtgggcattttgatgctaataacaacactcaattaggtttaacctttggttatatggtaactgataatattggggttgagttattagcagcaacaccttttgagcataaagtttctttaactggtgtgggcgaaattgctaaagttaaacatttaccaccaacattaatggcacagtattactttggtggtgctgaagataaattacgcccttatttaggtgctggtctaaactttacgaccttctttgatgaaaaattcaataataatccagcggtaggcaaacttggattaaatgatcttgatcttaaaaactcttggggctttgcagcacaagcaggtttagactataacctagataaaaactggatgctgaacgcttctgtttggtggatgaatatcgaaaccgatgtcaaatttaaagatggcgatggaaaccactataaagtggatactcgcttagacccatttgtgtttatgttcggtgttggttatcgtttctaa

SEQ ID NO: 429 - DNA, 1503 bp, Proteus mirabilis
atagagaaaaacagtatggatatatttattagcgcattagcttatattgattacacgacaatacttgttgtcatcggcgcttgcttatttggtttatttgttggagcaattccggggttaacatcaaccatggcaattgctttaatggtgccttttactttctttcttgatccaattcctgcattagcactgatgatctccgtaggtgcatcctcgatatttgccggcgatattccaggggcattattaaatattcccggaacacccgcctctgcagcttatactaacgatgcccatacattggttaaagaaggtaaaactaatcgtgtattagggatgtcattaacaagctccgttattggtggggtgatcggcacaattattttagcgtcaaccgctccgttgttagccgagtttgcacttaaatttagctcttacgaatatatgtggcttactttaattggattaagctgcgccactattgtttctggcgctcaaattagaaaaagtttgctagcactgtttttcggtattgctttagccactattggctacgatgaatttacaggacaagcccgttttacctttggtgaagtctctttaatgcaaggtgttagttttattcccgccatgatagggctatttgctatctctggtgcgattaaatattacgtcgatcgctggaaagaaaagcaaattaaattagcagttaatacagataatagctcatataatatttttaaaggggtgggaaaggttgtttgccaacgtaaagggggcattttccgtagtggtattattggtacattgataggtgctttacccggtgctggtgccgatatcgctgcgtggatctcttatgcggtatctaaaaaattatcaaaaaaaccgcaaaagtatgggcaaggctcagaagaaggtattgttgatgcatcagcaagtaataatgctagtttagcagggagttggataccttcattggtttttggtattcccggtgattctgcggcagctattatcattggtgtattgtatatgaaagatatgcaacctggaccaactctctttttatttaatccagataaactgtacgccgtttttatcattttctttattgcgaatttaatcttattacctatagcttttattgttgttaattttttaaagaaaattgttgctattgataatgcaattctttatccagcaattattttatttagtattgtcggttcatttgctattaccaatacgatgtcatccattgtggttatgatggtgatgggagttatcggctattttcttcaacagcgtaactttcctatctcaccgattatattagggatgattttagggccgatgctagagaagaatttactttcttcgttgatgaaatcggacggagagctaattaattttgttaatagacctatttcaattgtattagccagtgttttcctattaattgtcgctatgcaaattaggagcgcatttaaaaccaaataa

SEQ ID NO: 430 - DNA, 1101 bp, Proteus mirabilis
gtggaagaaaaccccttccagaaggaagaaaaagcaggtttagtctattctcgttttaaccaacctaatagtgagatcgttgaggatagattagcagtttatgaaaacacagcatcatgtgtcctcttttcatcaggaatgtcagctattacaacgacattaatggcttttacacaacctggcgatgttattttacattctcaaccactttatggtggaacagaaacattaatagccaaaacattcgctaagttcggtattcaagcaacaccatttacagatggtttaaatttagcagatatccaatcgcaagctgaaatagctagccaaaaagggagagtcgcggtgatatttgccgaaactcctgccaatccaactaattcactggttgatattcaagcgttaaaaatcgttgcggataaattagaaacaagccaaggctatcgacctattattatttgcgataacaccttattaggacctgtttatcaacatcctatagagcaaggcgctgatatttcactctattcattaacaaaatatgtgggtggacattctgatttagtcgccggtgctgcaatgggatcacgcgagcttattaatcaagttcgcctattaagaggtgcaatagggacacaacttgatgcgcattcttgctggatgttaggccgctctttagaaacattgcaaattcgcatggaaaaagccaatcaaaatgcgctattagttgcccaatttctacgtgaccatgaaaaagttaaagtgatccactatttaccttttgtagatgaaaatagtattgaaggtcaagtatttgctagacaatgcacaggcgcgggatcaacattctcctttgatattgttggtggtgaagcagaagcttttcgttttctcaatgcgatgaaaatatttaaattagcggtgagtttgggaggaaccgagtcattggcatgtcatcctggctctaccacacattcaggtgttcctatggaattacgccacaatataggtattcaagaaacaaccattcgtttatctattggtattgaaaatccttatgatcttattgctgatttatctcaagcattagatcatgtttaa

SEQ ID NO: 431 - DNA, 192 bp, Proteus mirabilis
aaacctcgaaattcttcgaggttttcttttttcatgaataagttgtactgttcacagatttacaaaagcctattttatttgccagatttgcgtttgctaaattcttataacgccttattatctaatgttagtgaggatatttcttatcttcacgggtatcaccactcattgatagggagttatttaagatga

SEQ ID NO: 432 - DNA, 1137 bp, Proteus mirabilis
ttaacgcccctgagtgggtgcacggatttgtggcgcaaggcgttaacatttcccctgtgcatttattccgctcaaggatacctgtgttattgcacccgtaactatgatgtttacaaaccctatgttgataaacacgttctttacaggtcaacaatatctctctctggacgcaagcctgaggtttttctcgtgcccgatatgaagctttttgctggtaacgcaaccccggaactggctcaacgtgttgccaatcgactctatactagcttaggagacgctgctgtaggtcgttttagcgacggtgaagtcagtgtgcaaatcaacgaaaacgtacgtggtggtgatgtttttatcattcaatcaacctgcgcaccaactaatgataacttaatggaattagtggtcatggttgatgcattacgtcgagcttccgctggtcgtatcactgctgttattccttacttcggctatgcccgtcaggatcgccgtgttcgttcagcccgtgttcctatcacggctaaagttgttgcggatttcttatctagtgtaggcgtagaccgtgttttaacctgcgacttacatgcagaacaaatccaagggttctttgatgtaccggttgacaatgtcttcggcagcccgatccttttagaagatatgcttcaaaaagaattggacaaccctattgttgtttctccagatattggcggtgttgttcgcgctcgtgctatcgctaaacttctgaatgatactgatatggcaattattgataaacgtcgccctcgtgctaacgtttctcaagttatgcatattatcggtgacgttgctaatcgcgactgtatccttgttgacgatatgatcgatacaggtggtacattatgtaaagcagcagaagcgctgaaagaacgtggtgctaaacgtgtatttgcttacgcgactcaccctattttctctggtaatgctgttgagaacatcagaagctctgttattgatgaagtggttgtctgcgatacaattccattgtcagcagaaatcaaagcattaaataaagtccgctcattgaccttgtctggtatgttggctgaagccattcgtcgtatcagtaatgaagagtcaatttctgcgatgttcgaacattaa

SEQ ID NO: 433 - DNA, 420 bp, Proteus mirabilis
tataaaagaaatcaacccagaatctgtatattgagtaaatataaagtagttccaggtatagatgatgagatggctgataaaaacttgcttcttatctctttaaactcaatatataatcttttctatacacctagcaatattattaacaaaagtgataataaagatattaatttttttattaatgatgaaaattttattaaaataaacaaccccactccttattttattaccatagcagaagcaaaggtagataacattgatatattaaatgagcgaataaccctatcgccatttaaaaattacagtataaaaaataaaaaaataactaaaaatattaaagataaaaaagtacattggaagagagtcgatgagtatgagcagactatcattgcaaccccaaaggaacttatttatgagtaa

SEQ ID NO: 434 - DNA, 1929 bp, Proteus mirabilis
caaggaagaaaaatgacatttagatatgataaatataatgatccttattgccccgattgtgctaaacataatgcttggatagaaatcttactggtagatgaattgaacaatcctatttcggatatgccctatacactgactgtctctgggggagaaaaaagaacaggtaaaacagatcgtaatgggattgttagagaaacagatttaccgccaacaggggggcgcttttctattaatgcacaaatgctggctgatgaaatggaaaaacgtcctttaagagtacgcagaaattgttcttccaaaattcgctatgatgcaacgcaacgtaatgataattaccgctatttaactattggtgatttatgtgatgcggcgcctaaaattttaaaatgggatcaaccagagttacctaaatatcattttaaaaaacagcaactcaatggatatatggtaatatttcgtaatcaacgttgggtttttgaagtatgttcatttagagcctggtcattcttattacatcatcagaaagattactcaattactaatgcctgtaatttaagtatattatctgtattgtcttatgcgagctttaaagctaataatgacaaggagcctaatgcaggaaattatttaggctcaattgaggacgttttttttaaccaactctttgacttatccaaaattccacagcaatttgagacaaaatcttttaccccgataatatacgatgttccgtttagtgaacgctatacagatgttgaatttattgattcagctaagaatttagatacccaaatgttttatatcgcaaataataaggaagttattgttgtttggcgaggaacggcaggaaaaactgatatatttacagatataaaatttaaaccagttaaactgcaacaggatatgggaatagaaggttatgtgcactctggtttttataattcatttaggattatggataatgattatgatttaaggccaaaaataaatgtaaataataacttaggggataataacccattaagtttaatcaaaggtttagcttcagagcgaaaattatttatcgcagggcatagtctagggggggcattagctttattacataccataaaattaagagaatataatccagtgctttatactattggtatgcctcgagtattaaccctttctattacagagcaattgggagatattattcaccatcgtcatgtcaatgaagacgatccagtaccagcccttccttttgaaaaagatatgaataatatcgcttttataagtgatcatgattggttagggtattctatagaaattgcaataacatatatagacttgaaacatcaaggtatggcgagtaaagctattgatcaattgaaaacaaatttcaatataaaaagtgatacatttattcaccatggtgatgctgtgcatttttacaaaccaacatcaaaaacatctatgtataaatacgtgttggcaagtgttggatatgcaccaagtcttttggtaaatatggaaatagataaaaaacgttatctcgtctctgatactgatgaaaagctctatctcgtttctgaattactacccgatcatcggcttaaacaagaattttttgaactttataaattacccaaaacagcatcacctggtgtaactggtggtggagaccactcaagtggtaaatatacaaactttattatttctaaaataattagtttagttaaatataaaggattaacagaatctgcatataatattagagcagaattgatcaatcaaaaaagactatcacaagccaaatacgacgaaagcagctatttgctagacttagatcttatggtcgcagatacattattacccacattacttatgccagaaggtataacggcgctgaaaaggttcaaatatgctaatgacaataattaa

SEQ ID NO: 435 - DNA, 1083 bp, Proteus mirabilis
cgtaagagaaaaataatgaaagttcattatgctgtaggtaaatatataatttctatatttattctattactgcttgttatcaccaccctattattttttacaagccatattcaagactttgactatgaaaacaaagatcaagaagaattaagttttttatctcaaggaaaccggctatcaggaactcttcttactcctcaacataagactctgtcagcggttatcgttgttattcatggtgatgggcctcaagatcgttattcaaatggtggctacaaccctctgttcaatacatttttggatgcaaatatcgcgatattctcgtgggataaagcaggcattggtgatagtcaaggaaactggctacatcaatcaatggaagctcgcgctgaagaagcggtagcagcattaaaattaatgcaacttcgttatcccgaagttcaagtaggttttttagggttttctcaagccggatgggttattcctatcgccgctagtcaatcacaaccagctttttctgtgattattggtggtgctgtcaattggcgagaacaaggacaatattatcaaaaattgcgttatgaacagcaaggaaaaacaccggatgaaattatacaattgctggcaaaagaacaaaaagaaaatgatgatatttttggactacatggtacaaaagatcgcactcgtcgcaatgatatgagtgaagatcgatttaattttgttgttaaaaattacttaagtgattcatcaagttatttaagaaaaatgaatggtcgtatattagcggtatggggaaataatgacttaaacgttaatgctcagcttaatgcttgtcgctatcgtgcaatattaaatactcatcatcaagctgatattgttgttttccctcatgctagtcatggattactccgtgtgccagaatttaattaccaattagaaagtgattggccaatataccgtcaattacaatttctgtgggctggccgtaaagcttacactgaaggttcgttaccacttattatcgattggataaaaaataaaaatccggatttctctccctataatatggattgtaatttatga

SEQ ID NO: 436 - DNA, 519 bp, Proteus mirabilis
caaaggagaaacaacatggcacatcaagtgactttacaaggtaatgcggtgactttagctggaaatttccccactgtaggccaaaaggcagccgatttttctttagtgggtaaagatctaaatgatgtttctttagcgcaatttgccggcaaacgtaaagtattaaatattttcccaagtgtagatactggtgtttgtgcagcgagtgttcgccaatttaataaagtcgccaacgaattaaataataccgttgtactgtgtatttcagcagatttaccttttgctcaagcgcgtttttgcggtgctgaaggtttagataatgttgtcacattatcaacaatgcgtggtgcggaatttaaagaaaactatggtgtcgcgattacgtcaggtcctttagcgggattaactagccgtgctgtgattgtacttgatgaaagtaacaacgttatctacacccaattagttgatgaaatcaccactgaacctaattatgacgcagcattagctgtactaaaataa

SEQ ID NO: 437 - DNA, 327 bp, Proteus mirabilis
aacagcggaaaaactagcagaaagacaagggcttttaaaatgaatgatgaactaatttttcaattacaaaattggtataaatctaaatgtaatggtctttgggagcatgaatacggattagatatcagtacgttggataatccaggatggaaagtgcatattaatggtgaaaataagaaaaaaaaatcaaatattattattaataataatgatgatgattggttaaatataataacaagtgatatagagtttaaaggttatggaagcccacagaatttaaatactattttaaatcatgccattaaatggctaaatgatcctcaataa

SEQ ID NO: 438 - DNA, 789 bp, Proteus mirabilis
gttattttgaaaagttggcacgcaaattgtattaactatagcaactgggcgttattgttaataacgctatttaatcaacactcaaggctattatttatcatagctattaaggataacatcatgggtatattttcacgttttgctgatattattaatgccaacatcgcttctttgctggataaagcagaagatcctgaaaaaatgatccgcttaatgatccaagaaatggaagacatgttagttgagatcagaacaacttctgcacgcacgctagcagagaaaaaaagcttagagcgtcgtattgagcaagcagaaaaacaaattaaagattggcaagataaagcggaactcgcgctgattaaagataaagaagatttagcacgtgcggcgttaattgaaaaacaacgtgttgcttcaatgtgcgataccttaaaacacgaactaattatcattgatgaaacattagatcgccttaaaggtgaaatcagtgaattagaaaataaactgacagaaacgcgtgctaaacagcaatcgttagtggttcgccaccaagctgcaaactcttcacgtcaggttcgtcgtcaattagatagcggtaaaatggatgcggcaatggcgcgctttgaacaatttgagcgtcgaattgatcatatggaaggcgaagcgcaaagctatggattaggtaaagaaaaatcattagaacaacagtttgctgagctgaaagccgatgatgaaattagcgcgcaattagcggcattaaaagctaaaatcaatactaataaagagtaa

SEQ ID NO: 439 - DNA, 240 bp, Proteus mirabilis
agagtattgaagatggtggtgggagaaggattcgaaccttcgaagtctgtgacggcagatttacagtctgctccctttggccgcttgggtatcccaccaacattaaattgtcttgctgtccgtgacagcgggcgcaataataccaaatacctgagatgtgtaaagtgctattttaagaaaaagcgatcaactgctgtaaaaatatccgctttgcttaactgttgtgctatatcgtattga

SEQ ID NO: 440 - DNA, 495 bp, Proteus mirabilis
aaaggattgaatatgaaaactaaaatagtttatcaatggaaggaaaaaagacgggatagactctcttttttaggggcagaagtggttttttctgtgttatttggtattgtaaacggtttaatatatatgttatttatgaccttgttacctgattccgttgagaatgatcctgataaattatttttctaccaattctcttttagttcttatggtatagtcgaattcatattattaatagcacaaatctacgtatttgcacttattttaactcaacgagtaagagattttggtttcaaatatcctatcactattgcactgatctttaccattggcaccatggtccttacgccatatccattacttatttcttcagatacaatggtgatagtgcgttttattttattattaggatacgttattgcattattattaccatcttcgaataatgttgagtgtaataacgatgaaaataataagataaccatactaaaatag

SEQ ID NO: 441 - DNA, 777 bp, Proteus mirabilis
attattatgaacgaacatacaatcagtaatgaatctcttattttttctctattactggtcttagtcgctatatttattagccgaaaagagaaactttcattagagaaagatattatttggagtaccgcccgagcgataattcaactctttattgttggctacgtattaacttatattttcgacgtcgaccatattatccttacatttctaatggtcttatttatctgttataacgctgcctataatgctaaaaaacgcagtaaatacgttaaagatatttttattatctcgtttgtcgctattaccacaggggcattgctcaccttaagtattttactttttactcatgctattgcctttacccctatccaaattattcctattaccggtatgatcgcggggaatgcaatgattgcgaccggactttgttataatcagcttgggcaacgttttgaaaatcatcaacaacagatccaagaaatgttaagtttgggggcaacccctaaaattgcttcaatggctattattcgagatagtattaaatcgtcgttaattccgaccgttgacgcagccaagacagtggggattgtaagcttacctggaatgatgtctggattaatttttgccggtgttgatccactacaagcggttaaataccaaattatggtcacctttatgttgatggcaaccgccagtatttcaacaattattgcttgctatttaacctataagaaattctttaatcaacgccatcaattaatgacgtttaatcaataa

SEQ ID NO: 442 - DNA, 1176 bp, Proteus mirabilis
tctaatatgaaaaaagataaatattttcgtatcgtgctgttattcaacgctaataaagtctatgaccgacaagttgttgaaggggtaggtgaatacttgcaggcgtcacagtgccattgggatgtatttattgaagaagatttccgcactcgccttgataatattaatcattgggtttgtgacggcattattgcagactttgacgatcccattattactcaacatttaagccaatcacccttatctgttattggtgtcggtggctcttatcatcaagcaaaagattatccttctgtgccgtatattgctactgataattaccaattgattcatcaagcttttttacatttaaagcaaaaagggcttaaacattttgctttttatggattaccggcaaaaaactacccgcattggtctaatgagagagaatatgcattccggcaattagttactcgcgaaaaataccctggcatcatttataacggtatggatatcacacaagagaattggcaacatgcacagaatcgtttatctgactggatacaaacgttgccaccacaaactggtattattgccgtcaccgatgccagagcgcgtcatttactgcaagtctgtgataacttaaatattaatgtgcctgaagaaatcagtattataggcattgatgatgaagatatgacacgttatttatcacgtatagcgttatcttctgtagtacaaggttcacgacaaatgggatatttagccgcgaagcttctgcatcaaatattagaagggcatccaaccgaacaactaccaagaatattagttcctccagtaaaaatcattgaacgtcgctcaacagactttcattcatttagtgatcctaccgttgtacaagcaatgcactatatttattacaatgcttgtaaaggaataaaaactgagcaagtgttagacgctgtaaatatgtcgcgttctaatttagaacagcgttttaagaaagaagtagggaagacaatccatgccgtgatttatgaagagaagctgaaaagggcgaaaaacttattagccacaacaacattatcaatacaagagatttctttgatgtgtggctatccgtcgttacaatatttttactctatttttaaaaaagagtttggcatgacaccaaaggattttagagatgagaattaa

SEQ ID NO: 443 - DNA, 1419 bp, Proteus mirabilis
actgccatgaaaaagacaaaaattgtttgcaccatcgggccaaaaaccgaatctgaagaaaaactgactcaattactggacgcaggcatgaacgtaatgcgtctgaacttctctcacggtgactatgaagagcatggcaaccgtatcaaaaacctgcgtaatgtctgcgcaaaaacaggcaaaaaagcagccattttattagatactaaaggacctgagatccgcaccattaaattagaaggtggtaacgatgtctctttagttgcaggtcagacttttacctttacaacagatacttctgttgttggtaataaagatcgcgttgcggtcacttatgacggtttcgcaagagacttaactgtcggcaataccgtattagtcgatgacggccttatcggtatgaaagtcattaaagtcactgatactgaagtggtatgtgaagtacttaacaacggtgatttaggcgaaaataaaggcgttaacttaccaggtgtttctatcggcttaccggcattagcagaaaaagataaacaagatcttatctttggttgcgaacaaggcgttgactttgttgccgcttcttttattcgtaaacgttcagatgttgaagagatgcgtgctcacttaaaagcacacggtggcgaaaacatcatgatcatctctaaaattgaaaaccaagaaggtttaaataactttgacgaaattttagaagcctctgacggtatcatggttgcacgtggtgacttaggtgttgagatccctgttgaagaagttatctttgcacaaaaaatgatgatcgaaaaatgtaacgctgcgcgtaaagtggttatcactgcaacacagatgttagattccatgatcaaaaatccacgccctactcgtgcagaagctggtgacgttgccaatgctattttagatggtactgatgctgttatgctatccggtgaaagtgcgaaaggtaaatatccagtagaagctgtgactattatggcgactatctgtgatcgtactgatcgcatcatgaaatcacgtttagagtcttaccaattaggtgctaaattacgtgtaacagaagctgtttgtcgtggtgctgtagaaatggcggagaaattagatgctcctcttatcgttgtagcaacttatggcggtaaatcagcgcgctctatccgtaaatatttcccaacagcgcctatcttagcattaacaaataatgaagagaccgcacgccaattactgttagtaaaaggtgtaacaacacaattagttaataaaattgcttctactgatgacttctaccgtatcggtaaagatgcagcattatcaagtggcttagcccatgcaggtgatcgtgttgttatggttacaggtgcactggttgatagtggaacgacaaatacttcatcagtacacgttctgtaa

SEQ ID NO: 444 - DNA, 300 bp, Proteus mirabilis
agtttaatgaaaatgatttgtgcaatttaccgtagtaccaagcgtgatcaaacttatttatacatcgaaaaaaaagatgatttctctcgaattcctgaggaattattacaaagttttggtgaaccacagtttgcaatgttgctagatctcgcgcaaagacagcgtttagcgaatgcagacatagaaaaagtcaaacaagcgttgactgaccaaggtttttatctacaagtgccacctcccgtcgaaagtatgttaaatgcttatttagatgaattaaaaaattcagaaaaaactgaataa

SEQ ID NO: 445 - DNA, 1482 bp, Proteus mirabilis
attacaatgaaaacgcaaacgataaataatccgagaacccctacacttatcgagtcactgtttcctatatttacaatggtggtgctattaggcggaggttacgccgcttttgatttacctcccgaaccactaatggtgttatcaaccgtcgtcgcggcattattagttaaacgattaggctatcgttacgacgaaatcttaacggctatctcacaaaaaatagccaaaacgatgccggctttgctgatcttaattagcgttggtttattaatcgggacatggatggtgggaggaaccattccactaatgatctactatggattaaagatgatcagtcctgaaatgctatatgttacagcactgctagtgacatcattagtatcagtttgtactggtacttcatggggctcggcgggcactattggcgtcgcttttatgggcgttgctgtcggtatggaggctaatcttgcagcaactgcgggtgccgttgttgctggtgcttactttggtgacaaactctcaccgctatcaggggatactaacctcgctgcaatggcggccagaatagatctttatcaacatatctgtcacctgctttataccacattaccttccttgatcctcacagcgattatcatgactgtttatggtatgaatggcgatttagcaggacaaggagtgcctgaaaaagtcaccttaattaccaatgggttggagaatatttatcacttcaacttgatcctgcttattcctgtattagtcattttatatggttcggtcacgaaaaaaccgactattccagttatgctagcctctgccgctattgcgatgttgaatgcttatcttattcaaggatttggcttacatgatatcgtaaaaagtgccgttgatggctttaatgtctccatgatccaaggtaaagaagtacctgaattattaggtaatttattaaatcgtggtggtatgaactccatgatgagcaccctacttatctgtttctgcgcactctcctttgcggggactctatctttaagcggtgcattagaagtgatagttcatgcactgctaaaaatggtgcattcaacgggatcgatgatcttagcgaccattgcctgtggactgaccatgattggtgttacttgcaatggacaaatctctattcttattcctatcgaaatgttacgtggtgcgtatattgaacgcggtttacaccctaaaaaccttgctcgtactgttgaagattccgccactatttttgagcctatcttaccttggactgctgccggtgcttatatggcgggcacattaggtgttgcaaccctaagttatttaccttgggctgtattgtgctggagtggcatcttctttgccatgttatggggtttcaccggttttggcattgctaaattaacaccagaagagcaggaagaaatgactgctgagcttggatcacattcagaattacaacttgatactaaataa

SEQ ID NO: 446 - DNA, 1053 bp, Proteus mirabilis
actaaaatgaatgagccattaaaatcacgtattgattttaaacaatcaaccttacaaaacgaagaaattagcttaaaaaaagggcttgatttcaatcaagatgaacaatttgttccctacaatccgcaattagaggcacaggaaaatgaagggcgtttagaaggtgagatccaatcggccctaaagcctagaaaaagtttatggaaacgcttaataacagtggcgagtactattttaggtgttagtgttattgctcaagcgggacagtggatctatcaatcatggataaattctgattggattgctttaggcgcagccagtgcgggaggattaattgttattgcgggtatgggatcggtaattactgagtggcgtcgtatttatcgtttacgccaacgggctgacgagcgtgataaagcgagagaattactctatagtcatgcaatagggaatggtcgccctttttgtgaagatttagccaaacaagcaggtattaattcacaacatcctgcttatattcgttggcaaagtacattacatgatacgcataacgatagagaaattttagaattatatagccaattagtacaaccgattttagataagcaagcacgagctgaaattagtcgttctgcagcggaatcaacccttatgattgcagtaagtccattagcaatggtggatatggcgtttattggttggagaaatattcggttaattaatcgtattgcacaaatatatggtattgaacttggttactatagccgactaaagctatttcgcttggtactcgtcaatattgcgtttgctggggcgactgaattagtgagagaagtgggaatggattggctttcacaagatttggctgctcggttatccacgcgtgctgctcaaggtattggcgctggattattaactgcccgattgggaattaaagcaatggagttatgccgtccattaccctggattgataataagcctaaattgagtgactttagaaaagagcttattggtcaattaaaaaatacattaggtaataagaagaaagagtga

SEQ ID NO: 447 - DNA, 1002 bp, Proteus mirabilis
ggagtgacgaaaaccatgtcttggtggcaaaagctaaaaattgactcttttttaatgattatgatcttggtggtcatactcgcaacattattacctgcgcaaggtgagataaaagtcatctttcaacatctcactacggcagcgatcgccttattgttttttttgcatggggcaaagctttctagagaagcgatattgtcaggacttggtcattggcgcttacatttagtggtttttgccagtacttttgttttattcccattactagggttgggactacagtttatggtacctgactggatgtcacctaccgtttatatgggatttttatatctttgtgctttacctgcgacagtacaatccgctattgcctttacttctgttgccggtggtaatgtagcagcggcaatctgtagtgcatcagcatcaagcattttaggggtatttttatcccctgtgctggtgggttttttaatggaaacacaaggctctgctgagcattttgatactgcgggggcgatacaatctattttattacaactgatggtgccttttattatcggtcatttatctcgtccattaattggccgttgggttgataatcataagatgttagtgaatagaaccgatcgctcttctattttgctggtggtttatgttgcatttagtgaagccgtcgttgaaggtatttggcataaaattgacggttggtcgttattgactatcaccattgtcagttgtgtattactggctattgtacttgttattaatatttatagtgcaagatggcttggctttaataaagctgatgaaatcacgattgtattttgtggctcgaaaaagagcttggcgaatggggttcccatggcaaatgtactatttcccgcagcaacggtggggatcatgctattaccgctgatgctatttcatcaaattcaattaatggtttgtgccatattagctcagcgttatgccaatcaagctaaaaaacaccatcagtag

SEQ ID NO: 448 - DNA, 1341 bp, Proteus mirabilis
ggaattaagaacgtgcagcagaagacgagatccattgcacaggtatatttaaatttacccttaccacataaaattatgcttggttcgttaactgcagcaacactggctgtcgcaatatggcggccagttgtgcttcacaccgaacaaagcagagaagttcctatcagtattcagactcccctaacaacccaaggggaaaacaccgacgatattatcaccgacagtagtgatcagctaacagatgaaggacttgtaggtgctgatgatggtgtcgatactagcaccgcagtggcacaggttcctcatacttatattgtctccagtggagattcattaagttcgatattaacgcaatttggtatcgactcagccgatattgcaacgctctccaatcaaaataaagatctcagaaaccttaaaataggccaaccaataagttggaaacttgatgatgatggtttattgcaagagttaagttggggcgtttctcgccgagaaactcgtgtttatacgcgtacggaaacaggttttactgaagcgaaagagttccaaaaaggcgaatggaaaaatagtgtgaccacaggggttatccgtggtagtttctctgcaagtgcaacaaatgctggcttaactaacgcagaagctcgcgcagtgactaaagctttgcaatggcaattagactttagaaaattacaaagtggtgataaattttcagcccttttttctcgtgaagtcttagatggtcgtaccgaacagagcgaacttattggtgtgcggttacgaagtggtggtaaagattactatgctgttcttgctgaagatggccgctactatgatagccaagcaggtggtttagaacgtggttttatgcgttttccaacggtaaaacagtttagagtctcttctcaatttaatcctcgccgtatcaatcctgtcacaggccgtgttgcaccgcataaaggggttgattttgccatgcctgttggtacgcctgttttagctacgggagatggtgaagtcattgtctctaaatacagtggtgcagcaggtaattttattgctatccgtcatggtagccaatataccactcgttatatgcacttacgccaactgttagtcaaaccgggacaacgtgtaaaacgaggtgatcgcattgcactatccggaaatacagggcgctccacagggccacacttacattatgaattatggatcaaccaacaagcggttaatccattaacagctaaattaccccgtgcagatggcctaacaggcaaagagaagcgtgaatacttagctaaagtaaaagagatcatgcctcaattaacgttagataattga

SEQ ID NO: 449 - DNA, 204 bp, Proteus mirabilis
agagataagaagcaagtttttatcagccatctcatcatctatacctggaactactttatatttactcaatatacagattctgggttgatttcttttatatcatccgttttgatattttttaatgtaaaattttcattgggtgctaatcttattaaactaggagaaatgataaatggtgcctcactattatcttctttgttatag

SEQ ID NO: 450 - DNA, 885 bp, Proteus mirabilis
ttaaaaaagaaaggagttgaaatgaaacggatattagtcgcgggagcaacaggatatttgggtggttttttaattcaagaattaaaaaaacaaggatattgggtacgtgttttagttagaaatcatcaacaagcgacaaagtttgcggatgttgatgacatattcatcggcgagatcacaaaaccagagcaactttctttgattgctcaaaatattgattgcgtgatatcaacggtagggatcactcggcaaaaagaagggttaacctatatggatgtggattatcaggcaaatgccaatttattagaagaagcgattaaatcgaaggttaataaatttatttatatctcggctattgatggcgaaacacaccgaaatctaaagatttttcaagcaaaggagcgctttgttgataaattaaaacaagccaatttagcatactgtattgtaagacctaatggctattttagcgatatgggggattttttacagatggcagcatcgggtaaagtttatttatttggtgatggcgaacaaaaaataaatcctatctctggaaaagatttagcgcaatttattgtcgagaaaatgacaaccaatataaatgaattcactgtaggtggaccggatattctatctttgaatcaaatatgtgaactcgcaggaagcgcattagataaaaaaattaaaataatccatttacccgatacgttaagaaaaataactatttttacgttacgtcattttacgagccaaaaattttatgggccattagagttttttttaacttttatggcaaacagtcatattggtatgtgttatgggcatgatcatttatcaaattattatattgaattagctgatccgacatataagagaaaatag

SEQ ID NO: 451 - DNA, 2412 bp, Proteus mirabilis
ttatgtgagaatgatatgtctataaaaaaacaagaaaaaaggcttgctaaccaagaggggatgccattaacgcgtcgtcattttgtacaagccagtgcagcattagtgagtatgccttttttcgcacaaaatgcacaggccaatcttgataaaagcctacctattgccaacattgatgagaaacctgctactgtcgtcgcaacatgcagcacctttgactgtggtggtaaatgtgatatccgagctcatgttaaagagggaattgttacccgtattaccacaagaccagatgctgatttagatgaacaaatgccgataatgagagcctgcgtaagaggtagaggttatcgtaaattcacttatcatgcggatagacttaaatatcccatgaaacgtgtgggtaagcgcggtgaaggcaaatttgagcgtatctcttgggatgaagcaacctctttaattgctgagaatgtaacacgattaactcaacagcatggtgcagcaagtcgttttcttacggtaaataccgccgtcactggggggatcttctctggtgatactatgatgaaaaaactctttaatctcacaggaggatatcttccttattatcactcagtgagcttagggaataccgctaaagtcacaccttatacttatggcgtatctaaaacaggaagttctcttgatactttagcggatacgcctttagttattttgtggggacataatcccaacgaaaccatttttggtcacaccaatcactattttcaaaaaatgaaaaataatgggaccaaatttattgttgtcgatcctcgttattcagatacagcccaatctttagctgatcaatggatcccattacttcctaccacagataatgcactgatggatgcaatgatgtatgtcattgtgaccgaaaatttacatgataaagcgtttatcgataaatatgtggtaggttttgatgaagatcatatgcctgaaggggtgccagctaacgaatcattaatggcttatttattagggaaaaaagacggtatagcgaaaaccccagaatgggcgacaaaaatcacacgagtcccagccaatactatccgtcaattagcacgtgaatatgcgatgacaaaacccgcggccttaattcaaggttgggggccacaacgtcatatttgtggtgaacgtaccgcccgtggttcaacgttattagcagcaattactgggaatgtgggtaaaaaaggcgcttgggcggctggatatggcggaattggtaaccgtcaatctattcgtggtcctaatattggcaaaaatccggtaactgcacaaatatccattatgaattggatgcaagctgttgaggatgcgagcaaagtgacgccagaagatggccttattggcgtcgataaacttgatagtaatatcaaaatgatcttttctttagcgggtaactatcttgtcaatcaaaaccctgatgttaatgcggcagctaagttacttgaagatgaatctaaagtagagtttatcgttgttagtgatctatatatgtctccgtcagccaaatacgcagacttagttttaccagaaacgagctttttagagcgttggaatatcggtaatacatggggaacgggcaactatttcttactgtcagaaaaagtcgttgaacctgcttttgaaagacgttctgattatgaatggatcagcgatgttgctgagaaaatgggagtcaaagaggcttttaccgaaggacgaacagaaaaagagtggatagcttatctcgttaatactaacaaagaacgctttaaagatagacctgatttcccaacttttgatgaattactcaagactcgccgctatcttttcaaagatgcaccttttgttgcatttgaagaaaatattcgtgatctagaaaatcatcctttcccaactccatcaggaaaaattgaaattttctctaaacgtctctatgacatgaataatgtcgatattcctgcattatctcattatgttcctgcaattgaaggtccagaagataaattgaccgagaaatatccactacaaatgttaacttggaaaggaaaaaatagagctaattcaacgcaatatgctaacccttggttacaagaggtacaacgccaagaaatgtggataaaccctattgatgcacaaaatagaggcatcaaaaatggcgatatggtgcgtatctataacgacagagggatcacccaaatacccgctttagttaccgagcgaattattcctggtgtggttggtttacaggcgggggcttggtggtctcctgataaagacggtgttgatcatggtgggtgccctaacgttttgacatcaacacgtatgacaccattagcccatggtaattcacatttaaccgttttagttgaggtaaccaaagcatga

SEQ ID NO: 452 - DNA, 315 bp, Proteus mirabilis
tctatacggaaattgattgatatggttctaaaaaagagatgttttagacaaattgctcctgcgcttattttttctttactaacaattggtactttctcggctaatgcgaatatcgatgttcgcgatgaaaccttatttgaagcacatcagcgttttaaaacacaaattataaatgatagttttgacaatactgaagcaccttgggaagcgccagcagaaatattcaatgtagttaaatatccggccaaactaggtgatatgtatgcttatttaacccctccgccggcgaataaaaaaataaactacctgcggtga

SEQ ID NO: 453 - DNA, 1413 bp, Proteus mirabilis
tcatgcaggaacttatctttgaataaaaaacttggtttaatgtcactaacagcgttagtgctaagctcaatggttggtgcaggtgtattcagtttacctcagaatatggctgaggttgcaagccctgcggcactgattatcggttggataataacaggggttggcatcctttttctcgccctatcattgttattgctttctcgcttaagacctgatcttgatggcggtatttttacctatgcgaaagaaggatttggtgaatttattggcttttgttctgcttggggctattgggtctgtgcggtagttgccaatgtctcttatttagtcatcgttttcgctgctgtgagttttttcaccgatagccctaataatattatttttggtgatggtaatacatggcaggcattgctgggtgaatcaatcttactttgggttgtgcactttttagttctacgaggtgtacaaacagccgctagtatcaatttaatggccacgatggcaaaattaataccattggggttatttattattgttgccctacttgcctttaatatggatatttttacctttgatttcgaagggataaaaatgggcgtgcccgtttgggaacaagtaaaaaataccatgttaattactttatgggtatttattggtattgaaggggccgttgtcgtatctgcaagagcaaaaaatagaagagatgttggtttagcgacaatatttgcggttgtgatcgcgctgattatttatattctcgttaccctattatctcaaggattagttagccaaccagagcttgctatgataaaaaacccatctatggcacctttactggttcaactaattggaaatataggtgagatagttattgccgccggccttattctatcggtatgtggcgcttatttaagctggacaattatggctgctgaagtcccttatattgccgcattacaccactcttttcccaaacaactgagtaaacaaaatcacaatgatgcgccttcctcttccttgtggtttactaatttagctgttcaattatcactagtattaatttggcttactggtagtaattacaataccctactgaccatcgcgtcagaaatgatcctcgttccttatttcctggttggtgctttcttatttaaagttgccatagaacgcagtagccgaggattattactgatagcaatacctgcaagcctctatggtttatggttactttatgcatcaggtgtaattaatttattactttccgtcgttctctatgcacccggtgtattaatatttttatattcacgaaaacaatataaagataaacagtcattaaatactagtgaaaaaatactactgatgatggtattaattggcgcaattcctgcttgtggctatttagtatttaattaa

SEQ ID NO: 454 - DNA, 201 bp, Proteus mirabilis
ttgctagggaaagaatcaggacgtatacttctaactttagtgctattaggtatgtcaaagctacaacttattggcgctggtaaactacctcttctattatcagataaagcaataaaagggaagtatagtaatagtagaggaattaaaaatgttatatttattgatttcatagaaacaccttacataaatattcaagaataa

SEQ ID NO: 455 - DNA, 1872 bp, Proteus mirabilis
atattgtacctaacgatgatgactgttaaatcttcgctgatagcaaaacaagtcaaacaagatttattaccttttgactatcggttcgccactacgtggcgcatagcgttactgtgtgccttaatggccgtgatcgctatggtttatgaaatccctgaatcagcaatcagctgttatttaattatctatttgattaaagcggatgcagtacaaaatatattactctcccttggggtcattattttatgctccattgtggttggtgtggcgttagtactgtttaatctcactattcaaaatattattttacgcttcttttttatggcttttttctcagccatttttatgtatttagcttcagcaagtagtcttggtgatataggcaatttagttgctttggtgatcgcctttttaatgacgctaattgaagatatcccatttggtgatgctgcaaccagaggattgctttatgcgttattaatggccgtttcgccgatgctattggtgattatattcaattatttttttggtattagcccacggaaattactgcttaataaaatttcaacgcgctttatggcagcccatgattttttcttagggaaaaaaactaaccagataacgctgagtgaaatactaggaacacaagcagaatgccaacgttatttgatggttatgaaaatcctttatctattaggtaaagaagatatccaatggttagaaaacatggttgataactcctatgcaatattagttatgtcaataacaatggatgacaatacctcaacatcgttacgttttatgttagcgaaaagatgtaaatatattgcggactgttttgccaaccactcgttagataacattaaagatagtgtgcaacgtcttcagccaataaatagaatcgctttattggctaaatttaatactattttgctaacaaaacgaaccactaaacccattaaaaaagccacacccttttttgtaagcgatgcatttagtaatcctaatcataaatacttcgctattaaaacaactcttgccgctattttatgttatttgttttatgattattttaaatggcaaggtatccatacagcgatgatcacttgctatgtggttgcacttacttcagtgggcgaaacggttcataaacttacactaagaataatagggtgtctgattggcgcattaattggcatgatctcactgctttatattattcctaatatttctgatatttttcagttgatggtattgatcttcttctgtcttttacctgcagcctgggttgccgccggtaatgaacgtatctcttatgctggcgtacaagtaggtttagcctttttgctaacgacactacatggctttaaaccgagttttgatatggatgtggtttccgaccgtattttgggtattttattaggcaatattgttatgtatgtcatttttactcgagtctggcccgcgagtatcgtcaatacaatatacaaacagctcgccacgattttagatgactatacaaagttaagatgctctgccaataaaagtgagtgtttagatttagtcgcctctattaatgagactattgcacaatctaaagataatattgatttactgctgtttgagagaaaagataaagaaagaaacaaagtattcaccttgttttttaaacagtcattaagcaagatttcttacatcagtcgtcatagttatgctgataggtttatttttgatgataatggtgagtattccgatacactgcctttatctccagatgattttaagaaaaatgtcttaactgaagaaataaaaatgttgcccatcaatgaaagagaacaagtatttaaacagttaataagagaaaatagatga

SEQ ID NO: 456 - DNA, 630 bp, Proteus mirabilis
caaggccaccttatgaaaaataccattgtaaaagatctgaaaacactggaagagatttatggtcaacctgccgaaccatcggtcttaaaagaagtggattttattcaccccctttatcgcccttatattgaagctacaccatttgttgcattagccacttatagtgctgatggtatggatgtttctcctcgtggcgatgagcccggttttattcatattgaagacgatcatactttattattacccgatagacgtggtaataaccgcattgatagcatgcgcaatttgttaattaatcccgcgattgctttattagtgctagtccccggcattaatgaaacattacgaattaatggtcatgcggaaattttaatagatgaagaaacactcgcacgctttaaatataacaatgcactacctcgctcagtcttgcgcatccatgttgagcgcgtatttttccaatgtggtagggcacttattcgttcaggtttgtgggaaaacaaatatttagctgataaatcaactattccagcaccgggacaaatattgaaatccatttctcatcaacaatttgatggtgataaatatgatgcacaattgcctgaacgtattatgaaaacattatattaa

SEQ ID NO: 457 - DNA, 192 bp, Proteus mirabilis
gatcattttgatgatgtttttgccaattttctattagatagtccgccattttattgctgtgtgagtaattttctaaaatactggattttagtacaagaagcttgttcattttattctctcggtaaatatctgttatgtttatatagacaaaattttatcttatctgaaaaatttcacaccataatcgtttga

SEQ ID NO: 458 - DNA, 657 bp, Proteus mirabilis
agctttattgaatgcacctgctcactgtgcattttggagagtgtgatgatgactaatattacactcgataatataaaacttgctgtacaacgtatcgcgattgcctgtgaacagtctcaaaatagactatgtgaagcagatagccaacttggtgacggtgatttaggggtaaccatgcaaaaaggatggcgacaaattgctaacgatgcccaagattggcctgacgatttaagcaaagcgctttttcaatgcagtaaatcattacaaaaagcctgtgcgtcttcttttggtactttgcaagcaacggcttttatggcaatggccaaatattgcaaagaaaaccacctgcaagaaatagcgcttactgatatttccccactattgacggtcgcataccaaagcatgatggcgagaggaaaaggggaattagggcaaaagtcagtattagatattctttatcatttatctgaagatctagcgtcaatctcatctctgactgaactaaaacccaccgctttaaaaagtattaataatacgctaaatgaatttcgccctaagcctaatttattgggacgtgcccgtatgttcccagaaaaatcgataggattagacgatcccggaatgttagcgattaacgttattgttgaagcaatttga

SEQ ID NO: 459 - DNA, 915 bp, Proteus mirabilis
aagtttattgataatggacttcatccagcatacataaatgtaggaactaaaatggaaaagagacattatcaacttattgaacaagcctgccgttttattgaagaaaatcagggtgatgtttctcttgccgacatcgccgcacatattcaatccagcccatattatttccatcgacgatttaaatctataatgggaattacacctaaagagtatgcgaatgcttatcggcacaaactaattaagaaagcattagctggcgataaaacaattacagatgcgatatatcaatcaggctttaatgcgaatagccgattttatgaaaatgcgacagccatattaggtatgacgccaacccattggcgcaatggtggacaaaatatcgtgattttttttgctgtagggatctgctcattaggccatatccttgtagctcaaagtgaaaagggcatttgtgcgataacacttggcgatgatcctgcgtgtttattagaagaattacaaaaacaatttcctcaagctgaacttgttggtgcaaaccaagagtttgaaaaattggttgcccaagtcattggttttgttgaactgccaacacaacctttggcattaccacttgatattcaaggaacagtatttcaacaaaaagtttggcgggcattattagatattccttttggttgtaccatgacatatcaagaaattgctcaaaaaattggttcgccaaaatcttatcgagcagtggcgaatgcctgtgcatcaaataaactagcagtggcgatcccttgccatcgagttatcagacaaaatggtgaaatatctggatatcgttgggggattgagcgcaaagaaaaattattacaaagagaaaaatcccttcatcatcagcatgatagattggctattagcaagagcgattaa

SEQ ID NO: 460 - DNA, 1005 bp, Proteus mirabilis
cacgtgattgacacacagttgcctttaaccgatttgcaccgccatttagatggaaatatccgtccggaaacaattttagatttagcacaacaacataatattgccctacctgcctatgagctagaaacattgcgcccacatgtgcagataactaaaaatgagcctagcttagtgagcttcttacaaaagttagattggggcgttgctgtactcgccgatttagacgcttgtcgccgtgttgcttatgagaacgtcgtcgatgttgctaatgcaggtattgattacgcagaattacgcttttcaccttactatatggccatgaagcatcaattaccgattgaaggtgttgttgaagcaattattgatggtgtacaaagtgccttacacacttatgatgttgagatccgtttaatcggcatcttaagccgtacttttggtgaaaatgcctgccagcaagaattaaatggtctattaaaacatcaagataaaatcaccgcacttgatttagctggcgatgaattaggtttccctgggcatttattccagcctcactttaatcgtgctcgtgatacaggctggaagatcaccgttcatgcaggtgaagcagctggtgctgaaagtatttggcacgcgattaaagaattaggggcaagtcgtattggtcacggtgttaaagccattgaagatccccgtttgatggattatctcgcagagcaccaaattggtattgaatcttgcttaacctcaaatattcaaaccagtactattgcctctttagcacaacatcctcttaagaagttcttagagcacggtattatcgcctcgctcaatactgacgatccggccgtggaaggtattgagttaaaacatgagtatactgttgctgctccagcggcgggtttaactgcagcacaaattcgccaagcacaaattaatggtcttactatggcttttattagccaagctgaacgtgatgcattaattaaaaaagtgagtttaggttaa

SEQ ID NO: 461 - DNA, 336 bp, Proteus mirabilis
caagtgcttttaaagatatcattgcttaataaagatactaacttcatttctactctacattcagtacagagtaacatttcaataggtatcgaaacgtttattattttccttgttatcctgcttattcttaacaaggagaataaaatgatcgctgttatctttgaagttcaaatagccacaagtaagcaggggcaatatttatctttagcatctcaactaagaccattactaaacaacattgatggatttatatctatcgagcgctttcaaagcctagcgacggaaggaaagctattatcgctttcttggtggaaaaatgaagatgctatactgtaa

SEQ ID NO: 462 - DNA, 375 bp, Proteus mirabilis
ccgggcactgagcgtttgatcatatcaggaaacacttcagcgactttttcatcaaagcgccagtcaccaagattagcaataggtgtcgcaaataagttgtcttgtggtgctgattttgaattagacataactaaaatagacttaaagaataaaagaagcgggtattctaccagaagcgacgttgctcacaaagttgcattatttagaaataaattagaaaaacaggtaaaccttttcgataccttgccgttattagactcaacagcaaggatgtctattgtgatcatggatgatcatattttccttgtggtattaatagtagaaggaaaaaatttgtatccaaggaaggaagtaaatattagcaaggatcattaa

SEQ ID NO: 463 - DNA, 435 bp, Proteus mirabilis
attcgccgtttttttagttttggcaatggagaaaagatggttagctcgctttatatcgtattgggcgcactattattgattaaattgtccctaaatgttgtaaaacttagaacacaatatcgagttgcatacggtgatggtggtttttatgagttacaaaccgctattcgcgtccatggtaatgcagtggaatacatccctatttctatgattttattacttatcatggaaatgaatggcgcctttgtttggatggtacatatttgtggctccattttaatagccggtcgtcttcttcactcttacgggttgaaacaccgcgagatacgctggcgtcgctctggtatggccgcaacctatttatcaatggtcttaatgatccttgctaatatttacttccttccttggatacaaattttttccttctactattaa

SEQ ID NO: 464 - DNA, 405 bp, Proteus mirabilis
tcggcagacctattacacgcagtgaaaatccactggaaactttacagcaaattaatcgttctatacaaggtgttgtgcaacatggataataattctcggctggtttattccactgatattggtcggattaaagaagaagagcagaaacctacacgccccgccggtgatggtattgtgcgtatccaacgtcaaaccagtggccgtaaaggtaagggtgtttgtgttatctctggtattgatttggatgatgcagctctggctaaattagcggctgaattaaaaaagaaatgtggttgtggtggcagtgttaaagagggattaattgaaatccaaggtgataaacgggatttaattaaatctttattagaagcgaaagggatgaaagtgaaattggccggaggctaa

SEQ ID NO: 465 - DNA, 2454 bp, Proteus mirabilis
aataataatgaactttataaaataaaatttaaaaagattgaaggtgaatataatttaagcgatgacgccaccgataatactaatattaattttattattgaatatgaaaaatatgaaatagaagatagtttaaaacatgatttatctaatattaataatattatagagaaagaagaaggaaatgtattaaaaataaatagagaagggatgcctattactataaatttacaagataataaactttttacatatggcttaccaccaacgctaatgcctaaagaggatgacgtagatggtaagagtaaaaaaaatcaaataaaattaccattaaaatcaaaagataaaatattagccataaaaccggtgttaaataaaatccaacttgtggttgataaaggtaataaaataaaaatatattactttgatcctctgcatatttttgcattaaaagattatcattatgaaatcactcgtttaactcaagagccaccgttatctttttattcaatggttggagaaaataattataaaaactatcactcaggacagccattttctactcaaaaaataggtaattttagtgctaaaaatattccctttttttcgtcggctattgataatgcaagggttcactttgatagagcaaaacaacaatatgcattaaaaaaatatggtgcaatggtaaaagatatcgcgaaaagttttgatcctggttttagagggatgttttctactataaaatctatagttaattctgctacattaccgagaacaattaaaacagatgctttaaatggtgtaaaaaaggtgattaaacatgattataatctgcttaataaatatattaccggaattaacaatggtaaatctcaaggtgaggttgtttattctttagtagaacaattaaatgataaagagagcattacaattagccagtataatgatatccgtgcattctttggtattagtgcatttcatttatctcaaaatattggtgtgagtgcgtttcttttagctaattttgcgaaaacacatgccctaacaatttcaaaaaataagcaagatgaagttgtattctcatttgtaaataaaatggatgcagggattgctacgggcttatctgctgggattatgaacaatgaacaaaaatggagagaaggggcgtttaattatggttttgtaacaccgttaatggccactgtgatactcgattatcattatgaaaaaaaatctaatttttcatttaaaattcaaccaaaagatttaatcgaatttattaatcaaggggtatctcttacagaaagtgaacttaaggataatgcaacgctggaatttaatagaacacaaaacgcgtcattaggtgttgaacttagaagtgaagtcagttttgatgtgggagtttctgctaatgaaaatatagaattaaatttaccgagaaatgcggttggtgctaatctctctttaaaaataataaatgtcattcacaatataaataaatttattggtcatggagagaccaaagcaaaacagttggaaaaaaatgttgatgttgagtattttagcggaagttttgaattataccgagatttaaaatttacaccttcagcgacaaaagcatcgcataatattcactggtatccattgacatcattgaaaaattttgaagtcatgttagaaaaaagagttaattcactatttaaacatagaatttatgatggaaaaataaaacaagacaaaaaagaatttgaagcacataaaaataacttaaaaggactttataaaagagtgcttaaaataaataacctatttgataaataccctgttcaatacgatgttaaaagaagtataaataaacttgatcatgtttatttacagttggatgcaaataagaaattaaaaaacaaactaaatccacaattgatggagaatgatctttctctcaagagtgatgtaatagataactcaatagatctagtacacaataataacagagtacaacaattcttagctgatttaacagaaaagaaaaaaatactttcttcacagaaaaaaaataatatgaatgaaaaatttaagccatattttatttctaaatatcagctaaatagtgaggggagagtgcgttattcagtgcttgaaactcaactggaagagcttatcaatgaagtgaaaacagatgaaaatctaacagttaatgatataaaagataaattagataatttctataataatgcgaaacaagagttaaataatattgaataccagcttaattcaatagatgtgatgtctataagtgaactcgccgataaagcaaaatcatttcctcttgcttttttacgattagaaagcaaaaagtctattatgcatcatcaagttaaaggtgaaattaattttttatatgataaatatgaaaagcaattggagaaaataaccactaattattattttcattaa

SEQ ID NO: 466 - DNA, 270 bp, Proteus mirabilis
atgaataatgaatcgcgttgtattttttctgaaggcagtgtgctattacctgatggctacaaagaacaaactatcaatattctgatttcacctactggtcatgcggtcaatatctcacgagatgataaagcaaaagacctatcctttgaagagtatattcttaatcaaaaagcactgttacaacgttcattaaaagagtggcaactcttagaagaaaacccctccatgctggggcaagatctgatccagcatggaggggttttcttctaa

SEQ ID NO: 467 - DNA, 756 bp, Proteus mirabilis
cgtttcaatgattctgcaagtgctaattttatgtctgacttaattcgtttaaaatcggttggtgtttcttttggtgaaagcgttattctaaaagatatctcttttaatctaaaagcaggccgtattcttaccttacttggccctaatggtgcgggtaagtcaacgattattcgtttggttttagggttgttggctccctcttctggaaagattgaacgtcaacatagtttacgtattggctatgtacctcaaaaactctatctcgatccaactatgccattgacagtcaagcggtttatgaccttaaaaccgggtgttaaagataaagatattttacctgctttagaacgagtcaatgcagcaaaattaataaacgcccctatgcaaaaattatcagggggtgaatcacaacgtgttttactcgcccgagctttacttaatcaaccacaactgttagttctagatgaacccactcaaggggttgatgtaaatggtcaattagccctctatgatttaattaatcagcttcgcaatgaattaggctgcgcaattttaatggtgtcacatgacttacatctggttatggctaaaacagatgaagtgctctgtttaaatggtcatatctgctgctcaggtacaccagatgtggtttcttctcaccctgaatttatagctatgtttggtagtcgtggtgctgaacaactgggtatttatcgtcatcatcaccaacataataaggagtgtcatcatgattga

SEQ ID NO: 468 - DNA, 840 bp, Proteus mirabilis
tcaaacaatgattgttctgatgactttttgagactaacaaaggtaaataccattatgagtagacaaaaagtagcaacacgtttacgtagagaaaataaacgtacattacgtaaagagcaacgtaatgccgcccatcgagataatgttatggttttaccaggatttggggatctagaaacaattggtatggcgagagagaaacgtgatcaacgaacactctctcctcgcaatgaagttcaacgccaatatatgaacgctattaaacatcaaaatttggtttttgcaacaggggaagcggggtgtggtaaaacgtttttaagtgcagcaatggctgctgatgcccttattaataaagagatagagcgaattattgttactcggcctgtattacaagctgatgaagatttaggttttcttcctggcgatatagcagaaaaattcgcgccttattttcgtcctgtctatgatgtattagttaaacgtttaggcgcctcttttttacaatattgtttacggcctgaaataggcaaagttgaaatagccccatttgcctatatgcgaggacgtacttttgaaaatgcatttgtcatattggatgaagcgcaaaatgtcaccattaatcaaatgaaattatttttaacgcgaatgggagaaaatgtgacagtgattgttaacggtgatattactcaatgcgatttacctgccaatgtaaattcaggattagcagatgcactaagtcgttttcaagctaatgagcgtgttggtgtcattaaatttaatgaagaagattgtgtgcgttctagtctatgtcagcatgtattagcagcatatagtgattaa

SEQ ID NO: 469 - DNA, 1068 bp, Proteus mirabilis
gggaatagtgatatgaaagtgagtaacacaaccccatttccttatcttttataccaaaaagtaggaaaaaaggatgagctgtttaatgtgatcgcattgcgccaaacttttcggctcaagactggcgggcattactcggatttaaatgaacagcaataccctttaaacatggccgatcgttactatcatgcaccggaaaccagtagtttaatcgaagaaacggatttagtgtggacgcgtccttgcactaatatccatatactgggggttgcgcgccctaaaggcaatcagcctacggcacaatggcgagcaggtattcgcattgaaaactttagcaaaacgtggtctttgtttggccctcactattgggaataccaagaggatcgatggagcttgagtgaatcaatacctgttgatggggtttctttacgccatgagttggcttatggaggaacatggcagtctccccagcaagaacaacaacaagtaatagaaaatcctattgggatcggattttaccccgatgtcgaagcacttgataaacaaaaacgttatccagcccctcagattatggaagatattcgtaaaagaccacttgatacgttgtctattgatactcgacaaattagcgaaggtatggggcctatctcccgttggtgggcaggacgtgttgaatatgccggaacatatggaaaagagtggcaagaaaaccaattcccattttatccggatgattttgatgaacgttttttcaatagtgcgcacccgtctttacgttatccagggtatttgctgggtaatgaacctatattattggaaggtttattacctgaatcatcgcgggtcgttacagcgttacctgactatcgtgtgaaaatcatattacaagacatcgaaggtgagcttttctctttgaagccagatttagacacactgactattgacttagatcgtcgtcttatttctgtcgtgaaacgacttgttatccccgcaaaatacccgattgtggaagcattaataggcgtttgggttccagcagaaacaaaaggagcttgttgtaatggctga

SEQ ID NO: 470 - DNA, 801 bp, Proteus mirabilis
atggtcagtgacgatgtcacttttaatagtctcttgataaataaaggccttaaaatgtcatttgattgtgataaaaaatcgcccagctctacctgcgcgcccgttattgtggcactagactatgaagaccaaaaaagtgcactcgattttgcacaacgtatcgacccttcatcttgtcgccttaaaattggtaaagagatgtttactcgctttggaccgcaatttgtaacgcaattgcaacagcaagggtttgatattttcttagatttaaaatttcatgatatacccaatacggtggcgagagcagttgctgcagctgccgatttaggggtatggatggtaaatgtgcatgcgagtggtggtagtcgtatgatgcgtgcggcaaaggagagcttaagctcatttggcaaagaggcaccgctattaaccgctgtcactgtgttgaccagtatggatcaatccgatctcactgaattgggcattaacctaactccagcagaacaagccgaacgcttagcattactggctaaagcctgtggtcttgatggtgtggtatgttcggcccatgaagccactcgttttaaacaagtgtgtggtgatgactttttattggtcactcccggaattcgacccgcggggagcgaagtgggtgatcagcgtcgagttatgacgccagagcaagcgatagtggctggggtggattatatggtgatcggcagacctattacacgcagtgaaaatccactggaaactttacagcaaattaatcgttctatacaaggtgttgtgcaacatggataa

SEQ ID NO: 471 - DNA, 1104 bp, Proteus mirabilis
agaagaagtgacattggattaatacaaatgaaatttagaccaatacaaaataacaatagcaaattgaaaatcgccagctctccatttactcataatcaacaatccaccagtcaagtgatgttgtgggtaatattggccgctattccaggtattctatgccaactctacttctttggtttagggacgctatatcaaatcatcttggcaatcattgtcgcgctattggcggagactatttgtgtcaaactcagaaaagaagatccacttctatacctaaaagataattccgctttactaacaggtatcttactagcaattagtattcctcctttagcgccttggtggataattgttttagggacattttttgcggttgttattgccaaacatatttatggcggattaggtcaaaacccatttaatcccgcgatggtcggttatgtggtgctattgatctcctttcctgtacaaatgacatcatggatgccccccattgaattacaagccgtatcttataactttatagatagcttaagtattttctttaccggacatacaccctcaggactcacccttgaagatttaagacgctctgtagatggcattacccaagccacaccacttgatagttttaaaaccggattattaacccactctattgatgaagtattagcaacgccaatcttacaaggtggatttgcgggaatgggttggcaatgggtgaatgttgcctatctggttgggggcgttatcttgttatataaacgaattattagctggcaaattcctgttgccatgttaacgctgcttggtgtttgttcgctgatcagttgggggatcgatgctactcgttactctcagccactattacagcttttctcaggtgcgacgatgttaggtgctttctttattgccaccgatcctgttagcgcctccaccacaccaaaagggcgattaatctatggtgcaatcattggcctattagtgtggattattcgtgtctatggtggctatcctgatgccgtggccttctcagtcctattagctaatattgctgtaccgcttattgatagttatacccgtcctcgggtttatggacattaa

SEQ ID NO: 472 - DNA, 645 bp, Proteus mirabilis
tggtttggtgaaactgtaatgaattctttatggatagcaattggtgtactgggtgtactagggcttctattcggcctgattttaggttattccgctcgtcgctttaaagtagaagaagatcctattgtggaaaaaattgatgccatattaccacagagtcagtgtggtcagtgtggtcatcctggttgccgcccttatgcagaagcggtagctaataatggagaaatgattaaccgttgtgcaccgggtggtgaacaggttatgttaaaaattgccgaactgatgggggttgatccacaaccacttgacggtgatgaagaagcattaaatccggtgagaaaagtggctttaattgatgaagacaactgcatcgggtgcacaaaatgtattcaagcatgcccagtggatgccatcgtcggcgctactcgtgcaatgcacaccataatagaagatctctgcacagggtgtgatttatgtgttccaccttgtccaacagactgtattactttagttcctgtgaaaatgacgacctctaattggaaatgggatttaaatactatccctgtaagaaatattcctgcagagccagaagaaacacccgaagatgaaccgtcattaaaggcggaggataacgctcatgtttaa

SEQ ID NO: 473 - DNA, 999 bp, Proteus mirabilis
agccatggtgatcaaggagcaaactttatgaataaattagcgcttcctacttaccaagatgtggttgaagcacatcaacgtattttgccatatcttaataaaacacctatcttaacctctcgcactatcaatgagttaacgggtgctcaattctattttaaatgcgaaaactttcagcgcataggcgcttttaaatttcgcggagcaatgaatgcattatcacaatttacggacgaacagcgcaaaaatggtgtgataactttttcatcaggtaatcatgctcaagctattgcactatcggcaaaattattaggtattccagctacaattatcatgcctgaagatgcccccacagctaaaatgcaagcaacaaaaggttatggtggtagagtcattctatataaccgttatacacaagatcgcgaagagataggacaaaaacttgctcaagaagaaggattaactttaataccaccttacgatcatcctcacgttattgccggtcaaggtactgcagctaaagagttattcgaggaagttggtgagttagatatgctgtttgttcccttagggggaggtggtttactttcaggttcattattatcaaccaaagccctttcgccacattgtagaatttttggtgttgagcctttagcgggaaatgacggacaacaatcattacgcaaaggtgagataatttatattgatacgccaaaaactattgcagatggcgcacaaactcagcatttaggcgattatacttttgagatcattcgcaacaacgtagacgatattttaacagcaacagatgaagaactaatttctgctatgcaattttatgctcagagaatgaaaatcattgtagagcctacaggctgtttaagtttagctgcagctcgtcaatttggcgataagttaaaaggcaaaaaaattggcattattatcagtggtggcaatgtcgatattatgcaatatggtcattttttatcacaaaaataa

SEQ ID NO: 474 - DNA, 1599 bp, Proteus mirabilis
tttagaggtgaaattaccacaatgagtcaactaatgagaacgcaaagtcattctcatatcattgaattgactcatgtatcccaacattatggtgataccaaagcacttgatgatgtgacattgactattcctgccggaaaaatggtcggcttaataggcccggatggtgtcggaaaatcgagtttaatttctcttatttcaggagccagagaaattcagcaagggcaagtgatagtacttaatggtgatatgaatgatgttaatcaccggcgagctgtttgccccaaaattgcctatatgccgcaagggttaggtaaaaatctttatcacacactttctgtttttgaaaacgtcgatttctttggtcgcttatttggtcaatccaaacaagagcgagaagagcgcatcaatgatttacttgaaagtactgggttagcgccttttaaggatagacctgcgggtaaactatctggtggtatgaagcaaaaactggggctttgctgtgcattaattcatgatccacaattgctgatcctcgatgaacccaccacaggggttgacccattatcacgggcgcaattttgggagttaattaatcgtattcgtaaacgtcaaaccaatatgagcgtattggttgcaacggcctatatggaagaggctgagcgttttgattggctggttgcaatggatgcaggtaaggttttagccactggtcatgcggaagaattaaaggcgcaaacggcgacagatgaattagaagctgcttttattgagcttttaccggaagaaaaacgtaaaaaccatcaaaaagtgattattcctccacgggataaaagtgatgacgatattatcgccattgaggccaaagagttaacaatgcgctttggtcagtttgttgctgttgatcatgtcagttttcgtattcctaaaggcgaaatttttggtttcctaggttcgaatggttgtggtaaatccaccaccatgaaaatgcttacaggtttacttgaggcaagtgaagggcgcgcttggttatttgggcaagaggttgatccaaaagatatcgaaactcgtaaacgtgttggttatatgtcgcaagcattctcactgtatagcgaattaacggttcgacaaaatttagagctacatgccaaactctttcatatcccagaacaggatattcctcaacgtatcaaagaaatgagtgagcgttttaatttgaccgatgtggaagatatgatgcctgacggtttacctttaggtattcgacaacgcttatcgttagcggtggctgtgatccacaaaccagaaatgctgatccttgatgaacccacctctggggttgaccctatcgctcgagatatgttctggaagctgatggttgatctctcaagacgtgacggtgtcactatttttatctctacccactttatgaatgaagcggcgcgttgtgacagaatgtctctgatgcatgccggaaaagtgctagtgacagatactccggctaatttagtgaaaaatagtcaatttgatacactagaagaagtatttattgattatttgaaaaaagcatccggtgaaaacagaagcacccgatattga

SEQ ID NO: 475 - DNA, 393 bp, Proteus mirabilis
tctcctttcgaaatgaggtcagtaatgacaaacaatgttgaaactttttctctaaatgatactgcttggcaaggcattgtgctgactgatagtgcagcgaaacatatttgccaattagtggagaaaaaccctgaaagtcagggactttccttaagtattaagccatcaggttgtacgggctatggttatgttattgagcttgctgcaggccccacagaggacgatcttgtctatgaacataatggtgccaagttattcgttgcattaaaagccatgccattcattgatggtttagttgttgattatgtccgtgaaggacttaatcagatgtttaaatttaataatcctaaagctcagaacgtctgcggatgtggtgagagctttggggtataa

SEQ ID NO: 476 - DNA, 282 bp, Proteus mirabilis
tgccagtacgattatgatagcagtaactttataatgttctttatactggagcttataaaaatgaatatcacgtttaagaaaattggaacaatgtgtgtcgcttctgttctgcttttttcacttacgggttgttcaagcatgacaaaacgcgatcgtaatacagcaattggtgccggtgctggtgctatatgtggtgcaattttaacagatggtagtccattaggaaccattggcggcggtgtattaggtggtgttattggccatcaagttggcaaaaaataa

SEQ ID NO: 477 - DNA, 1017 bp, Proteus mirabilis
tttttacgcctatttagaggtgtcagttcagcgagttatctgatgaataaagaaaaagatacagatagtaaagcgggttatgtaccgacttttcaccgcgcctatttgcatcctcgtcattggggaacctggtttggtgcaggcgtattgtgtgcattagcgtatatgccggtaaaatggcgtgatccgctccttgcttctataggtcgttttgttgggcgtaaagcgaaaagtgccagacgtcgtgcagatatcaatttaagatattgttttcctcactgggataaagcacaacgagaagatgtgcttgataaaatgtttgaaacagcgccacagtctttcgtgatgcttgcagatctttgtttaagaggggctaaacacacattacagcgtacctcttgggaagggatagagattatagagcgcttaaaagcacaagggcgtaatgttatttttatggtaccgcatggatgggctgttgatgtacctgccatgttattggctgctaaagggcaaaaaatggcagcaatgtttcaccaccaaaaagatccggtgactgattatttatggaataaagcacgttaccatttcggcggacgtttacactcgcgcgaagcggggataaaaccttttatttcaacggtgcgccaagggttttgggggtattatttacctgaccaagatcatggtgccgagcatagtcaatttgtggatttttttggtacctataaagccacattaccggcgattggccgattaatgaaagtatgcagagcggccattgtgccactgtttcctgtttactgtcataaaacgcatcaactaaagattattatccgtgagccgatggatgatatagaagggcaagatgatcgttatattgcgcgtcggatgaatgaagagctagaagcgttagtctcaccgacaccagagcaatatacttggatcttaaaactattaaaaacgcgtaaagagggggaaatagaaccttatgcgcgtgagaatatcctagactag

SEQ ID NO: 478 - DNA, 477 bp, Proteus mirabilis
ggttattgcgatactattaaggcaaatggagagttgagaggagttattatgtataaaacaattttagtgcctatcgatattgtagaagaagagttaaccagtaaagcagtacgccatgctgtttatttagccaaagaaacaggagctaatttacatcttatccatgtgcttcctatctcttcagccattattaatgcttattcactgggttatcccgaaattaaagacaaagcgacagtaaaagccgaaaatgatatgcaaatgttggtggattcggtggatctgcctgctgaaaaagtggcttacactgtcacttttggctctccccgtgatgaaattttaacgacagcaaaagatattcaagcagatttaattgttatcggctctcgcagacccaacattagcacacatttattaggctctacggccgcaggcgttgttcgttatgcagatatttctgtgttagtggttcgttaa

SEQ ID NO: 479 - DNA, 963 bp, Proteus mirabilis
ggtatacgcgataatatgcatcgttatatttatttaacaacagtgttgtgtatgaactttcttagtttaggctgtgatgaggcaacaacatcgacaacacaaacaggcattttttatatcagtaacaataacaatgtgccgttacaatttaaaattgatactaatcatttttcgattaataaaggtgaggtaaaaaaaataacattaaccaatggagagcatatattagaatcaaactcaggtgaaaagaaagtatttatggtttaccctggaaataatggggggattattaatccctctcaggaaatatactatagctttacttccgtgtttacttcagaagaaaataaagaacacttttatttagatacgcgctctgtttggatcaatggacaattaatacatggtgctattaatagcacagatgctgtgtttatcgacaacaatatctttcgttgtgacattccattaaatgagcctattcctccttatttaccagattggaagaattctggggtaggcaatgtattgactaaatgcttctctcaagaggagtttcaaacatttttagccaaatatccttatggtattcatttcgataacaatcacgatttattaaccaaacaagctaaaaaagaacagtttagttggataaatgaaaaagatacacgtactgaggattttaatcctacactgagtgaaataaattttaataataaagaattagtccaagaagctaatactatttatgaaatagtttactcgtatttagcgtctcgtgatcctgataagaaacaagagctttataatatttatcatctgcatatcatgtctatggcatggatttatagccaacaaatacaaaatgatatactggatgataaagaagcctactttcaattaataaaagagaccggaagaatatttggtgcaggtatattaggtgaacctgtattgatataa

SEQ ID NO: 480 - DNA, 216 bp, Proteus mirabilis
cctaatggcgagcctgcaaaacgaacgccagttgttttccctgggttggtaataagaaaagatggtttgcgcacattagcactgttatcttcacggtatgtgactttatcagataacggttcaatttcttttaataaggcttggatatcagcagaatgtttgctgtcgtctaatgttgcaactaactcaactggctgggttaatcgttctaggtaa

SEQ ID NO: 481 - DNA, 1365 bp, Proteus mirabilis
ctgggaggcgatatgtttattggctttgactatggaacatcaaattgttctgtggcaataatgaaagaggggaaaccaacgctattacctttagaaggtgagaatgtttatattccatctactctttgtgcgccaacccgtgaatctgtttccgaacatttatttcgccacttaaatattaaacctaccaactctattggcgaacaactattaagaaaatcaatcgcgtttaatcgtgatgaagatattgaattagtgcctgaggatattgttttcggtcaggcagcattaagtttgtatctaaaagatccccgtgatgtttattacgtcaaatcgcctaaatcttttcttggtgcctcaggcttacatgagatacaaatcagcttttttgaagatttagtgtgcgccatgatggccaatataaaacaacaagcggaaaaaagcacccaagcaaccattactgatgccatgattggtaaacctattaattttaatgggttagggggagaggctgccaataagcaagccgagcgtattttaattaatgcagctaaacgggccggctttaaacaggttttatttgaatttgaaccagtagccgcaggtttagaatatgaatccacattaaccaaagaccaaacagtcttggtagttgatattggtggtggtacaacggactgctcattgattcaaatgggccctagctatcggggtaaaaccgatcgtgccagtacactattagcgcatagtggacaacgtgtgggtggtaatgatcttgatatctacctagcttttaaacagctaatgcctttatttggcatgacagggctaacttcatcgggcataaaattgccgttaaaacaattttgggatcctattgccatcaataatgttgaagcacaaaaagatttttattctcaacaaaacttagcggcattaaatcaactacgtcgtgatgctcaagagccagaaaagataaaacgcttaattgaagtctataatgaaacactaggatatggcattgtccgcaaagcggaagaggcgaaaatggcattatcagattgccatacctatttagccagcatcgcgttattaagtgaaacattagaaaccaatatcactcgccagcaaatggttgaagccattggatcccctaaagataaaatgattgatttggtcaatgatgccgtacaacaagggggcgtggtacctgatgtggtgtttatgacgggaggctctgcgcgttcaccgattttatgtcaagctatcgagcaacagttacctaatgtgcctattgtaaaaggtaatgatttcggctcagtaaccgcaggattagcccgttggggtgaagtttgttttaaatag

SEQ ID NO: 482 - DNA, 675 bp, Proteus mirabilis
cttattatagatgatatttttttattgatgataatgctagaaatagtaggattacttcagaataagattaatcaaaaatacaacaggactgatatgtttggttatcgtagtgggatccctaaagttcgttttgaaacgaaaagaatgatcgttcgcttagcttatgaaagagatgcagagaagttagctaattactatacactaaaccgccatttcttgatcccttgggagccagtaagagataaatcgcactatttaccttcagggtgggagcaccgcttactttatataaatgaattgcaccgccaagagagtgcttttcattttctattattgacgccaaaagaagatgaagtcattggggtcgctaattacagcaatgtcatgcgtggtgcttttaatgcctgctttttaggttattccgtcggtgagaagtggcaagggcaaggctatatgtcagaagcattgcatgaaacattacgctttatgcaacgtcaacaaggaatgcatcgtattatggcaaattatatgcctcataatttacgcagtggtaatttattggctaaacatggctttgaacgagaaggttacgctaaaaattatctgcagataaatcaagaatggcgtgatcatgtacttaccgcattaacaactcgtccttttcccaaaggataa

SEQ ID NO: 483 - DNA, 222 bp, Proteus mirabilis
cttaaatcagaagattcatcagccattgagccacttgtatctattaccacaactaaatctaaagcaacattgccatctcctgtctccatttgtgaacttaaagtagggttagcagatggtggcggaattattggtttagctatttgtttattactatcattatttattaaactattatttgattttccattcatattctcgctccaatatatgcaatattaa

SEQ ID NO: 484 - DNA, 189 bp, Proteus mirabilis
cggtatacagaacggacattaaattcttcttcgttatttttatcaaagggtaattcaaccatcatccgcccttctgtgcgtagtttaagatcaggtattcctcctaaagagaatattgccctgaatttatcactgtattcactagccaataatgctctcgttcccccagtgctatgtcctactacgtaa

SEQ ID NO: 485 - DNA, 288 bp, Proteus mirabilis
accatgacagaagctcgttctaaagatccactacacggtatcacgcttgaaatgcaagttaatgcgttagtggctaaatatggttgggttaaattaagccaacgaatcaaaattaactgttttagaaacgagccaagtgtaaagtcgagtttgaaatttttgcgcagaaccccttgggcgcgctctgaggtagaagcactatatctaaatcttgttgaagaaaaccttgatgatacaatcaattattctgaaagtgatccttgggcaaatagtcgctataaaaaataa

SEQ ID NO: 486 - DNA, 657 bp, Proteus mirabilis
aaaatgacagatctggatttaattgatgtgctgattcttcgacgtgaatatatgaaaggtggattacgccgtcatgaattaaccgaacagccattagttttatttgaaaaatggcttaagcaagcttgtgaagctcgcttaagtgatccaactgcaatgtgtgtggcaaccgttgatgaaaatggacaaccttatcaacgcattgtgttactaaagcactttgatgaaaaaggtttagttttttataccaacttaggtagccgtaaagcgagtcatttagaacataaccaaagagtcagtttactcttcccttggtatcctttagagcgacaagtctgttttttagggaaagctgagaaactttcagcatttgaagtcgtaaaatatttccatagtcgtcctaaagatagccaaatagcagcttgggcatcaaaacaatcttctcgcatttctgcccgtggggtgcttgaaagtaagtttttggagttaaaacaaaaatttcaacatggagaagtacctctacccagtttctggggaggatatcgagtcacttttgactctgttgaattttggcaaggtagagaaaatcgtctacacgatcgctttatataccaaaaatcaccagaaggatggtctattgaacgtttagcaccttaa

SEQ ID NO: 487 - DNA, 189 bp, Proteus mirabilis
tacatccaagagactgagccagacaccaagaatgaggcaaaaatagtattgatgattagcgaaatttggctgacagaaacccctaaaatagcgggacccatcaatttaataacacgccacactccgctatttttaaacgagatccgcggtaataccaacatccctatttttttcagatgcggaagttga

SEQ ID NO: 488 - DNA, 243 bp, Proteus mirabilis
tcaatgcaagaacaattagaattcttcgatatcccaagcccttgcattggtcgatgtgaatctaatttacaagggtattgcattggttgttatcgtagtcgtcaagaacgctttagttggtcaacgatgagtcaacaagaaaaacgaaatgtattgagactttgtcgacaacgatatttaagagctcaacaaaaaacagtgtctgaaacagaaaaagagaatgaacagctggatttattttaa

SEQ ID NO: 489 - DNA, 1008 bp, Proteus mirabilis
ccaatgcaagagaatttagagacaataattggtgttgatagtcattttatcgatgttttagaacaaacctcagccctcgctcaactcaaaaaaccggtgttgattattggtgaacgtggtacaggtaaagagcttatcgctcatcgattacactatttatcaccttggtggcaaggaccatttatttccattaactgttcggcattaaacgataatttgcttgattcagagctgtttggtcatgaagcgggggcatttaccggagcgaaaaaccgccatcaaggacgttttgagcgtgccgatggcggctctctttttcttgatgagctagccactgcaccgatgctggtgcaagaaaagttgctacgcgttattgagtatggccatttagaacgagtgggaggtagtcaatcgctgcatgtcgatgtgcgccttatctgtgccactaacgcagatctaccggcaatggcggacgagggtaaatttcgtgctgatttactggatagattggcctttgacgtaattcgtctgccccctttaagagagcgtaaagccgatattatgctactggctgaaaactttgcgattgctatgtgccaagagttagggttgccctttttccccggttttagtgacaatgcccgccaaattcttttagattaccgttggccggggaatattcgcgaactaaaaaatgtggttgaacgttctgtttatcgccatggcaccagtgagcgtgaactggataatattattatcgacccttttgcgcgcttttcgtcttcaaccatagctgagcaacctcagcctcaaaaggagatgatcttttcattaccgccattaccgctagatttacgccagtggcaacatagcacagaaaaaaacttactagagcaagcattgaaagagagtcgttataaccagaagatggcggcagaaaaattagcattgagctatgatcaattacgcggattaataaaaaaacatcacataaaattgtcggtctag

SEQ ID NO: 490 - DNA, 294 bp, Proteus mirabilis
gtaatgaaagaaataacactagatgggaataaacaaaaaacacctattgaagtgtatcaacttttttctgaggaatttgattttggcccgtactttggaaataatcctgatgcgttatatgactttatggtgcctattgatgcagaagataaaccagtcattatattgtggtataatagtagtattttcaaggaaaagtatcctaaagaatttgcacagcttgtctctgtgctaaatagcataagtgaatttggaaaatttgaccaagacacttttcaatttaaaattctctaa

SEQ ID NO: 491 - DNA, 426 bp, Proteus mirabilis
caaacacgagaggtttatatgcgagtacttcataccatgatccgtgtaggcgatttacaacgctctatcgatttttataccaaagttttaggtatgcaacttctacgcaccagtgagaatgaggaatataaatactcgttggcttttgttggctatggtgatgaaagtagcggtgctgttattgaattaacctataactggggtgtgactagctacgaaatggggactgcatttggccatgtcgcattaggggttgatgatgtagctgcaacttgtgaggctatccgtcaagcggggggtaacgttacccgtgaagcaggccctgttaaaggtggtacaacaattatcgcctttgtagaagatcctgatggatataaaattgaattaatcgaaaacaaaagtgccagtcaagctctgggtaactaa

SEQ ID NO: 492 - DNA, 1602 bp, Proteus mirabilis
cgaaagcgagactatttcagggagcgtccaatgaaagtgaaaaccaaattattatcattacttgtgatgggtgctctcagtgcccctgtattggcagcaacacccgccaatacattgattgtagtacaaggccttgatgatattgttagccttgatcctgccgaaagtaacgaattatcaagtattcagaccgtaccaagtttatatcaacgtattgttcagcctaaccgtgacaatccagaaattaacgagccaattttagtcgagagttggcaggctcaccctgaacaaaaatctatcgtctttaaaattaaacaggatgcaaaatttgcctccggtaatagcgtacgcccagaagatattatcttctcttaccagcgtgcagtgacgatgaataaatcccctgcttttattttaaatgtgctaggttggaaagcagataatattaataccctcttgaaaaaagtcagtgataaagagattgaagtacgttggacagcagatgttagccctgatgtggtacttaacatcctttctacaccaatcgcttctattgttgatgagaaattgattgccgcacatattaaaaataatgactttggtaataattggctaaaaatgaattcggctggtagtggtgcttataaaatgcgtgcctacaaacctcgccaagccattgtgttagaagctaaccctctttcaccgaccggtgcgcctaagatagccaatattattatcaaaaatgtgcccgaccccgcttcacgtcgtctgttaattgaaaaaggcgatgcggatattgcccgtgacttaggtacagaccaaactgcagcattagcaggtaaacctggcattcaaattttaaatatcccttctgctgagcaagtctatatggcgtttaataccggtagcggaaatccgcttcttagcaatccggcattttggcaagcagcgcgttatttggtcgattataaagggatcaccaatgacttaatgcgtgggcaatattttattcaccaaagtttcttgccggtgggattgccgggggcattagaagataatccatttagttttgatccgcaaaaagcgaaagatatcttagcaaaagcaggaattactcatgcacgttttactcttgatgtagaaaacaaagttccttacatcaccgttgcacaatctattcaagcaagctttgcacaagcgggtgtacaggttgatctgttacctgctgccggtagtcaagtttatagccgagtgagagcaaggcagcaccaagcggcgatccgtttttggatccccgactattttgatgctcactccaatgctagcgcttttgcctataatgacgggcaatcgaataccgtggcttggttaaataattggaatattcctgagttaagtaaacaaacactcgtcgccctgaatgaagcggataaggctaaacgtcagtccctttatactgaaatgcaaaaagagctacaacgcagttcaccttacgtgtttatcgaccaaggcaaaaatcagattgtattacgggataacgtgaaaggttatgctcaaggtctaaatgccgatatggtctattacgacaaagtcactaagtga

SEQ ID NO: 493 - DNA, 891 bp, Proteus mirabilis
atgaacagagagcaactattacaagcaatatctcactatcctgcactcgctcagcgaaatatgggaaatacacataaaggcacttttggtacattagccattatcggcagctcagaaggcatgagtggtgcgattgttttggcgggaaaaagtgcgcttaaagcagggtgtggtaaagtctttttgggctttgcacaaccacaattgccactgccttttattgatagtgcacccgaactgatgctacaaacagccataacattattagagcaaccacaaatatcagcatgggcgattggctgcggtttagggctctcctctgattcggaacaattgctgactacagtactagcacaacgtaacgagaaaataccttatgtttttgatgccgatgcgctggtgttattggctcaattaaacttatcgcatattaacactaagttaaccgctaattgtgtattaacaccccatccgaaagaggccgcaactttacttcattgtgatgttgctgatattcaaaataaccgtcaacaagctgcaatagaaattacacgccaatatcattgctgggccatagtgaaaggacaaggaacggtgattgcttcacctcaaggagatatcacagtaaatacaacagggaacagtggattatcgacagcagggagcggtgatgtattaaccggtgtcatggcaagttttttagcacaaggtatgccaatcgcagaggctgtgccgagtgccgtatggatacatggtattgccgcagaccaattaataaaacaaggaatagggccaataggattaaccgcatcagagcttattgataccatccgtgcggttcgcaaccaaatgtgggcaacccaccaacagcacagcactgatttattttaa

SEQ ID NO: 494 - DNA, 1608 bp, Proteus mirabilis
ctaaatggagaaaactttatgttaaaacattatttattagccattattatagggtgcagtatatttcctgccttctctgccactatgccatcaaagcaagataatagtcccgcgccagcagcaaaatggaattgctggggaagaaaagaagtgaatatgtctaatcgaaatatcaataataaatcggtcagtttaaagttaagtactgatatttgtgatagaaaagatctaagaccattatttatcgatgtttatctacacaagatatcctttaaaggggcgaaatacgatgggataactattgatattatcgccaatgccactcataaattaacagggaaaacacaagaaataagatcaacagaaaatattaataacatagatgaacatgtgcagagattgcagtttagcgcagtgcgttcgggagattataacgtagatataaaacagatatggcttatttttagggagcatggtaaagcagtaggttcatttcagataacaggggataatgctcgtaatggcgaggcttatatcgaatctcatatcacctataatgcaatgctttctctcattgagaacgcaaaatcagaaacattaacaacaggaaaaccaagtcatatcgtttttggtggtcattatgaaataccaatgaatgcaggctcaggaacctatacattagccaataacggcaatctactgattattcctaggatccatgaaaaagaaaaataccttattcctcatctattaggtgatactcatcaaggcgaggcagcccgctgcgaaggtaatacaaatgctaaaacacaggatggcacttcacagacagcggagctttataccccagaacaggcatggaacaaactagataaaccgttagtggctttaaatgcaaactattttgatgttcgtcctcaactcaataacaccacttggcagagtaatctttgctcagtgccattagggatatattacgataatatcgcgcaagggcccactcatggtactcataacgagcccaatcagttttttgcagggcctaattactttatcaataacaataatgagcaaatcgcattagatgcactgttttgggtgttagatcaaacatctaggatagatatctactatagcaaaaaagtatctgatcctgcgattgaactgtatgccaatgaactctctttatcaggatatcactttattgctatatcaggctccggtttacctgttcgcggattaacaccactccctacccctgattctggcgattcagagacaacccgactcgcaatgggtgctgatgataacaatagccttatttatattttccaaggtggtagttatagagagggaataagccgcaatgatctgcatcatttatattatggccttagcattgcgcaatctatggagttagatggcggtggctcagctgcgctggctttaaaggcagatgaattcacagtaagaggtgatacaaggcctgattcatcttgtaacgaagcaggtttgtggtgctctttgataacacaacctgacggaaaacatcgccccgttccatcttggattggtctggctattaataatctagctattggtcaataa

SEQ ID NO: 495 - DNA, 363 bp, Proteus mirabilis
tacaaaggagaatttatcgtgactataaaacgtatcgatccagaggaccgttggtctgaagcggttatttataatgatactgtctattacactgcagttcctgaaaacttatcaggggatataatcgaacaaactgcagatacattagcagctattgatgtgttattacaaagagtgggatcagataaaagtaagatccttgatgcaacactatttttagccgataaagccgattttgcaggtatgaatcaagcatgggatgcatgggttgctaaagggagcgcgccagtacgttgtaccgttcaggctcaactcatgcatcctgaatataaagtagaaattaaaatcatcgctgctctctaa

SEQ ID NO: 496 - DNA, 333 bp, Proteus mirabilis
tataagggagataatatgagattagtatatttcgtttatcaagataaaaatgcttatgaacgacaaagtgatggtgttgagttctgcaaaattccggagtttcataatgataaaatttatttttattgtgatgaatattccatgttttggaattctattgataaagttggaaatcctaatgattgttgtaatttctcattaaagagtagtattgtcccagctacattactagaaatatctaacaacgacctgatatcttatattgatacagtaaaagaatacgttatagaaaataacaaattaagtaaattaacatatattcatataaaataa

SEQ ID NO: 497 - DNA, 1011 bp, Proteus mirabilis
tttaataaggaaattgctgtggattttcaccacgacgatcaagaaataacaccagaaacatcacttgtattggcggaaaaacaaccattattagatctcaatgcaactttcacctctccgacacaaactaaccctgcactggcttatttacgcagtttaggctctaaacgtagtcgccaaacgatgggatcgtttttaacgatcgtggcaaaaatgattggcttctcttcaataaagcattgccaatggggagcacttcgccgccaccatattcaagcaattatcgacatgttatctgatgcggataaagcacccgccacgattaacacttatttagctgcactaaaaggtgtcgctttagaagcatgggcgatgaaattgatggatacagaaagctatcaacatattcgccaagttaaatcggtaagaggcagtcgattacctaaaggtcgagcgcttactggacatgaaattcgcgcactttttcgctgttgtgaaaaagaccactcctcaaaaggtttaagagatgcggccatattaagtgtactacttggctgtggattacgccgttcagaaattgttgcgcttaattacgagcatattcaatttcgtgatcaagcttttattgtcagaggaaaaggtaataaagaaagaatatcctatatgccagaagatacttgggagcgtgttcagttatggatcgatgaaataaggggatcacaagatggcgcccttttcacacgtattcgccgctttgatgatgtaacggatgaacgaataacagaccaagccatttattatattttagagacacgccaacaagaaagtggcattgataaatttgctcctcacgatctgcgacgcactttcgcctctgcaatgttagataatggcgaagatattgtaaccgtaaaagatgccatgggtcatgccagtattatgactacacagcgctatgatagacgtggtaatgatcgtcttagaaaagcggctcgacatttacgtttttag

SEQ ID NO: 498 - DNA, 1074 bp, Proteus mirabilis
tttaataaggaacaaaaaaagatgatagaaaataaccgacaccccttcgcttgcacaacacttgcgattactgacaagaaaaaacgtgtttatcatggtcggacaatggagttttcttctgatgagccaacgtctatcttagcttattatccacaaggtcatacttttcagcaaaatgcccctgatggaacccccggattaaagtacagcgttaaatatccttttatggctattaccgctcctattaacttatcgggtaccaaagatgtacttgaaggtgtaaatagtcagggactctcttttagcttaaatatgctacctaactctaagttagatgatctcgatccccaatattacgcaagctctgttcctattgctgctattggtgagtgggcattaggacaatatgcgacggttaaagagttaaaagagattatcccccaaacccatttttggtcacaaaagctattattgttacgtaacttaccaagccctttccattacgcattttatgataaaaccggtgattgtattgttgtcgaagtctctgatggtaaattacatatttatgataatcctacctattgcatgaccaatggccctattttcccgtggcatttaactaatttaaacaactacactcatctttctaatatcaacgtttccagtagcacattaggtcgtattaaaatcaaccaacctgatagtggtattgcattagcaacattacctagctcagatacttctgtagatagatttattcgtgcagtttattattcaacctattaccacaaagtttctgatcctgataaacagcttattgagcttgcccatatcatgaatcgcttcgatcgccctaaagatgcaaccattgatccactattaggtaatgatacgctaactaaacttcatactagtgaattttctgtctggacggcgctaactgatttagaacgggggatctttttcttcagaggctacaacaacttaaactttcaaaagttcacacttgagtcatttaaaaatgaaagtagcgcggtttttattaaggtcaatttggaagaggcattgtaa

SEQ ID NO: 499 - DNA, 1407 bp, Proteus mirabilis
aggataagggagacaattatgtccagcggtgttgttacagcggcatatattgtcgccgcaatattatttatttttagccttgcagggttatccaaacatgaaacctcaaaacaggggaattactttggtattgcagggatggctatcgcgttatttgcgactatctttgggccttatgctgataatgtaggttggatcattgttgctatggttattggtgccgttattggtatccgtttagccaaaaaagttgaaatgacgcaaatgccagagttagtggctattttgcatagttttgtaggtttagccgcggttctggttggttttaatagttatctagatcacaatcctgccattgatcctgtaatggccaacattcatctcacagaagtctttttaggtatctttatcggtgcggttacttttaccggctctattgtcgcttatggcaaactaagtggcaaaatgtcatccaaacctatgatgttgcctaatcgccataaacttaatttagcagctttagttatttcatttttattaatgatctggtttgtcaaaactgacagtgttggtttacaagtctttttaatgattgtgatgactgtcattgcattagcatttggttggcatttagttgcctccattggtggtgcggatatgcctgttgttgtgtcaatgttgaactcttattcgggttgggccgccgctgctgctggttttatgttaagtaacgatttgttaattgtgaccggggcattagtgggttcatcgggcgctattctttcttatatcatgtgtaaagcaatgaaccgctcatttattagcgttattgccggtggttttggtactgatggtagcagctccagtgacgaaggagagatgggggaatatcgtgaaacaaccgcagaagaagttgctgaactattgaaaaactcaacttcagtgattattacgccgggttatggcttagcagtggcacaagcacaatacccagtacatgatataacagaaaagcttcgtcagcgtggtataaaagtacgctttggtattcacccagttgcgggtcgtctaccggggcatatgaatgtattgttagcagaagcgaaagtaccttacgatattgtcttagaaatggatgaaatcaatgatgattttgctgatacagataccgttttagttattggtgcaaatgatactgttaacccagccgcacaagacgatcctaatagtccaatagcaggtatgccggtattagaggtatggaaagctcaaaacgtgatcgtgtttaaacgctctatgaatactggctatgcgggggtacaaaatccattattctttaaagaaaatacccaaatgttatttggtgatgctaaagccagtgtcgatgcgattttaaaagccttgtga

SEQ ID NO: 500 - DNA, 891 bp, Proteus mirabilis
aaaaggagggaaccaagcatgagtgaatggccattagttacctttactttgttagtacaaagttctgttggtgttactatttttactgccctctatttttgttggttagagaaagaaataggtaatcaacgagcaacacgcactttgcgccccgtattactgacaagtgctatattgggatgcttaggattattagcctcaacactgcatatgggatatccgtggaatgcgtttcatgccttgcgccatatatcatcatcatggttaagccgtgagattatctttgctgctctttacctgggcgcattatgtttatataccttgctagtactaataaaaggtcatatgaataaaaccctcttagccattatcggtttactggggttagtggatattttctgtatggcttcgctttattacagcacatcgatgataacttggatgcatgttaatacctattttatgtttatcggctctgttttttctgcgggagcggtgatcacattattaatcacttcaataagggttaaagcctttgctgatggcgaacttgctaaaaaaatagtattaagtgctttagttggtatttttcttgctgtgactatccgtatggcagagcaaccactttatttatcatggatgtcagaaatacaattaaccaatgatgcaattacttttcctcatacccctataattgcgtataatgagactttcggattaagaatatctgcatggatattgtctattatcagtatattaatgatgggatatagcctgtataaatatcgtatagctgtatttacttctgggttatctctaatttggggtagcggtattgtcctgttaattgctgagatacttaaccgatttgcattttttattgttaagtaa

SEQ ID NO: 501 - DNA, 1182 bp, Proteus mirabilis
aataatttacttgggaaacatcacatgaatcgtcgttcatttttaacatcatcaagcttagtgatcgggggactttcattaagttcgtttgttagcgctgcctatgccgcagaaacttcaaaccctaaacagctatttaatgcagaaaatcctttactgttaaactttaatgaaaactcgctaggcatgtcatccaatgccaaacaggcgattattgatgcacttccccatgcttttcgctatccagatgatgcgcgaagcgcacttatcagtgcattaggtgaagaatttaagctatcagacaaacacatcactctaggtaatggctcctctgaaaccatacaagcagccgtacaatatgtggctaataaagcgcaaaaagcaggtaaagcggcacaactaattgtgcctgatccaacgtttaattatgccgaactttatgctgaacctttaggtgtcaatatcgtaaaagtgccggttgataacacattggcttttgatttaaccgccatgcagaaaaaagcacaagcatttgatggtattagcatggtatatctgtgcaatcctaataacccaaccgcaatgctgacaccaacagcggcattaacaaattggatcacctcagcaaaagaaaatgtcttttttattattgatgaagcttacgctgaatttgtgacaacacctgaatttaccagtgcgatagcattagttgctcaaggttataaaaacttgattgttacccgtacattttcaaaaatttatgcattagctggattaagggtaggctatggtgtggcagtccctgaggtaattagtgaagtagatagtttcgtttctattgataataccaatactgccggtgctgttagcgcattagcctcgttaaaagatcacgcttttgtggcatatagtcgcaagtcaattgatgtatcacgacaaatggtggttgatactttaaacgccttaaatatcgagtatgcaccttctcacgccaactttatttttcataaagtcaaaggtgatgtgaaaacttatcaagagagaatgaaagcggcaaatattatggtaggacgtgagtttcctcccgcattaggttggagccgtttgaccttaggaacccctgaggagatgagttattttgtcgcgacgttaaaagagtttagaactaaaggatggatataa

SEQ ID NO: 502 - DNA, 1158 bp, Proteus mirabilis
aaaatactactcttctgcgggtattcctcaagaggggcgcaatgcaaaagtactggtgagttatcaatggtaattaacaataaaataaacgaaacaataggagtttccgtgactaaacctctttatgagagctacctgcaagcaaaaaatgaaaaaaaagcatcttatgcgcgtgatttagcaacttaccttaatgtaagtgaagctgagcttactcacgcgcgtgttgggcacgatgctaaacgcttacatggtgatgttcgtgatattttaaccgctctcgcaaccgtaggcgaagtgaaagccattactcgtaatgaaattgcggttcatgaacatcttggtgaatataccaatgctcgttttaacgatcatgcaggattgatcttaaaccctcgagccctcgatttacgctttttcttctctcattgggcaagtatctttgcattaaccgaagagacggctcgtggcattcgtcatagtattcaattctttgatcttcatggtgattctctccataaagtgtataccactgataatactcatatggacgcatggaataccttaatcgatacttatttatcaccagaaaatcccgtattagagattacccccgctaaatcttttactgatgcaccggtaacaacggcattagcacaacagttagaacagcaatggcgctcgatgactgacgttcatcaattctttaaaatcctgcaagaaaataatctcagtcgccagcaagcgttcaaagcggtcagtgatgatttagcttatcaagtagataatagtgccttaaaaacattattagcactggcgaaagaagtacaaaatgaaattatgattttcgtgggaaatagaggttgtgtacagatctttaccggtaaaattgatcgtttagtacctcatcaatttgaaaatagtgaacaagtatggattaacatttttaatcctgcatttacactgcatttaattgagagcgaaattgtggaaagctggatcactcgtaagccaacccaagatggttttgtcacaagtcttgaactatttgatagcaaaggtcaacaaattgctcagctttatggacaacgcactgagggaacaaaagaacaacaacaatggcgtgagcaactcaacgctcttgctaaaatagcttaa

SEQ ID NO: 503 - DNA, 789 bp, Proteus mirabilis
ataatgtcactgacatggacttcatggttaacaaataccattcaaagtgatgtgtattttttaattaacacgttatcgcaaccaaatccgattaaacaattttatattaatgattggattgaagaggcattccctatatatcgtggaacggcattatcacacttatcgagtgtcagtccatggttggtaaaagtaaaaccctcgcaatactcacatttgggccaagtattagatactatgccattaggtgataatagctggggatgggcttatcatagccaactcgattggcgtacccaaatcactcattggcaaaagcatcaactagtgataatgaatgataaaaaagttatctttcgtttttttgatgcgcgtatagcgcgtacgctattaccaaaattatcacttggcgattgggctgtcttaatgatgcctgttgatgactgcttgattgaaggtgatgaggttaatgaaaaccatacgcgacctcaatatgcagatccctttattagccccgtagattatgaattaagagagcatctaattacagcttggcgtgattctgaacaggcttatgttaatgtaattaataacttctatattcagttttgggaaaaacagagtgaattagcttatcagttagatgaagttgacggtcgtttaatagggtttatccgcgattggatggacgaatgtcagaaaaatagattagataccgcctatctgtatgatgatttatttttacgctatctaaataaaaataatctattacctgatatgactatataa

SEQ ID NO: 504 - DNA, 807 bp, Proteus mirabilis
gacgttacactttatttatttttcaataaacaggatattaatatgttgcaatatcaacccgatcatactgtattaagagataaaataattctagtaacgggggctggtgatggcataggtaaagaagctgctctcacatatgctcgctatggtgcgacattaatcttgttaggacgtaccttatctaagcttgaagatgtacaaaatgagattatcacttcaggcgggcaacaaccgatgctttaccctttagatctactcaccgcgagcgagaacgattatcaggaatttgctgatactatcgtaaaacgttttcctcatttggacggtgtattacaaaatgccggcctactcggtgtcgttgagccgataattaaccaaccaagtacactttggcatgatgtgatgcaagtcaacgttaatgcaacctttatgttgactaaagccttaatccccctaatgcttaaggcacctcatgcaagccttattttgacaacctccagtgtaggtcgccaaggccgttatggttggggggcttattctgtctctaaatttgccacagaaggcttaatgcaagtgttacatgaagaatataaagacagtagcttgcgtattaactgcatcaatccgggtggaacacgcaccagtatgcgagcaagtgctttccccgatgaaaatgcacaaaaacttaaaacgccaaaagatctaatgccgttatatctctatctaatgagtgatgacagcattgaagtgagtggtcaatctttagatgcacaacccgatcgtaaagccggacctgctgaataa

SEQ ID NO: 505 - DNA, 2073 bp, Proteus mirabilis
ataaggacactcatcatgaaaaaaacacctctttttaatagaaaaacaatgatgtcggctttcttggatgctatcaaaaaatgcacccctcaagcgcaatggcataatccggtgatgtttattgtttatgttggtgcactactcactacgggtatttggtttgccgttttactggggtatctaccaccagataatcattttacttttcaagtcatgctttggttatggataaccctactatttgccaattttgctgaatctttagcagaaagtcgtagtaaagcacaggcggcaagcttacgaggtgcgaaacaacaatctaaagcggtgcgcttacagcatgctgatcttcacgctccccaagaaatcattgattcacttttattacataaaggcgatattgttttggtcaatgctggcgaggtaattccttgtgatggtgaagtgattgaaggtggcgcttctgttgatgaaagtgcgatcaccggtgaatcagctcccgttattcgtgagtcaggtggcgatttttcttctgttactggagggactcgtgtgttatctgactggttgattattcgttgtagtgctgaagcgggtaactctttcctcgatcgtatgattggtatggtggaaggggctaaacgcagaaaaacgccgaatgaaattgcattaactattttattaacggccctaacgctgatctttttattcgcttgtaccacactctatccttttagtgtgtttgccgtgcaattccaacatcatggtgaggttatttctgttgtaacgttaatcgcattattagtttgtctgatccctacaaccatcggcggactactctcttctattggtgtggcaggtatgagccggatgttagacgctaatgtgattgcgacgagtggacgtgcagtagaagccgcaggagacgttgatgttttattactcgataaaacagggacaattactttaggtaatcgccaagcttctcgttttattcctctatcaggaataactgaaaaacaattggcagatgcggcgcaattaagctctttagcagatgaaacacctgagggtcgtagcatcgttatattagccaaacagcgctttaatttacgtgaacgagatttaacttcgatgggggcctcttttgttccattctcagcgatgaccagaatgagtggcgtaaatattggcgagcgtattatacgtaaaggctcggttgatgctattcgtcgccatatcgaagttagtcatagtcattttcccgatgaagtcaacaccatagtcgagcaagtcgcaagagctggtgctacgccattagtcgtcgttgaaaatcaaaatatccttggtgtagttgaacttaaagatatcgtcaaagggggtatcaaagagcgctttgctcaacttcgccaaatgggcattaaaaccgtgatgatcaccggtgataaccatcttactgcggcggccattgctgccgagtccggtgtagatgattttcttgcgcaagccactccagaggctaaactggcgttgatccgtcaatatcaatcagaaggtcgacttgtcgctatgaccggagatggtactaatgatgcgccggctttagcgcaagccgatgttgctgtggccatgaattcaggaacgcaagccgctaaagaagcaggcaatatggttgatttggactcaaatcccaccaaattaattgaagtcgttcatattggtaaacaaatgcttatgacccgtggcgccctaaccacctttagtattgccaatgatatcgcaaaatattttgccattattcccgcagcttttgcggtgacatatccgcaattgaatatgctcaatattatgggattacactccccggcatccgcgatgttatcagccgttatttttaatgctttgatcatcgtctttttgatccctttagcgttgaaaggtgtgcattatcgtcctgtttctgctcattcattattacgccgtaatctctctttatatggaataagtgggttaattgttccttttttaggcattaaactcatcgatatgattttagctattattgggctttaa

SEQ ID NO: 506 - DNA, 1206 bp, Proteus mirabilis
ataatggcactggtaacacaagctcgcaccttggggaaatactttctcctccttgacaatatgctggttgttttaggattttttgtcgtattccctttaatatcaattcggtttgtcgagcaattaggctgggcgggtgtgattgtcggctttgcccttgggttaagacaacttgttcagcaaggcttaggcatttttggcggtgccatcgccgaccgatttggtgctaagccaatgattattaccggtatgctattacgtgctcttggctttgcattaatggctttagcggataaaccttggatcctttggttatcttgtattttatctgcactcggtggcactttatttgatccgccaagaactgccctcgtgataaaattaactcgcccttatgaacggggtcggttttattctttattattaatgcaagatagtgcgggtgccgttattggggctttaattggcagttggttactcctttatgatttccatttagtttgttgggttggcgctggcgtattcgttcttgcggctatttttaatgcttggttactacctgcctatcgtatatcaaccacgagaacaccgataaaagaagggctaaaacgcgttattcttgataaacgttttgttcagtatgttcttactcttacgggatactttgtactgtcggtacaagttatgctgatgtttccgattgttgttaatgaaattgccggcacccctagcgcagtaaaatggatgtatgcgattgaagctttattatcattaacactgctttaccctattgcccgttggagtgaaaaacattttcgcctagaacagcgcttaatggcaggattatttctgatgagtatcagtatgtttcctgtggggatcacccactcattacatgccatatttcttattatcaccctattttatctaggcactattaccgcagaacctgctcgagaaacattaagtgcctctttagcagatcctcgtgctcgaggcagttatatgggttttagtcgattagggttagcttttggtggcgcgattggctataccggagggggatggatgtatgatattggcaaacaacttgaactgcctgaactaccttggtttttattaggcacaatagggtttatcaccctttacgcactacatcgacaatttaatcgtaaaaaaattgaaacagccatgcttaccccatag

SEQ ID NO: 507 - DNA, 540 bp, Proteus mirabilis
ataaagggttttataagagcgagaaatcaaatgagaattgaatgttatagttggtcagatgttagtgaacaaattctggagcaagcaatagccttacagaattcagcttttgaggatatgaagggtaatttttatcaggttgatataccttacaagttggtactggcaattgatgataatcaggttatcggacatgtagctgtttatttacgagatgtttacctagattcatttcctgaaaccattggtatattgagttgtgtagtggtggctcacaaataccgaggaaagggcgttgcggcatcattaataaaaatggctcatgctatactgaaagagcattctgttaatttttctattttatttgctgtttctcatgcttattatctctcctctggatatattccgatgaaaaatctcacccgttttattgagaataatgagaagaaagaatttatatatgacggtggtatggtgtgtgaattaggtagtcaaaattggaatgtaaatatattagaattaaatggggaagttgtataa

SEQ ID NO: 508 - DNA, 1443 bp, Proteus mirabilis
aataataaacttttgaatattcttaccatccgagaggtagttatgtcatttactaaatcaatgcttgcactcgctgttatggcggtttcttttactagtcacgcagccaaacaggctgatttaatgattgtcgatggcacagtgttaacaatggacgcacaaaatcaggttatcgaacaaggaacggttgttgtaaaagaaaataaaattatcgccgttggggggcctgagttaacacaagaataccaagccaacaaagtgttagatgtggatggtgatatcgtgatgccaggattaattaatacccacacacatgcatcaatgacggtttttcgctctttagccgatgacgtgccagaccgattacatcgttatattttccctttagaaaataaaatggtgtctcgcgatatggttcgcgtgggagcaaacctcgccaatgttgaaatggtaaaagggggagtaactacctatgttgatatgtattattttgaagatgaagtcgctaaaacggttgataagatgggaaatagagccatcttaggtgaatcagtgattaattttccggtggctgatgcacaaacccctgaagaaggcattcaatatgctgtcaattttattaatgaatataaagatcacccgcgcattattcctgcctttgcacctcatgcaccttataccaataccacagagaacctgcaaaaaattgctaaactctcggtagaacttgatgcccccgtgatgatccatttagcagaaaccgatagagagaaagaagaaattgcaaaacgaaccgatggtaaaagcccagttcaatatatggcagatattggcgctttaaataataaaatcattgccgctcatgcgattatggttgatgagcaagatattgatttattaaagaaatatgatgtaggtgtggctcataatattagtgctaataccaaatcagccaaaggtgtttcgcccgttgttgccatgctagagaaaggtgttcgtgttggtttagggactgatgggccaatgtcgagcaatacactcacaacgatgaatgagttaaatttagtaggcaaaattcataaattagagaataaagatcgcgccgcaatgccaccattaaccgttgttgaaatggcaacaataggctcagccaaggcattacatatggaagataaattaggctctttagaatcgggaaaacttgctgatattattgttgttgatactaaagcacctaatatggtgcctatgtatagcccatatgcagcattagtttatggtgcgaatggaagtaatgttcgtcataccattgtagatggtaaaattttgatggaagatcgccaactgttaaccgtagatgaacaagcgattatcagtgaagctcaaaactttgcgaataaagtacgccaaaccgttgttgatagtggtgaagtcgttaaatag

SEQ ID NO: 509 - DNA, 720 bp, Proteus mirabilis
aaaaataaactacctgcggtgatttggctgaatggaggatatggtgggataggaggagatgattatttttggacaccacaaccagttgaaaatgaccaaacaggagcgacgtttcgtgatcctaatatggtactcatgataccttcttttcgtggtgaaaataccaaccctggtcgctatgaaatgttttatggtgaattagaagatttagactcagctagagaatatttagcgtcattaccttatgttgatcctaaacgtatttacgtagtaggacatagcactgggggaacgagagcattattggctagtgaatacagtgataaattcagggcaatattctctttaggaggaatacctgatcttaaactacgcacagaagggcggatgatggttgaattaccctttgataaaaataacgaagaagaatttaatgtccgttctgtataccgctatattaaatcaataaaaacaccaacattttattttgaaggtcatgattatttttgggatgaattcaatgaattacgtgtgtttgcaatggaacacgatattcctctgaaaatttataatataaaaaatggagaccattttaatattattgtccctgttagccaattaattaaagagaaaatattgcaagatactgatacaaataaagaaagtaatattcgattcactaacgaagaaattaagtggatcaataaaatggtgaaataa

SEQ ID NO: 510 - DNA, 405 bp, Proteus mirabilis
agtgcagtttggtttaatgttttctcatggcgtgacatagagaaaataggtaaaccggtgctaattcgtgacatcatacgggcagtacgaccggactcagtcatagcgataatcgcattaacgcctttcatatggttagctgcatacatggttgacatggctatcgcttcttcagcattatcaaataccatatctaaacggtgttttgatacattggccgcaggcattttttccgcgcctaaacagacttgtgccattgcggctacagtttcagcgggatattgtcctgctgctgtttcagccgataacataacggcatctgtaccatctaataccgcattggcgacgtccatgacttctgcacgagttggcattgggttagttatcatcgattccatcatttga

SEQ ID NO: 511 - DNA, 300 bp, Proteus mirabilis
cgacgcgcttggaggtgcaacatgaaatataaacatgcttttgccgttggcaatttattgatggctatcggtatggtgcttatgctcggtagtcttggttataatcttcttagccatatttttccattaggactacctgatattttatctgatgcttcgctaatggggatctttattggtgcacttgtttggttagcaggggctcgtattggtggtagagaaaccgttgcagaaagatattggtggttgcgtaatcatgacgaacgttatcgtcgccatgataatcatcgttatccataa

SEQ ID NO: 512 - DNA, 954 bp, Proteus mirabilis
agtatcaattggcatttacatcaacgaataatacaaattatgaatatagaacttcgccatttacgttattttattgctgttgctgaagaattacattttggtaaggcagctgagagattaaatatttcccaacctcctttaagtcagcaaatacaagccttagaaagtgagataggggctcgtttactcgaaagaaccaatcgttctgtttcgttaaccccggcaggacaaatgtttttaaaaggatcctatcaaattatggcacaagttaaggcggtagcgacacgagcatcaagaatggaaaaaggagaattaggtgaaatttcaattggttttacctcaacaacaccttttatgcatttggttacgttaagtttgcgtcaatttagggaaaattatcctgaagtcggtattcatatgcatcaaatgaatactaaacagcaaatatcaccattattaactggccacatcgatttgggaattatgcgtaatacggtgttacctgataatttgcaccaccagctcctatttcgtgaaccttttattttggcagtttatgaagggcatcctttacttgaatacaaagaaacaggcgtaaatattcaagatattgggcaatatccttttgtattttttgagcgagatgtaggaacggcgctttatgatgaaattattcaattgcttagccttgcgggaattacaccaacgatagcacaggaagcaggagaggcgatgaccatcttggggcttgtcgctgccggattagggatttctattgtgacaaaatcatttacccgcatgaaagttgatggtgtgcattatctgcattttgctaattcgaatgctttctctgaagtatggttagtttctcataacaaacgaacgatccccgctgcggccaataggttgactcaattattgctaaaaaatatcttagaagatcaaaaatcttga

SEQ ID NO: 513 - DNA, 1332 bp, Proteus mirabilis
cacaaaaattggaggaacaaggttatggctggcttattgaccctcaatgagaaacgtgaaaaacagcatcaagtagaacagcgtaatcaacaggcattaaaacaattctctgcgctatatcaacagcgtaaaggggaagataatttaaatgcacgtaatcactggctacaagtggaaaaagtgggttttccagcttatcgacacgaagattggcattatacgccattagatgagacgctcagtcagcaatatcaaatgttgccaccttttgaggtacaagatttaattgagcaacgggcgctctcatttgattgctaccgtatcgtgatggttaatggtgcattttcaccggctgaaagtagtcaagattttggtccataccaagtgacattactggataaccaaagtgaattaccgcaagccattaatggtgaagtgttcttgcatttagttgaaagtttagcgcaacagccgctattcattaccttgaaaaaaggcgtagtggcagataaaccgctttatatccttaatattacacaaggtcatgcagggcaagaagttaacagtgctaactatcgtttccatcttgatgttggcgctaatgctcagatgcaagtgattgaacactatattagtagtgatggtgaaaaccgtcattttaccggggcgagattaaccgccactattggtgataatgcctcgttcaaccatattaaacttggttttgaaaatggcattagccaacattttgcccataacgatttaagcattggacgagatgctcgtgttaatagttatgcattcttgttggggaataaactgagtcgtcatcatactagcgctgcactgacgggtgagaacagtgagctatcaatgaatagtgtggtattacccaaagcgaacgaaattgccgatactcgtacttggctcgtgcatggtgagaaaaattgcctaagccgtcaattacataaaagtattgcaatggatgcagggaaagccgtatttaatggcatgatcacagtcacccctcaagcgctgaaaacagatggtcaaatgaccaataacaacttgttattaggtgataaagcacaaattgatactaagccacaacttgagatctatgctgatgatgtgaaatgtagtcatggtgcaacggttgggcgtattgatgatgagcaactattttatctacgttcacgaggtattgcgttaagtgaagctcgcaaaatgatcattcatgcatttgctgccgaattaacagaatcattagaaaatagtgtgatcaaaactcatgttctagagagaataaatcaacgcttatcagaggtataa

SEQ ID NO: 514 - DNA, 387 bp, Proteus mirabilis
aaaatgaattggtacttagaggttattaaaaataattatgctaatttttcaggtcgtgcgcgtcgaaaagaatattggatgtttatagtggtaaataccattattttagctgtgttatatgggatcatgttctcttctatcgacagttatactggtgaaatgagtggcacaggctttgctgctttgattattatcggtatctactctttagcaactattattcctaatattgcggtcacagtgcgccgttttcatgaccaagatagatctggttggatggttttattatcatttattcctttcgttggcggactgatcctgtttatttttatgtgtttagatggtactagaggtgaaaatagatttggtcttgatcctaaagcctaa

SEQ ID NO: 515 - DNA, 189 bp, Proteus mirabilis
gtaattgattggttttatttaggttttaagttgaagattgcaatacactgcatagttaatcaattcttagctgaacttgttattaatttattcatttatatcgcagtaatcatgcttaataaaaaaacaccgcaaaactcgacctcttattttacggtgttatttatattagttagggactatatctga

SEQ ID NO: 516 - DNA, 186 bp, Proteus mirabilis
gaatttttatgggatactcgatatgacatttactatgtagagataaaaatatatagtagaactaagtcacaagaatattacaccattcaaaatcgtaatagttttttatttagccttataattagttatagatatttttgtattgtaattatacctattagcttaaatatatacagggagagttaa

SEQ ID NO: 517 - DNA, 918 bp, Proteus mirabilis
cgctatttatggtcgggagaccaactgatagaaggaacgccgatatatgccgatggcactcttgcggagtctcagcaaatccaatggctgtatcaatccggagagataacacccaccgcgcgttatcaacagggtaaactgcattatgtggtcaccgaccaccaaggaaccccgcgagagatattcagtgaaggcggacaagccagttgggcaggacggctgaatacatggggccaaatgcagttttggcgttaccgagaaggcaaggcggagaatgaccctaattataccgaatgtccttttcgctttgcggggcaatatgaagatgaagaaagtggcttgtattataatcgctttcgctattatgataaggagacaggacagtatctttccccagaccccatagggctattgggtgggctgaatccatatgggtatgtgcattgtccgacggggtgggttgatccgtttgggttgcaagttgtaaatgcttcattatcaggaaatagtcactctacaagctcagcacaaggagctctgcttaaacaatattacagcaccgcagaaagtgctaatgatgttgtaaatagtttaaaagcgacaggaaaattaccagataactatgtaacaaaagcacaggcagaggctgctgggtggtctagaggaaaagcgttaggaaattatgttccgggaggtcaaataggaggggatatttttgctaatagcacgaagatcttacctgatgcccctggaagggtatggtatgaagctgatatcggactgaataatagcatgtctagagcgaagcaaccaggtaccagacttttgtattctaatgacgggttaacttacgtaacttcaaatcattacgatactgccgaggcattaggcatttggaactgttgtaaaggaggttaa

SEQ ID NO: 518 - DNA, 729 bp, Proteus mirabilis
tatcacttatgttatcctgattacactaaattaattaagataaactcgcttatcagtccaaggagatgtgagatgtttacaggtattgttcagggaaaaggacgtgttattgccattgaagataaaggtgatttccgtacccatatcattgaattaccttccgagttagtcaataacttagaaacaggagcttcgatcgctaacaatggttgttgcctaaccgtcacaaaaatcgatggcaataaaattagtttcgatttagtgaaagagacgctgcgcttaactaatttgggcgagttaacggttggttcagaagttaatattgaacgagcggccaaatatggcgatgaaattggtggtcatgtgatgtctggtcatattgtcactacggctgaaattgcgaaaattattacttcagaaaataacttacagatctggtttcgtatttttgatcagacattgatgaagtatattttgcataaaggttttattggcattgatggtattagtttaactattggtgatgtggttaataatcgtttctgtgtccatctgatccctgagactcgcgatagaacgacgttaggtcgtaagcgtttgggggataaagttaatattgagttagatccacagactcaggcgattgttgataccgtagagcgtgttatggcgcaacaagcattaacggttaagcttcaagcaacacacgaagaagaaaacaaaaaataa

SEQ ID NO: 519 - DNA, 297 bp, Proteus mirabilis
cttcatatatgtaaggaaacaatgatgagagccacagtctttgggaaaagaattggattacataatgacaaaacgaccaccggagcgacttgtcttgctagcatattaacggtcaccaatgaagggattagcatattgaggcttggagataaaacaacacgttgtccagtatgcaatgaagaaggcacgatagtgactggagagcaaggaatgatactggatggacaaaaaattgctgtagaaggctctattgtccaatgtggctgctcttatggaaagaatagggttacttgttaa

SEQ ID NO: 520 - DNA, 300 bp, Proteus mirabilis
aaaataaagtgtgttttaggagcgattatgaaaaaggccattatcctttcggtatcattagccacattatttcttgctggttgcactgcagatggaaaaatcaaaacctctcaactgacacccgttaactgtgtcggcgtatttaataaaactaatgaacaagtcagctttacggcaaaagatgttgatcagcgcttatacagcccagataagccaatagacagtgttgatggttggattgatgttaaagatgtttctggtcttctctgtgaggatgtgatcacggctaatgaagactag

SEQ ID NO: 521 - DNA, 525 bp, Proteus mirabilis
cgatatgagtgggaatgtgttattttaataggattaattttcaaaaagaaacaatcaaagagagttactatgccgatatgggttgatgctgatgcctgtcctaaagttattaaagagatactttatcgggcagctgatagagaaaaagtggtgatcacttttgtggcaaatcagcgattaagtatacccgcatcgccttatttacgcacattgcaggtttctgcaggttttgatgtggctgataatgaaattgtacaacgtgcaaaccaagatgatttggtgatcactgccgatattcctttagcggctgaagtgatcgaaaaaggggctattgcactcaatcctcgaggtgaacgttatacagagtcaacaatccgcgaacgattaaatattcgtgattttatggatacgatgagagcaagtggcattcaaacaggaggaccagcaagtttatcacagcgcgaccggcaactttttgctaatgagttggataaatggttactacagcaaaaacgtaaaaaataa

SEQ ID NO: 522 - DNA, 300 bp, Proteus mirabilis
aatgataggtgcattaccttgaacttaataaaaaaacatcatcgaattatcagcttaactgtgatgactgtattgttgacgggctgttcacaagggcattctccttttattcctatgctaggtgcttattttccctattggatgttatgtacatttattggcctattaggtgctttttgtctacgggttttacttatctactggggaattgatgataaattgccagtacctttgttattttattttgcgattatgctatcaatttctttaactatctccttactttattttacttattaa

SEQ ID NO: 523 - DNA, 909 bp, Proteus mirabilis
aacacaaggtgggatatgcctttagatagccagttttataaagagaaaaaaacaccatcaccagctgcggtgatttggcaatgtttttctaaagatattctctccatggtgggcttttatggtgttatcttcctgttaatattaagtattgttggtccttatattgcgccttatgcactcgaccaacaattcttcggtcatcaattaacaccgccttcttggtatcaaaacggtaatgtcaccttcttttttggtactgatgatttagggcgcgatgtctttagccgtattttaattggtacgagtatgacctttggtggcgcttttattgtcacctttgcggcgacactgatggggttaattatgggttgccttgcaggaatgacccacggcctaaaatccgcagtgttaaatcatattttagatacactgttatccattccttcactcttattagccattattgtggtcgcttttgtaggggcaagtttagagcacgccatgatagcaatttggctagcactactcccccgcttagtgagaatgatctattcagcggtaaatgatgaattaaataaagagtacgttattgcctcacgtcttgatggtgcatcaaatatctctattttatggtataccgtattgccgaatattaccccagtattggtttctgaattaactcgggctttttctatcgcaatattagatatcacggcattaggttttctgaatttaggcgctcaattaccttcacctgaatggggggcgatgctcggcgattccctagagttaatctatgctgcaccttggacagtccttatccccggagccaccattatgatcagtgtattacttgtcaatttattaggggatggcttacaacgtgccattaatgagggggtggaataa

SEQ ID NO: 524 - DNA, 567 bp, Proteus mirabilis
tacaggactcgcacgctgggcgatggcgacgatgttaacacttgctacctgcttaggggttattttagcgatggcagtatgggagttaagagattgggcataatcaacattattctaacgctaattgaagatatgattttagcggcaatacctgcggtggggtttgcaatggtatttaatgtaccgctacgtgcattaaagtattgtgcgttattaggtgcaatagggcatggctctcgtacggtattaatgatcagtggtatgaatattgagtgggcaagcttttgtgccgctattctagtcggttgtataggtattcaatggtcacgctggtggttagctcatccaaaagttttcactgttgcagcaattattcctatgtttcctgggatcaatgcttatgttgcgatgatctccgtggtgaaattgactcaaataggctatagcgaagaaatttttgaagctttagtgactaattttcttaaagcttcatttattgtgggtgctctttctattgggctatctttaccaggattgtggttatatcgtaaacgtcccagtgtataa

SEQ ID NO: 525 - DNA, 828 bp, Proteus mirabilis
tgttattatcgcaatttacgaacaaacaaggatacagctatgggctttatgaccggcaaacgcattctgattactggtgttgcgagcaaattatcaattgcttatggtattgccaaagccatgcatgatcaaggcgctgaactggcttttacttatcagaatgaaaaactcaaacctcgcgttgaagagtttgcagcctcattaaattctaacatcgtattagagtgtgatgtgtcaaaagatgaaagcattgacgcaatgtatgcagagctagcaaaagtttggcctaaatatgatggttttgttcactctatcggtttcgcacctgctgaccaattagatggcgactatgttaacgctgtcactcgtgaaggctttaaaattgcccatgacatcagtgcatatagctttgttgcaatggcaaaagcaagccgtgcaatgttaaatccaaactctgcattattaacgctgacttacctcggtgctgagcgtgcaattcctaactataatgttatggggttagctaaagcttctctagaagcaaacgtacgttatatggcaaatgctatgggtcctgaaggtattcgtgttaacggtatctctgcaggtccaattcgtaccttagcggcatctggtatcaaagatttccgtaaaatgttaagccattgcgaatctgtcacccctttacgtcgcacagtcactactgaagatgtgggtaatactgcagctttcttatgctctgacttatctggcgggatcaccggtgaaatcattcacgtagacggtggttttagcattgccgcaatgaatgaattagagttgaaataa

SEQ ID NO: 526 - DNA, 1428 bp, Proteus mirabilis
ataagttatcgcgtcacgtgtcttgggagaaacatgaaacgcttacaaaatgaactaactgcactgattaatcgaggcgtagataggcatttacgcctcgctgttacagggttaagccgcagtggtaaaacagcctttattacctctttagtcaatcaactcaccaatgtacatagtggggcgcgtttacctttattttctgcggcacgcaaccaacagttattaggggttaaacgtataccgcaacataacttaagtattccacgctttacttatgatgaagctatggagtcactttaccatacgcctcctagctggcctgttcccactaagggtgtcagtgaaatacgtttgcaattacgctatcgctctcatgagtctttaacgcgttttataaaagagacttcatcgctctatttagaaattgttgattatcccggtgaatggttacttgatttacctatgcttgagcaagactattttgaatggtctgagcagatgaatagagttaatcaacaacgaacggcacctgtgcaacagtggcagtcgttaataaaaaaatgtgatccctttgcccctgctgatgaaacgctgttagccgagatcgccgcagcttatactgaatacttattagcctgtaaaaaacagggactacattttattcaaccgggacgctttgttttaccgggggaattatccggtgcacctgttttacaatttttcccttgggctgacttaacgcaatacgatagtgctaaattaaaaaatgccgataaaaaaaccaatattggtatgttaaaaaagcgctatgaatattatggtcaacatattgtaaaaggattttatcgcgaccattttcaagggtttgacagacaaattgtcttagtcgattgcctacaacccctaaatcaaggtgcggatgtttttaatgatatgagacaagcgctcacacaattaatgcgcagctttcattatggcaaacgaaccttattaagacgtttattctccccctgtattgataaactgctatttgcagccactaaggctgatcatatcacgccagatcagcatgaaaatttagtctctttgttacagcaacttattcaagatgcgaaacagaatgctatttttgaaggaataagcattgattgtatggggcttgcttctattgctgcgacagaaagtggcattgtcgatcatcatggtgaaaaaatcccagccgtaaaaggctaccgactaacggataatcagccgctcgtttattttccaggagaagttcctaagagattgcctgaaaaggcattttggcaaaagcaaggatttagttttgaatctttccggcctcaacaaatatcgagagacagtgccgttccccatattcgtatggatagtgccttggagtttttattaggggataaactaaaatga

SEQ ID NO: 527 - DNA, 1455 bp, Proteus mirabilis
agtcaaagtcgaaggcaataccgtcagtgtgcgttcgcgtcattgataaaaccaataaataggggaacccagatggattattttccaatattctgtcagctcaacaataaaccttgtttattagtaggtggcggtgaagtagcagagcgtaaggcacgtttactgatggacgcgggggcggttatatccgtcgttgcaccgacattcacaccacaatttatgcagtggcaaaacgagcaacgattacagtgtttcacggctgaatttagtgttgctgatttagctgacaaatggctagtcattgcggccacagataatgagcaagtgaatcaactcgtctatcagcaggccacagaacaacgcattttttgtaatgtggttgactcgcccaagcaagctagctttattatgccctcagtgattgaccgttcccctattatggttgcaatttcttcgggaggaaaagccccagtacttgcacgtatcttacgtgaaaaaatggaacagtggttgcccaactcgctaggcgctttagcgcagttagcagggaaattacgtgagcaagttaaacaacgttttgccaccatgggtgctagacgctatttttgggagcgtttttttgcagataaagcgctacaagtggaaattgatgcaggtagagataacggtattcaacaacgtatcagcacattgctagcggaaaataaccaaccccaagggagtgtggtgttggtgggggcaggccctggagatgcaggattaatgactattaaagggctgcaacaatgtcagcaagccgatgtcgtggtttatgatagattagtctctgatgaggttatgcatttagtgcgcagagatgctgaacgtatttatgttggtaaacgagctggttttcattgtgttcctcaagaggagattaaccaaattcttattaatcacgctaaggcagggaaaagggtagtgaggttaaaagggggtgatccttttatttttggtcgaggaagtgaagagttagaagctttaattgagcatcaaatacctttttctgtggtgcccggcattaccgcggcatcaggctgtaccacttatgccggtattccgttaacacatcgggattatgcacaaagtgtgcgttttattactgggcatggaaaagggctgaacgacgcacaatggcaatgtatcgcacaagataaccaaactttggttttttatatggggctaagtaaagccgattacattcagcaaatgttacttaatcagcatatgcgtgccactatgccagtggcaatagtagaaaaaggtacactagcgacacaaaaagtggttgttggtcaattacagcaactggctgaaatggcaagctcaatgaaaagtcctgcattaattattgttggtgaagtcgtcagtttaaatcaaaagctacaatggtttggtacgactttagccaattaa

SEQ ID NO: 528 - DNA, 1716 bp, Proteus mirabilis
gaacgtatgctacaaagcatacacagaggatggactagaattatgaagaaatcgcttgtcgctgttggtgttattgttgcactaggtgttgtttggaccggtgcatcatggtacatgggcagtaaaattgaaagccgcttacaggaagaaaccaaacgcactaacgttcaattagcgcaacttgctaaagaaagccaattaggtgcggatattaaacttgaaattcgtgactataagaaaggcgtctttacttctactgctgatcttgcggttgtgatttcagagcatgccaaatcagatgaagataaaaaagtagaagaagtgctctttaagacggatattgaccatgggccattccctctttctgatattgctcaatttaatctagctcctaagttagcagcaatgaataatactttagtgaataatgagaccactaaagatctatttaagttgaccaaagagccatcatttattgatatgcactcttctttatcgtttgatggcagtgtatcaggtaaagttaacataaatcctattaattacagcaaagatggtagccagttaacaacatctgcgtttcagattgatttttcttccgataaaaatgcaacaaacatctcaacagcagtaaaaggtgatgaagtcattgttaagaaaggtaatgatgaaacctttacgctgaaaaatattgcaggctctgtcgaaggaactaaagttaaagacgatcaatatctatttgatacacaaacactgaactttggcgatattacctttacgagccaagataagtcatctaatttcactttaaaagatacttctcttgcgactaagagccaaattaaagataaattattctttatcactcaagattatagttttaaatctcttaatgttggtggttttgattttggtgcgggtaaatttgcttactcaattgataaagcagacccagatgcgatgttgctattaacaaaagtttataacagcaccttcttaccttggaatcaaaataaatacgataattcagcgatgattgagcaagctgtacgtgatgttttggaaaaaggtttagtattccgtatcgatgaagcatcgcttaccaatagcagtggcgcaagcaagctaaactttaagttagatttaaatgcgttcaatgctgatgcactgaaaaaagaaaacaaggcgccttcagttctgtttaatgaattgtttaataatatcgattttaatatcgatctttctgtaccaatgctaacggagttccgtagtaccacacaataccttgatgttatgcgttattctgaaaaaggcttaacagacgaagataaagctgaaattcagaaaacaaccgctaacgacatggcacagttaaaaactgaattacagcaaaatatcaatcaaatttctcaagacgagaaagatgctctgccattgatgctgttatcacaagacggtaataaactgtctttaaacctgaactatgctgctgataaatttactatgaacggtaaaacttacagctttgatgagtttatggaagtaacacaagcccctcaaatgttaggtttagcggctatgttatttggtgcaggtgcttcttcttatgattatgatgactctgattatcctgaatattcagaagagccagatcaaaatgatgcaatagaagagccacaagttgaaatcccagcggcacctgctgaaaacaattaa

SEQ ID NO: 529 - DNA, 600 bp, Proteus mirabilis
aaaataatgcttgtactaaaaagaggattagacatgccacaaattgttatggaaaatcttaaaaatctttactacgacatgcgttcaaataaattgtcagttcaaatttataacgtccaattaggcgctattagtttcaatgtttgcttttcaatttcagaaaacccatttgtcttaactttgacgtctcgtacagatacccccgaattttttctattcaatgtaacaaatggatttagactagaaacattcatcaatatcgatacatttaaacgacttcaatatcttctatatattggaaaaaacagtaataagctaagtaccaaatcattttttttagatctagataaaaaatcaccaacaaaagctaatcttgagaaaatagatgaacgagagattttaaatttaagacaagatatcaaatatgatcgagaaagaccgtattttgatcattggcgcgaacatataacagatggtaaaaatgtaacagaagataatttagcaaaaacattagctctcttagggaaggaagcttattatttttctagaaataataacaattcggcgatttggagtcattgccccgttatcaggaattaa

SEQ ID NO: 530 - DNA, 639 bp, Proteus mirabilis
actgcttcccgcgataatacacactatttaaggagagagctgatggctcagctttacttttattattcagctatgaatgccggaaaatcaacatctttattgcagtcttcttataactataatgagcgaggaatgcgaactttgatttttacggcagcgatagacacacgttttgccaagggaaaagtaacctcaaggatagggttaagtgctgatgcattgcttttcagtgatgatatgaatattcgtgatgctattttagctgaaaataataaagagcctattcattgtgttttgattgatgaatgccaatttttgactaaagcacatgtagaacaactttgtgaaattaccgatagttatgatatacccgttttaacctatggcttaagaacggattttagaggtgaattatttaccggtagtgcttatttgcttgcatgggctgacaagctcgttgagcttaaaacagtttgttactgcgggcgtaaagcaaataaagtattacgcttagcggcaaatgggaaagtactttcagacggcgcacaagtggaaataggtggtaatgaaaaatatgtttcagtgtgccgcaaacattatacagaggctacgttaaaaggacgaattgaacagttataa

SEQ ID NO: 531 - DNA, 1401 bp, Proteus mirabilis
tgcgctagccgcaagaggataaaaataatgactgtattaaatgccattgttaaagataaagccgaatatttagttgcacgtaaagcacagcaacctttatcaacctttatagataagattgcgccatcgacacgctcattttatcaagcattaacgcgatcacacccagtgtttattttagagtgtaaaaaagcatcgccctcaaaagggattattcgctctgattttgatcccgttgccattgcgaaaatttatcaaccctatgcagccgctatttcggtactgactgatgaaaaatattttcaaggcagttttgattatttacgtcaagtcagtgatgccgttcatcaacctgttttatgtaaagattttattatcgatgaataccaaatttatttagctcgtttttaccaagctgatgccattttattaatgctttctgttcttaatgatgaacagtaccgtgcgcttagtgccgttgctcaccaattaaacatgggagtattaacagaagtgagcaccgaagaagagcgtcagcgagccattgagcttaaagcaaaagtgatcgggattaataatcgtaatttacgtgatctctctattgatttatcccgtaccgaacaacttagccaaggtttaccgcaagaggctattgttatcagcgaatctggaattcatacccatcaacaagttaaaacactaagtcaatatgctaatggctttttagtgggtagtgccttgatgtcacaagagaatattgcccaagcggtaagagcacttattttgggaaagcataaagtgtgcggcttaacccgtacacaagatgttaaagcggcctatcaagcgggtgcctattatggaggattaatttttgctgagaaatcaccacgaagagtgacgctgtcacaagcgcaattattggtaacacaagcgccattagcttttgtgggcgtttttcaaaaccaatctattgagcttatttgtgactatgctaaacaacttaatttatctgcggttcagttacatggcgctgaagatgcacaatttatagcccaactaagggaaaaaatcgccccacaatgtgaaatttggcaagcgcttaatatggcttatcaccatgatattcagcacattgcgcaagttaacaaatatgtattagataatggtacgggtggcacaggcaacacctttgattggcaaactattccgcctactttacgccataaagcattacttgcaggtggcctaaacagtgataactgtttagacgctctaaacaccggttgcttaggacttgattttaattcaggggtggaatcttcagcaggtatcaaagatccacaacgtctatcgcaagtctttacacaattacaacaaagcaaattttcacaaaatttctga

SEQ ID NO: 532 - DNA, 807 bp, Proteus mirabilis
gcaacgtcgcttctggtagaatacccgcttcttttattctttaagtctattttagttatgtctaattcaaaatcagcaccacaagacaacttatttgcgacacctattgctaatcttggtgactggcgctttgatgaaaaagtcgctgaagtgtttcctgatatgatcaaacgctcagtgcccggttactccaatattatttccatgataggcatgttagcgggtcgttttgtcacccctcatagccaagtttatgacttaggatgttcgttaggtgctgctaccctttctatgcgtcgtaatatcgatgtagcgggatgtaaaattattggtgttgataattcacctgcgatggttgagcgttgtcaacgtcatattgatgcttataaagcagcaacacccgttgaaattattgaaggcgatatccttgatattgacattaataatgcctcaatggttgtccttaatttcaccttacaatttttagcccctgataatcgccaaagattattaaatcgaatttaccaagggttaaatcctggtggggttttagtgttatcagaaaaattcagttttcaagataaacaaattggtgaattactgtttaatatgcaccacgactttaaacgtgctaatggctacagtgaattagagattagtcaaaaacgtagtatgttagaaaatgtgatgctcactgatcctgttgaaacacataaatcacgcttacatcaagcaggttttcctcatgctgaagtttggttccaatgttttaattttggctctctgttagccatcaaaggcgaataa

SEQ ID NO: 533 - DNA, 420 bp, Proteus mirabilis
gactctaaacgtgatttcatgatgcgatcagtacgatcacagatagtcgccataatagtcacagcttctactggatatttacctttcgcactttcaccggatagcataacagcatcagtaccatctaaaatagcattggcaacgtcaccagcttctgcacgagtagggcgtggatttttgatcatggaatctaacatctgtgttgcagtgataaccactttacgcgcagcgttacatttttcgatcatcattttttgtgcaaagataacttcttcaacagggatctcaacacctaagtcaccacgtgcaaccatgataccgtcagaggcttctaaaatttcgtcaaagttatttaaaccttcttggttttcaattttagagatgatcatgatgttttcgccaccgtgtgcttttaagtga

SEQ ID NO: 534 - DNA, 465 bp, Proteus mirabilis
ctgaggaaacggctgataatagccgtttttatgcctatgctaaatcgtcatatattatcatttatattttgcctatttggattatttcttattatttatagcgcctattcattaggtgattttagtgaatatggtgcggcttttatgccttcactaattggtggaggaataattattttttcattattagatatttttgcaaaaaagcagcaaatggatacacctttggtgacatggcatgaaataaaatttgtgttattaattattggtatcattctattttatgtgttttttgctgaataccttggttttattgttacaggatttattgttattgcaccattaatgatgaaatacgcaaaagtaaaaccaatatttagttttattatttctgctggaattgtattaggcgtttactatttatttaccgctgtactgttagtaccgctacctcaattattttaa

SEQ ID NO: 535 - DNA, 204 bp, Proteus mirabilis
caatcaccgctgatttatttaaataatctgttgttactttctcttttaaaaaccttgcactatgcaaggtttttttatacttgtccaaataacctcactcaatttcttatccttatgcataaaatttatgattttatgcatagacaaccaagtcaactctccgtaaaatctcgctgttttttagtggttttatctttgtcttaa

SEQ ID NO: 536 - DNA, 825 bp, Proteus mirabilis
atgtggagacgacagatgttcgataaattacttgaagtcaaaaacttatcaaaaacatttcgttaccgtacaggattattccatcgccagcagttgaaagcggtaaaaccggtgagtttcactcttgaaccgaagcaaacactggcgattattggcgctaatggttcaggtaaatcaacattagctagaatgttatccggcgttacagagccaacggggggtgatatttttataaacggtcatcaattaagttttggcgattactcttatcgtagtcaacgcattcggatgatatttcaagatcccacaaactcactcaatccacgtcagcgtattgggcaaacattagatttaccattacgacttaataccgaacttagtggcatagagcgagaaaaacgcatttatcaaactttgcggcaagtaggactattaccagaacatgctaattactatccacatatgtttgcctcaggacaacgccagcggatcgccttagctcgtgcacttattttacagccacaggtgattatagcggatgaagctattgcctctttagatatgtctttacgttcacaaattattaatttgatgttagagctacaagagacacatgaaattgcctatatctatgtgacacaaaatttaggaatgactaagcatattagtgataaagtcatggtgatggataatggtgaagtggtcgagcgtggtaacaccgctgaggtattagcatcgcctttacatgaagtgacacgtcgattagtggctagtcattttggggaagcacttacggcagaagcttggcgacaagatttaccttaa

SEQ ID NO: 537 - DNA, 225 bp, Proteus mirabilis
cctcgaaagcggttacataattcattagggtttattttatcaggcattaaactgtacttatccgatgaaaatagcacatcagaaattaataataatcaggaaccagaaaagcaatacaatgcctttctggttttactaatatttagttacccagagcttgactggcacttttgttttcgattaattcaattttatatccatcaggatcttctacaaaggcgataa

SEQ ID NO: 538 - DNA, 819 bp, Proteus mirabilis
atactaaggcgtagtatggataatcagataatggctgaagaatatgccatttcacaagataaacagcgtgaaattacgaaattatgtattcaaacggcgctattgttgttacaacatggtgctgaaagtatgttggttgaacagctctcaacgcgacttgggctggctttaggcgttcatcaagttgaaacggctatttcagccaatgcggtggtattaacgacaatagttaatggtcattgccaaacctcaacacgaaaaattgttgatcgtggtatcaatatgcatgttgttaccgaagttcagcacattgttattttagttgagcatcatctcgcggatattgatgaagcaaggaaacgttttgaacatatcaaaccactacgttatccacgttggataattattgttatggttgcactttcttgtggatgtttttccaaattgaatggcggtgattgggatggctttttagtctctgctttggggggaggaatgggaatgtgggttcgtcagctcctcactcatcgtcaagtaaatcctttaatcaacttttgtattacggcatttgttgcgacatcagtatcaggtttattgctaaaactcccttattttcaagttactgccactatatcaatggccgcgagcgttctattattagttcctggatttcctttaattaatgctgttgctgatatgtttaaaggtcatgttaatacaggactcgcacgctgggcgatggcgacgatgttaacacttgctacctgcttaggggttattttagcgatggcagtatgggagttaagagattgggcataa

SEQ ID NO: 539 - DNA, 888 bp, Proteus mirabilis
agtatgaggcgttttattagggtagatcttcctcctgaacctatcattaatgataaatgtgttaggaaacgcctcaaacaaagcctttgtgatagctgttcaaaagtctgtcctgtggacgctatcacttttagtcttttgaacgttgaaatagataatgagcgttgtttccaatgcggtaattgtctatttacttgccctgttgacgctatagaaaatatctccccccatgaacgtagctttcaagataatctattagtcattaatcatgatgaaccactggccagtattgaagagcttttggtttggcatcgacaatatcaaatacgcggtatgaaaatagcggaacccttggttgataagtggctgccgatactcgcacaacttaatttgcaattaaaaaccttacaagagcctatttggcaattagttttagtggagcctgaaccggtcgatagtggtcgtcgctttatgctatttcgacaaaaattagatgaaaagccacttaataaaggtcacgtaaaaacaggattaaatgcaaggaaacagctttatccgcaagatagctggttccatattcaattagataaagaaagttgtattctttgttctgcatgtgccaaggtgtgtgatgaaggtgcaatcacaatcgaagataatcgctttatcattgatgaaaaacgttgcaccggttgtatgaactgccaagttgtctgttttccaaaatcaataaaagtcgtagaacaaattgctaaaaatagcacaccgacacattaccattattatgatgcacaatgtgataaatgccgccttgctttttttgcttgggagcctaatgccaccttatgtccgatttgtactcagcatcaaaaacagggatggctataa

SEQ ID NO: 540 - DNA, 705 bp, Proteus mirabilis
aaagatattttgttcagtttacacaaaactgatacccatatattattacatacttatggtatgttttatgggttttttatcatgaaattaaaatcacggcaacaagagaattcagaacaaacacgcttagctttacttgaagccgggcaatatctctttgtaaatcaatgctattatgatgtttccattgatgaaatatcacgttatgcaagggttactaaaggggcgttttatcatcacttcagtaataaaaaagcccttttgagagagtgctatttactgcaagttaagcatgctgttcaaaaattagatgaagtgcctacttatgatgataaatggcaagagctaacggctctcttctctctttgtgttgaccatatttatcagtgtaaaaacgagttaattcccttacaagaagttatctcggtattaggttggaaagagtgggaagagattgacgccaacattcttattcctcgtatccaacactgtgttgatattctctttgctgaaaaacagatctgtgcttattcaccggctattgtggtgaatttaatttatggttttattactcatattgctatcaatctaaaaaatgaagcgtcattgccgaaagaggcatgtagtgactttaaagctatttttgctgattttttaatcggggtaaaacaagcatcaccacagcgtcatcaacatagggtataa

SEQ ID NO: 541 - DNA, 1026 bp, Proteus mirabilis
gtactctttttctatgctttcctcggttcacagaacaaaaaaaggttaaatataatgtctaacaaaccattacatagaattgatttgaatttgttagtcatatttcaaattcttttacaggagcgcagtgtcaccttggccgctaagtggttatccatttctccttctgctgtgagtaaagcattagccaaattaaggatatggtttgatgatcctctttttatccgtagtccacaagggttgatcccaacaccattatcgttaagtattgaagattctttatctgattttattaatattagccaccatatagccaataaacgtaatacagaagttcctgttggacttaaatttaatttagttttagaaacaccgttacatcaggtcatgttaccttctttaccacaacaaatattatctcattacccaaaatccacacttcagataaaaaattgggaatataattccctttctaatattattgatggagaagttgatattgggcttgttggacgagaatactattcacgctcaaaagagttactagagctacttcctgatgtgattgattatgaaatattatttgatgatatcccactcgtttatctacacaaaaatcatccgttaatgaaaatgaagtgggatcttaataattttttatctttttctcaggtgagtacagaatatgacaaacaaagtcattgggctttagataatatcttaaaagaaatgaacaaaagtcgtcagatagcaattacttatacttcttttgagcaatctctttttatgatatctcaacctgaccatcaattaattacttgtgcaccaggatattgtcgttattatgtgaaaacacattttcctgatattgtaacattacctatacctctcccccctgtgtttttagaccatcttcatctaccttttgttttgttatggcataagcgtaatagccataatacaaaaattatatggctaagaaatacaataagaaaaagtattaaccaacaaacctcctatatctga

SEQ ID NO: 542 - DNA, 840 bp, Proteus mirabilis
cgatattttagctgcacgaggagaaatttaatgagccgttaccaattatgctttgaagcattagcacaaaaacaacaaggcgcgtttgttccctttgtcactttaggtgatcccgatgctgaactgtcgttaaaaattattgacgcattaattgaagggggtgcagatgcgttagagataggcattccattttctgatccactggctgatggccctactattcaaggggcaaacttacgagcattaaatgctaatgtcaccccaaccctatgttttgagttattaagccagatccgccaaaaacatcccactattccgattggactattggtgtatgcaaatcttgtttttagcaatggcgttgataatttttaccataaatgccaacaagcgggtgttgattcagtactgattggtgatgttcccttgcgtgaagcaaaacaatttcgagaagcggcattaagcgcgaatattgccccgatttttatttgcccgcccaatgcagatgatgagttattacaagagttagccaccagcgcagagggatatacttatctattatcaagagccggtgttacggggacagataaacgagcagaacagtcactcactcatttaaccagtaaacttaaagcttataatgcaccacctgcattacaaggttttgggatttctgagccacaacaagtttcacaggccattagtaatggtgcatttggcgctatctcaggctcagccgttgtacaaattattgaaaataacctacatcaacctgatgtgatgttaaaaatgttgacgcagtttgtgcaacaaatgaaagccgcaacaataagcgtttaa

SEQ ID NO: 543 - DNA, 849 bp, Proteus mirabilis
tttatgtttagtcaatcattattaaagttaaatatcccttcggagtatgccgttattggtgaaagcgatatgcataatgaattaggctatccattagcattatcttatgttgtggttattatttgtttagatggcagggctgttattaatatagattttcaaacaaaaaccattaaagcgaatgatatagtgatactcggtgatgatagaatggtcacattgcaacgtaaatcagctaattttcgtattttttattgttttcttaagaaatcttttgcctctgagatcgcttatgcactttcaaatagtttgtttacatttttgcatgaaaaccccatttgtcgcccttcaacggctcacttaaacgccataaacaattgggtggaacaattaaaatatatagataaaagttatactgatcatagaaagttaatgttgagagggcagttacaaaatcttttttttgcgataacagaattaataccatctcattattccttatctaaaaaagaattcagccgtaaagagcacttatgttggcaattttgggagttagttataaaacatagccaccagcacagagacgttgcctattatgcaaatcgccttagcatcacaccgttttatctatcacagctcactaaacaatattttaatgatgttcctaagacgctgattaataggcaagtaattcttaaaataaaagcgttattgacgcacactacgctatcagtaaatgagatcgccataaaactccattttgacgatccctcatatctatgccgttattttaagcgcgagactgattgttccttatctggatatcgccaacaatatcaacggcaataa

SEQ ID NO: 544 - DNA, 1200 bp, Proteus mirabilis
ggaaggaagcttattatttttctagaaataataacaattcggcgatttggagtcattgccccgttatcaggaattaatatcatggaagataaattaaaagaaattataaaaatagatttaattagagagtttcgagatttagtgaatgacaataatagctttatttatgtgaaatattcaaatattcgcaataaaaatttattcaatcctatatgtagtagtatggattggattggtgtcacaactaattatttatataatttcccctctttatctaaagatatagatgtaaaagttatgcaaatatactcttttatttcttcaattgatattactttagaagcgataaaacaactacatcgtattttactggatgattacaagcttaaaaaatggccatttttcaaagagaataatatatttaaaaacaaaacaataaaaaatataaatgatgacgactattttaaagagattcgagctcattttggtgcccatccaactaatctcaatggaaatgataatgaaaaattatttgctagctggccttttcatccaatatttgatgataatgatttaagtgtacgagtttaccccaatgcaatagataaagatgatttaaagtttggcataaaactcaatgagttaatagagtattttgattctagatattgttacctcaaagatttaatgacggaaattaataaacaatataagaatttttgtgatgaatacaaaaaaataccaattcaaaattcacaagatattgtttctgaattggaaatattaaaaaacgaagcagagataaggttaaataacaaccactacatttataccttaaatgatttaaccaagatattccgaactagcttaggcgaacatggattaaagaaaaaagaaactatatttaaggaggctttagaacctttaattactgaaataagaaaaaacttgcaagaaatgaatttaattgatttaaaagaaagcaaatatatcagttattctttaaaagataaatcacacacatatgagttaactaaactatatacttggctttatagtaatagtaaagacccattagctgattattatttaaataaaatgaatgaaattagtaatggagaatattccttttctatattagattctaaggaagttaattttttaaaattaaaaataatgctctttttcgataataattga

SEQ ID NO: 545 - DNA, 1527 bp, Proteus mirabilis
actattgttagtaaattgcctccgacctattcatgcgattctttttcaacggaaaatagctttactatgacaacattttatactgtattaagttggctaacttttttcttctattggctattgatcgcaggggtcacatttcgtgtcctaatgcatcgacgacctgtcacctcaacgatgacatggctactgattatttatatccttcctttagtcggtgttatcgcctattttgcctttggtgaacttcatcttggtaaacgccgtgtcgaacatgctaggcagatgtggccttccgtagttgcatggcttgaagaattaaaaaaatgtaaacatattttcgctaaacactatagtgatgttgcggagcccatttttcagttaaccgctaaacgccaaggtattaatggtgtaaaaggtaataagatccagctactaacaacttgcgaagactcattaaatgccatcacgcgtgatattaataatgcgcgcgataatattgaaatggtgttttatatctggcaatccggaggattggtagaggaagtcactgaagcccttattcaagcggctaaacgtggtgtaaaatgtcgcattatggtggattctgcaggaagccgtagtttctttcgcaccaatggccctgcaagaatgcgagccgccggcattgaatttgtcgagtcattacaagtcaatctgttccgtttcttcttgcgtcgtatggacttacgtcagcatcgtaaaatagtattaattgataactacatttcctataccggcagtatgaatatggtcgatccacgctattttaaacaagatgcgggtgtcggtcagtggattgatattatggtcagaatggaaggccctgtttctacgacactgggtattatttatgctttcgactgggaaatggaaaccggtgaacgccacttaccaccgccaccagataacaatattatgccatttgaacaagcaaatgggcatactacacaggtgattgcctcaggtcccggctttcctgaagaactcattcaacaatcattaattacggccatctattcagccagaaaagaattagtcatgacaaccccctacttcgtgccaagtgacgatctggctcatgccatttcaaccgccgctatgcgtggtgttgatgtcagtattattgtgccacgaagtaatgactctttcctggtacgttgggcaagccgagccttttttactgaaatacttgaggcgggtgtaaaagtttttcaatttgaagatggcctattacatacaaaaagtgtaatggttgatggtcaactgagtatggttggctcggttaaccttgatatgcgtagtttatggcttaattttgaaataactgttgtgattgatgatgaatgttttgctagtgatcttagcatcgtacaatatgattatattgcccgttcaacacaacttactcttgatgaatgggaaaaacgtccatttatgaatcgggtgttagaacgcctttgttatttctttagcccacttctctag

SEQ ID NO: 546 - DNA, 2589 bp, Proteus mirabilis
cctcgtattttaaccttagatacctttagatctgaggcaaaaatgagcaagaaaacactcgcaatcatcggtaacggcatggttggacaccgttatatagaagaattgattgataagggcggcaatgaaacgttcaatattatcgtcttttgtgaagaacctcgtattgcatatgatagagtccatctctcttcctatttttctcatcacaccgctgaagagctctcgttagttaaacccggctattacgagaaacatcatattgaagtattagtgggtgagcgtgtgatcaccattaatcgtgaagaaaaagtggtgcacaccaatactgggcgttgtgttagctacgacaaattgatcatggcaacaggctcctacccatgggttcctcctattaatggaaacaactcaccagattgttttgtttaccgaactattgaagatttaaatgcgattgaagcttgtgctcgtttaagccgtaaaggggcggttattggcggcgggctgttaggtttagaagccgctggtgcgctaaaaagtttaggtattgaaactcatgtgattgaatttgcgccaacgctaatggcagaacagcttgatagcatgggaggagagcaacttaaacgtaaaatagagcgcatgggggttaaagtacacacagcgaaaaacacccaagcgatcttatcgacaggggaaaatgcgcgtaaaacattacagtttgccgatggctcctcacttgaggttgattttgtcgtattttcaaccggtatacgtccgaaagataaattagcacgccaatgttctctcgatatagcaccacgaggggggattgtgattaatgactattgccaaacctcagatgcggatatttatgccattggggagtgtgcttcatggcataaccaaacatttgggttagttgccccgggttataaaatggctcaggtagccgttgatcatctattaggtcaacagacagcattccaaggggcggatttaagtgcaaaattaaaactactcggggttgatgtagggggaattggtgatgctcatggtcgccaagcaggttgtcgtagctatatttatcttgatgaaggtaaagagatttataaacgcctgatagtgagtgaagacaataaatacctattaggtgcggtattggttggggacacggaagattatggcaatctgttacagttagcattaaatacaattgaattaccagaacatcctgacacattaatcttacctgctcatgctggaagtaaaccggcaatcggggttgattcattacctgaaacggcacaaatttgctcctgttttgatgtaagcaaaggcgacattattcaagctattgaacgaggttgtcatacggttgcggcgattaaagcagaaacaaaagcgggaacggggtgtgggggatgtattccgcttatcactcaagtattaaatgcggaactcacaaaacaaggcattgaagttaaccatcacctttgtgaacattttcactattctcgccaagagctttatcatcttattcgtgttgaagggctgaaaagctttgatgaactattgaaaaaacatggtcaaggctatggctgtgaaatttgtaaaccgaccgtcggctctctgctggcttcgtgttggaacgactatatcttgcgtgatgacttagttgcgctacaagatacgaatgataacttcctcgccaatctgcaaaaagatggcacttactctattattccacgctcccccggcggtgaaattacgccagcgggtattattgcgattggacaaattgcgcaagaatacaatttatacaccaaaatcacaggctctcaacgtatggcgatgtttggtgcacagaagcaagatttaccggcgatttggcagaaattaattgccgcgggttttgaaacaggccatgcctatgccaaagcgatccgtatggtaaaaacttgtgtaggaaacagttggtgtcgttttggggttggcgatagtgttggattaggtgtctttttagaacatcgttataaagggatccgcacgccgcataaaatgaaatttggggtatctggttgtacccgtgaatgctccgaagctcaggggaaagatgtagggattattgccacagaaaaaggctggaatctctattttggtggtaatgggggcatgaaaccacgtcatggcgatctattcgcggcggatttagatgaagaaacgctgatccattatattgaccgctttatgatgttctatatccgtactgcagacaaattacaacgaacctccgtttggttagaaagcctagaagggggcgttgaatatttacgtgaggtcattattcacgacaagttaggcttaaatgcacagttagaaaaagagcttaaagttttacaagagcgcgtagcctgtgagtggcaagaaacccttgattcaccacaagcattgaaacgttttgcgcactttattaacaatccgatgcccgatcctaatatacagatggtaaaagagcgtgctcagcatcgtcctgcccgcgtgcatgaacgtattgatatcaaaatggtaacagaggagacgcaatcatga

SEQ ID NO: 547 - DNA, 246 bp, Proteus mirabilis
aaaatgtctagttctcaactgaaaaaacaatatattggcgaacatcaattatctccagaaacgttaatgatgagctatggatacgatccattgttatcggaaggctctgtcaaacctcctgtatttttaacatcgacatttatttttaaaagtgcagaagaagggaaaaatttttttgatacggtaagtggaagaaaaccccttccagaaggaagaaaaagcaggtttagtctattctcgttttaa

SEQ ID NO: 548 - DNA, 1650 bp, Proteus mirabilis
ctcgcttatagactacaggacgaaacagacatgcgcaaaatattcgttatatcatgtgcacttgtcgttcaaggattgctcatatcacaggctaatgcggcagtggtgccatcaggaacgatactcgacaaaaaacaggaagtagtgcgacatttaaaagatgaacccgcatcacttgatcccattaatgccgtaggtttaacggaggctcaagttcaacgagacttatttgaaggattagtgatagaagatgagcgagggcgtcccattcctggagtggcacaatcatggcgaacagaagacaaccgggtttggatttttacattacgtgataatgctaaatggtcaaatggcgaaaaggtgacggcttctgactttgtttatagttggcaaagattagttgatccaaaaaatctttctccttttgcttggtatgcatccctagcttctattgagaatgcccaaaaaattattgatggtaaattaaaaccaaccgcgttaggtgtggaagccattgatgaaaaaacgttaaaagttaccttagaacgacctgttccttatttccctagtttagcgaccaatttttcactttatcctgtacctaaacacacaatcgaaaaatacggttcagaatggatcaaagtaggtaatttagtcggcaatggggcttttatactaaaagatcgcgttgtgaatgagaaaattgtgttaacgccaaacccttactattgggatcaccacaatacggtgttaaccaaagtcacttttgtgcctattaatcatgaatcacaagcgactaaacgttatttagctggggatattgatattacagagtcttttcctaaacacttatatcacaaattgatgaaagatattcctgatcaagtgtatatccctgagcagttaggtacttactattatgcatttaatacacaagcagggcctaccaaagatattcgggttcgcaaagcgttagctatggcaattgatagaaaaattattactgataaagtccttggtactggagaaaaatcagcgaatcgctttactcctgatgtgacggctaattttacgcctgagccaacactatatgatgaatacagtcaggatgaattagatagccaagcaaaaatattgttatcagcagccggctatggtcctcataatcctttaactctctctctgctttataataattcagaaaatcatcaaaagatcgccattgctgtcgcttctatgtggaagaaaaagttaggcgtaaaggtaaacttacgcaatcaagagtggaaaacttatattgatagtcgtaattcaggtgattttgatgtgataagagcgtcatggataggcgattacaatgaaccctccacatttttatctttattaggttctaagcatgctggaaacatcccaaaatatcagagccagcaatatgatgagattttagtccaagccaatatgacgacagatgaagaggaaagaaatcgtctctataatcgtgcagaacaggttattgcggaagaggcgcctattgcccctatctatcagtatactaatggtcgtctaatcaaaccttggctaaaaggttatcccattgagaatcctgaagatgtcgcttatagccatatgctgtatgttataaagcattaa

SEQ ID NO: 549 - DNA, 201 bp, Proteus mirabilis
tatcataatagtattcaacagaataaatacacatcatatgtaatcactattatgactccgacactatttcatttcgttgtgcccgttggcttaaaaaataactggttttttctaatgaacgggttcgtggtgatgggggcaaactacttaaaaacacttccccataaggtcttgaaactaatctatcatcacaaacaataa

SEQ ID NO: 550 - DNA, 2466 bp, Proteus mirabilis
cattgtgataggcttatttatgttgtcgttttgacagcgggtttttcttttttttctctctctcatttgtttaaaaaaggattgttctcaatgtccagcaatagcctcaccccgtgcaatgtactttggtataaccaattgggtatgaatgacgttgatcgtgttggtgggaaaaatgcttccctcggtgaaatgatcactaatcttgcggaactgggtgtgtctgttcctaatggatttgccaccacagcgcaagcgtttaatgattttctggaacaaagtggtattaatcagcgtatttatgagctgctcgatagtattgatgttgatgatgttaatcaattagcacaagcgggtaaccaaattcgccaatgggtgattgatacaccttttacccctcagtttgagaaagatattcgtgatgcttatcagaccttaagtgaaggtgaatctgaagcctcatttgcagtacgatcatcagcaaccgctgaagatatgcctgatgcttcttttgccggccaacaagagacatttttaaacgttcaaggtatcgatgcaattttagttgcgattaaacacgtgtttgcttcactgtttaatgatcgcgcaatttcttatcgtgttcaccaaggctatgatcaccgcggtgttgctttatctgcaggtgtccaacgtatggttcgctctgatttagcttcatcaggggtgatgtttactattgatactgaatcaggctttgatcaagtagtctttattacctctgcttatggtttaggggaaatggtggttcagggggcagttaacccagatgaattctatgttcataaaccaactttggcgaaaggtttaccggcaattgtgcgccgtaacctaggttctaaaaagatccaaatggtttatgccgatagcattgagcatggtaaacaagtccgtattgaagatacgccagaagcattgcgcaatcgtttctctttaactgatgatgaagtgcaagagctagcaaaacaagcggtattgattgaacaacattatggacgtccaatggatatcgagtgggctaaagatggtcataatggtcgtctatatattgttcaagcgcgtccagaaacagttcgttctaaccaacaagttatggaacgctatcagttaaatgaaacaggcactgtgattgtagaaggtcgtgcaattggtcatcgtattggtagtggtacggttaaggttatccataacttaagtgagatggatagaatagaggcgggtgatgtgttggtcaccgatatgacagatcctgattgggagcctatcatgaaaaaagcctctgcgattgtgactaatcgtggtggaagaacatgtcatgcggcaattattgctcgtgaattaggtattccagcagtggtaggttgtggcgatgcgacggagtgtattagcgaagggcaagtggtcaccgtctcttgtgctgaaggggataccggatttgtttatgatgggaaactcgatttttctattcaaagctccgcaatcgataacatgccagaacttggcttaaaaatcatgatgaacgtcggtaatcctgatcgcgcctttgactttgctgggttaccaaatgatggggtaggccttgcgcgtttagagtttattatcaaccgtatgattggtgtgcatcctcgcgctttactcgaatacgaagatcaaacagatgcactaaaagctgaaattgatgaaatgatggcgggttatgcatcacctgttgaatattatattggtaaattaaccgaaggtatcgcaacactcgctgcagcattctggccaaaacgtgtcattgttcgcttgtctgattttaaatcaaatgagtatgcaaacttagtcggtggcgatcgctatgagcctgatgaagaaaaccctatgttaggtttccgtggtgcgggtcgttacgtatcggatgatttccgtcgttgttttgcactcgagtgtgaagcagtgaaacgtgtgcgtaatgagatgggattaactaacgtggaagtgatgatcccatttgtacgtacggtgcgccaagcagaagaagtgatagatgagttagcacgtaatggtttaaaacgtggtgagaatggcttaaaagtgattatgatgtgtgaaattccatccaatgctttattagccgatcaattcttggctcattttgatggtttctctatcggctctaatgatatgactcagttaacattgggcttagatcgtgattctggtgtcgtctcatcactgtttgatgaacgtaatgatgcggtaaaagcgctattatctatggcaattcaatcagcgaaacgtcaaggtaaatatgtcgggatctgcggacagggcccttctgaccatgaagattttgcacaatggttaatggaagagggtattgatagcttatctttaaacccagataccgttattaaaacctgggtgaaattagcacaacaataa

SEQ ID NO: 551 - DNA, 1059 bp, Proteus mirabilis
aagcgggatagggttatgacaaaaaatttaaacgtggggattataggctatggttatgcaagtaaaacctttcatgctcccctgatcagtaccactgaggggttaacactatcagccatttcaagctctgatgaaagtaaagttatcgctgattttcctaatattacggtgtatgccaacccacaacgactgattgatgatccagacatcgatttaattgttattccaacacctaataacactcactatacctacgcctcacaagccttaaaaaacggtaaacatgttgttgtcgataaaccttttactttgacactcgatgaagcagaaaaattggcacaacaagcgaaagaagctaagagattactctcagtttttcataatcgtcgttgggatgccggttttcttaccgttcaaaaattactcgccgataaaacattaggtgaagtcagtgcctatgaagcgcatttcgatcgttttagacccgctgtgcgccaacgttggcgtgaagatgccggacttggtggaggactttggtacgatctggcccctcatttactagaccaagcggtatgtctttttggtcaaccttatgcaatcactgctgatattgctcagttgcgccctaatgctaaaaatgctgactactttcatacactattggactatggtcatctgaaagttattttacatgcctctatgttggttgcttcacctacgcctatttttgctattcatgggaccaaaggcagttatgtaaaatatggtttagatacccaagaagatgcattaaaagcgggttatcttccgactgaaatgtataactggggggctgatcctcaagagggtgaattaacattatcgacagagagtggtgaattagtaacaacaaagttaccgactctatcaggtaattatcccgcttattatcagcaaatttatcgtgcgattgcatttggtgaagagagtcctgttactgtgtcacaggccattaatgttatgcgtttaattgaagccgggagcctttcaaatcaatcaaaaaccacaattaagctgtaa

SEQ ID NO: 552 - DNA, 2685 bp, Proteus mirabilis
cattttatcaggagtctctttatgtctgtaactaacgttactgaactcaatgatctggttgctcgtgtaaaaaaagctcagcttgaatttgctaacttttctcaagaaaaagttgacgcaatttttcgtgctgctgcattagctgccgctgacgcccgtattcctcttgcaaaattagctgttgaagagtctggcatgggtatcgttgaagataaagtgatcaaaaaccactttgcttcagaatatatctacaatgcgtataaggacgaaaaaacctgcggtattttgtctgaagatttaacctacggtactatcactattgctgaacctatcggtattatctgtggtatcgtgccaacaactaaccctacttctaccgctatttttaaagcattaatcagcttaaaaacacgcaacggtattattttctctcctcatccacgggcgaaattagccacaaaccgtgcggctgaaattgtgttaaacgctgcaatcgccgcgggtgcaccaaaagatattatcggctggatcgatgaaccttcagtggcattatccaatgcattaatgcaccatgatgatattaacctgatcttagcaacaggtggcccaggaatggtaaaagccgcttacagttcaggtaaacctgctatcggtgttggtgcgggtaatactcctgttgttattgatgactcagcagacattaaacgtgcagttgcttctattttgatgtcaaaaacctttgataatggggttatttgtgcttcagagcaatctgttatcgtcgtagacagtatctataaacaagttcgtgaacgtttcgccactcacggcggctacatgttaaccggtaaagagttaaaagctgttcaagatattatcttaaaagatggtaacttgaatgcggccatcgttggtcaaccggcagtgaaaatcgcagaaatggccggtattgaagtgcctgttaacactaagattttaattggtgaagttaaagaaactactgatgcagaaccttttgctcacgaaaaactatcgcctctgttagcaatgtaccatgcacaaaactttgaagatgcggtacataaagcagaaaaattagttgaaatgggcggtattggtcatacttcttgtttatataccgatcaagacaactgtcctgaacatgttgcctactttggcgacaaaatgaaaacttcccgtattttaatcaatacaccggcatcacaagggggtattggtgacttatacaactttaaactcgctccttctctcactttaggctgtggctcatggggtggtaactccatttctgagaacgtagggccaaaacaccttatcaacactaaaaccgtggcgaaaagagcagaaaatatgttgtggcacaaacttcctaaatcaatttatttccgccgtggttgcttacctattgcactggaagagattgcaactgatggtaaaaaacgcgcatttatcgttacagacagtttcttattcaacaacggttacgttgatgaagtgaccaatgtactgaaaaaatttggtgttgaaacggaagttttctttgaagttgaagcagatcccacattaagtgtcgtacgcaaaggtgcagagcagatgaacagctttaaacctgatgtgatcatcgcattaggtggcggttcaccaatggatgcggctaagattatgtgggtaatgtatgaacacccagaaacacacttcgaagaattagcattacgctttatggatatccgtaaacgtatttataaattcccgaaaatgggtgtgaaggctcaaatggtagcaattaccacaacatcaggtacaggctctgaagttacaccatttgctgttgtgactgatgatgaaacaggccaaaaatatccattagcagactacgcattaacgccagatatggcgattgtagatgccaatctggtgatgaatatgccaaaatcactctgtgcttttggtggtttagatgcggtgactcacgcattagaagcttatgtttctgtattagccaatgagtattctgatggtcaggcactgcaagctctgaaattgctgaaagaatatctgccagcaagctatcatgaaggtgctaaaaatccggttgctcgtgagcgtgtccacaatgcagccaccatcgcaggtattgcatttgctaacgccttcttaggggtttgtcactcaatggcgcataaattaggctctgaattccatattcctcatggtcttgccaatgcgttattaatttctaacgttattcgttataacgcgaatgataacccaacaaaacagactgcatttagccaatatgaccgtccacaagcacgtcgtcgttatgctgaaattgctgatcacttagaactgtctgctcctggtgatcgcacagccgctaagattgaaaaactgttagcttggttagaagagatgaaatcttcattaggtatccctgcttctatccgtgaggcgggcgtacaagaaagtgatttcttagcgaaagtggataaattatcagaagatgcgtttgatgatcagtgtactggtgctaacccgcgttatccgctgatctctgagttaaaacaactgttattagattcttactacggccgcgaatttaacgagcaccctgttgctgaggtaaaagaagcgaagcctgcgaaaaaaagcagtaagaaataa

SEQ ID NO: 553 - DNA, 444 bp, Proteus mirabilis
tattacatcagccaacaacatttatttgagaccaggaaaatgagcgaatctttaaaaatattaaataacatccgtactcttcgtgcacaggcaagagaaacttctttagaaactttagaagaaatgcttgagaaacttgaagtcgttgttaatgaacgccgcgaagaagaacaagcaatgcaagctgaaattgaagaacgtcagcaaaaattacaaaaataccgtgagctattaattgccgatggtattgatccaactgacctgcttgaagctgctggcgcaagcaaaactggtcgtgctaaacgtgcagcacgtcctgctaaatattcatacgttgatgataatggtgaaactaaaacttggacaggccaaggccgtacaccagctgtaatcaaacgtgcaattgaagaagaaggcaaatctttagaagatttcctcatctaa

SEQ ID NO: 554 - DNA, 1446 bp, Proteus mirabilis
tgcatgtccagacggctcagaagaacaaaaattgttaccaccttaggcccagcaacagatcgtgataataacctagaaaaaatcattactgctggtgcaaatgttgttcgattaaatttctctcatggctctgcagaagatcatcttgctcgtgctaatcgcacccgtgaaatagcagctagacttggtcgccatgttgctattttaggtgatttgcagggtccgaaaatccgtgtttcgacatttaaagaaggcaaagtattccttaatgtgggagacaaatttctccttgatgccaatttagaaaaaggcgaaggcgaccaaactaaagtcggtattgactataaagggttacctgccgatgttgttcctggcgatatcttgctacttgatgatgggcgtgttcaattaaaagtccttaaagtcgaaggcctgaaagttttcactgaagtgactgtcggtggtccattatctaataataaagggatcaataaactcggtggtggtctttctgctgaagcattaactgaaaaagataaacaagatattattactgcagccaaaattggtgttgattatcttgctgtctccttcccaagaacaggcgaagatcttaattatgcacgccgcttagcacgtgatgcaggctgtgagtgccaaattgtcgcgaaagttgaacgtgccgaagccgttgccaatgatgaaattatcgatgagatcattctcgcttctgatgttgtcatggttgcccgtggtgatttaggcgtagaaattggtgatcctgaattagtcggggtacagaaaaagctcatccgtcgtgctcgtcagctaaatcgtgttgttatcacagccactcaaatgatggaatcgatgataactaacccaatgccaactcgtgcagaagtcatggacgtcgccaatgcggtattagatggtacagatgccgttatgttatcggctgaaacagcagcaggacaatatcccgctgaaactgtagccgcaatggcacaagtctgtttaggcgcggaaaaaatgcctgcggccaatgtatcaaaacaccgtttagatatggtatttgataatgctgaagaagcgatagccatgtcaaccatgtatgcagctaaccatatgaaaggcgttaatgcgattatcgctatgactgagtccggtcgtactgcccgtatgatgtcacgaattagcaccggtttacctattttctctatgtcacgccatgagaaaacattaaaccaaactgcactttatcgaggtgttacgcctgtttattgcagtactcatactgacggtattgctgccgctaatgaagctattatgcgtttatgtgaaaaaggctttttagtttcaggtgatttagtcttagtcacacaaggtgaccagatgggcacgatcggaagtaccaatacttgtcgtatccttaccgtagaataa

SEQ ID NO: 555 - DNA, 525 bp, Proteus mirabilis
agaaagtggctttataatcgctttcgctattatgataaggagatagggcagtatttttccccagactcgatagggttattgggtgggctgaatccatatgggtatgtgcattgtccgacgggttgggttgatccgtttgggttgagtggaacgtctcaattaaatgcatttcaaaatgctaatttcgccgactcccaaaaattaactcagcatttcgaaaaacatggccatgagttcagagctacttcagaagctgaatatttaaaaattggccgagatgtaatagaaaaaggtcataaagttgagtactattacaaaccattagaacaataccgtactggctatgtaatgtacatgagaaatacgaaaagaggtgatgtacaaatggcatttgtaggtattaaccctcaaggtcagatagcaactatacacacaaaaagtggtaaagacgtttggaaattactcaatggtaataaagatgaaaaagttatcaatcttatacctagagatgctaatgggttataa

SEQ ID NO: 556 - DNA, 1029 bp, Proteus mirabilis
ctatcattaaggtgttatatgagtaaattaacaattggtggagtaaatatatcaacttcgcaaataaataaattatcacacgcatctaaagctagagatgcaatgtctatttgggaaaaaataaaagattggtttaatcatggtcaaaaagaacatgtgcttaaattactttatcatacctattttaatcctaaaaattcaatatttgataaggttgattgctttgcagaattatattctatgacaggggcgcaatataaaaataattttcatttatatttaaaagatggttatgatttaaaaatgaaatttgttataaaaaacgtttataatggtgaggtattattagataatttaattaaagacatgatggttcggatacataataaaaacccaagcatagaaaaagacataggaaatataagaagttatataagaagaagactacatgaaattcctaataaagccaattatgatattaatcaatacaatttctatttatccaaaataaaaaatgacttactaccaaataattattttaacgtagagcgttatttggatagtgtaacagattttgttcgtttatataatataaataaaaataattctagaattagtgtagacgataaaattgaagatcgttgtaaattacaaaaacttatgaatataatacagcatattgatatagaatatagaaaaaatattcaaataaaacttttgatgaatagtgttgctttaaatataaaagataaaaattcaaaagagtttttgaatttaattaaaatcgaattattgtcattgtacaatcctcatgtagatataatagaaggatttataaaacatggaatggaaactttatttaaagatgaagacaaaaaagaaaaagcctgtggatcattaaggaaagctattattgattataactttccatttattggatcacttgaattcaatgttactgatgagactataaataatatttatataaataatatagtaccaagtgagtatatctctttcctccaataa

SEQ ID NO: 557 - DNA, 1614 bp, Proteus mirabilis
actcaattaagatcattgctgtctgccacctattttttaggaggcttaattatgacgatcgcctgtcaattttctcagcttaatattgaattcaatcaagaagcgcttttcccaccgctgactcattcactgacttgccaaagaaatgctttaattggtcagaacggtaaaggaaaatcggtgctgttaaaattgttagcacaaaaactattgccttcatcaggccatatcatgtggcgtatgccttttattcatgtcgaccagcttactcgcctaacaggtaataccattgctgatgctttaggtatagagactttttttcaagcatttaagcgggttgataacggcagtgcttcattagaagattttgagttacttgaagataagtggcatttgcccatgacttggcaaaatttacttcattcagcacaactgccggtttcacttgatacacctattccccacttaagtggtggtgagcaaacgcgtttagcattatgtcaggcttttttacatgacgatcattttctattattagatgaaccagataaccatctcgatcatcaaggtcagcaatggctcgttgaacaattaatgcatcataaatcaggtgtattatttattagccataatcgacatttattatcttatgctgaaaatatatttgaactgagtgaaaaaggcttacaagaatatggcggtaattattcgctttatgaaacacaaaaaaatgcgcaaatagcctcaatcgaagctgcaaatgagcgtatcaatagtcaaataaaacaggaaaaacgccaacaacatgtaacattacaaaaagcattacagcgacgtaaacaaggtgaaaagataagaaacagcggctctcaatcactgttacttcttgatatgcaaaccaatcgagctgagaaaaaacagtcatcaatagctaaacgacatcagcgcgttatggatgatatgcagtcacaaaaacaacagttagaacaagagttaactcatattcatcagcaaaaattaatattaaactatcaaggcgatggccatcggttaaatgtatttgccacagagcttgttttaccttttggcaagcaaactccctactccttttccgcttatggtggtgaacattggcatatacaaggtaaaaatggcagcggtaagtcaaccttattaaaatgtttaatgggcaagctatccccgttatccggcgaatatcgtctcaacccaaattattgctatcttgatcaacatttaactttattagataaatcattacccgttgctgaagcgttatatcaataccagccattaatgaccattgagcagtggcgcacaaaactgggtatgttacgtattcgaggtaacaagtctttatttcctttagaaacactcagtggcggtgagcaattaaaagcaacactattagcattaatttatagtcctcaaccccctgccgttttattattagatgaaccagataattatttagatttagactctaaacaattattggaaaatttattatctcaatatcaaggaacattattattaatctctcacgatgaagattttgttaaacaatgtggtataacaaatacattattactctaa

SEQ ID NO: 558 - DNA, 378 bp, Proteus mirabilis
accatgaggcttataatgaaaccacttctgttatccctgcttttacttcctgctgttgcatttgctaacccaagtaaaatggctgaagattattgcaatacattcaaagatatctcagtaaaagcttatgatactaatgaagcgcctgagaaaatcgccaaagacgcattagcaacattgaaatctcaaaactttgattttgcaaaactagatgcaacggaagctgatttttctaatggcaccgttgaagttgttaaatctttacgtgatgcaaaagcagaaattggttcacgtgaagagttccaagaaggcttaacgcaaattgttgcggcatgtaaaattcaaatggattctgttttacaagagcagaaaaaataa

SEQ ID NO: 559 - DNA, 1020 bp, Proteus mirabilis
tcgataataagcgagtacaggatgaaaattgtttcctatagtactaaacattatgaccgcaaacatatggaatgggtcaatcagcataatggatatcattatgatatcgaatattttgactttaatttgactgaacaaacagcaaaaaatgccgtcggcgcagatgcagtctgtatctttgttaatgatgatgctaatcgtgcggtattacaagagcttgccagtctcaacatccatatccttgcactgcgttgtgcggggtttaataatgttgaccttaaggcagcggccgaattagggatcaccgtagtgcgtgtgccggcttattccccagaagcgattgctgagcatactgttgggatgatgctctcgttaaatcgtcgtattcacagagcctaccaacgtacccgtgatgcaaacttttccttagaaggcttaactggctttaatatgcataatcgcactgcagggattatcggtacggggaaaattggtctagcgactttacgcatactaaaaggctttggtatgaagctattggcctatgatccttatccaaaccaagctgtattagatttgggtgcggaatatgttgacttagcgactctttacgcaaattcacatgttatttcgttgcattgcccattaaccgcagaaaatcatcatttattaaatgaaagtgctttttcgcaaatgaaagatggcgtaatgatcatcaacactagccgtggggccttaattgattctgcagctgccattaatgccttaaaacgaggtaaaattggcgcattaggcatggatgtctacgaaaatgagcgcgatttattttttgaagataaatcaaatgatgttattcaagatgacgtgttccgtcgcctttcctcttgccataacgtattgtttaccgggcaccaagcattcttaactgaagaagcgttaattagtattagtgaaacgacattgcacaatattaaagaggttgctgcaggtataacatcacctaacgaagtgaaagcctaa

SEQ ID NO: 560 - DNA, 1227 bp, Proteus mirabilis
ccaagagtaagtacaacgagtattttgttgttaaaccacattgccgaggggattttcatgaatcagaataactttaataaattaatttctaggcaaaatacctacagtgctaaatggtgcaacagtaacgccaatgttattccattatcggttgccgatatggatatttctgcaccagattttattattaacaaactcagtcagtttaatttaaccggtatttatggctataccgatcttagttctgattggaataatgttgcggtaaattggtttaaatctcaatatgcttggcatgttacacctgaatctgtagtgttttgccctcgcattatccaagccgtctctctctatattcaaaattttactcaaattggcgataaagtgacaaccttgtcacctgcttatcatcctattagcaatacagtttgtgtaaatcatcgccagctactagaaagcccattaatttatcataatgggtgctatgaaatagattttgacgatttagaagataaatttaaacaatctgtctgttttatattgctctctccccataatccaaccggaacagtatggcaacaagctgatttattaaaaattgctaaacttgctgaaaaatataaagtttttattatttctgatgatgttcatgctgattttatttttgataatgccatttatcgacctatatcaactttaagtagctatgtagaacaacactcttttatttgcacatcaccggctaaaaccttcaatttagcggggcttgaaatagctaatattgtgattgctaatccagaatatcgtgagaaatttaaacaatgcttaattgccgcaggtattcataatcctggttacttctctgtccctgctttcttacaagcttataccttacaaggtcaacaatggatcaaagagcttaaacattaccttgctgaaaacaggcagtgggtaaaagagcaatgtgcacgttattttcctgattgggttatcactcaaagccatggcacctacatgctatggatcaattatcaaaaaatgcagttaaccgaacaacaattaaagcattggtttgtttcattagccgaagtagaaatgagttggggaagcggttttggtgcggctggggatggttttttccgcattaatattgctacacctcgttcaatattagaaaccgtttttactcggcttattcgtacctcacctcacgccagtttggaataa

SEQ ID NO: 561 - DNA, 204 bp, Proteus mirabilis
atgatggtaagaacggctctattgaaaattaaaaatttgattatttggctttatcatcagtttagcgatctgctccatatcgcggtgacttttgtactctgttatttttgctttcttttatctcccacacttaccattgccgttataggcgtcgtgattattgttgtaaccatgtttttattaagcctatttgttttgccctag

SEQ ID NO: 562 - DNA, 960 bp, Proteus mirabilis
ttcttttcaagtgagagaacaatcaatgttacactgcctatattcaatactccccatataggcagtatttttatgtcaattgaccttaatttattacgtattttttctgcggttgcagagcaagcacagtttgccagtgctgcacgatcgctttctatgccaacatctaatgtcagtagggcaataaaacagctagaacaacagcttaactgccgattaattgatagaaccacgcgaaaaatgcgtttaactgagcaagggaaaatcttgtatcagcaagccaaaaagaccttatatgaattagataatgttgtagaacatataacgagtgatggcccattaacaggaacctttagactcacgatacccagtgaatatggtagtgagttacttgccgatattttagcggattttgctgcacttcatcctaacttaaccattcaatgtgatacgcagctaatgccaagaaatgttatagaagatgatattgatttacttctaacatttcatcgtggccaattagccgatagtagctaccattcacgtctcataaagtcgtggcgtagtattgttgttgcctcagagagcttattagcaaaaacgggtatccctacagatattgagcaactaagccaattaccttgtatttccagtttaagtgcattagaagggcaaccgtggatctttattgataaagagcagaaccctgtaaaagtgacaattaatagctgttatcgtgtaaatagtgctatcttagccaaagctgccgtattaaaaggtttaggttttgctattttagctgaacattgttgccttgatgcgataaaggcaggcaaattgcgagctatttcttttcctcaacagcccgcatcaattagtttagtcgcgatatatgcaagtcgtcgttcgctttcacgtaatattgaacattttcttgcatttttaactcagcgtttataa

SEQ ID NO: 563 - DNA, 993 bp, Proteus mirabilis
tcacaaccaagaggctacaacaaacccatgattatctactcgatacgtcgcttactgttattaattgtgacgctctttttcttgtcactggtgagctttagtctcagctattacacacccaatgggccgttaagtggtgcttctttatttgatgcctactttttttatacccacaatatgttccattttgattttggaatttcttcaattaatggcgaacccattaaagcacaacttattgaagcatttcctgccactatggagttatgtgcactggcatttatctttgccctgcttatcggcattcctgcggggatcatcgcgggtgtatggcgcaataaacctgcagatacttttattagtcatctcgcacttttgggcttttcagttccggtctttggtcttgcattattactgacgcttttcttttcattaaagctaggttggctacctgtttcaggccgtattgatttactgtataacttacagcctataacggggatcgcaatcgttgatgcttggctatcggattcgccttatcgtcaacagatgatcataaacgttttgcaacatttaattctacctgtgactacactagctattgctcctactacggaagtcattaggttaatgcgtaatagtacagaagagatcatggtcgagaattatgtgaaagcagcggcaacccgtggcttatcacgctttactattattcgccgtcatattctacataatgcattaccccctattattcccaaattaggcttacagttttctaccatgttaacactgacgatggtgaccgaaattgtttttaactggccaggattaggccgttggctagtaacggccattcgccaacaagactattcggctatttcagccggtgttatggttgttggttcaatggttatcatcgtcaatgtgttatcagatattgtcggtgcgatgagtaatccaatgaaacacaaggtgggatatgcctttagatag

SEQ ID NO: 564 - DNA, 642 bp, Proteus mirabilis
ggtaaccaaagcatgagtgaattcaaacaatatgcgcctgttagcgatgaacagcttggtttttttattgattcttctcgttgctcaggttgtaaagcatgccaagttgcatgtaaagataaaaataatttagaggttgggcgccgttttcgccgtatttatgaaatacagggcgggggatttgcgcctaatgggcaaggtgcatttgaaaataatgtctttgcatacacattaacgatttcatgtaatcactgtgacgatcctatatgtgtaaaaaactgtccaacaacagcaatgcataaacgccccggagatggcattgtccgtgttgataccagcaaatgtgttgggtgtggttattgctcatggtcatgtccttatggtgcaccacaaatgaatactgaaacgggacaaatgtcgaaatgtgatttctgcgtagatttattagcagaaggtaaaaatcctatttgtgttgatacatgtccattaaatgcgattaagtttggaaaaattaaagatctacgcgctaaatatggtcatttaagccaagttcaagggttacctgattttacaatcactcaccctaatttggtcattaaaccacatactggtgcaattaaaaaaggagggaaccaagcatga

SEQ ID NO: 565 - DNA, 873 bp, Proteus mirabilis
aattggcaaagccaaggatctgtatatttaatgaatatattggaaagggttcagtctagtctggacatcttgagtaaatcagaaaaaaaagtggctgaggttgttttaacaacaccacaaaccgtgatccattcaagtatcgctcttatggcgaaaacagctgatgttagtgagcccactgtaaatcgtttttgtcgacgcatggcaacaaaaggatttccagattttaagttacaattagcacaaagcattgccaatggtacaccttatgtcaatcgtaacattgatgactccgattctgtctctgcttataccaataaaatatttgaatccgcgatggcgggtttagagactgtcaaaaataatctcgatattgcggttattaatcgagctgtcgatattcttactcaagcaagaaaaatctcgttttttggtctaggtgcttctgccgccgtcgcacatgatgccatgaataaattctcacgtttcaacattcccgtgacctattttgatgatgttatcatgcaacgaatgagctgtataaatagtatcgacggtgatgttgtggtgattgtgtctcacacaggtcgtactaaaaatttagtcgaaattgctaaaattgcacgtgaaaatgatgcatcagtaatagcgattaccacttctggctctttattagccgccgaagcaacgttacccatcttacttgatgtaccggaagataccgatatctacatgccgatgatttctcgccttgcacaacttacagttattgatgttctggctacagggtttattttacgccgagggccaaaatttagagataacttgaaacgtgtcaaagaagcattacgcgattcgcgctttgataagtaa

SEQ ID NO: 566 - DNA, 600 bp, Proteus mirabilis
atagtgcgaagagaagagcagagcaagcgtatttgctcttttctctcgccatcgaccttatccgccataggaattgttatggctattattttaggtattgaccctggctctcgtgtcacgggatatggcgtaattcgccaacaagggcgacaacttatctatttaggaagcggatgtattcgtacacaggttcctgatctaccaagccgactgaaacgcatttatgcgggagtcagtgaaatcatcactcaattttcacccgatgtattttctgttgaacaagtctttatggcaaaaaatgcagactcggcattaaaattaggccaagcaagaggtgtggcgattttagcggcagtcaataatgatctccccgtatttgaatatgcggcacgtcaagtaaaacagagtgtggttggaacagggggagccgataaaagccaagtacaacatatggtacgctcaatcttaaaactatccgcagcaccacaggcagatgctgcagatgcgctagcgattgcgattacacactgtcactttaatcaaaacttattgcgtgtaggtgatccgcgtcttgttttaacgcgaggcaggttaagatag

SEQ ID NO: 567 - DNA, 243 bp, Proteus mirabilis
cttttcatttttaatgggaattgtgagagtaccgcatggcctaagacttctgcggtaatagcggtgccgtcagagataaaaaaaacagttctatcaacaagttcattattatcacagttaattgaattcaaacttaatatcattcctctcaccttttttttagctgaattagcaattcagacaatattatctatagtatttttagtgattataaaggataaaaaaataaagttttctggttga

SEQ ID NO: 568 - DNA, 966 bp, Proteus mirabilis
cgtttcacgagaattttgcctatgttacataaaaacaacaaatttgcgcatggttttttaattaaatcatgtttagtgactgctatgatagcctcatttagttcatctgttcaggcagatgttgttgcttcaattaggccgatagggtttattgcggcagcaattgctgatggtgtaacgccaacagaagttttattacctgatggggcatcgccacatgattatgcattaaagccttcggatttacgcaaaatcacctcagcagatttaatggtatgggttgggccggatatggaagtctttttagatagaccattaaatagacttagtgacaaaaataagctggctttagcggaaactgacaaaataaagtcgcttttattgaaagatgataatgacaatgtgcataaacatgaggaaaatcacgaacatcattctcatggtgattataatatgcacatctggttatcaccagagattgcgttgtcgtctgcgaaacagatccacgataggttagtgacgctctatccagataaaaaagaacttctggacgtaaacctaagtaaattcagcgaacaactcaagcaaacagataaaaatcttgttaatattctgtcgcctgttaaaaacaagggttattttgtctttcatgatgcttatggctacttcgaaaaacattataatttaaagccattaggtcattttacgatcaaccctgaaatacaaccaggtgcacagaaattacatcaaatacgaacacagttggttgagcaaaaagccacatgtatttttgctgagccacaatttaggccgacagtaattgagacagtggcgaaaggcactggagttaaaatgggggtattagatcccctaggaagtgggattgcattaactcaagatagttatgtgaaattccttacccaattagctaaccaatatgcgagctgcctgaatgaaacacaataa

SEQ ID NO: 569 - DNA, 612 bp, Proteus mirabilis
cgtacaaagaggtggtttatgaacagacaattaaactaccgtttggtaagtaaagcgctatttttatctggcgctctattactaacgggctgcgtctctatacctgaatctattaaagggacaacagcaactcctgttactgacttaaatgtagttctagcggcaccggagctttatgtcggtcaagaaggtcgttttggtgggcgagtgatagaggttaagaatctaccttcatcaacccagttagaaattgctgtgatgccactttctcactatgatgcggctcctgagttacagcaaccttctgttggtcgtctttatgcgaatgttactcattttttagatccaacagattataaaaatcagtatgtcacggtagtgggtacgatcaaaggtgtaaaaacaggcaaagtgggtgaagccgtttatccatttttacgtatcgatgttacaggaatgaaacgctggacattaacgcaacaagttattatgcctgcgcctgttatgacatggggatactatggtaatgccccttactggtataattatggctatggcggctatggggcatatccatatggtactggccaagttgtccccgttttggagtaa

SEQ ID NO: 570 - DNA, 486 bp, Proteus mirabilis
aaatgctggaggaaggcaaaaatgaatattattttttatcatcctttttttgatgcaaatacatggataagtggaatgaaagcacgacttcctgacgcgcatattcgtgtttgggagcatggtgatgataagcctgctgattatgcaatggtctggcttcctccctatgaaatgttagcaagccgtaaccaattaaaaggtatttttgcacttggtgcgggtgttgatgccattttaaagcaagagcaacaaaaaccaggcacattacccgctggggttccggtaatgcgcttagaagacacgggtatgggtttgcaaatgcaagagtatgccattgctaaagtgatgtattattttcgccgtatggatgattataaacgtcaacaatcacaacgcttatggaaacaactccccgcacatacttatgataattttgttattggtgtttggggggcaggtgcattaggcgcaagtgtagcgaattag

SEQ ID NO: 571 - DNA, 720 bp, Proteus mirabilis
atctgccggagttatggcgtgtcactgcgaattttagcaattgataccgcaactgagtcttgtactgttgcggtttggaatgaaggtgtcgttgcttcacgttttgaaatttcaccgcgtgaacatacacaaaaaattttaccaatggtgaaaagtgctttagaagaagccaatttatcactgcaatccttagatgccctcgcttttggtcgtggtccgggcagttttaccggtgttcgcattggtgtcggtgttgcgcaaggtatcgcactaggggctaatttgccactgattggtatttcttctcttgccaccatggcagaaggcgtctttagaacaacaggcattaagcaagttttagtcgccattgatgcccgtatgggggaaatctactgtgcccaatatcagcgtaatgacgctggcatttggtctggtgaagaaacagaagcggtaatgaaaccagaacaatttgccgaaacgctacaagctaccacaggtcgctgggcaattgcgggtacggggtggcaagcttatcctgatttagctttatcattgccttttaccgtggttgaaacgcaaattactttgcctgcggcacaagatatgttgccacttgccgttacagcatggcatgaagggaaagcaactaaagtagaagaggccgagcctgtttatttacgtaatgaagtcacttggaaaaaattaccaggacgggaatag

SEQ ID NO: 572 - DNA, 777 bp, Proteus mirabilis
accacgtttggagatattttcatggcaggtcatagtaaatgggccaatactaaacaccgtaaagcagcgcaagatgcgaaacgcggtaagattttcactaaaattattcgtgaattagttacagcagcacgtttaggtggtggtgatcctgcaactaacccacgtctacgtgcggcagttgataaagcattatctaacaacatgactcgtgacacactaaaccgcgcaattgctcgcggtgcgggaaatgatgaaaacgataatatggaaaccatcatttatgaaggctacggccctggtggtactgctgttatggttgaatgtttaagtgataatcgtaaccgtactgtttccgatgttcgccatgccttcaccaaaacaggtggtaacttaggaacggacggttcggtatcttatctctttaccaaaaaaggtgttatctcttatgcaccgggtgttgacgaagatgccgtcatggaagccgcactagaagcgggtgcagaagacgttgaaacttatgatgatggtgctattgacgtttacacaacccctgaagctttcggtgaagtaaaagatgccatggatgctgcgggttttgtcgctgaatcagcggaagtttccatgatcccatcaacaaaagcagagcttgatattgataccgcaccaaaattaatgcgccttatcgatatgctagaagatagcgacgatgtgcaagaagtgtatcacaacggtgatatctctgatgaagttgcaaaacaactggaagatattctgtaa

SEQ ID NO: 573 - DNA, 2175 bp, Proteus mirabilis
cgagtccttgggggctcgtccttattttgtattgttcccttttctttatccatttttgcatggaggcagattatgcttagcaaagatccgaaatcaacgcccattgacccggcatccgttttaaaagatgaagccatcaatcaagtaaaaaatagggtgcaatccaaagtgaacgaaacgctatcgacacccacgcaaaaggtcgccgggatggcctcagcagcggcctcgctcactcaatcagccagcgcatcggccaatcgcgtgactgctcatcccctgatccacggtggcggttttaccggtggacaaacattcgctgaaaaccaagcactccaagcggcccatggggcgttacttgatgcattaggtatggacagcctcgaaagtggtttggtgttcacttgcaccattggtggattgcctgacgacacctttcaagtcaccgaatttaatcttaccgaaggattatcctcgctattttcactgtccatcagtgcggtcagtgccttaccctttatcgatttccagcgccatcttggcttagcctcatcattaacggtcaaacgcgatggggtgttgatccgcaaagtcaacggtatcttagctggggcagtacaaggcaataccgacggagtgaaaacgtggtatcacttcgatattcgccctgaaatgtgggtgatgaccctcaatcaagacagccgtatttttcaacatcaatcggtgccgaccatcttaaaaaccttattggatgaggcccatgttaaagcggattgccaattctaccgtgaagatctacaccctgaacgtctctacaccacccaaaaacgcgaatcggcatttgatttttggtgtcgactggcgtttgaagagggcattaacttctggtttgaagaagaacaactgttttacagcgatgaacatatggggatgacggcgggtattcaccttacctataacccgcaggccgacaccgatatcagcgatagcactgccatgacttggcaatatggcgaatatttgtgtgtggatgaaactatccataaagacaacaactttgtgcgtccttcttatccgttgtctcatgaaaacaaagttgagcaggggggacagcacagtgtgtttgaaagttatggtcgttttcaattagacgatgaaggtcgacctctgacacaggtgcgctttgagcaattacgtaacggcagcaaagtgggacaagcgacaacaaattgttttgcactgatgcccggcaaaatcttcaccttatctcagcatccccatcagccgatgaatgatcgctggcaagtgatcagcgtcagccatcatggtgtacagccattggcggacaatagcgggggcgaaggcacacaactgtcgaatagtgtctcctttattccgggcacgcaagagtggcgtcccccttatcgttataaaccgacggccgacggcgatgaagtggcgacggtggtgggaccgccgggggaagaaatctacgtcaatgaatatggcgccgtgaaagtgcattttcattgggatcgtcggggaagtgccgatcacagtgcctcctgctgggtgcgggttgccatgggttggagtggaaatggttatggtttttctgcggtaccgcgcattggcacgcaagtgctggtcagctaccttaatggggatatcgacagaccgatgattaccggttgtacctatgatggtcgtaacgcaccaccgattaagttcccagagaataagacacaaaccactttccgtagccaaacccacaaaggggaaggttttaatgaattgcgttttgaagatgcgggcggtaagcaagaggtgtttcttcatgcgcagaaggatatgaatacccgtgttcttcatgatcgcactacccatgttttacacgatcatgttgaagtgatcgaaaacaatcaacagatgcaggtgaaaggcgctcgcacagaaacgatagataaagataacagcgaaacggtaggccaacataaaaaaattactgtaggcaaaacattatctatcaatgtcggtgaagtcattgaattacgttgtggagcaagtgtgctacgaatggataatggtgggcatgtcacgattaatggtcaggaatttaagttcgaagctacaggtcctgtgaaaattacgggtaaagatatcgatttaaactaa

SEQ ID NO: 574 - DNA, 183 bp, Proteus mirabilis
caaggagttggcataacaatatccttttatcaaaaacgacaaattaaattaaatgattgtcttaaaaacaatccgttagtcatgtctgtcatcttagccagtgcgcacggtaagacttcggtaaaggataataaaatcttatcaatatgctgtaaacagcccgttttttttgtatctctctag

SEQ ID NO: 575 - DNA, 204 bp, Proteus mirabilis
aaaattactggggatagaatgaatatatatgacggtatagtatcaaactcgttacttaagaagtttccatcgggttatcctgcaaatgtactattgactaattttgtggcgaattttgttgatttagaaggcgttcttgcctgtgctggtttattttgcccaacatttattgaaatagataatgtactaatgaatatcttttag

SEQ ID NO: 576 - DNA, 1980 bp, Proteus mirabilis
ctatccactggcataatttacgtcttattttataaaaagagtatgcctgtgtcagacgattttgcagaaaacgggattttaacccgacgcgttcctggatttcatccccgtgaagctcaacgacaaatggcgatatcagtaacagaggttattgataaacaaggtgtgcttattgcagaagcggggaccgggacagggaaaacctatgcctatcttgtgcctgcattacgttctgggaaaaaaactatcatctctaccggatctaaggcattacaagatcaactgtatagtcgtgatctccccaccataatagaagcgctagactacgatggtacaacggctttattaaaaggtcgctctaattatttgtgtttagaacgtttagatcagcaaatgctcagtggcggtgatttagaagcagaagtacttgctgatgttatgcatgtacgccaatggtcaacgcaaacagaagatggtgatattagtcgctgtcatagtgtggcggaagatagcaaagtatggccattggtgactagcactaatgataattgtctgggcagtgattgtcctcgctacaaagagtgttatgtattaagtgcccgtaaaaatgcgttagccgctgatgtggtggttgttaatcatcacctttttatggcagatacggtagtaaaagatactggttttggtgagctgatccccgatgcggagataatgatcttcgatgaggcgcatcaaattcctgatatagcgagccactacttcggtcaacagctcactagtcgtcaattattcgatctagcgcgagatatgattgtggcgtatcgcactgaagtgcgtgatcaagtgcaactgcaaaaaagtgctgaccgtttaactcaaatggtacaagattttcgtcttagcttaggtgatacgggttttcggggtaacttaagggaattattacaaaataaggaaaccaaacgctatttaaccttattagatgatgcgttagagctaagttatgatgtaatgaagctctctttagggcgtagccaattactggatagtgcgtttgaacgggcaacactttatcgtaatcgtttaaaacgcctaattgatacgacgattgccggatacagttattggtttgaaagctatggtcgtcattttttactggcgatcacgccactttcggttgctgataaatttcatgagctgattaagtcccataaaagtagttggatatttacttctgcaacactctctgtagatgaaaaaatgtcttattacacagatagattaggactggaaaatgccacaacattaattttaaatagcccatttgattatcaacatcaaacgttgctctgtgtacctcgttatttacctccgttaaatcaaccatacaccgcgaagcgtttagccgctatgctggctcctgtgatcttaaaaaatcaggggcgttgtttttttctttgtacctctcacgctatgatgcgtggattagccgaagagtttaaagccagcttaccacttcccgtgttaatgcaaggcgaaatggggaaatcgcaattattgaaaaaatttgtttcctcaggcaatgcgttactcgtcgcgacccaaagtttttgggaaggggtggatgtcaggggagatacactttcttgtgtgatcattgataaattaccctttaccgcacctgacgatccattattaagagcacgtattgaagattgtcaattacgtggtggtgatgcatttcgggatgtacaaatccctgatgcggtgatcactctaaagcaaggcgtcgggcgtttgatccgcgatatacatgattatggtgccattattgtttgtgatgatagattagtttcaagaccttatggggaagtgtttttaagtagtttgcccccatcaccacgaacccgttcattagaaaaaaccagttattttttaagccaacgggcacaacgaaatgaaatagtgtcggagtcataa

SEQ ID NO: 577 - DNA, 996 bp, Proteus mirabilis
atattagctggtatactctggcgattatttttttatatgtaccataacatcataggaatatcatggtacttaatttgtaggagaagagtaatgtcatcagtggtgcgtaaagtaagaaaagcggtgatccctgttgcagggctaggaacaagaatgttgcctgccaccaaggctatcccaaaagagatgctacctgttgttgataaacctttaattcaatatgttgttaatgaatgtattgcagctggcatcaatgaaattgtgctagttacacactcttcaaaaaattctattgaaaaccattttgataccagttttgaattagaagctattttagaaaaacgagttaaacgtcagttgttggaagaagtacaaggtatttgtccaagtcacgttactattatgcaaactcgccaaggaatagcaaaagggttaggccatgccattttatgtgcaaaacctttggtgggtgatgagcctttcgctgttatcttgccggatgttattttagaccgatatagtgctgatctgactaaggttaatttaaaagagatgctttctcattttgaacaatctggcgcaagtcaaattttagtagagcctgttcctgaagaggaagtatctaactacgggattgttgactgcatgggagaacatttacagcctggcgacagtaaacccattactcgtgtggtagaaaaaccgaagaaagaagaagcaccttcaaatttatctattgttggtcgttatgtgttgtctgaaaacatttggcctttattagccaaaacggcaccaggagcaggggatgaaattcaattaactgacgcgattgcaatgttaattgaaaaagagcctgtagaagcttatcacctacaagggaaaagccacgattgtggtaataaattaggttatatgaaagcttttgttgaatatggtttacagcacgaagagtttggcgaagagttcacgaaatggataaaatcactgcaagcttaa

SEQ ID NO: 578 - DNA, 363 bp, Proteus mirabilis
tatcaaaatggtaacagaggagacgcaatcatgagtcaatggatagcggtttgccaattagatgacatcactgtgggaactggcgtttgtgcgctggtggagcaagaacaggtggctattttccgtccataccaagatgaacggctctacgcattaagtaatattgatcccttcgcgcaagcgagtgttttatcaaggggattaattgcagagcatgacaatgagttatatatcgtcagtccactgaaaaagcagcattttcgcttaacagatggttattgccttgaagatgagcactattcaattactcattatgaagtcaaagtcgaaggcaataccgtcagtgtgcgttcgcgtcattga

SEQ ID NO: 579 - DNA, 645 bp, Proteus mirabilis
aataatgatggcaaaaaaatcacggtttattcaactatttcccctgaaacagtagtggaagttattggtacttatacgtcaaataagtgtgaacgttctcattttaatgcttcttatactagagtcacttattcctctttaacgcaagaagtggaagcagagcgtaaaatagcagaggataataaaaccgcaacctatatcgtgcctattgatggagggagatggtgtaattggaagctagtagaaatagatatagccccagtctctactatttataaaagtcatatggtgattagtaaggttattccaattgtcgatgacaaacattcaaaaatagaactatttactacattagctcccgtaatagtggaaagcaagaatgatcaaaaaatctattatgcatcatcagaaatggaaggtgaaaagaaattatctaataaattaaatggagaaatttattttaattataaagttgaacctaaactaactacgactatcatctcaaatgataaaaaagctattttccctaacggtaatattaaaacactgagtggttcgacttatagtaaaatgattggttttaatgaaataatcgagaatagtgatgaaaaggcgtttgcttcttttgttagatatattgattaa

SEQ ID NO: 580 - DNA, 486 bp, Proteus mirabilis
gttaacattttgctaacaaagagcgctattgaggggaataaaatgcgttttttaaaattaccttttatttattggctgctactcaattgcatcccatttattggctttgaactacactcaggcaatataaaacccggtgtttttttctatttaggtgctctaacgatcatcacttcagggatttggctatttttctgcctttacttttttatcaaacataatacatctcctaaccctcaccagacaccgcgccatttagtcaccacaggtccatataaaataagtagaaatcctatgtatcttggctttctcgatattagtattgggctgttttttatttttggtaactggggatttttaggggctgcgcttgccttctactttattaccgatcgctatactattgtgcaagaagagaaaatattaagtgagcggtttccacaagcgtggcgacaatattgccgccacgttcgacgctggatataa

SEQ ID NO: 581 - DNA, 1005 bp, Proteus mirabilis
tggtatcaaggaggacgaataatgaaaagtgtcaataacgctataatcgaagattctgatgctatctatatggctcagcttaatgggcatggcggaattatgccgatcacggctaatagcatagcaagtaatgaaaggcctttttgggttcatctcgattatcgtaaacccaaaagtgatcagtggattaatcagactgagttacttcctcctatcgcaaaagatgtgcttttagctgaaaatgttcgacctaaggcacagcgtatcggggaaggggttattattaatttgcaaacgattaataacaaccccgatgatcggccggatgaactgattgcgtatcgtatttatattaatggtcaaatgattatttcgagccgacatcgtcgcgttaattccgttgattcggtgatccactctttagaagtgggtgatggtccagaaaatagtggtagttggttgatcactatggccgatgcagtgacagatgaaataggtgattttgttgaaacacttcatgaccaattaattgagttggaagatatgatcctcgatcagcaaattccggctcgaggtgaattggcattgctacgtaagcaactgattgtgttacgccgttatatggcgccacaacgtgatgtattctcccgactctctatcgaaaaattaccttggatgagcgacagtgatcgcattagtttggttgaaatatcagaacgtctctcgcgtcgattagaagatttagatagtagtatttctcgtacagccgttattgctgatgaaattacttcaatgatggcagatgcgatgaacaggcgcacatataccatgtcattaatggcgatgctatttttgcccacgacctttttgacaggactatttggggttaatttaggggggatccccggcaatgaatttccttatggctttgctatattttgcttttcactgtttttcttgattgtgattgttgcttggtggttaaagcgtagtaggtggttgtga

SEQ ID NO: 582 - DNA, 645 bp, Proteus mirabilis
agtcgtcaaggcgtaaggagtctggttatgtcaacgcaatatggtttttatatcgattcaagtcgttgcaccggctgcaaaacctgcgaactcgcgtgcaaggattttaaaaatttatcccctgaggtcaatttccgccgtatttatgaatatgccggtggtgattggaccgagcaagatggtgtgtatacgcaaaacgtttttgcttactacttatctatttcatgtaaccactgtgacgatccggcttgcgtaaaagtctgtccaagtggcgccatgcacaaacgcgaagatggttttgtggtggtaaatgaagaagtgtgtataggctgtcgttattgccatatggcatgtccttatggtgcaccgcagtttgatgaagtcaaaggccacatgaccaaatgtgatggttgttatgagcgtgttgctgaaggcaaaaagccaatttgtgtcggatcttgcccattgcgtgcattagatatggcaccgattgaagagttacgcgctaaatatggtgatcttgctgaaatagcccctcttccatctgcgaaatacactaaaccgaatattgtacttaaattaaatgccaatagccgacctgtaggtgacaccaccgggcatctggctaacccagaggaggtttaa

SEQ ID NO: 583 - DNA, 1026 bp, Proteus mirabilis
agcggcggaggagttagtatgagccaagccaccttacaagatagaaaagtgatcctcgaagtcaacgatctaaaagtttatttcgatgtacaagataataagcagtggttctggcaacctaaaaaaagcctcaaagccgttgatggtgttaccttacgtttatacgaaggtgaaaccttaggtgtagtaggggaatcaggttgtggtaaatcaacttttgcgcgtgccattatcggcttagttaaagcatcgggtggtacagtcacttggttaggccatgacttattaggcatgggcaataaacagtggcgcgatgttcgtcaagatattcagatgatattccaagatccacttgcctccttaaacccaagaatgacgattggcgatattattgctgaaccactaaaaacctatcatccgaaaatgaaacaggctgaagtggttgaaaaagtcaaagcgatgatgatgcgagtggggttattaccaaacttaattaatcgctatcctcatgagttttctggtggacagtgtcaacggattggtattgctcgcgcactgatcttagagccaaaactggttatctgtgacgaacctgtatcggctctggatgtttctattcaagctcaggtagtcaatctactgaaagatatccaaaaagagatgggattatcgctcatctttattgcgcatgatcttgcggtagtgaaacacatctcagatcgtgtcttagtgatgtatttaggtcatgcggtggaattggggacttatgatgaagtttatcatcacccattacacccttataccaaagcattgatgtcagcggtgcctattcctgatccggataaagagcgtaacaagcatattgatttgttagaaggagagcttccttcaccaattaatccaccatcaggctgtattttccgtacacgttgtccgatggctgatgaagaatgtgctaaaacgcgccccttattagagggaagtttccgccatgcggtatcttgtttaaaagtcgatccgctttaa

SEQ ID NO: 584 - DNA, 621 bp, Proteus mirabilis
ctattattgggctttaaggagaatactatgcatctttttcgttcatctttagtgatgttagtattactgacacttatcactggattagcctatcctttatttataaccggattagctcaattgtttttcccttggcaagcaaatggttcactggtttatcaggacgataaactgattggctctgaattgattggacagtcatttaatcgagccgattactttcaaggtcgcccctcaatgacaagtgaaatgccttacaatagtatggcttccggcgctagccaacttgctacatcaaatccactcttaagcgagaaagtggctgcaggtgttcgtttatggcaacaaagggttgataatcatcaagtcgttcctgttgatttagtgaccgcttccgccagtgggcttgatcctcatatttcattggctgccgcttattaccaagcaccgcatattgcgttattacgtcaattcacaataaatgaaataaaacaattaattacagaaaatacgacatcgccattaataccatttttaggtgaacctgtggtgaatgtctttaaactcaatcaggcacttgatagattgagtgcagaaaaaaacaataaagtgagcgggtaa

SEQ ID NO: 585 - DNA, 1281 bp, Proteus mirabilis
gtcatgctgggtaaaaatatagaacaaattaatcatgctcgtttagctggaaaagaaggtttatggcgcattacagttaaaaataaccagattgcagccattgagccacaaccgcaaagcgattttcatccccaagggttagatgcacaaggtggattggttcacgctccttttgttgaacctcatattcatttagacaccacgcagacagcaggacagccaaactggaatcaatcaggaaccttatttgaaggtattgagcgttgggcagaaagaaaagcattactcacccatgatgatgttaaacaacgggcgtggcaaacattacaatggcaaatcgccaatggtattcagcatgtaagaacccatgttgatgtttctgatgcatcgttaacggctttaaaagccatgttagaagtcaaacaagaagtcaaaccttgggttgatttacaaattgtggcatttccccaagaagggatattatcttaccctaatggcgaagcattattagaagaggccttgaaattaggtgcggatgttgtgggggcaatcccgcactttgaatttacccgtgagtatggcgtggagtcactacataaaaccttcgcattagcgctgaaatacgatcgacttattgatgtgcattgtgatgaaattgatgatgaacaatcgcgttttgttgaaaccgttgctgcattagcacataaagaaaatatcggctcacgggtaacagcaagtcatacaaccgctatgcactcttataatggcgcttatacttcgcgtttatttcgtttattaaaaatgtcaggcattaattttgtagccaatccattagtgaatatccatttgcaagggcgttttgatagttatccaaaacgtcgggggatcacccgtgtcaaagagatgttagcgagtggtattaatgtttgctttggtcatgacgatgtctttgatccatggtatccattaggtacagcaaatatgctacaagtgctgcatatggggttacatgtttgtcagttaatgggctatgggcaaattgataatggattacaacttatcagtcataatagtgcaaaaacattggcattaacggattatggtgtggaagtcggtaatagtgctaactttattattcttcctgctgaaaatggttttgatgctttacgtcgtcaagtccctgtacgttactctattcgtcacggtaaagtgattgcacaaaccgagccggctaagacagaaattatgttagctaagccaacgcgaattacgtataaataa

SEQ ID NO: 586 - DNA, 1098 bp, Proteus mirabilis
acgtttatgggatttaaatgtggtatcgtcggtctgcctaacgtagggaaatctacactgtttaatgccttaactaaggcaggtattgaggcagccaacttcccattctgtactattgagccaaatacaggtgttgtacccatgcctgatcctcgcttagataagttagcagaaattgtaaaaccacaacgagtgttacctacaacaatggagtttgttgatattgcaggtttggttaaaggcgcatctaaaggtgaaggcttaggtaaccaattccttaccaatatccgcgaaactgaagctatcggccatgtcgtgcgttgttttgaaaatgacaatattgtgcatgtggcgggtaaagtcgatcctgcagaagatattgaaactattaataccgaattagcgctttctgatttagatacctgtgaacgagcaatgcatcgtaatcagaaaaaagccaaaggtggtgataaagttgctaaagcagagatggaagttttagagaaatgtttaccgcacttagaaaaagccggtatgttgcgtgcattagatttaagtgatgaagaaaaagcgattatccgttatttaagctttttaaccctgaaaccaaccatgtatattgctaacgtcaatgaagatggtttcgaaaataatccttatcttgatacggtacgtaaaatcgctgaagccgaaggctctgttgttgttcctgtttgtgctgctatcgaagcagatattgcagagctagacgatgaagagcgcgaagagtttatgcaagatttaggcatcgaagagccgggcttaaaccgtgttatccgtgcaggttatgcgttactcgatttacaaacttactttactgctggtgtaaaagaagtccgtgcttggacaatccctgtaggtgcaactgccccacaagctgcaggtaagatccatactgactttgaaaaaggttttatccgcgcccaaaccatctcatataatgactttatcacttatggtggtgaacaaggtgcgaaagaagccggtaaaatgcgtgcggaaggtaaagattatatcgtgcaagatggcgatgtgatgaacttcttgtttaatgtgtaa

SEQ ID NO: 587 - DNA, 1218 bp, Proteus mirabilis
gatgaaatggggatcccgcctagccatattgatcatgtaaaacaatttaatcttggcactgtttttcgattaattgatgaacatggtcctatttctcgcatctcattatctaaaaaagcaacacttgcgcctgccagtattactaaaattacgcgagaattagttgaagcacaccttattcatgaaacagaatttcctgggttaggatttcgaggacggccggctgttggtttaaagttagagagcaaagggtggcaatttttatgtattcgagtaaataatggtagcctactttttagtttaagagagcttgataatcaattagttgttgaagataccttcgactttcctaaacaaaatagtgatgcttttttgcatcatttccttgctgcaatagatacattctttcaacgttatcaatcaagagtagagcgccttactgcaattagtattaccatgaatgcaattgttgatccgattagtggcgttatttatagctctccttactatgctatccaagatatcccgctggctgataaaattcaggaaaaaacaggtgttgctgttttcttacaacacagtgtaacggcttggacgatggctgaatcactctatggtgcagccaaaaataacaccgatattctgcaaattgttattgatgatattgtcggtgcaggggttgtgactaatggaaagacattacattcaaacagccatagtgccgtcgaaatagggcatacaaaagttattgattcacagacgcaatgttattgtggtgcaaaagggtgtttagaaacggaaatatcgatccctcagttaattaaaaaagcacagcacttggcgcaagaaaatcccacctcaatacttaatcaatatccgattacggtagaaacgctatgtgatgctgtattaattggtgataaacaagcattagacatcattaatttagtggcgcaacgacttggttttattttagccgtgatggtcaatatttttaatcctcaaaaaatattaataggttcacctctgtgtagagcaaaatctgcacttttccccctgatccttagtagtatccaacaccatgtattacctagatacgcccataacttggttattgaagaaacagaattgcgcaataaaggcacattgccagcggcatcactagtaaaagaagccttatataatggctcattattacttgagttaatgcaaggctaa

SEQ ID NO: 588 - DNA, 432 bp, Proteus mirabilis
ggtgtatcggggcggtggcacagttttgttatcgctcctccgtgtaacagagcgtggcgctatttatggtcgggagaccaactaatagaagaaacgccgatatatgccgatggtactcttgcggcatctcagcaaatccaatggctgtatcaacccggagagataacgcccaccgcgcgttatcaacagggaaaactgcactatgtggtcaccgatcaccaaggaaccccgcgagagatattcagtgaaggcggacaagccagttgggcaggaaggttgaatacgtggggccaaatgcagttttggcgttaccgagagggtaaggcggagaatgaccctaattataccgaatgtccttttcgctttgcggggcaatatgaagataaagaaagtggctttataatcgctttcgctattatgataaggagatag

SEQ ID NO: 589 - DNA, 1161 bp, Proteus mirabilis
gaaataatttttagtaaattcctaggaacatttatgaaaatgaaatactcaccattttttatattactcatgacaacaggtacaacattaagctatgctactgatggtgaaattaaaataatggcagggaaaactggctatgtaggcgaagttgttccagtgacaaaattagctgaaacctttcctaaaagtttcactgccccttcgagcgctaattattatgctaggcttggttttctgagccttaccaaccagacgggttattgtggtagtaccgatgggctacaaaaaatacctgaaattaatgaatggggatttaaactaataaataaaaactatcctacctctggctatttactattggcgataaatggaaacattggaggacaatataaaactaataattcaggtatccaaaatataaaaggagtattaactcgatctaagttgactcgttcaagtttatataatgtaagcaaaaatggttctttttgctggggaccttcggcttatgatcaagaaaatttttatgatccttcttttcgatcttatgtctctatcagtataaatagttattcagtttatgcatatggcgatataaaacctggtattttttcattagaaactagttttaagttgtcaagaaatacagctaatagcgtcgatgatagtactgcttattttatccgccctggagaaattaaagttacggccttaagaagctgtaacgtaataagtagtactgagactaatattaaatttaaagatcaatttacatcaacatttacttcaccaacattattagatacttcaccagtaaattctgttaatgttacatgtactcaaggtggaaaaaactatattacaataaaagcttataatagtcttgttagtggaaatatgtctggaatgcttttaaatggaacaaaatcaaacaatcaatcagaagtttatgttgttgcatcattaaaaaatttaacaaatcaaacatgtcaagcgaatgatacaagtgccattagattctttgatggtcactatatacccaatatggataatataaaatcctttaatcaaacttttctatttggtctatgtgctaatggcaaagttatagcagataaatattcaggagctgtcgatgtttcatttatcgttgagtaa

SEQ ID NO: 590 - DNA, 1275 bp, Proteus mirabilis
ccactttttatggacactcatgaaataagcagtaaaaacatggccctaaaagaagatgtttctatcaacaccacttctaaaccaaacagtccgaaacactatatccagcgtgatgacgcgctttatataaaagtgacagtgtcattttttatggttggtttagccacttttgcattactctactttgtgcaacctatcttacctatcctatcaaaagaattttcagtcaccccagcaaccagtagtcttgctttatcgctttctacaggtcttatggcttgtggtctattgattacagggcctctttctgatgcgtttggtcgaaaaaatgtgatggttattgcgctattttgtgcggcttttttcacactattaagtgccatgatgaatagctggacggggattttaattacacgagcactcgtaggactatcacttagtggtgttgcagccgttgcgatgacctaccttagcgaagagatccatcctgcttatctagccttatcgatggggctttatattagcggtaactctattggtggtatgagtggccgtgttattactggtgttttgagtgattattactcttggcgtgtgtctgtgattattttaggtatttttgcccttgttgctgctatcattttttggcgaatattgccgacatcacaacattttaggccagcaaccttaaaaccacgtaatcttcttatcacaactaaattgcattttagagataaaggactccctcttctttttattgaaggtggcttgttaatgggaggatttgtaactttatttaattatattggttatcgcctattagatgcaccttattcattaactcaaacaaccgttggtttaatttcaattgtttatttgagtggaacttatagcgcatcgaaagcaggcttattaaccaataaatatggattaggtaaagtgtttattgccggtgtttctatgatgctagcgggtatattaattacactatttgactctctagcaattatttttataggtatgcttattttaactacgggtttttttgctgcccatgcggtagcaagtagttgggttggacgtcgagctaaacgaggacgtgcgcaggcctcttctctttatctatttacctattatgcaggctcgagtattgcgggaacactaggtgggatcttctgggtcaattttggttggcttggtgttggtttgtttattgcttttttaatgttaaccgcactattaatcgcactgcgccttaatcgaatagcacaataa

SEQ ID NO: 591 - DNA, 621 bp, Proteus mirabilis
cgtgattttatgtattttcagtatggtgaaaaagagatctcttttttaaaacaaaaagataagcgtctagccgcggtgatggaaagaataggggaaattaaacgtccacttacccctgatttatttaccgcattaattaaaaatattattgaacagcaaatttctgttgcggctgccaccacggttcagcaacgtttacttaccctatgtgatggtatttatactcctgtacatattgctagtttatcagtgcaagatattcagcaatgtggaatgacaatgcgtaaagccggttatattaaaggtatcgcagactcagttataaatcatacgttagatttagaccaaatccccgctatgtctgataaagcggtgatcaataccctaataaaattaaaaggtattggcatttggaccgctgaaatgttattaatttcatcacttaatcgtcctgatattttaagttggggggatttagctattcagcgtggtatcatgcgtttatatcgccatcaaagcttagatagaacacgctttgaacgctatcgtaaacgttattctccttatggttcaacggcttcactctatttatgggcattatctaaagaaagcgcagactaa

SEQ ID NO: 592 - DNA, 312 bp, Proteus mirabilis
gggatatttatgataaaggttattgcagaagattttattaaatcaggatcaatagaaacggtcttaccactttaccaagaattggtgaaagctagccaacaagaagcacgttgtattagctatgatttatttgttgatgagaaagatcccggtcactttatttttattgaatcatggccaaataaagaagcactggatattcattgtaatagtgaacattttcgtcgcatcattccgatgattaaacaatatacaaaagcagagtcaaaaatcactttagtcaatagtgtatttgataaaaatatagattaa

SEQ ID NO: 593 - DNA, 1077 bp, Proteus mirabilis
tatgggtttattaggctttaccttatcaacccccaaagttatgcaacaaattcgtcaagcattggagcaataatgtctcgttttcgctcaccgtggatgagtattgccattttactcatcttatttaccatcattacgcttatttctgttaatagcggcccgctagcactctcatttagtactttatgggatcgctcttttgatgatatagagtggcaaatttggcttgatattcgtttacctcgagtactattagctattctcgtcggtggcgctttagccatatcaggcaccatcatgcaaggattatttagaaactcacttgccgatcctggattactaggtattagcagtggtgctgcgctaatggtcgctattgtgattattttacccttctcttttttatccgtattttctttctacagtcatattattgccgcctttattggcggcttaatagtggcaatgattattttttcattgcatcaattaagtgatggtaacttggcaagattgctcctagcgggaattgccattaatgcactttgtatgtcttttattggtgtattgagctatatcagcacagatcagcaactgcgccaattttcactatggatgatgggctctttaagtaaaatagactggaacaccttggcgattgcaactctcgtgattattcccattagtgcattagcctgttggcaaggtcataaacttaacctattacaactcggtgatgaagaagcacattatttagggttaaatgtaagaaaaacaaaatttattttactactactcagtgccattttaatcggttgtgccgttgcattaagtggtgttattgggtttgttggtcttgtggtgccccaccttattcgtatgcgattaggcagtaaccatatttggttattaccggccaccctattagggggagcaatactcttattagccgcagataccctgtcaagaaccttggtatcccctgcggaaattcctgtaggacttattaccggacttcttggtggaccttattttctttggcttattttacgacaaccagcaggacgcatgtcatga

SEQ ID NO: 594 - DNA, 666 bp, Proteus mirabilis
ggatatttcttatcttcacgggtatcaccactcattgatagggagttatttaagatgaaattgtactacacgccgggtagttgctcgctttctcctcatatcgttctacgtgaaacgggtctcgacttttctattgagcgcattgatttacgcaccaaaaaaacagagtcagggaaagattttcttgccatcaaccctaaagggcaagttccggttcttcaattagataatggtgatattttaacggagggtgttgctattgtgcagtatcttgccgatctgaagccagatagaaatcttattgccccaccaaaagcattagaacgttatcatcaaattgagtggctaaactttcttgccagtgaagttcataaaggctacagccctctattttcatctgatacgcctgaaagttatctccctgtggtaaaaaacaaactaaaaagtaaatttgtttatattaatgatgtactaagcaaacaaaaatgtgtttgtggtgatcactttactgtggcggatgcgtatctgtttacgttaagtcaatgggcacctcatgtggcgctagatttaaccgacttaagccatttacaagactatctagcacgtattgcacaacgtcctaatgtgcatagtgcactagtcacggaaggattaataaaagagtaa

SEQ ID NO: 595 - DNA, 639 bp, Proteus mirabilis
tatctccttattcattatttattgattagaattttatatatgactttcgacatttttttatcattagccatattttcatttgttacttcaattacaccaggcccgaataatattatgcttctagcatcaggcattaactttggcttaaagcgtacaatgcctcatgctatcggtgtgtctctcggtttttttgtgatgttattggctgtggggataggcataggagcacttattaaatcatcgcccattatttacaatatattaaaatatctcggagcgctgtatttattgtggttagcttggaaaacggcaattagtcattctgttgagcaaaatagtaataaacaaggctcaccgttaaccttgttagaggctgcattatttcaatggattaatcctaaatcatggatgatggcgatttcagggataacattatatacctcaccacaatatccttatatttcaatgttgttagttgctattattttcacattaattaattttccttgtgttgctatatgggccacttttggtcatagcttacgagagcgattaaaaaatcccaaaatattaaaactatttaattttattatgggtggtttattagcattaagtgctatttctgtattattccaataa

SEQ ID NO: 596 - DNA, 2613 bp, Proteus mirabilis
ggctttattatgctaaaatctaaaactatatgttttaatttatatatctttttaggtacatgcttttctggtgtggtgtatgcggatagtttttttaatcctaacttaatttcaaatattgataatgaagtagcagatttatctcgatttgataaaggtgaaggccaacctgaaggaatgtattcagtagaaatttatgtaaacgatgaatatgttgaaacaaaaaatttaatattttatgaaagcgatgcatcatccgatgatacaggtttattaccttgtatagataataaaactttgacaaattttggaataactttaactgaaaatagcaaaaagaaatcagaagaggtagaaagtaaagatagtgcttgtgagaatattttagataaaatagaaaactcaagtgttaaattcgattttgaaggacaaaaattatttttaagtattccacaaataatgtttaaaaataatgttcgtggctttatcccacctgaaaaatgggataatgggattaatgcgtttttactaaattataatttcacaggaagaaatagtaagaactttaaggataacgttgataataataattattttttaaacttaaatcctggtattaatcttggttcatggcgatttagaaatgaaagttcatggaactatgccagtggtgaaagtaagcaaaataaatggaggaatataagaacatatgtacaaaaacctattattccattacgtgctgaattaacccttggtgactctttttctaatggaaccatttttgatagtcttggttttagagggattaagctagaatctgatgataatatgttgcctgatagcatgagaggatttgcacctacgataaagggtattgcgaatagcaatgctattgttacagtcaagcagaatggttttgtcatttatcaaatttctgtacctccaggtgcatttgaaataaaagatctctatgccacatcaagtagcggtaatttagatgtcacaatcaaagagaataacggtaaaattacacaatttgttgtaccttattcaaatgtgcctattttacaacgtgaaggacgcttaaaatacgaattgattggaggggaatttcgtagcggagcagattatcaagataaacctaattttggtcaattaagtttagtatatggcttaccttataatatgacgttatatggaggaagccaattttcaaataattatcaagcctatgcgattggtttaggtggtaatctaggcacctttggggcgatatcagcagatgtaatacaggcgaatagtatattgccaaacgatgagcataaaaaagggcagtcattccgattactctatgctaaatcgattaatagcacaggcactaactttcaaataatggggtatcgatattcaacgcaaggctattataccctaaatgaagttagttataaaaaaatggcagggcgtgaaatagtaacagataatggaataataagagatgaggataacttatctaactactataatttaaattattctaaaaaagggaggtttcaacttaatataaatcagcaaattaccaataatagttctttgtatattttaggctcttaccaaaactattggcgcacaactgaaactgaacagttatggcaactgggttataatgctaatattgataggataaattatagtcttagtttatcgaaattaaaatcaccgggtatgcgtggtgataataaaaatgtagcttttaatatatcaattcctcttaatgatgtatttaaccaacaaactgtaagtgacttacattcaagtagaaatagtatgtatgctgtttactcaatgaatagaagcgatgacaatgtttgggtcaatcaagtgggactaacaggaactctccttgaagacaataatttaaattataatattcaacaaggatatacgcataatggttctggttattcaggaatggtttatgctaattataaaggtaaatatgctaatataggtagcggatataattatagtaatgattggcatgagtttaattatagtttaaatggtggtgttgttgctcatgcaggtggtattactttaactcaacctttaggggataccaatattcttattaaagcaaatgatgctaataatattaaagtagaaaatgcaaatggtatattaactgataataaaggttatgccgtcttaccgtttgcttcaacatataaaaataatcgagtttcattagatgttaattcattagaagaaaatattgaattagaaaatacgattattaatgtagttcctactaagggggcattggttgaagctaattttaaaacgaatattggctatcgagcaatggttacattaagcaaaaaagatggcgctattatacctttcggtgcgatggttgttgatgaagagcgttccgtaagtggtattgttggcgataatgggaatgtttttatctctggtttagcacctgttggtaggctaaaagcaaaatggggaaaaatggctgatcaacaatgtatattcgattaccaaattaatgagaagtcatcaaaagaaaaaggtatctattttatttcttccacatgccaatattaa

SEQ ID NO: 597 - DNA, 501 bp, Proteus mirabilis
aaaattattatcagatttccattaggagtaattatgtttaagcatttacttgttggtctttttgctgtgacaacgctggctggttgtgtaaatacaagctctttatcaggtgatacttatacagcaagtcaagctaaacaagcacaaaacgtaacttatggcaccattgtttcagtacgtgcagtaaatattcaagccggtagtgatgaaaatgttcttggtgctatcggtggtgccgtattaggtggtttattaggtaatacaattggtggtggtacaggccgtaacctagcaaccgcagcgggtgctattgctggtggtatggctggacaacaagcacaaggtgctttaaatacaaccaagggtgtgcaattggaagtacgtttagatagcggtaaaaccgtggttgtcgtacaaaaagcagacaatactgcctatagacaaggtcaacgtgttgctgtgattggtaacggcaataatctcaccgtttctccacgctaa

SEQ ID NO: 598 - DNA, 828 bp, Proteus mirabilis
gggaatattatgatgatccaagcgttacattcgctttatcaacaacacaccgataatggtggtcatggcatcggacgttgtggtggtaaaggtaaacacagaggacaacaccacaatggcaataatgaacattgttgtcatggtgaaagaggccatcaccaagaaggtcatggcaaatgttgccaacagggtgagcaaagtcatgagcataatgatcatgccgaacatggctgctgtcacggtgaaaaacagcaagagcatggtaaacgacatggccgaggttgtggtgctggtaaaggaaaaggaagaggccaaggtcgtcaattaaaacgtatgtttgaccatggtgatttacgtgtccttttgttgagtatgatcgcggcaaaacctagccatgggtatgaaattattcgaggaatagatgaagcatcttcaggactatatgtaccaagtccaggggttatatatccaacactgacactattagaagagcaagatttagttgttgctaatatcgctgaaaaaggccgtaaaaattatagtattacgccagaaggttcagcatttttagcagaaaaccaagaaacagaaaaaaatattcaaaataaactggcttatgcacgtgatttatcacaaaacgcagggggagtttctgaggaaatcgaatttgcggtaggaaaattaaaagcggtattacgtcataagttagtattgaaacaactttctgtagaaaaagcgcaacgcattgcttttatacttaatgaagcagtcgaaaaaatagaagccattaatgaggcattgatctctgaggtaagggaagatgaataa

SEQ ID NO: 599 - DNA, 768 bp, Proteus mirabilis
agaaccattatggatgcacaactgtataaagagtttaaaattatagaaaaagcgttttggtcagagatatgtgaaaacaatattcgtattggtgatcatacccactgctttatgacaccgatggacgcgcctatttttaattttatctaccttcgccaaggcgctagcgaaaatactttccaacaagcaagtacgctgttctcctcgcaaaaaaaaggtcacatgctggttctgccggaatctctgttgcctgaatttgaagagataataaaaaaagcaggttatacgggtgacggtatgacaaccgctatgtatctctcattgtctgatgcgacttatcccccctataaaaataacccgtgcgatattattttaactaaccatgatcttaaacagtgggcgcaaccattgaaaaccgcctttcctgttggtgacgatacgataactaatgaatatattcgttatcaccaaaaagcgttagataatggtgcgacgatccttcattatgcattattagttgcagggcagcctgtatcatcattaacgctgacattacatgataaactagcaagatttgacgatattgggacggatattgcttatcaaggcaatggttatgccacacatctaattactcacgtattagagttttgtcgagagcaaggtgtcgagcgttgtttcttagatgcgtcagcggatggtctagcgctatatcgtaaatttggttttaagccactttttaactatttaagctttattaacgaataa

SEQ ID NO: 600 - DNA, 1506 bp, Proteus mirabilis
agtcagattatgtctcagagcaatgttgaaattggtgatgaagttcaaggctggctcagtgatcatcactataaagaagggttctataccgatatctcaaccgatacgttagataaagggttgaatgaagcggttgtgcgagctatttcagctaaaagaaatgagccagagtggatgctagagtttcgtcttgatgcttatcgtcattggctagagatggaagagcctcattggctaaaagcagattatccatcgctgaattatcaagattatagttattattcagcgccatcttgcggtgcttgttgtgccaatggcagttgtgctagtggtaacaatgaagctgtctcaacacaagaaacccaagattatttaactaaagaagttgaagacgcatttaatcagttaggcgtgccagtaagagaagggcagtcagtggctgtagatgctatttttgactcagtatcggtttctaccacttatcgtgaagagctagctaaacatggtgttattttctgctccttcggtgaagcgattcaagaatatcccgaattagtacgccaatatttaggtacagttgtttctagccacgataactattttgcggcacttaatgcggcggtcgcttctgatggtacctttgtttatattcctaaaggtgttcgctgccctatggaattatccacctattttcgtattaatgcggcacaaacaggccaatttgaacgtacgattttaattgcggatgaaggaagttacgtcagttacatcgaagggtgttcagcacctgtacgtgatagctatcagctgcatgctgccgttgttgaagttatcattcataaagatgccgaagtgaaatattccacggtacaaaactggttctctggcggtgatagcgaaggcggaattcttaacttcgtcactaagcgtgccctttgtgaaggtgagaacgctaaaatgtcgtggactcaatctgaaacaggttcagcgatcacttggaaatacccaagtgttatcttaaaaggagataattcaacggctgaatttttctcagtggcactgaccaatggtaaccaacaagctgacacgggaaccaagatgatccacatcggtaaaaataccaaatcaactattatttctaagggtatttctgcgggtaaaagtcaaaatagttatcgcggtttggtgaaagtgttacctggtgcgcagaatgcacgtaactacacacaatgtgactcaatgttaattggcacagagtgtggtgctcacaccttcccttatgttgaagtcatgaataactcagcacaattagagcatgaagcgacaacgtcacgtattggtgaagatcagttattttactgccgtcaacgtggattaagtgaagacgatgcaatctcaatgattgtcaatggattttgtaaggacgtgttctcagaattaccgctggaatttgctgtagaagcacaaaaattattagcaatcagcttagaacatagcgttggttaa

SEQ ID NO: 601 - DNA, 1485 bp, Proteus mirabilis
cagggtgttattatggaggtgtttatgaagaaatataaaataacgagtgaaacaaaagaatataatggtgttactttatatagaattagaagagtgtatacagatagtccaggaggatggatagaaaatgaaagtaatttaagcagagatgataattgttttatttttgataatgtaatggtatttggtaatgctaaagtcacagataatgcaattataagaaataatgtgaagatctacggtaatgcaatagttaagggaaatagtaaagtaaaagacaatgcagagatttatggtaatgtgctagtggaagataatgtgacaatatctgatgatgttgtaatatatgataatgcagttattaaagataatgcgagaatatctgacgatgctgtaatatatgataatgctgttattaaagataatgctaaagtatcagaatatgctattgttcgtggtgatgcaatagttgaaaaaaatggttgggtgactggttatgcgactgttgagggaaatacaattgtatcgaaaggtgaggttattaagagccaatttggctcttgggatgatattgatgaactaagagcattttatatttatattaatagatataacagtacagcgactgcatatgttaatggtagacatcaggtacctattactatttatatagaggctttagataaaaatggtcgtatcataaaaatagccaaagaagatatttatagaaatacacatattgtaaatgaaaaaaatcttcctattgaccgcaatgatatttctttatctgataaagaaaatggatttgtatttccaagcagtgaagaagcaacattgaactcccctgatgcatctacttgtgttatttatctttctgttaataaagtgatagatacctttagaatttgtgcacagactcacattaaaggaaaagagtatactacagcctttaaaaataattacagtgattatttaaattttatcattctggacgttgcaccaaaaaaaatatttacagaagcagatgtagacatagaaccgctggtaaatcctagaatagaaaaagatgtagaaacatcaggtgatgtcttgacgaaatattatctaaggtttaacggtaataatagaacgataactaagagtgtagagtatgaagaaaataaatcttttcattattttcaaaaaggtcattatcagattattagcacatcgactgataaatatattaaaaaaattccattaaagcctcattattacactaaggaattccattttaaaccagatactttaattccggtcacatcagcaaatgatgaggatggggtatgtttctggagctatagtatagaatatggaaaagcgtttacatccagtaggaaagatgaagaaatgaattgtattatatatgatcaatatggtaatgatcttcaagtatcaattaaagcagatgaaaataataaattaaagttttattttgggtcataa

SEQ ID NO: 602 - DNA, 810 bp, Proteus mirabilis
gagggagttatgaaggaaattattacaggtttgcttctagcctcaataagcttattttctgtctcttgttcgcaagaagatacagatgtcgtcaaagtagcaatcaatactggaccagaccaagtcatttgggatgaagtgatccgtttagctaaacttaccgaaggattaaatgttgaagttattgcatttaacgactatgaacgtcctaataaagccctagaaaatagagaagtagacgtaaatgtatttcaatctattccttatttacaatcagagataaaagcccacaattacaaatttcatattgccagcaaaacgtacattttcccgttagccgcgtattcaaagaaaataagcgatattagcgaactcgaatatggtgatgtggttgccattcctaatgaagcaagtatgaaagggcgagctttattattacttgcagaaaatcacctcatttctttaaaagagggagttggttttttaccttccgttgaagacattattgataatcctaatgccttgatatttcatgaagttgaaactcccatgttagttgaagcccttgatgatcctgaggttacgatggcggttatcaacaataatttttcctctcaaattggcttacttgctacccgcgacggtttaattatggagaataaacattcgccttatgccaatgttgttgttactcgtatagataatatgaatgatgaaaaaataaagaaattaattactgttttacattcaagacaagtcgaattaaaggtgcaagaaatgtataaaggggacgcggttaaggcgtggtag

SEQ ID NO: 603 - DNA, 594 bp, Proteus mirabilis
ggtgtttctatgaaatcaataaatataacatttttaattcctctactattactatacttcccttttattgctttatctgataatagaagaggtagtttaccagcgccaataagttgtagctttgacatacctaatagcactaaagttagaagtatacgtcctgattctttccctagcaattatgcaggaaccttagctaatgacagatattctaaaagaattgctatagtttttagtctttgttcagaaaagaatactaaaataactttacgtattgataatacaaatattgattttaataatggttaccttatcaacgatgtaacaggctctgaagcaagtgataatgtgacattccaattaattgatgatgaaaataatcctattgatttaaatcagaaaaatacattcactaaaactattgatgaaagtggtactgcttattttaatttctttataaattatgtcaaaaaagataatcttcgcgcaaagccagggtatatatcttctcgtattacgttcattgtggaagcaaaagatcagattgttgaaaatgataatgaatttgcgggtgtagaaaacagagtactgtag

SEQ ID NO: 604 - DNA, 933 bp, Proteus mirabilis
ggttgttctatgcgtatttgttctttgttgctatgtaccactttcttagtatcatcaataacatcaagctacgcagaaataagcacacataaactgattcgccaagataatagcgaactaatttattatctagataaacaagctgaacataacaaaacactgttagttttaatgcaaggttctgactgtaatagcataaaaaataatacttttattcaagaaacctttggtagatggctaccgagtagtgatgttttaatggttgaaaagtatggtattacagcacaattaacttattccgatgataatggtgaaagagaagattgccctaaaaactataaacttcatgataatcctaaccaaagacttactgattatttagcagtgctagataaattatcccctaattacaccaatattgtattacttggaggaagtgaaggcgcaacaatggttcatttagttgttgctgaacgtcatgatattagcgctgcaatcgcattaaatggcggtggtcgttttttccttgatgatgtactgtacaatatacgcaatacaacacctaaagagcatgtggaagaagcaataaatagctttcaacaactcgctaatgcaataataacgaatcaaattggtgatgagcaatttgttagtgaacatagcaaattatggtggcaacaatatcttgctattgatctacttgaggtgattaagcgcaacacgcaaactccggtattaattgttcaaacattagatgatatcaatgtagatgtggctgcattccatcaattatctcaagagataacgcaacctaatgtgacatttattaaatatgataaattaaatcatggtttttataatcaacaaggtgagcgattaaccggaaaagtcgttcaagatatacagcaatggtatgcgcaatataataaataa

SEQ ID NO: 605 - DNA, 408 bp, Proteus mirabilis
gaaaatactatgagttcacatcttgtgatgcaaaatattgaagctctttcatcgccaggggggcactactctcatgttgttacagccaataatatgtcctttatttcaggcctattacctttagataaaaacggcgtgccattaacggataaacctattgaatttcaaattaatcaagtgcttgaaaatttaaacgcttgccttataggaataaaagcacaaaaaaccgatattgcccaagttaagatgtatattacagacattaacgaatggcctgttgtcaatgagttatatgcaaaatggattggtgagcataaaccggccagattagtcgcgggtgtaaaagagcttcattttggcagtaaaattgaaattgaagccatggtgatcaaggagcaaactttatga

SEQ ID NO: 606 - DNA, 1974 bp, Proteus mirabilis
atgataactattgaaaatgcagttgaactttttaaaccttgggccttcaagatttttgaagagaaggtgcttccttttgttttttgtaaaggtgcagatgtttataatagaaaaaaaaatttatataaacttaaaggtcagatgtcagactatttagctaaaactagagcccagtgttcagtaattaattctttagcgtttcctaatgtattaaaaaaagtgaacgatatttatattcctttgacattatcaatgttggattcaagagaagaaagagaacacactattaagagaggtgatttgttcctaagtgaatttaataacatattgataattgataatgcagggatgggaaaatcaaccctgatgaaaaaaatagttattgatactattgatcattcagaatacattccaatttatatagagttaagaactctcaccaataatcctattgaagagcaaattaataaattattaggttttgatgatgttaatgatagtgatagcattttaaaaaaaataccttttatatatttctttgatggtgtggatgaaataccatttgatttaaagaatgatttaataaagaaaataaaggtgtttagtgatgagatgagtaattctaaaattatcattacttctaggccagatcaatcattacttgaacttcattcttttaatagatttaaaattaagccattagagatagagcaatcatatgatcttattaagttatatgacataaacctagtcaaaagaggaaatagactaattctttcaaacaagttaattacagaaattaagttaatgagagaaaaggaaaataatactattttagagtttttaacaacacctttatatgtatcccttttattttgttcttataggtataaaccagttataccaaggcgaaaagatttattttatagtcaagtttttgaagctctttttgaaacccatgaccttagtaaagaaactggttatgttcgagaaaaatcttctggtttggatataactgactttagcatcatacttcgtaggcttgcattttggtgtttaaaaaataatggcaaactagaatttagtagggcagaacttgaaagtattttaactaatataacagaaaaactaaaaggagttaatgttaaacctatttcttttattaacgatttgacatattcagtacctttatttattaaggaaggcgctctttatcgatggtctcataaatcacttatggagtattttagtgcagaatttatttgtattgaagttaaggataaaagagatgaccttttattaaagttatatgagagtggtagtgctgttaaatataaaaatataattgagctctgttctgatattgactatgcttcttttagaaaatcaattcttcgtaaatgtctcactgaatattttgagcatttagaaaaactagaagatcttgactttttagatgattgcaacaaagaaatatgggcaagcattagttttttttctgatttaaaattacttttaacaccatatagtaatgctaatttgggtgatctaaatattcttgataatgtatatgtttttgaagaaagtgatttttcacatagttcttttgaaaataattttatagggtttcgtgagtatattactcatataacttatccagtttcgttaaaaaatactgtttttgatatacttaggctaaagaataatgagtatttctttaaagaaaaagactattataatcggttatctttagattctttaaaaatcccagaaaacgtaatgatatcaactaattcaggctatgttaagggatacagtaatgacataattcctgacattataagtatattattgcaatttagacataccttaacaattcccgtgatatacaagtctttagccatgaaagcattagatgatatcgtttcagatacatctaatggtgtgaatgatttattggaaggctttgattga

SEQ ID NO: 607 - DNA, 339 bp, Proteus mirabilis
atgacgactatcgaaaaaattgaacgccaaatcaaagaaaatcccatcctgttatacatgaaaggatcaccaaaattaccaagctgtggattttctgcacaagccgttcaagcgatttctgcttgtggtgagcgttttgcttatgtcgatattttgcaaaaccctgatattcgtgcagagctaccaaaatatgctcattggccaactttcccacaattatgggtggatggcgaattagtcggtggttgtgacattatcttagaaatgtatcagcgcggtgaattgcagaagttattaaaagagactgcagataaataccgtggtgaagaagaagcataa

SEQ ID NO: 608 - DNA, 447 bp, Proteus mirabilis
ggagttgctatgtataagacaattctagtgcccgtggatatttcagaagatgaattaaccgaaaaggctttacaacacgctgtttatattgcaaagcttgaaggggctaagatccatttgtttcatgctattcctgatgtttcacgtttttcaattagttatagctaccattatgatatgttaagctcttttgctaataaagcgattgaacgagttcaagaacaactgcaagaattagctaattctgtagatttacctaaagagcaagttgatttctctgccgcatttggctcagcaagagataaagtgttagagctggcagaaaaaattaaagcggatttaattgtcgttggctctcgtcgtcctagcatttcaactcatttattaggctctaatgcatcaggaattgtggcttacgccaaacaatctgtgttagttgtgcgttaa

SEQ ID NO: 609 - DNA, 687 bp, Proteus mirabilis
atgaatgctatctatttaaagaccaagtggtttttctacttcttaggcctattaatggtttcatctatctttatggtaaaagcaatggcaaattctgataaagcagatctagtaacactggcacaagagggaaacttgccagaattaaagcgccagatagcgcaaggagagaatattgaacaacgagatatcaaattgcgtacaccgctaatggcggctactcatgcgaatcaaattgaggtggcaaaatacctgattgaacaaggggctaacgtcaatgcccgcgatgctatctatgattcaccttatctttatgctggagcgagaggattgcaggaaattttagctttaaccttagctcatggcgcagatctgaatagcatcaaccgttatggtggtacggcattgattcctgcggcggagcgcggccatgttgccacagtaaaaaccttgattgatgccggtgtggatgtcaatcatgttaatcgccttggttggactgcgttaattgaagccattattttaggtgatggaagtcaaaaatatgcagatatcgtgacgttgctgatcgatggtggggcggatgttaatttggctgatggatctggacgtacaccattaaccttagcgaaagataaaggctataccaatatcatcaatattcttcaacaagcaggggcaaaataa

SEQ ID NO: 610 - DNA, 465 bp, Proteus mirabilis
tgtttttatattagtttatatctaaagtacgaggaaagaaaaatgaagattgaaacaataaaaaaactttcaaaacaaagacgcaagttttatattggttcttctttgaatattactcatattaaccgtcaattggcctttttaacgcctattttggatgatgcaattgataaaataaaatatgcacaacaaaagcaagttatattatcaccaattaaagaaacggcacagatctttgagtatgtaaaaaacaataataaaaagaaagcagcgatatatgcactagattatctcattttttgtttttctcatggttgttgtacaatcaaaaaatttataagaagagaacttatgtttttattggaaaggatcaagcattttatcgcttatgagttaaaagagatcattcaaccttcaacatttttctgttttaattttttaaaagcgttaaaaaagcatttataa

SEQ ID NO: 611 - DNA, 1083 bp, Proteus mirabilis
ataatttatatgaaaaatcaaaaaacgaatcgtttttttgtttacggcattattattgttgcaattattgcagcaggtattttttggtggaaaacacaagcaccagcactccctgatgggtttgctcaaagtaatgggagaattgaagctactgaaattgatatttcaaccaaaacaccaggaagaattgacactattttggtcaaagagggggattttgttaaagcgggtgaagtgttggcaacaatggatactcgtaccttaaaagagcaacttcatgaagttcaagcccaactagagcaagccaaaagtagcgttatgacggcagagtcggcactttctcaacgtcaaagtgagcaagttgcagcgcaggcggttgttcgtcagcgtattgcagagcttgacgcatcagtaaaacgccttaatcgctctcgggcattagttaaaacaaaagcaatttccattcaacaactggatgatgatatagcaagaaccgaaggggctcgtgctgctgttgaagctgcaaaagcacaagtgactgcaaccattgcggcaattgattcggcaaagtctggaattattcaagcaaaaaccaaagttgatgcagcaacagctaccgaacgacgtattatggctgagttggatgatagtatcttaaaagctcctcgtaatggccgtgtacaatatcgtgttgcggaacccggtgaagtgctaggcgctggcggtcgagtgttaaatatggtcgaccttagtgatgtgtatatgacattctttttgccaactgaagccgctggtaaagcagccttaggcagtgatgtccatattattttggacgcagccccacatattgtgatccctgcgaaaacgacttatgttgccagtgttgcacagtttacccctaaaacggttgaaactgacaatgaacgtttgaaactgatgtttcgtgtaagagcgaggatctcccctgaattactagagaaacaccttgaatatgtcaaaacaggtttaccgggacgtgcctatattcgcttagataacagccaaccttggccgactgatttagaggtgaaattaccacaatga

SEQ ID NO: 612 - DNA, 201 bp, Proteus mirabilis
tcaatctatatcgttttttacattcagaattatttctatgcgtaccattattccccttaccaattacagcaatgtgtgttaaaattgacacatatcaatatttttatttgtaatgagcaagcttatgatcccagaaaaacgcgtcgttcgccgaatccaatctggcggttgtgcaatccattgtcaagattgcagtattag

SEQ ID NO: 613 - DNA, 1317 bp, Proteus mirabilis
gacttgattttaattcaggggtggaatcttcagcaggtatcaaagatccacaacgtctatcgcaagtctttacacaattacaacaaagcaaattttcacaaaatttctgacaaggacaacatcacaatgagaaaacttaatccctactttggtgagtttggtggtcaatatgtaccagaaatattgatccctgcattagatcaacttgaacaagcctttattgacgcacaaaacgatccgtcatttcagcaagagtttcaagatctactcaaaaattatgcaggtagaccaacggcactgacactctgtcgcaatttgacccaaggtactcgtacccgtttatatctaaaacgtgaagatttattgcatggcggtgctcataaaacaaaccaagtattaggccaagcactgctagcaaaacggatgggaaaaacagagattattgcagaaacgggcgctgggcaacatggtgttgccactgcgttagcttgtgctctgttaaatatgaagtgccgtatttatatgggggcaaaagatgttgaacgtcaatcacccaatgtatttcgtatgcgtttaatgggtgccgaagttattccggtgcatagtggttcatcaacattaaaagatgcgtgtaatgaagcgttacgtgactggtctggttgctacgagcgtgctcactacttattaggcactgcggcaggcccgcatccttatcccactattgttcgcgaattccagcgcatgattggggatgaagctaaggcgcaaattttagcccgtgaaggtcgtctccctgatgccgttatcgcctgtattggcggtggctctaacgccattggcttattcgcctcatttataccagaaacctcagtacaattaattggtgttgagccggcaggaaaagggatcgaaacaggagagcacggagcaccattaaaacatggcaagttaggcatttatttcggtatgaaatcaccgattatgcaaaccgaagaaggccaaattgaagagtcctattctatttctgcaggattagatttcccatccgtaggcccgcaacatgcgcatttaaacagcattggccgtgccgattatgtttctgtaacagatgatgaagccattgaggcttttaaaacgctatcacgccgtgaagggatcatccccgcattagaatcgtcacatgcactggcctatgcgttgaaactgattgcccaaaatccagataaagaacaactcttaattgtcaatttatccggacgaggtgacaaagatatttttactgttaacgatattttagctgcacgaggagaaatttaa

SEQ ID NO: 614 - DNA, 1194 bp, Proteus mirabilis
aatgataatatgttctcaaaaaaatctcgttctacaactgcactactcttttcatcacttattctgactataggaagaggtgcaacactgccttttatggcgatatacttatcacgacaatataaattgcctgttgatgatattggtatcgcaatgtctatttcactgactacggggatagtatttagccttgcctttggtatgctggcagataaatttgaaaaaaaacgttatatggttttttctattattacctttattatcgcattttctgctatcccaatggtcaatagtactattttagtggttatctttttctcaattattaactgttcctatttagtcttttctacggtattgaaagcttatttttctgaaactttatcaatatcagcaaagcctaaaatattttcactaaactatacttttattaatatcggatggacggttggcccacctattggcacattattattaatgtatggtacccaattacctttttggttagcggcaatatccgccagtattcctttatttatgatccaatgttttgtgcaacgttcagtggtagaccattccacagaagaaaatagtgtaaagtgggatccgaaaataatgctaaaagataaagcattaggctggtttgtgctttcaactttttttggcacattaacttttggtacatttgcttcgtgtatttcgcaataccttttagttgtttatgatgctaaattggctgaatctgctattgcggtgatcctccccgtcaatgcggccattgtcgtctcattacaatatatcgtcggtaaacaagtggttgctgaaagactacgtaaattaatgaccttaggcacactcttttttatcttaggattagcgggctttatgctggcgggtgataatttaattttctgggcaatggcgatagcaatatttacctttggtgaactgatttatgcacctggtgagtatatgatgatcgataatattgcgccgttaggaatgaaagcaagttatttctctgcacaatctttaggttggttaggtgctgcattaaatccacttgctagtggttatatcctgacaaccttgccccctatttcgttattcgctattttaatggggatcgcagtactagcttggctttgtatgctgcaaggtatgaactacagtgaaaaaagaatagctgcttaa

SEQ ID NO: 615 - DNA, 1575 bp, Proteus mirabilis
gaggaaaatatgatgagtgtaaaaattaatcacaatgatatttctagtttacagatattaagaatatcacaaggagaaaaaacaaaagatgtgatgtcattatgggataaaataaaagactggttccaatcaaacaaaagagaaaaagcactaaaaacagttgaaaatattgtatatcaagatctatttgatgacaaaaatcattttaaaatgctatatcatgttttaatgctaaaaactatggcttcagatgcatataaagaaagaataaaaattgatattaatgataatgataaaaatattacgatttcaatagataattataatatttctataacggatatagacaatgaacaacttaataaaatgtcaacaataattaatgcatttaatcggcattcatcaattttttctaatgaaattgcattgaaatgtctatatgaaaagttagataaaaatgagcttaatgatcaaatttttgctgagttgtatattgaattagataataaaatacgttctggtgaaatagacttaaagcttaataaaagtaactttaatcaagttaactttagtgcaataagacagctcgtaagcaaagcgatagaaaatgataatactaacttagatacagaaaatgataatattaacttagaaaatgataatattaacttagaaaatgataatattaacttagaaaatgataatattaacttagaaaatgataatattaacttagaaaatgataatattaacttagaaaatgataatattaacttagaaaatgataatattaacttagaaaatgataatgttaacttagaaaatgataatgttaacttagaaaatgataatgttaacttagaaaatgataatgttaacttagaaaatgataatgttaacttagaaaatgataatattaacttagaaaatgataatgctaacttaaatataaaaaaggcactaataaaagatataaatagaaatacttatattttcaatggtaaagaaataaaaagtaaagatcaagacaaggcaatgaaagaatttgaaactttaactaaagatatctcagaggaaaataaaaaggcaatttattatttactaaatcaagaagggatcaccttaattaaatcatataatgattcttttgattactacacattaacaacatctttttctatgagtaatattgttaagcaagaacaaatttatagtataaagactctttctgatgatttaattgaattaaaaataaaattttttaaaaaaagtagcgataaaataaatctagatattcccttagctcaaccatttgaaagtaagttatataattttatctatgatatggttgctattaataataatatcgaaataacttatgataaaattttaaatgaaaagatgaaagagataataaaacaactagataataaaaaaccaaggataggagagctattctcccatctattgagtcgaaataaaatcattaaagaagacagcgttgatattacgttaaaactaaataaaggacaactagtctcattaggtggagaatgctcatataatttttattaa

SEQ ID NO: 616 - DNA, 612 bp, Proteus mirabilis
ctaatgaatatagcaagtcttcttgaacaaattgcagataaaggttggtgtgtatgggatgattttcttacaccagaggcggttaaacaattgcgtgcttgttttggtaatgatgcacaacaagcacgtataggacgtcatgaaaacctattagcagaaaccacgatacgcagtgataaaattcgttggctagagccgcaaatgggagagccagttcaacattatcttatgcagatggaaaagcattcacgagcagttaatcgtgagttctttttagggctgtttgaatatgaagctcatttcgcttgttatgaaaaaggtgctttctataaaaaacatcttgatgcatttaaagaaaatgtcacaagacgtttaacgacagtgttatatcttaatgatgaatggacaccacaagacggtggagagctagttatctatgatctggatgataatcaattagcgacagtcgcccctcaaggtggtcgtttagtggtttttctttcagaacaatttccacatgaagtattacctactcataaagaaaggatcagtattgcagggtggtttcgagttaatggtgtcagagataattttctcgatatcgccagctaa

SEQ ID NO: 617 - DNA, 954 bp, Proteus mirabilis
tgttacgatattgtaaattatgactatttttctggggcacacactatgcaaaatgtgttgttaacgttatggcctttatttgcgttaattgcgctaggcgctattttaagaagaaataaagcatttgaacctgcattttgggtagggactgaaaaattaaattattttttactctttcctgcattacttctcaatagcttggctaatgctcctttatctgatcctcaattacctcaccttgctggggctattttctcagtagtcattattaccactattttgtgtgttatttttaaaaaaataaccggctggtctgctggccgctttggtgcgatcgttcaaggcaatattcggtttaacacttatttaggtttagctattgtcgctgatttatttggcgttgaaggtttaggaatagctgctttgatattagcaaccttggttcctctatcaaatgtgacttcagtgctttgtttaaccgcaggacaaaatgtaacttttcgtcaattaatcttcccaattattaaaaatccattaattatctcttgcgtaatagggattgttatcaatttatcaggaatagggcttccttttggtagcgatcaatttctaaaattgttagctgcgactagtttacctttagggcttatctgtattggtgcggcattacatttatcaacactaaaagcagaaagtaaaatgattagtattaacacagtgactcggttgcttattgtaccgataattgcatatagtgttgctaattttttaggtttgtctccattagttatgatgcttttagtcattttcttttctatccctacagccccaacttcttatattttaactcgacagctaggaggggattctgagctaatggcggggatcattactgcacaaaccatgcttgcagcaattaccttgccgatcgtattaagttttttaattccataa

SEQ ID NO: 618 - DNA, 990 bp, Proteus mirabilis
caaggagatattgtgagcaacgaacaatccatccagcgattaagaagactacgccagtcagagaacctgcgcgcgctgtttcaagaaacgacactcagcaaaaatgatctagcactacctattttcgttgaagaaggcttagaggattatcagccgatcaaaagtatgccaggtgtggtacgtattcctgaaaaacgccttgcttatgaaattgagcgtatcgctaaagcgggtatcaaaacggtcatgacctttggtgtctcacaccatcttgatgaaacaggtagcgatgcttggaaaagcgacggtctagtttctcgcatgtctcgtatttgtaaagatgctgtaccagaaatgattgttatgtcagatacttgtttctgtgaatatacttcacacggacactgtggcgttttacatggtgaacatgtcgataatgatgaaactatccataatttaggtctacaggcggttgccgccgcacaagctggtgctgattttattgctccctctgccgcaatggatggtcaagttgccgctattcgtgctgccttagataaagcaggatttaccgataccggtattgtttcctactcaactaaatttgcttctgcattatatggtccattccgtgatgctgctggctctcgcttaattggtgatcgtaaaacatatcaaatgaatccgatgaatcgtcgggaagctatccgtgaatcattgattgatgagcaagaaggtgcggatatgttaatggttaagcctgctggtgcttatttagatattattcgtgatgttcgtgaacgtacactattaccgttagcagcctaccaaattagtggggagtatgcgcaaatcaaatttgctgcattagcgggtgctattgatgaagatcgcgtggtaatggaaacactaggctccattaaacgcgcaggtgctgatttaattctctcttactttgcgcttgatttagcagaaagaaatctactttaa

SEQ ID NO: 619 - DNA, 303 bp, Proteus mirabilis
ataaaaagtataaatttatactttgcatcaactgcacgattagtcaaaacattcatgcaaaattatattaacataattttgcaatgtttattccttttgagtctccttctgttgcataacagagggattttttttctctatctctcttcccctaaaaaaaagtacgcaataatcattacgtactctttgctaatattttggctttcttatcttattgcctgtaacacttatttaatgctttataacatacagcatatggctataagcgacatcttcaggattctcaatgggataaccttttag

SEQ ID NO: 620 - DNA, 378 bp, Proteus mirabilis
attattttcattgggttgcgcattaatagagtcaatgggatggaaaaatttacacaagaacttttaaggctcgacaattttattctacgtattctacgctactatataataggtactgtattcttttttttaggattattaccgggcgtgctagggttctattttattgaaggacatacttttatggagtcctcattaaacgcaatatcaatgttaagtggtcaaccggtagagcctgcgcctgcaacaccaacagggcgtttttttattgcgatttatggtttgtttcttcagtgtgtttttattttatcgattggattagtggtgaccccttttattcatcgacaattacataaatggcatcttgaagaggattag

SEQ ID NO: 621 - DNA, 936 bp, Proteus mirabilis
ggttgtttcatgagcgataaatcgcaacgtactgaaaaattacaaaaaattcttgctcgttctggtcatggttctcgacgtgagattgaaggctatcttcaagaaggccgtatcagtattgatggcgtgaaggcaaaattaggcgatcgtattgatgccaattctacagccaaaatccgtttagatggtcgtatattaagtattcgcgaagcacaaaaagatgtttgtcgagtgttagcttattacaagccagaaggtgagctatgtacacgtagtgatccacagggcagaccgaccgtattccaacgtcttccgcgtttaaatagtgcgcgttggatagccgttggtcgtcttgatgttaacaccagtggtttattactctttaccactgatggtgagttagcaaatcgcttaatgcacccaagtcgtgaagttgagcgtgaatatgcggtacgtgtttttggtgaaattgatgatgcaaaaattcgtcaattgactcgtggggtacaattagaagatgggccggcatcattccgttcggtttcttatcgcggtggtgaaggcattaaccaatggtacaatgtatcgctaacggaaggacgcaatcgagaagtccgtcgtatgtgggaagcggtaggtgtgcaggttagtcgccttattcgtgttcgttatggtgatattgatttgcctaaaggacttccacgtggcggatgggttgagctaggcttaaatcaaattaactatttacgccagctggtggaactaaacgatgagacagtaaccaaagtggctgtcgaaaaagatcagcgtcgaattaaagcaaatcaaattcgtcgggcggtgaaacgtcataccaaaatttctgcgcgtacttcaacttcaccggctaagcgtgcttcaagtcgccgccaatcagcgggaagtaaaagcaaataa

SEQ ID NO: 622 - DNA, 567 bp, Proteus mirabilis
gctaatatcatgaatgagttattacatactagaaaaataatgcgctttctattatggggaatgctactttttagcggatatacagtattttttactaaagatgcaacagcagaattagctaatacaaatattgttataaaagcgaacattgtggcaaatacttgtagagtcagccctgattcgctaaataaatttgttgacttaggggtttggggaacaaaagattttcagcaaaaaaatacaacagagccagtaaagtttacacttaacttaactgattgcagtattgttactagcggtgtaaaagtaatgtttagtggtgatactgacagtaaggatagtaccttgtttaagttggcagaaaaaaatgcggctcaaaatataggtattgctattttagataaaaatcagaataaaatattaccgggaaaaagtagtatgatttaccctgtagagacaactaataatatttctctcgatttttatgcgcaatatatcgcaactaataaggacgtagttgggggaagtgcaaatggtgaagtattattttctttagaatatctgtaa

SEQ ID NO: 623 - DNA, 1035 bp, Proteus mirabilis
ggtgacatcatgataaaaaataatgacttacctgcttttatgacgcaagtggttattactgaacccggtggcgttgataaactgcaattagaaaatagcccattaccgtcattgccccctcattatatgttggtaaaagttaatgcagcgggtgttaatcgccctgatatttttcaacgtcaaggtagttatccaccgccagccgatgcatctcctatattaggattagagattgctggggaagtggtgaaattaggtgaacattgtacaaaatgggcaataggtgatcgtgtttgtgctttagttgctggtggcggttatgctgaatattgtttagtccatgaagatatcgctttaccgtcgcaaggattaagcgatattgaagcggcagcattacctgaaaatttatttactgtttgggcaaatctatttcaactcggtcagttaaaagcaggggaatcggttttgatccatgggggcacttctgggattggctctatggcgattatgttagcacacaatcttggttgtgaaatttacacaacggtaggttcaaaagaaaaagccgaagttgcccaaaaattaggggctaatcatgttattaattaccgtgagaaagattttgctacagaaattcctgtattaactcaaggtaaaggcgttgatgtcatacttgatattatcggcggcgattatgtggaaaaaaattatcaagttgcggcgaaatttggcagagtgatccaagttggcatgatgaaaggggcccctaaaaacttaaatatgatgccactgatgcttaagcgattaattcatacaggttctaccatgcgttctagaacgccagaagaaaaaacgcatatagcacaagaattaaaacaacaagtatggccgttgattatcaaaggtcaaattaagcctattattaatgcggtcttttctttacaagaagttgccaaagcacatcaattaatggagtctggtgacttaattggtaaagtagtgcttgagattgatatgaataaatcactggtgtag

SEQ ID NO: 624 - DNA, 441 bp, Proteus mirabilis
tatttccccatgactgaacaacaatctttgcctaatggtgagctagtattacgtacgcttgccatgccagctgatactaacgccaatggtgatattttcggtggctggataatgtctcaaatggacattggtggtgccattttagcgaaagaaattgccttaggtcgcgttgttactgtaagtgtaacaggcattacctttctaaaacctgttgccgttggcgacgtcgtttgctgttatgctcgttgtttaaaaaccggtaactcttcaattactgttaatattgaagtgtgggttaaaaaagtagcgactgagccggtaggtcaacggtatcgtgccactgaagccgtgtttacttatgtagcagtcgatgagaataatagcgctcgtcgcctacctgaaggtaaaaccaattttaccttagcaagtaccatggaataa

SEQ ID NO: 625 - DNA, 294 bp, Proteus mirabilis
ttaatccccatactttgttcattagaggctaaggcaatctgttgcataaaatcattaacttggctaatggtggtcacaatttccgacatggagcgtcctgcttcgctcacttgttgtgatccaacctgtactttatttaccgaatgggtaataagttcatttatctctttggctgcctctgcactacgactggctaagttacgcacttcggctgcaacaacggtaaatccgcgaccttgttcacccgctctagccgcttcaaccgcggcattcaatgagagaatattggtttga

SEQ ID NO: 626 - DNA, 1608 bp, Proteus mirabilis
gtattcgtcttgttaataagtaataatatcactatgcagtttggttcgaagccactgtttgaaaacatttctgttaagtttggtggcggtaatcgctatggtttaatcggtgctaacggcagcggtaaatccacctttatgaaaattctcggtggtgatctcgcgcctactagcggtaacgtattccttgatcctaatgagcgtttgggtaagctaaaacaagatcagtttgcttatgaagagtttaccgtgcttgatacggtaattatggggcacgctgagttatgggaaattaaacaagagcgtgaacgtatttatagcttaccggaaatgagcgaagaagagggtttacgtgttgccgatcttgaagtgaaattcggtgaaatggacggttacaccgttgaatcacgtgccggtgaattattattaaacgttggtattccacttgagcaacataatggcccaatgagtgaagtggcgccaggatggaaactacgtgtgctccttgcacaagccctattcgctgatcctgacatcttattacttgatgaaccgacgaataacttagatattgatacgatccgctggctagaacaaacattaaatgaacgtaatagcactatgatcatcatttcccatgaccgccattttttaaatatggtgtgtactcatatggccgatcttgactatggtggactaacagttcacccaggtaattatgatgagtatatgttagcggcaacacaagcgcgtgaacgtttactcgctgataatgcaaagaaaaaagcacaaattagtgaattacaatcctttgttagccgctttagtgctaatgcatcaaaatctcgtcaagctacttcgcgtgcaaaacaaattgaaaaaattcaattaaccgaagtcaaagcttctagccgacaaaatccctttattcgttttgagcaagagaagaaattattccgtaatgccttagaagtagagaatattgctaaaggttatgaagcaaatgcgcctttatttaaagacgtaaatatgatgctggaagtgggcgaaaaagtggcgattttaggcaccaatggtgtgggtaaatcaaccatgatcaaaacattagtgggtgaattaacgcctgataatggacgcgttaaatggtctgaaaatgccactataggttattatgcacaagatcatgccactgattttgaagttgatatgaccgttttcgattggatgagtttatggatgaagccagaagatgatgaacagtcggtgcgtagtgtattgggtcgccttcttttctcacaagatgatattaaaaaatcagtcaaagtattatctggtggtgaaaaaggcagaatgctgtttggtaaattaatgatgcaaaaaccaaacgttctgattatggatgaacctaccaaccacttagatatggaatctattgagtcactgaatatggcgttagaactctatcaagggacgttaatttttgtttctcacgatcgtgaatttgtcagctcattggctaaccgaattattgaaattacgcctgaaaaagtgactaatttccaaggcacttatgatgagttcttggctaagaaagggattgatggttag

SEQ ID NO: 627 - DNA, 240 bp, Proteus mirabilis
aaattagccatcatggcgatatcagctgcggtatcaagatcggcatcatcaaaaataattaacggtgacttaccacctagctccatagtgacatcttttaagcttgatgaagaagcgctcgccatcacttttttcccagtatcgatcccccccgtaaatgagaccttagcgatatcagggtgctgcgttagccattgccctacagtggcatcacccgtgaccacattaaataccccttga

SEQ ID NO: 628 - DNA, 369 bp, Proteus mirabilis
aggatagccattatgataaatacgttaactaagaaacaagcaacaaggactctgctattttcactatttcttggtttatccgtgtcttctttttcttctgttgcagcttcaacaaatgtaaccattaatggcaatggctatgataatgttttagataaagagcaagctcgacaaatgaaagaagattgggatcaaaaacgcgatctccgtaataaaatcaaccaacgcgaaaaaactgagtttaataaaatagataaagctattgatgagcgtgatgcttgtttaaaaagcgccaatatctatgcttactgggagccagaaacacgtcgctgtttagacagtaatactggtcgcccaattaacccttaa

SEQ ID NO: 629 - DNA, 846 bp, Proteus mirabilis
gagaaagccatgaataaagcccctttaatcgaagtcgataatctgtgtattgattttccacgtgctagagtggtgaataatgtctcctttcagttaggacaagagcggttagcgctggtgggtgaatctggttcaggaaaatcgatgacggcacgctcattaatgggcttagtgcgtaagccgggcaaagtttctgctgataaattgcattttatgggggacgatctcctcgcttattctcctaagcaatggaaccagttacgaggaaaaacaatatcaatggtattacaagatcctcgttatgcattaaacccagtgaaaaccatttatcagcaagtagaagaaacggtaaaactccatcaaaaattatcccataaagagcgacatgcattaattactgaaactttgctttccgtgggattaccggaacagagtatttctcgctaccccggtgaattatcgggcggtatgggacaacgcgcgatgatcgctatagcgctaattaataacccaacggtactgattgcggatgagccaacttccgcactagatgcacagctacgacatcaaatattagaacttatcattacccaatgcgcacaacgagatatggctttgttgttaattagccatgatctacctttagtggctgaatattgtgatcgtgttatggtcatgtatcaaggggagcaagtggatgaacttgaggcaaaagcattacctcaagccacacatccatacacccgcaccttatggacctgtcgccctaatgcgagtacctatggcacacaattaccggtattagatagaacactgaattttaaaggtacaccttatgctaattga

SEQ ID NO: 630 - DNA, 645 bp, Proteus mirabilis
ataatatacatttcagcggataataaaaatattatggaacaacaagttattacagatatttctctctctgcccgtattattggggctgctttctattacccaccaactgaaaaaagtgacattgttgagttactctcaagcggcaaatggttaactgaatggccttatggctctgaagaagaaaaacaacgcattgcctcattattggcgcaaactacctatcaagatgaaacattagcacaagcctatcaacgtttatttattgggccttatgcgctacctgcaccaccttggggatcggtgtatcttgatcatgagaatgtcttatttggtgattcaaccttagatttacgtgaatggatgctggagaatggtattgatattgccttgactcaaaatgaacctgaagatcactttggtttaatggtgatgatggtggcatgggttgcagaaacacgccctgaaaaattaactgaactacttgctgaacatttattaccttgggcttatcgctatctagagaaattgtcattacaaggggcattcccttattatgaaggtcttgccatgttagcaacgttaacgcttaaaagctggcaatccctactctcgattactcctgttgaaaaacagctattttgctaa

SEQ ID NO: 631 - DNA, 642 bp, Proteus mirabilis
acctattgcattatcaaattatttattaaaggaaaaacgatgaaaataaaaaatcatatcagattactatctgcattattagttatctcttctagcatgaatgtattagcagataatagcaaaacaacagaaaagaaaaataacaatattattaattttagtggaacagtaatatcaacatcctgcaatatagatagccctagttctcctatcactttgcctacaattaataaatcggaaatagtcttagataaagattgggccaatgccaaaagcagtacaggtagtaattttgaaattaaactattagattgtggcaataataatgcaacattaacatttaacggcactgatttagccggtgaaaataaaattatgaagaataaaagcatcacaaataatagtgctaaaggagtaggaattttcattcgtagtgatgaaggtaataaaaatattattcatttaaatggtaaccaagcaataactaagagaattgaaaataaaacagcaacttataaaattcatgccaattacgcgagttatcttccaaaatccacatcaggaactgtcaatacatcagtaaatttaccgttaaatattcttaatttaaaaaacacaggattattttattatgaaggataa

SEQ ID NO: 632 - DNA, 462 bp, Proteus mirabilis
ttacgatgcattgctcgttcacaggtatctaaatcagaaagcgctaattcggtattaatagtttcaatatcttctgcaggatcgactttacccgccacatgcacaatattgtcattttcaaaacaacgcacgacatggccgatagcttcagtttcgcggatattggtaaggaattggttacctaagccttcacctttagatgcgcctttaaccaaacctgcaatatcaacaaactccattgttgtaggtaacactcgttgtggttttacaatttctgctaacttatctaagcgaggatcaggcatgggtacaacacctgtatttggctcaatagtacagaatgggaagttggctgcctcaatacctgccttagttaaggcattaaacagtgtagatttccctacgttaggcagaccgacgataccacatttaaatcccataaacgttcaccttgtcacataa

SEQ ID NO: 633 - DNA, 924 bp, Proteus mirabilis
aaaatgagcatcccaaaagagcaatataattttaacaaattacaaaaacgcttacgccgtaacgttgggcaagctatcgctgattttaatatgattgaagatggcgataaaatcatggtgtgcctttctggcgggaaagatagctatactctcctatctatcttaatgaatttgcaaaaaagcgcgccaatacaattttccttaattgccgttaatttagatcaaaaacaaccgggcttccctgagcatattttacctgaatatcttgagcaactgggtgtagagtataaaattgttgaagagaatacttacggtattgtaaaagagatcattccagaaggtaaaaccacctgttcactttgctctcgcttacgtcgtggtattttataccgtacagccaccgaagttggggcaacaaaaattgctttaggtcaccatcgtgatgatattttagaaacgctgtttctgaacatgttttatggtggaaagctaaagggcatgccacctaaattaatgagtgatgacggaaaacatatcgttattcgtccattggcttatgcccgagaaaaagacattgagcgttttgctcaagcaaaaaatttccctattattccctgtaatctttgtggctctcaacctaacttacagcgccaagtgatcaaagagatgctaagagattgggataaacgttaccctgggcgcattgaaaccatgtttagggcaacccaaaatattgttccgtcgcatctatgtgatacccaattatttgactttgctaatatcaaacagggtgatgagattattaacggcggtgatctagcatttgataaggatgatattccaacaagccctattctttccgatgatgaagatgagcgtcctgattttagccaagctagattggatgttgttgaggtaaaataa

SEQ ID NO: 634 - DNA, 651 bp, Proteus mirabilis
tttgtgagcataatgaatcaagctaaacgtatagaaattttaactaggttgcgggataacaatccgcatcctactactgagttaagatttaactccccgtttgaattattgatctccgtgttactctctgcacaagccaccgatgttagtgttaataaggcaacagcaaaactttaccctgttgccaatacacctcaagcaatgctggaattaggtgttgaggggatcaaatcctatattaagaccattggcctatttaatacaaaagctgagaatgtgattaaaacctgccaaatattggtagataaacatcatggccaagttcctgaaaatagagaagctttagaggcattacccggtgtcggtcgtaaaacagcgaatgtcgtacttaacaccgcttttggttggccgaccattgctgttgatacacatatctttcgcgtgtgtaatcgcactaaatttgcaccgggaaaaaatgttaatgaagtggaacaaaaactgctaaaagtggtaccggcagaatttaaagtcgattgccaccattggcttatcctgcatggtcgttatacctgtattgccagaaaaccacggtgtggctcttgtattattgaagatctctgtgagtataccgaaaaaacagatccacaataa

SEQ ID NO: 635 - DNA, 339 bp, Proteus mirabilis
tttataggcatgaccatgaaccaaccaaccttaatcagtgaagaagaagctttagaacaagcctatgatctctttttagcgcaagccgctgataatcttgatgtagccgatcagctgctttttaatttacaatttgaagaacgaggtgcggctgaagttgttacattagggaatgattggcaatttattgtcggtttacctgtttcatcagcccggtttagtgaagtgattatcggtcttgcaccggatgaaaacgccgatattgatgatatttttggtcgtgtattaattagtcgtgatcccctgcaacccatgtaccatattatttggaaatcttaa

SEQ ID NO: 636 - DNA, 768 bp, Proteus mirabilis
actagaggcattattttttgtttaggtgaaataagatcagttatgcgctttaagctttgggtatttatatcactgtgtttgcatgcctcgcttgttgcggctgccatactgtatgttgtagaagataagccaattgcaccagaacctatctctatacagatgctagcctttgctgcagatgagccagtaggagagcctgagcctgtagttgaagaggtgacgccaccggagcctgagcctgttgtcgagccagaacctgagccagaaccagaaccgatcccagatgtaaaaccggtgattgaaaaaccgatagagaagaagcccgaacccaaaccaaaacctaagccaaaaccggtggaaaaaccaaagccacctgtcgaacggccacagcaacagccattggcgctgaacaagggaaatgagatgaaaaatcttaatcccaacgctacaccgagtaataaaggtgaggaaaagcctgttgcgacaactagccaaggggaaggaaaagtacctaatgtgcttcgccaagggttacctatctatcctcctcgtgccaaggcagtgggtattgaggggtcaataaaagtacgctttgatatcgatgccgatggacgggtagataatgtagaaattctctctgctaacccaaaaaatgtctttgagcgcgaagtgagaaaagcaatgcgtcaatggcgttatgagaaaatcccttataaaggtaaagtggttatcattgattttaatatagatggtgtttctgcaagttaa

SEQ ID NO: 637 - DNA, 1533 bp, Proteus mirabilis
tttttattaattttattctttggtcaaaatagagcttcttgctatgatgtgaaaaacgtgagaataagtagaggttcctttatgtcaaaacatcataacccagaaattcaaaaaattattaatgagttaaaacaacaatatcaaaatgctgttgatgccttacgtaatgctattattatgtatgctcaagatggaaaattacctgatataaaacaaagggctgaaggtctatttgcttatccgcaattaaccgtacattggtatggtgatgttaaaaaagaagataaaacaagagcttatgggcgtttatcaaaatcaggtacttattctactactatcaccaatccaactttatttgaaaattatttaactgagcaactgcaacttattgcggatgcttatcatgtctcttttgaagtgacggcctcaaaacaagagataccatatccttttgtcattgatggcactggcattggttttgatcggtcaatgagcgcctctttagcaaaatattttccgactaccgatctctctaaaattggtgatgatattaccgatggtttaattgatgacagcgagcttttacctctttcacattttgatgcactacggacggatttttctttggctcgtttaaagcattataccggaactttacctgaagatgtgcaaccttatattttattcaccaattataaccgctatgtggatgagttcgttcgttgggcctgtgcacaagttgctgataaaaatagtccatattgtgtactttcttgtgcaggttttcagcaaataaccgccgatacggttgatccggaaaaattaatttctgatctgacatggaaaaaatatcaaatgcccgcctatcatttaatcgcaaaagaagggccgggaataacattagtgaatattggtgttgggccgtcaaacgccaaaacaatttgtgatcatctggcggttctacgtcctcatgtttggttaatgattggtcattgtggaggcttaagagaaagccaattattaggtgattacgttttagctcatgcttatttacgagatgatcatattttagatgctgtattaccgccagatattcctattcctaatattgctgaagttcagcgtgcactttatgatgccactaaagccattagcggtaagcctggacatgaaatcaaacaacgattaagaacaggaacggttgtgacaacagatgatcgcaattgggaattacgtttttcagcaacatcaaggcgatttagtttaagtcgagccgttgccgtggatatggaaagtgccactattgccgctcaaggttatcgttttcgcgttccttatggcactttgttatgtgtatctgataaaccgttacatggtgaaataaaattaccaggacaagctaatcacttttatgaaggtgcggtatcagagcatttgcaaataggtattcatgcaattgagttattaaaagacgaagaagataaattacattctcgtaaattaagaacctttaatgagccgccatttagataa

SEQ ID NO: 638 - DNA, 687 bp, Proteus mirabilis
ttattattaatttctgatgtgctattttcatcggataagtacagtttaatgcctgataaaataaaccctaatgaattatgtaaccgctttcgaggttactatccagtcgttattgatgttgaaacgggtggatttaatgccaaaacagatggcttacttgaaattgctgctatcactttaaaaatggatgagcaaggttggttaaaacctgataatacattgcattttcatgtcgacccctttgagggcgcaaatttagagccagcggcgttagaatttaccggaattgatcctacaaatcctcttcgtggtgctgtcagcgaatatgaagcgttacacgccatttttaaaatggtacgtaaaggaatgaaagacgccaactgtaaccgtgcgatcattgtggctcataatgctaattttgatcatagctttgttatggcggcagctgagcgagcaggtttaaagcgtaaccctttccacccttttgctacttttgatactgcggctttaagtggtttagtactaggacaaactattttagcgaaagcctgtattactgcaggtatcccctttgatagtaaactcgctcatggggctttatacgatacaaatcgtacatcattactgttttgtgaattagttaaccgctggaaaaaattaggtggttggccactaccaacgccctaa

SEQ ID NO: 639 - DNA, 858 bp, Proteus mirabilis
gcaagattaatgaattataaacaatggctgcatcaagcagccttgcaattaattgatagtgacagcccaaagcgggacgcagaaattctattagggcacgtaacaaaacgtgctcgtacttatttgattgcttttagtgaaactgtacttttagaagatgaactagtgcaattgtcatccctccttgctcgacgtataaagggcgagcctatcgcttatttagtaggagagagagaattttggtcactacctttaaaagtctctcctgcaacacttatccctcggcctgataccgaatgtctagttgaaaaagcattagagaaactctctgcacaagcaagccgaattttagatttaggtacggggacaggggctattgctttagcgatagcttcggaacgttctgactgccgtgtccttggtgttgattttcaaccagaagcggtagcattagcgatagaaaatgcacaacatttggcacttagcaacgtagaatttacggaaagttgctggtttagttcactctctggttatcaatttgatatgataatcagcaatcctccttatattgatgaagaagatgagcatctttatcaaggagacgttcgctttgagccattaaccgcattggtcgcggcagatcatggttttgctgatattgagcttattattacaaatgcccgtcagtttttagctaataacggttgggtattaatagagcatggttggcaacaaggtgaaagagtacgtaatatttttattgataagggttactgctgcgtggaaactttccgtgattacggcggtaatgagcgagtgacagtaggtcgttggaatgatgatagaaaccatagctga

SEQ ID NO: 640 - DNA, 378 bp, Proteus mirabilis
agggagttaataagccaatttcttctaatgttaaagaggcttaatatgttagctcaatttgaatggtggcatggcgcttttcttcttcttgctgttgtgcttgaaatcgtggccaatatattcttgaaaatgtctaacggttttagtcgttgggggttgggaatattgtcattgctttgtgtgttaggcgcatttagctcattggcaatggccgtaaaggggatagagctttctgttgcttacgcactatggggagcttttggtattattgccactatcgccgctgggtggatcttatttaatcaacgcctaaattataaaggatggagtggaattatattattattagtcggtatgataatgattaaattcgcttaa

SEQ ID NO: 641 - DNA, 303 bp, Proteus mirabilis
cctttgctaatttatagcaagggctattataattttttaattacatcgggtatttctttactcgcaaactttgtatcactaccagttgggataaaatattgtcctttgggtgaacggtttcattcaactatttttattctttctttacttatatccgctatgcggcacccatctggatcgaagactataatatgcccaccagttgctttgaaatatgttctaggttctcccatcaacggtaacttgccacttcagtcttccggctttgttgatacattaatatttactcattgtattcgatag

SEQ ID NO: 642 - DNA, 2610 bp, Proteus mirabilis
gtaaaggtaattatgggtaaagctcttgttatcgtggagtccccggctaaagccaaaacaatcaataaatatcttggcaatgactacgtagtaaaatctagcgtgggtcacattcgtgatttgccaaaaagtggttctggcagccagaagagcgaaaactcatccgccacgaaaggcgtgaaaaaggttaaaaaggatgagaaatcagccttagtcagccgtatgggtgtcgatccttataatggttggcatgcaaactaccaaattctgccgggtaaagagaaggtagtcgctgaactaaaagcattggctgaaaaagcagatcatatctatctcgcaacggaccttgaccgcgaaggagaagctatcgcgtggcatttacgcgaagtgatcggcggtgaagatgatagatttagtcgtgtcgtatttaatgaaattacgaaaaatgccattacacaagcattccaaacaccgggtgagctgaatattgaccgtgttaacgcgcaacaagcacgtcgttttatggatcgtgtggttggctatatggtttctccgctgttatggaaaaaagtggcgcgtggtttatctgcggggcgtgtacagtcagttgcggtacgcctactcgtcgagcgtgaacgtgaaattaaagcatttgtgccagaagagtattggcaattacacgcttcactgctgacacccgatgaacaacccttgcgtatggaagtgacgcactatcaagataacgcctttaaaccagtctcctctgaggaaactcaggtggcggttaaggcgttacagaatgccactttcatcgttaaaaaccgtgaagatagaccaacattcagtaaaccaagtgcccctttgatcacctctacattgcaacaagcggcaagtactcgcttaagctttggggtgaaaaagaccatgatgttggctcaacgtctttatgaagcaggttatatcacctatatgcgtactgactctaccaacctgagtcaggatgcaatccaaatggcacgtgattatattcacgataaatttggtgcaaaatatctgcctaaagagccgaatgtttattcaagtaaagagaactcacaagaagcgcacgaagctattcgtccttctgatatcaatgtgacggctgaatctttaaaagatatggatagcgacgcgaagcgtttatatcaactgatttgggatcaatttgtcgcctgtcaaatgacaccggcaaaatatgactcaaccacacttacggttgtatcaggggattataaactacgcgctaaaggtcgcacattacgttttgcgggttggacaaaagtcatgccagcaatgcgcagtaaagatgaagataaaacattaccagcggttgatgtaggggcgcaattagcgttagctgagttatcgccaacgcaacactttactaagccaccagcgcgttttagtgaagcgacattagttaaagagctagaaaaacgaggtattggtcgaccttcaacttatgcttcaattatctctaccattcaagatagaggttatgtcaaagttgaaaaccgccgtttctatgcagaaaaaatgggtgagattgttaccgatcgcttagaagaaaactttagtgatttgatgaactacgatttcacggctcaaatggaagatcatctcgaccatgttgccaacaaccaagaaaactggaaagcggtattagatgcattcttcacagattttagtcagcaactagaagtcgctgaaaaagatccagaagaaggaggaatgcgacctaaccctatggttattacttctattgaatgtcctacttgttctcgtcatatgggaattagaacagcgacgacaggggtattcttagggtgctcgggctatgctttaccaccaaaagagcgttgtaaacaaacgataaatcttattcctgaagatgaattacttaatatcttggaaggagatgatgcggaaactaatgcattacgtgcccgtcgtcgttgtccgaaatgcggtacggcaatggacagttatcttattgatactcatcgtaaattacatgtttgtggtaataatcctgcatgtgatggttatgaagttgaagaaggtgaattccgcttaaaaggttatgaaggcccagtgattgagtgtgataaatgtggcgctgaaatgcatctaaaaatggggcgttttggcaagtacatgggttgcaccaatgaagagtgtaaaaatacacgtaagatcttaaagagtggtgaaattgcaccaccaaaagaagatccggttccactacctgaattgccttgtgaaaaatcggatgcttactttgtgttacgtgatggcgcggcgggtattttccttgcggccaatacgttccctaaatcaagggaaacccgtgcaccgaaagtggctgagttagtacgttttaaagatagattatcggaaaaaatgcgctacttagcacaagcacctgtaaccgatcctgaagggaatccaaccatagtacgttttagtcgtaaaactaaacagcaatatgtctcttctgaaaaagaggggaaagcaacaggttggtcagccttttatattgatggcaaatgggttgaaaaaagtaaatag

SEQ ID NO: 643 - DNA, 417 bp, Proteus mirabilis
cattattcaattatttttcaggtaacaatggatggtatgatgaaaaaagttatttttgtaagtgcaatatcaggggggatcttattttggtcaatacatttacaagcggataattttgattgtcgtaatgcggaaacacaaacagaaattaaccaatgtgcataccaagattttcaacaaaaagatgaagagctgtcacaaatttatcaacaatattatgcgaaattagaaactaaacgacaacaacagttacagcatgcacagtcagtttggatgacatttcgtgacctctcatgtcaatatgaggcggactattaccaaggtggcagtttggctccgatggtttacagtagctgcttaaaagataaaaccatagaaagaattaatgatctgaaaaactatattgccttatattaa

SEQ ID NO: 644 - DNA, 636 bp, Proteus mirabilis
aagtgttcaatgtattttttaggtcttgaaaacatgccgaagatagggatgcagtcgatacgtaaacagcaattaattcaggcgacattagcggtgattaatgaggtcggaatgcaagatgccagcattgcattaattgcacgaaaggccggggtatctaatggcattataagccactacttccgtgataaaaatggtttattggaagcggcaatgcgccatatccaatatcagttaggttttgccgtcgcaatgcgattacgtattttaagcgatgctgagcctaaattgcgtattcaagccattgtcgatggtaactttgatacgtcacaaaccagtgaaaccgcaatgaaaacttggctggctttttgggcaagtagcatgcatcagcctaatttgcatcgtttacaaaaggttaatgatagacgtttgtactctaatctctgttatgaatttggacgtgcgttaacaaaagataaagcacgcttagccgccaaaggcttagccgctttaatcgatggtttatggctacgtagtgcccttagcgaggagccattttcgttagcagaagcaaaaaaaattactgatgagtatatcgatatgcaacttaatctttgccaggataaacagacttaa

SEQ ID NO: 645 - DNA, 618 bp, Proteus mirabilis
atattctcaattggaataggtacattagattcataccaaacaggaggaaatacaatgtctttaattaataccccaatcaaaccattcaaaaacatggcatttaaagacggtcaattcgtagaagtgactgaaaaggacgtcgaaggcaaatggagcattttcttcttctatccagctgactttacctttgtttgtccaacagagttaggtgacttagctgatcattatgaagaattccaaaaaatgggtgtagaaatttactctgtttctactgacactcattttactcataaagcatggcatagcagctcagaaactatcggtaaaatcaaatatggcatgatcggtgacccaactggcgcattaactcgtaactttgaaaatatgcgtgaagcggaaggtctggcagatcgtggtactttcgttgttgacccacaaggtatcatccaagcaatcgaaattactgctgaaggtattggccgtgatgcagctgacctgttacgtaaagtaaaagcggctcaatatgttgctagccacccaggtgaagtttgcccagcaaaatggaaagaaggtgatgcaactttagctccatcactggatttagttggcaaaatctaa

SEQ ID NO: 646 - DNA, 795 bp, Proteus mirabilis
cacatatcaatatttttatttgtaatgagcaagcttatgatcccagaaaaacgcgtcgttcgccgaatccaatctggcggttgtgcaatccattgtcaagattgcagtattagccagctctgcatcccgtttactttaaacgagcatgagcttgatcaactggataatattatcgagcgtaaaaaacctatccagaaaggtcaaaccttgtttaaagccggtgatgagctgaagtcactttatgccattcgttcaggaactattaaaagttatacgatcactgaagaaggcgacgaacagatcacaggttttcatcttgcaggtgacttggttggatttgatgccattatcaacaccgaacacccaagctttgcacaagctcttgaaacatcaatggtttgtgaaataccatttgaaacactagatgatttatcaggcaaaatgcctaatttacgtcaacaaatgatgcgtctaatgagtggcgaaatcaaaggtgaccaagagatgatcttactgctatcaaagaaaaatgcagaagaacgtttagccgcctttatttataacctctctcgccgctttgcgcagcgcggtttttcacctcgtgagttccgtttaaccatgactcgtggtgatattggtaattacttaggcctgacagtagaaaccattagccgactattaggtcgtttccaaaaaagtggtatgttaagtgtaaaaggtaaatacatcactattgaagatagtgaaatgttaagtgaactcgcaggcaaactgccttcctcaacagaagcttaa

SEQ ID NO: 647 - DNA, 372 bp, Proteus mirabilis
ctggaggcaatcataatgacgatgcagagcaaatcattgtatcgcttgccacaagaaggcatgatccgtggcgtatgtgctgggcttgcccattattttaatattcctgtgctattagtcagggttattgcggtgattgcactctttgctggtttttttggcttaaccattgttgtttatcttgttttaagtttctttatggagcctgcacctgataattataaccaacatcaggaacagcaagaggatttaaaagctattttaaaagaagtggatagtcaattaacaaaaggtgaaaaacgtttacaacaaatggaacgttatattacttcttcgacttatcagctcaataaacgctttcaagatttataa

SEQ ID NO: 648 - DNA, 930 bp, Proteus mirabilis
gaacgggcaatgctcaaatttatttttcgtcgctttttggaagcgatcccgacactttttattctaataacgatttcgttctttatgatgcgcttagcgccgggtagcccttttactggggaaaggaaattaccccctgaagttatggccaacatcgaagcgaaatatcatttaaacgatcccatttacaaacaatacttcgattatttaattcaattaacgaaaggggatttagggccttcttttaaatataaagactacagtgttaacactttagtcggtaaagcattccctgtttctgcaaaattagggctatcggcctttgtattagcggttatttttggtgtgggggcaggcgtgatagccgcactgaatcaaaataccaaatgggattataccgtcatgacatttgccatgacgggggttgtgataccgagctttgtggtggcgccactattagtgcttatctttgcgattaccttacgttggttaccggcgggaggttggaatggtgggcaaattcagtacatgttactgccgatggttgcattatcgctctcctacattgcaagtatttcgcgtatcacacgtagttctatgattgaagttttacactcaaactttatcagaacggccaaagctaaaggcttaccaatgaaacgcatagtgctacgtcatgcgttaaaaccagcattactgccagtgatctcttatatggggccggcatttgtggggattattacaggctctatggtcattgaaaccatttttggattaccgggtattggtcaacttttcgttaatggtgcattaaatcgagactactcattggtattgagtttaaccattattgtgggtggtttaaccattttatttaatgccattgttgatattttatacgccgtaatcgatccgaaaattcgttattaa

SEQ ID NO: 649 - DNA, 1125 bp, Proteus mirabilis
ggatttaaaatcatggaaaaaccgcagatccatacagatatacccaaaattttattcaccgttctttttatttctttttttattatcggtagtttttggatcctgaatccttttatcgttggttttatttgggctggcatgatagtggttgccacttggcctttactcattattttagaaaaacgagtaaaatatcgctggctatcaaccatgatcatgatgattttaatattactgattttcgtcattccgattattttgttaattagtagtgttattgataacagtgctccattgattgaactagcaaaatcaccttcagatattcaaccaccacaactactatggttaaaagagatccccatggttggtaatacgctctatgaaacttggcactctattctcgtttctggtggtaatgccttaatggcgaagatccaaccctatattggacaagcagcaaattggttctttgcacaagccttaaatattggccgttttgcgcttcacttagttgtcatgttacttttttcaggattactctttttacaaggtgaaaatgttgttgcttggttacgccattttgctgtgcgtcttgccggacaacggggtgatgcagccattttattagcctccatgtcaattcgcgcagtggcgctgggtgtggtgttaactgcgctgatccaagccgttattggtggtattggcttaggtatttcgggtgtgccttatgccacagtgttaacggtattgatgtttatttgctgccttgcgcaattaggacctttgttcgttctggttccttctattctatggctattttggaccggtgatactacatggggtatcgtcatgatcatttggggtgggattgtggcgacgatggatggtgtactacgtccattcctcatcaaaatgggagctgacctacctatggtactgattttgaccggtgttatcggtggtattttaacactcggtatgattggtctgtttattggccctgttgtattagccgtagcacacagtttattgaatgcgtggatcaatgaagttcctaaacccgatccagatttaacagaaactgtagaatttatgaataaaaactttatagaaaaagagtaa

SEQ ID NO: 650 - DNA, 1227 bp, Proteus mirabilis
aaaattaaaatgactttaaagaattccacacaatcaaaaacaccttctctctttatggtgtatctcgcctgccttagtatgctgggctatttagctatcgatatgtatctgcctgcatttggtatgatgcaacgcgaattatcaatcagtgaaggcgccgtcagtaacagcttaagtatctttctatttggctttgctgtcgctcaactactttggggaccactctcagacaaattggggcgtaagcctattttacttattgggctaagtttcttctccctaggttgtctaggtatgctttgggtagacagtgctgccggtttactaaccatgcgcttcttacaagcctttggcgtctgctctgcagccgttatttggcaagcactagtgatagaccgttttgatgagtctcgcgctcaacacgttttcgcatcaattatgccattggtcgccctttccccagccttagcgccactcattggtgcttttctgttaaaccacggtggctggcgcatgatctttatgttgctgatggcaattactcttgtattaatgctacccacattgatgctaaaaaatattaaacaaaaatcagttattgatgcaggcccatctacagtatcatttttaactttgcttaagtcacctatctatgccggtaacgtattagtttacgcgtcctgtagtgcgggtttctttgcttggttagcaggctctccgattatccttgagaagatgggttattcaccacaagatatcggcttaagctatattccacaaaccatcgcatttatggtaggtggttatggttgtcgcattctattatcaaaaatgtcgggtaaaacactgttacctttattgttaattggctacgcagtgagcatgacagcgttgttcttagtcgccaaatatacacacccaacattaacaacaattttaattccattttgtattatggctgtgatgaacggtgcttcttatcccattgctgtctctaatgcgctatcagcctaccctgaagtgagtggtaaagccgccgcattgcaaaatgcgctacaattaggtctatgtagtttagcaagctttattgtctcagcctttattagccaacagccattaattaataccacagcgattatggcactcacggctattccaatggcgctgggttactttattcaacgtaataaatccgttagcaaacacacagttcaggcgacagaataa

SEQ ID NO: 651 - DNA, 183 bp, Proteus mirabilis
aataacaaaatttatagtaaaaatagccttactatttcaacactaaaaagagtgaaatttgaagatgcaatagaatctatcactaacaacggtgagtatattgcatttattatgctaaacgcagttgctattaatttatcattgatgttacttttcatgataattaaaaaagaaaggagttga

SEQ ID NO: 652 - DNA, 1014 bp, Proteus mirabilis
tatataaaaatgaaatacattattattttaatttatttactctcattccattgttattctgatgaaccatataaaagctttagtaacaattgcgtttatgacgatataacagacaatgggtttattccagtacataatattagatttaaagctagtgatattgatttaggtgtcgatattggccaacctatcgcagaaatgagttttactgatgccgctctatctacgtcaattcttcattgtaaagataaagttgatctaaaattaattattaatgcaaggcattataaagatgatatttttaaaacaaatattccaggagttggctttaagatatcagcgaataaaacaccttttaacttagtaggcgatgaatttaatgtaacacctgaatatgcaaatgtctgtaatgctcaaactagaaaagaaggatataaaaatatatattgtactgatagttggccaagactatatattcaattaataaaaataagcgaaatcgttctagaacctctgagcgacatatttgttatggatgattttcttgtttatacattagataataaaaaatttacttataataatttgattattgagaagcctcagaataaagtttgcgaacttaatattgaacagcctaatattgaattagcgcctgtagaaaaaaacagtttaagtgattcaatacccgctaatgaaacacatttttctattggtgttatttgtaaccaagatacattagtttcattaaagcttgatgcacctgctatttataaaagtagaaatactaatttattaacacttcttaataatggcaccccttctggggtaggtttatcaattaaatataatgataataaatattatttaggtaatgttatttataatagcgttcatagaacaccttcgacggaatatacttttcctttttcagtaggttatgtgaaaatgagtgaaaacatcttgcctggcaaggtaacatcacaaattaatgtaaacttagaatataaataa

SEQ ID NO: 653 - DNA, 546 bp, Proteus mirabilis
agaataaaaatgaaatttaattttttgctttcaacttcaatactcgttgtttctactctttcttttaatgcttatgcaacattagaaaatacagtgtcgatagggtatgctaaatctaaattgaaagtcgatgaagatttaataaatgataaccttaaaggtattaacttaaaatataatcatgaagtagctaatgattggggcgttatcagttcgttttcatatgcaaaaaataaaaatgatggttatgatcattggggatatgcaggtacttcaaagattagctattattcgttaacggcaggtccaagttaccgccttaacaattatgttagtgcatatggactaataggttttggctattttcatgaagactttcactactatgatgaaagagaaaaagaaaataagatatcaatggcttatggattaggcgtacaagtaaacccaatcactaacttagctattgatgtttcttatgaatactccaaactatatgatattgattttactacttgggtagtgggtatcggttatcgtttttaa

SEQ ID NO: 654 - DNA, 1542 bp, Proteus mirabilis
gaagggaaaattatgcgaattggtatacccaaagagcgactttctaacgaaacaagagttgcagcaacacctgctacagtcacacaactcttgaaattaggatttacagtcgcgatagaaaatgaagctggcattgcttctagtttcgataatgacgcttatcaacaagcaggggctgagatcttagattgtcaaaatatttggcaatccgacattatcttaaaagttaatgcccccctagaagatgaaattgctttactcaaaaaaggctcgactttaattagttttatctggcccgcacaaaatgcaccattgctagaaaaattagctgaaaaagagattaatgtaatggctatggatagtgtaccgcgtatctcccgtgcacaatctttagatgcattaagttcaatggcgaacattgccggctatcgtgccgtagttgaagccgctcatgaatttggccgtttctttactgggcaaattaccgctgcaggtaaagtaccaccagccaaagtgatggtgattggtgcgggtgtcgctgggcttgccgctattggggccgcaggtagtttaggcgctgttgttcgtgcatttgacactcgacctgaagtcaaagagcaagtgcaaagtatgggcgctgagttcctagagctggattttaaagaagaagcggggagtggtgatggctatgctaaagtgatgtcaaaagcatttattgatgcagaaatggcattatttgcagagcaagccaaagatgttgatatcattattaccacagcattaattccaggaaaacctgcaccacgtttaatcactaaagagatggttgattcaatgaaaccaggtagcgtggtggtcgatttggcagcccaaaatggtggtaactgtgaatataccgttcctggtgagatttttaccactgaacatggtgtgaaaattattggttatactgatttagccgcccggttaccggctcaatcatctcaactttatggtactaacttagttaacctattgaaattactctgtaaagaaaaaaatggtaatatcaatattgattttgatgatgtggttattcgtggtgttaccgttattaaagcaggggaagtgacatggccggcgcctcctattcaagtttcagcgcaacctaaagcagctcctgcagcaaaaccccaagaaaaacccgttgcgaaacctatttccccgtggaaaaaatatggtttattggctattgcctttttactgttcgcatggttggctaatgttgcgccaaaagagttcttatcacactttactgtcttcgcactttcttgtgttgttggttattacgttgtttggaatgtcagccattcattgcacaccccattaatgtcggtgacaaatgccatttcaggtatcattgtcgttggtgcattactacaaattggtagtggtggttgggtaagctttttctcatttatcgctattttaattgccagtattaatatttttggtggatttaccgtcactcaacgtatgttgaaaatgttccgtaaaggataa

SEQ ID NO: 655 - DNA, 339 bp, Proteus mirabilis
attttggaaataaataatttctcattgaattttgaatatatttcagaaagaaaaatattttgtcattcgattggatatgaactttttcttttaaggcaacgtaattctatgacgggggctgagttaggaaaattattgaatatctctcaacaacaaatttctcgttatgaacgaggaataaataaaatacctattgatatactttttcacatactaaatatatttgatatttcaataagtgatttctttgaaaaggtttccaaaagagttatcacattaaaatataaaataaaatatgattctgataataatattccattctttgagaatattatttaa

SEQ ID NO: 656 - DNA, 825 bp, Proteus mirabilis
gtcgttggaatgatgatagaaaccatagctgattacgaatttaacaaagcccctttggttaagggtatgatccttatctctcaggcaattcgcccagattttccagtcacttcagttggctatcaattggcacagctggtggagcaagcagaagcggaaattccccaccaagccagtatacaagagagaattgatgcactgctgaagctattttataaacaatggcatttcagtggtgcaagtggcaaatattgtctttctgatacgttatggttagataaagtattggccactcatattggttcacctgtgtcattaggttccattttaatttatatcgcacaggcaataaatttaccgttagcgccagttatttttcctacacagttaattatcagaatagatattccgaatgaaaaaccacttttcttaaatcccattaatggtgaatatctttctcgtcatactttagacgtttggctaaaaggtaatgtaggcagtacatctgagctatcagcatccgatctagaagagtcagaacacagttctattattcgcaagttattagatacactcaaagtctctttaatggaagaaaagaggatggagcaggcacttaagaccagtgaaacggtgttattgtttgatccagaagatccctatgaaatacgtgatcgtgggctgatttatgctcaattagagtgtaatcatgtggcattgtctgaccttaactactttgttgaacagtgtccggaagatcccatttcagagatgattaaaattcaaattcattcaatagaacagcatcctgttgttttacattaa

SEQ ID NO: 657 - DNA, 1014 bp, Proteus mirabilis
gggggtggaataatgccgttattagacatacgcaacctaactattgaatttatgacgcccgatggcccagtaaaagcggtagatcgcgtttccattaccctcagtgagggagaagtaagaggtttagtcggtgaatctggctccggaaaaagtttgatcgctaaggcaatttgtggcgtgactaaagataatattaaagtgactgcggatcgctttcggttcgatgatattgatttacttaaattgtcaccaagagcacgtcgtcgggtgattggtcataatgtgtcgatgattttccaagagcctcaatcttgtcttgatccggcgaccaaaattgaacaccagcttattcaagcaatccctggttggacatttaaaggccactggtggcaacgttttcattggcgaaaacgccgtgcaattgagttacttcatcgggttggtattaaagatcataaagatatcatgcgtagctatccttatgagttaaccgagggtgaatgccaaaaagtgatgatagccattgccattgctaaccaaccccgtttactgattgccgatgaaccaactaatgcgatggagccggcaacgcaaacacaaatatttcgtttactcacccgtttaaatcaaaataataatatgactattttattaattagccatgatttgcagtggatgagtaaattagccagtaaaattacggtcatgtattgtggtcagaccgtggaaaccgccatacctgaagaactattggttaccccctatcatccttatacacaagcccttatccgctctattcctgattttactaactctttgcctcataaaagccgtttaaatacgctacccggtgcgatcccctctttagagcacctacctgttgggtgccgtttaggccctcgttgtccttatgcacaacgtcaatgtattgaagcacctcgattacgtgcatttaaaaatcatgcggtggcttgtcatttcccattaaatgtggagacgacagatgttcgataa

SEQ ID NO: 658 - DNA, 228 bp, Proteus mirabilis
gatctcttgattaatatggaacaattactaaccaaaaccgaaatgccagaatggttttcttacccacgtgaatttctcagaatagttgagcaaaatttacttaattttgatccttggattattttggaaggagagcggctcagggttcgttttggtggtttaaaaaaagatacccaacaaatagaaatattattccttttgcccatcgggaagataatgatgatgtag

SEQ ID NO: 659 - DNA, 243 bp, Proteus mirabilis
aatattctgataacgataatgattatcataatcataacctctatcagtattgctattgaaatgaataaaaatgttcataatttaaacgattcatcgataacacgtgaaacaagctccccagtcattcaatctataaatagcatagaattactgggtaaatcgggcgtggtttatattcaacataacggagagttgtatcagttacgccaaacaaaaacaggaaaacttatcctaacaaaataa

SEQ ID NO: 660 - DNA, 1248 bp, Proteus mirabilis
aaaggcatgatgacacattccattgaaaaagcgcgggatgactttcctattctttcccagcaagtgaaagaaaaacctttagtctatctcgacagtgccgcaagtgcgcaaaaacccgcttgtgtcatggagcgtgaaaaacagtttgccttaacacaatatgccgcggttcaccgcggcattcacacattaagtgcaaacgccaccaccttagtggagaatgttcgtaagcaagcagcacatttcttaggtgcaaagagcgaagaagaaatcgtttttgtaaaaggaacgacagaagggatcaatttagtcgcttacagttatagccatcgtttcctaaatgatggtgataacattatcattactgaaatggaacaccacgcgaatatagtgccgtggtatatgttagcaaaacagtatggttttcatgtccgtgttattcctctgcttgctaatgggcaactcgatttagcgcaattaccccaattaattgataacagaactaagttactggcgatcactcatcagtctaatgtactgggaaccgtcaatcctattgctgaaattatttgccaagctagagagtattcggctcagcaagggggcgagttacatattttagttgatggggcacaaagtgcgatgcatcaagctatcaatgttagtgcgttagattgtgatttttttgtatgtagtggccataaactttatggtccgacagggattggtttgctatatggcaaaaaagcgctacttgatgaattacctccatgggaagggggtggcgctatgataaaacatgtgcatatcaatggtgatattacctacgcggatgcgccgtggcgatttgaagctggaacgcctaatattatcggtatcattggcttaggggcagcattggaatatcttgctcaatttggtatggataagattgctgcatatgaaaatagcttaatgcaatatgcacaacaacaattaaccaaagtaaaatcattaacgctttatggtaatgaagcgcgtcaaggtgtgatagcatttaatttaggtaagcatcacgcttatgatgtgggaacttttcttgataactatggtattgctattcgtacgggtcatcactgtgcgatgccaattatggactattatcaggttcctgccatgtgtcgcgcttcgttgggattatacaataataaagcggatattgatgcactggttaatgcgttgttacgcattgaaaaactattaggctaa

SEQ ID NO: 661 - DNA, 213 bp, Proteus mirabilis
gtcagaatgatgttattatttttaaaaagactatttttatttgttattttcactatcggcatatcagcactcactggatgtattcgattagaggttgctaccccggaaaaaccgataaacattaatatgaacgttaagattgaacatgaaattaatgtcaaaatagatcgccaagttgaagacttgctgaaaaacaatagtgctatattctaa

SEQ ID NO: 662 - DNA, 264 bp, Proteus mirabilis
ggaggaatgatgaattccactttgataccgacaaccgttaaaacaaataaactcactaaatgggcgaaaaaaggggtaacatttgctttaatgttattaactttatttgggccagccgcaataaccggcggtatattaaaacgtgtgagttataaaccgttacgttggttggttctattgatagctgagcctatgataaaaatggggctagataagttatcgcgtcacgtgtcttgggagaaacatgaaacgcttacaaaatga

SEQ ID NO: 663 - DNA, 1017 bp, Proteus mirabilis
ttgattgtgattgaagcagatcgcctgatttcagcagatatacaacaacctgaagaagaaattatcgatagggctattcgtcctaagctgcttgctgaatatgtgggacaaccacaagttcgtgaacagatggaaatctttattcaggcggctaaactacgtcatgatgccttagatcacttacttatctttggtccgccggggcttggtaaaaccacgctggctaatattattgccaatgagatgggtgttaatttacgtacaacctcagggcctgtattagagaaagccggcgatcttgccgctatgctaaccaatcttgagcctcatgatgtactgtttattgatgaaattcatcgactctcgcctgttgttgaagaaatactctatccggcaatggaagattatcaacttgatattatgattggtgaagggccggcagcacgctctattaaaatcgacttaccgccatttactttagttggggcgacgacccgagcgggatcgttaacctctccattacgtgatcgttttggtattgtacaacgccttgaattctataatgtcgatgacttacagcatattgttgcacgtagtgccagctttatggggttagaaataaccgcagaaggggcgcgacaaattgctatgcgttcacgaggtacaccgcgtattactaaccgcttattacgccgagtaagagactttgctcaagtcaaaggtaatggcgaaattgatgaagatatcgcgtctaaagcactcgatatgcttaatgttgatgctgccggttttgactatcttgaccgaaaactactctttgccattattgataaatttatgggtggccccgtagggcttgataatcttgcggcagctattggtgaagagcgtgaaactatcgaagatgtattagagccttatttaattcagcaaggttttattcaacgcaccccccgtggtcgggtagccacaaatcatgcttatcgtcactttaatcgcattatggaagcaccgtga

SEQ ID NO: 664 - DNA, 201 bp, Proteus mirabilis
ttagtcgtgatcccctgcaacccatgtaccatattatttggaaatcttaacttcttaataaccacacaatttgtctgtttaactacactggcgaacttatcaattttaatttgtttaaaagtggcttatataaagactaaaaaggtcgcaaaagcgaccttagaaaatatattgactatcgtgtgtgacacctttgattaa

SEQ ID NO: 665 - DNA, 354 bp, Proteus mirabilis
taccgcacgattagcatcatcattaacaaagatacagactgcatctgcgccgacggcattttttgctgtttgttcagtcaaattaaagtcaaaatattcgatatcataatgatatccattatgctgattgacccattccatatgtttgcggtcataatgtttagtactataggaaacaattttcatcctgtactcgcttattatcgattaaaatttattttgagagtgagaaaacaagaattatctaaccccaatagagaagcatttaatactattattataaacaatttaatgggtaaagtggatgttcggaatgtggttaatgtgatcaaaaggaaaatgaggtgttgttaa

SEQ ID NO: 666 - DNA, 186 bp, Proteus mirabilis
acttcaaagataacagcgatcattttattctccttgttaagaataagcaggataacaaggaaaataataaacgtttcgatacctattgaaatgttactctgtactgaatgtagagtagaaatgaagttagtatctttattaagcaatgatatctttaaaagcacttgttacttgttatatttataa

SEQ ID NO: 667 - DNA, 1014 bp, Proteus mirabilis
atccgaaagatcgttaaggagaacatgatgacaaattcaacaaataagccattgttaagtgtaaaagatctctgtgtcacctttggtactccagatggggatgtaaccgcagtaaataagctcaactttgagctatctgcaggggaaaccttaggaattgtcggtgaatctggctctgggaaatcgcaaacggcgttcgccttaatgggattattagctaaaaacggtcgtactgctggaagtgctcattttaatggtcgtgaaattttaaacttacgccaaagtcaattaaacaaaatgcgtgctgaagaaatatccatgatatttcaagatccgatgacctcacttaacccctatatgaaagtcggcactcagttaatagaagtgcttatgcttcataagggtatgagtaaaaatgatgcatatgcggaatctgttcgcatgcttgatgcagtaaaaatgcccgaagcccataaacgtatgggcatgtatccccatgagttctctggtgggatgcgccaacgggtaatgatagcgatggcactattatgtaagccaaaactattaattgctgatgagccaacaacggcactggatgtgactgttcaggcacaaatcatgacactgctaaacgagctaaaaaaagagcttaatacagccattatcatgatcacccatgacctcggtgtggttgcgggtatttgcgacaaagtactggtaatgtatgctgggcgaaccatggaatatggtaatgcgcgagatattttctaccaaccatcacacccatattctattggattgctgcaagcagtacctcgtttagatggtgaagatgaacgtttggcgaccattccgggtaatcctcctaacttattgcgtttacctaaaggttgcccattccagcctcgttgccaatatgcaacagagcagtgtttgaatagtgaacctcaattaacacaatttgctcagggaagattacgagcctgttttaaagcggcggaggagttagtatga

SEQ ID NO: 668 - DNA, 861 bp, Proteus mirabilis
atgggttggataaacgtgagtaatcaagacagcacgcaacaaaagaatatttatcgtcctgcaccacctcgtttggtgcaagtaaaacgtatagtagatatcacgccgggcatgcgctctattacctttactagcgatgacttggacaattatccaagtcacacagggggtgcccatttaaaaatatttttacctgtagaaggccaaactaaaccaacaattccaacactcactgacaaaggccctagttggcctgaaaaccaaccaagagcgatagtgcgaacttacagtgtgcgagctattcgtcctgaattaaaagagcttgatattgaatttgcggttcatgaagatgcaggtccagccattaattttgctttaaatgccaaggtaggtgattatattggcattactaatcccggagggcctgatcccctattggctcccgcttctcattactatatggcagccgatcccagctcattacccgctttaatggcattaattgaaacaatgtcacccgatgtacagggtaaagcggtgatccgcatagaaaatgaatcagatcgccaaattattgatgctcctcagggactagaaattgtttggttagtcggctctgttgaaacacaaactcagcctctgattgatgaatttatctcttggtcgttaccaaaggaagatgtggcattttggatcgccggagaagataaaattatccgtgcactaagacgttatattcgtcgtgataaaggctatgagcgcggacagatttatgctatcccttattggcgttttggctttaatgaagaaggttatcatgcagagcgtcatcatgttatggataatgaagatgtaagctaa

SEQ ID NO: 669 - DNA, 1356 bp, Proteus mirabilis
gttgttcggatttggttttgcttccgtttttggttttttgttttgaatgttatcgcaaaatcatcggctggatatccttattctcgtattaatgatacggaggcactttatatgttttcagaagaaagacgacaggaaatctatagcattattagggaacagaaaaaagttaaagtggctcagctagcggaaagattcaacgtcacattagaaacgatccgcagtgatttgaaatacctcgaaaatgaagggttgatcaaacgttgtcatggtggcgccatactagggaaacaagaaataaaaaagatcagtaaatttagtgatagttttgatatctcatgtttactacacgatttattgatcgtcaaagaacataaaaagaaaacaccagaaggtaaagtgtgtgtattaggctcttttgtggtggacattattgctaatgttgatgcatttcctcgtgtaggggaattggtaaattcaaaaggaaactcaataggtccgggtggaaaagggacgaatcaagccatttctgccagtttttctgatgcaaaagtgcatttaattaccaaagtcggtgaagatcattttagtaagtacgcctataaatatttgcaagagagcggtattgattcatttactatttttcaaacagaaatagagccaacaggtagctcaattagctatttagcagataaaacccaaaataatattacggctacctatttaggcgcaaataacacttttaccctgcaagaggttgatatctcactgccttatattagtgaagctgacgtgctattactgcaaggggaaattaatattgatgctaatgtgaaagccgcttcttttgctcattctattaataaaaccgtcatacttaatgtcgctccgtatagcgatgatttaaaacaactttatttatatgtagattttattacgttaaacgcttaccaagcttcagattggtcaggtattgaaattaatacgattaatgatgccaagcaagccgtagagattattgccggtaacgaaaagaaaaaagtgattatctacatagatgaattaggcgtggtgtattttgatgggaggaatacttttcatattccgccactaccttctctacgtgttgatacgatggcagcaacagatgcttttaatggtgcatttgcctcaaaaatagccgcaggaggcacaatgccagaaagtgttttatttgctagcgctttcttgtctgcatttatagaacaaaaaggggtgacttcaatgccttcactatcacaagtacaagcacgtcttaaattaagaattgaagatattcgaccacaagtaatctgcaatgagaaaaggtgcatataa

SEQ ID NO: 670 - DNA, 666 bp, Proteus mirabilis
atgtataggatcagaatgaacaataatcgcgcactactatgtctggaaaaaattggctttcaactcgatagcaaaattattctagataatgtgactttctcactacaaccttctgaatttaaattgattacaggcccttctggctgtggaaaaagtacgttattaaaaatcattgcctctttattatcaccgacaagtggcacacttttctttgacggaaaagactacttaaccctttctcctgaacaataccgacaacaagtttcgtattgtactcaaaccccgatgttatttggtgaaacggtttatgacaatcttaaatttccttatttactacgcaaaatcgccgttgatgagaagaaattagcgaaagatttagattactttaatttgcccaatgagattttaaataaaggtattaatgaactttctggtggtgaaaaacagcgtatctcacttatccgtaacctacagtttttgcctaaagtgttattgcttgatgaaattactagtgctcttgatgaagacaataaaataaaagtcaatgagcttatccatcattatgtcaaagagcaaaaaatcgctgcattatgggtaactcacgatcaaaatgaaatcaaacatgccgatgatgtgatccacttaccgagtcatatgaacaattaa

SEQ ID NO: 671 - DNA, 2040 bp, Proteus mirabilis
aggcggaggataacgctcatgtttaatctcttttcgttatttaaaaaagataaaatttgggattttaaaggcggcattcatcctcccgaaatgaaattacaatcaagtcgcacgcctatgcgtatagcccagttaccggatgaggttaccatccctattcatcaacacttaggtactcctgggcaactttgcgttaaagtgggtgatcatgttttaaaaggccaagccttaactcgtggtgtaggaagaacattacctgttcatgcttctatatcaggtacggtcacggcaatagagccatttccaagcactcacccttctggtctgcctgaaattgcagtgaaaattgtctctgatggtaaagacgaatggcgagaaaaatcaccactggttgactatcaatcacaaagtaaagaggtattgcttacccgtattcatgaagcaggcattgctggattagggggagcgggttttccaacagccacaaaattaaaaggtggtggtgatttagttaaaacgctcatcataaatgccgctgaatgtgagccttatatcacggctgatgacagacttatgcaagagcacgcagatgaagttattgcgggttgtcagatattaatgcatatactgtcaccggatgaagtgctgattggtattgaagataacaaacctgaagctattgccgccttaaaacaagcattagcagcactcacaaatgaaaaacgtatttttattcgggtgatccctaccaaatatccatctggaggcgctaaacagttaaccaaaatattaacgggcaaagaagttccttctggcggtcgctcctctgatattggcgtattaatgcaaaatgtggggacggtagtggcaattaaacgtgccattatcgatgatgaacctttaattgaacgtgtcgtcaccgtaactggacaagggactaaaaccccaggcaacttttgggcgcgtttaggtactcctatttatgcacttataaaacaagcaggctttgttgctggctctgagcagatggtcattatgggggggcctttaatgggcttcaccttacctgacttaaatgcccccgttataaaaattactaactgcttattaattccctccccagaagagatggatacagataatattgaagaagcctgtatccgttgtggtcaatgtgttgacgcctgccctagtggtttactaccacaacaactttactggtttagtaaagggaaagagcatgagaaagcgcaacaacataatctatttgactgcattgagtgcggggcttgtgcttttgtctgccctagtaatattccattagtgcaatattaccgccaagaaaaagcagaaatacgagaaattgatgcggaagctaagcgagcggctgaagctaaggctcgctttgaagcgaaaaaaatccgtatggaacgagaaaagcttgaacgtgaggcaagacatcaacgtgctgcagttaagcttgatgatcaccaacaaaatgaagtgcaatctgcactttctcgtgtaaaagaaaaacatagcattggcaaaattattgctgttaaagcaggagaacaacctgacaacgcagcggctattgctgcacgcaaaaaacgtaaagaagaagcccgagcaaaacaagctgctaaattggcacaacaggtaccacaaaatacccataccaccgccgatgcagaaagtgatccgcgcaaagccgctgtagcggcagcattagctcgtgtaaaagctaagaaagctcaacaagcgcaagcaactacaaaagtagacactcctgctgaaactccggctgaggtggaaaccgatccacgtaaagcggctgtcgccgctgctattgctcgggtaaaagctaaaaaagcccaacaagcgcaagcaactgcaaaagtagacacaccggctgaaactcaggctgaagtggaaaccgatccgcgcaaagccgctgtcgctgctgctattgctcgggtaaaagctaaaaaagaagcacagcaacgccatgctaaagaagaagtgacattggattaa

SEQ ID NO: 672 - DNA, 570 bp, Proteus mirabilis
aggtcatacttttatatcgagggaaatatgaaatatagtttaatatattctattgtcctattttttactctttcatttacagcctattctaatgacagggaaaatatttctttagacgatggtattgtgacttttaaagggggaattgtagagcctgcttgtacagtatcttctgaaagtgaatatcaaattgttgatcttggtgttattagtagtaaccaatttcatggagtaggaagtcactctataaaaatcccattttttattaaattaatgggatgtaataaaagtattacggataaagtcagtataattattataggtgatgtaaacaataatgataaacgattatttagcatcaccgatcaacaaaattcagcttcaggattaggtgttgcattatttaatgatgaaggtgaaataattattcctaataaattcaataagtataaatttattgaagagaatgaattaaaactaaaatttaaagcaagttatctggcaacgaaagaaaacgttatcggtggaaaagctgacagcgtagtttggtttgttttcaattatcaataa

SEQ ID NO: 673 - DNA, 831 bp, Proteus mirabilis
tccctttttgttgtcttaaaaggtacaatatgtcccattgacttagtctatttgtataggagcagtttcatgcctaccccggcacgcacaatctaccgtgatagtcttaacttttataaaaatgaacaacgtagcattatcacgctatctgcagttttggccctcattttatctgtcatatatctattggttggccctaatgcacaagaatcacaaataattaatgactttattattaattttcaaaaaaccagattcgctgatgtctcacccgctgaattagaagcgatgaataacagtgttattggggtatttcaaaaggtcttactggtctatgtttttgagctttttcagcaaagtattctggttttagtgattttaatgttggcaatggcactttctgccggtcataacgtgacattgaaccaaacgtttaatgccagcttaccccgtttaccgaagatgtttctgctaattttgctctgctctattttaattagtgcaggctttatgttgattatccctggtatcattttattagtgggatttgcactagcgccagtcgtactggtacgccaacaatctattggtagcgcaatacgtctaggctggaaaatgggctttggtgaatcaggggcgctgatccctgccttaggaatttggattttattacaatttgggattggcttcttaagcaatattacgggtgaattgcctaacatgatccacaaatttttatattattttttaaagaatattacgtctgcatggatgattatttatctattccgtctgtttatgctgactgaaaataaatatatcaccaagtaa

SEQ ID NO: 674 - DNA, 531 bp, Proteus mirabilis
aaggatattgttatgccaactccttgctatatttccattgaaggaaaaactcagggcaacatcactgcaggcgcgtttactgcagattctgtcggcaacatttatgtacaaggtcatgaagaccaaatgttggtacaagaattttctcacgtggtgacggttccgaccgatccgcaatcaggccaaccttctggccaacgtgcgcataaaccgtttcgttttaccgtggcattaaacaaagccgttcctctgctgtataacgcattggcttccggcgaaatgttgccaaaagttgagttaaaatggtatcgcacgtctgttgaaggtaaacaagagcacttctttaccaccacactgactgacgcgacgatcgtgaacatcgattgccaaatgcctcattgccaagatccggctaaagccgacttcacgcaacttatcgaagtctccctctcttaccgcaaaattgactgggagcacactgttgctggaacgtctggtgcggatgactggcgtgcgcctctcgaagcgtaa

SEQ ID NO: 675 - DNA, 594 bp, Proteus mirabilis
aaggcaattgtgagtaaaattaaacttatcgtcgggttagccaaccccggtgctgattatgcccagactcgccataatgcgggtgcttggtatgttgatttattggctcaacgtcatcaacaatctctaaaagaagagagcaaattcttcggctatactgctcgtattaatttaaatggtaatgatgttcgtttattagtccctaccacttttatgaatttaagtggtaaagcggtattagcgatggcaaatttttatcgtattcaacccgatgaaatattggttgcacatgatgaactggatttaccaccgggtgtggtaaaaatgaaattgggtggcggtaatggtggccataacggactaaaagatattcagagtaaatttagcaataaccccaatttttatcgattacgtattgggattggtcatcccggtgataaaaacaaagtggtcggttttgtgttaggtaaaccaccaacaagtgagcaaaaacttattgatgatgcaattgatgaagcccttgcttgtacagatattctgatgcgtgatggttacgaaaaagccattaatcgtttacatagctttaaagcttaa

SEQ ID NO: 676 - DNA, 639 bp, Proteus mirabilis
ggaacagttgtacagtcacccgcagcaaatacccctttaatattggtttcaccacgtggatcaaccacgatctcaccaattttattacgctcaacagttccttctaaccattgtgtgtttggcagtaaaccaatttggacgaaaatacccgctaaggcaatatcatgcattgaatcgttagtgcgatctttatatttcagtcctgttaacttagtaccatctccatatacttctgttgtttgggcatttaagataacatcgacattacttaagctacgcagtttcttttgtaaaacagcatcggctctcatttctgaggcaaattctagtacggtcacgtgctccactaaacccgctaagtcaatagcagcttcaacacccgagttaccaccaccaataacagccactcttttacctttaaatagaggaccatcacaatgtgggcagtatgttacaccgcgagtacggtactcgttttcacccggtacgttcatatttctccagcgagcacccgtggcaataattaagctacgggtttttaaaatcgcaccagatgcggtttcaatttggtgtagatcaccttctgctgctcccggaattaaacggctgacagtttggctgtcaatgacatcaacttga

SEQ ID NO: 677 - DNA, 786 bp, Proteus mirabilis
ttgctttctgtattaaggatagagaggggtggtatggcaaaactggagatttgctgctttggtgcagaatgcgcactgatcgcagaacgttcgggggctgatagaattgagctgtgtacaagcccgtcagaagggggtgtaacaccgagttatggaatattaaaacaagtcatagatctcgttcgtatccccgttcatcctattattcgtccgcgtggtggtgatttttgttatagccaagccgattttgctgcgatgaaaaacgatatcagtatgatccgtgatatgggtttttccggtgctgtggttggtatattaaatgaagaaggtcacattgatttacctaaaatggcgattttgatggaattagcagggcctttagccattacgtttcatcgcgcttttgatatgtgtattaatccattgctagcgttagatcagctgactcaattaggtgttgctcgtattttaacttcaggtcagcaagctaatgctgaattaggcttacctctattaagaacactgaatgaaaaaacccaagggccgattatcatggcgggggcgggagttcgtttaagtaatattcagaaatttttagactcgggattacaagagatccatagctcagcgggcaaacaagcaccctcgacaatgaattatcgtaaagcgggggtcaccatgagttcagacagcgaagtggatgaatttacccattattgtgtggatgaagatgtggtgggggcaatgaaggatattatgagtatttatacaacatctgttaattaa

SEQ ID NO: 678 - DNA, 882 bp, Proteus mirabilis
tcggtttatgtcatgaaaaatatactctctattcaatctcatgtagtttttggtcacgcaggtaatagcgctgctgaatttccaatgcgccgtatgggggtaaatgtttggcctttaaatacggttcaattttccaaccacacacaatatccagaaaaatggacgggttgtgtgatgtcggcagagcatatcactgagatcgttgatggtatcgctgctattggtaaattagcacagtgtgatgcggtattaagtggttatcttggctcggcagagcaaggccgacgcattgttgatattgtaaaaaaagtcaaacaagctaatcctaacgcatggtacttttgtgatccggttatgggacatcctgaaaaaggttgtattgtgcctccagaagtttctggcgtactttgtgaagatgccttgcccatcagtgatattattgcacccaacttattagaacttgaaacattagctggtggagcaacgctgcataatgttgaccaatgtgtaaaagcggcccgtcaattatgccagcaagggcctaaaattgtattagtaaaacatttatcacgagcaggctttcgtcatgatcgctttgaaatgttactggtgactgcagatcacagttggcatgtgagccgaccgctggttgattttggtgaacgtcagcctgttggtgtcggggatctaaccagtggtttaatgctggtggatttactaaaaggtgttgagctaaaaacggcattagagcatgttgctgctgctgtttatgaagtgatgttaaaaactaaagagatgaatgagtacgagttacaactcgtcgccgctcaagatcaaatggtgcacccaacccataacttctgtgcaacgcagttagattaa

SEQ ID NO: 679 - DNA, 1083 bp, Proteus mirabilis
tttcactgtgttttattaaccttaaaagaggcctttgtggagtatattttacaatatggactgtttttagctgagattgcgactgttgtagtcgctattattgctattgtttcgttttttgtggttatcggtagtaaaaagcaacatcgaaaaggcacattaaaggtgactgatcttgctgagtcttaccacgataaacaacgtgttatgcaacaagccaaaatggatgaggctgaattaaaagtgtggcataaagcgtttaaaaaacaacaaaagaaagagcaaaaactgagtaaaaacaatgctaaagaagggcgcaaaggcgttgttaaaccttgtttatatgttattgattttaaaggtagcatggatgcccatgaagttggtgcattacgtgaagagataagcgctatcctctctgtggcacaagcgggtgatgaagtactgcttcgtcttgaaagtcctggcggtatggttcacggttatggcctagcagcagcccagttaactcgtttaaaagataaagggatcaaattaactgcagtggtcgataaagtcgccgccagtgggggttatatgatggcctgtgtcgctgataaaattgttgcggcaccttttgcgattatcggctctatcggtgtggtcgctcaaatacccaatattcatcgtttattaaagaaaaatgacattgatgttgagttacatactgccggtgaatataaacgcacgttaaccctattaggggaaaatacggatgaaggtcgtgagaaatttaaacaagatctcaatgaaactcatctgctatttaagtctttcgtacataaatatcgccctgaattagatatcgatagtgttgcaaccggcgagtattggtatggaacggatgctgtagataaagggctgattgatgaagtgggggtcagcgatgattggctcatcagtcgtattaatgattttgaagtattatccgttcaatatatcctgaagaaaaaaatggtagaacgagttactggtggcgcaatggaaagcgtggataaattaatgatgcgttggctacaaaggggtaaaaacccactgttataa

SEQ ID NO: 680 - DNA, 291 bp, Proteus mirabilis
gttttattttttttagttactagaatgccactttctaaaacgaggtggtttatgactaaatatgttatttttagtttttttttagtattgatttatcctcttggtgttgatctatacttaactggattaacagcaattgctagcgatttaaatgcttctgaagtgacattgcaccatgcattttcaatttatttgatgggaatggtgtcatccatgttaattgctggatggtgcagtgacaatttaggtcgtaagcctgttattttatttggtactctgattttttcttag

SEQ ID NO: 681 - DNA, 459 bp, Proteus mirabilis
ggtaataacgtagagatgacacaggctttttggcagacaaaaactttggatgaaatgagtgatgatgagtgggaatcgttatgtgacgggtgtgggcagtgctgtttacacaagttaatggatgatgatactgatgagatctattttactaacgtcgcttgtaatcagttaaatattaaaacctgccaatgcagtaactatgaagatcgttttcgttatgagcctgattgtatcaaactcacgcgatataatttgccgacgtttgaatggttaccgatgacttgtgcttatcgcttattagcagaagggaagcctttagcggattggcatccccttattgcaggtaataaagcaaaaatgcatcaaggtaatatctcagtaagatatattgctgttcctgaagtggaagttgaagactgggaagatcatattcttaatcgccccaaaggacgcggttaa

SEQ ID NO: 682 - DNA, 687 bp, Proteus mirabilis
caggtcaacgtttatatcatgtacagtaaaagtatgggggttactgtgtggcttgaacaatttggagtgctcaatatttggacatatcttgcgggtatgttctttattattatcgtccccggccctaattccctttatgtgcttaaaaccagtgcatcaagaggagttggtgcaggttatcgagccgcattaggggtttttattggcgatgctatcttaattttcttagcatttatcggtgtggcatcagttattaaagcctctcctgtgctttttactattgtccgtttcttaggtgctttttatctactctatctcggtatcaaaattattcatgctaacttctttgccaaaaagcaaagccatactgagacaaactgtattcaagagcatgtatttcgtaaggcattaacattaagcttaaccaaccccaaagcgattttgttttatatctccttttttgtgcaatttatcgactttaactatgcacatactggtttatcctacttgatcttagcttctatgcttgaagcatttagctttgtttatctctcttttcttatttttggtggtgtagcattggcgcgtttcttcggttcacgtaaaaatatcgctaaactgggaaatggtattgttgggctattttttatggggtttgccaccaaacttgccacactctcctcttaa

SEQ ID NO: 683 - DNA, 189 bp, Proteus mirabilis
gctacgcgcttcttttatatacttctgcacgcatacacctttattcattataataagacggaagggaggaaagaacgtcacatgttaatatggcgtaaaataatccttaagcaaacatattctaatgataaatgtttaattatcaatgaaagatatgacgtttttcaaccacagaattttgataagtaa

SEQ ID NO: 684 - DNA, 1440 bp, Proteus mirabilis
aatcatttagtcactaatgtaataataattagtaaaggtaatttcaagatgaataaaaaaacgccaagttatagctcactcgatgatgtttatgcatcggttgatttatcacaatccttaccgaaaacacattttccgcaacaagagagccatcctcgtcatgtttttgatgctgtaagggatgagctgatgctagatggcaattcaagacaaaatctggccacattttgtcaaacctgggtagatgatgagatccgtgatttgatgaatttatctatcgataagaacatgatagataaagatgaatatccacaaacggcagaaattgaaaaccgttgtgttcatatgcttgctgatttatggcactcacccgatccactcaataccctaggttgttcaaccattggctcctctgaagcggcaatgctggggggacttgcattaaaatggcaatggcgtaaaaaacgccttgctgctggaaaagcgacagataaaccaaatcttatttgtgggccagttcaagtctgttggcataaatttgcccgttattttgacgttgaactcagagagatcccgcttgaaggtgatcgcttgatgatgagtcctgaagaggtcattaaacgtgttgatgaaaatactatcggtgtagtgccaacattaggggtgaccttcacctgtacttatgagccagtaaaagcggtacatgatgcactcgatcaactacaaaaagagaccggacttgatattcctattcatgtcgatggtgcgagtggtggctttttagcgcctttctgtgcacctgatttagaatgggatttccgtttaccgcgtgttaaatccattaactcatcaggccataagtttggtttagcgccattgggctctggttgggtagtatggcgtgaagccaaagacttaccggaagagcttatttttaatgtgaactaccttggcggtaatatgccaacctttgcgcttaatttctcacgtcccggtgggcaaattattgctcaatactataatttcttgcgtcttggcagagaagggtatgcgaagatccacaatgcctgttatcacaccgcgcaataccttgctcgagaaattgaaaagctagggccttttgaaatgatcttcagtggtgatagtcaaaaaggaatacctgcattagcgtggaaactgaaaaaagaggctaaggtaagctactccttatatgacatcgctgataaattgcgtagccgtggctggcaagtacccgcttattctatgcctgctgatcgccaagatttagttattcaacgtattcttgttcgtcatggtgtgagtttagatttggcgacattactgatagaagatatgaaacgtactctcgattatttcgaaaaacatcctgtcagcacacctttatctgaagaggacggcggtggctttaaccacagctaa

SEQ ID NO: 685 - DNA, 1374 bp, Proteus mirabilis
ctgctgagcttggatcacattcagaattacaacttgatactaaataaggacggttccatgtcttactttgataaaattgaacaaattcaatatgaaggtaccaccagcgataaccctctcgcttttcgctactataatccagatgaaattattttagggaaaagaatggaagatcatctgcgatttgctgcctgctattggcataacttctgctggaatggttcggatatgtttggtattggtacgtttgatagaccttggcagacaccgggagaagcactagaacaagcaaagcgtaaagcggatgttgcttttgaatttttccataaactcaatgtacctttttactgttttcatgatgttgatgttatctctgaaggaaatagcattaatgaatatatcaccaatatggcagcaataactgaggtattagcgcaaaaacagcaagaaacgggcgttaaattattatgggggactgcaaattgttttactcatcctcgttacggagctggtgctgcaacaaatcctgatccagaagtatttgcttgggcggcaactcaagtttgtgaagcgatgaaagcaacaaaaacgctgggaggcgaaaactatgtgttatggggaggccgcgaaggttacgaaacattattaaatacagatttacgccaagagcgggaacaaattggtcgttttatgcagatggttgttgagcataaacataaaattggatttcaaggtacactgctcatcgagccgaagccacaagagccaactaagcatcaatatgattatgatactgcgacagtttatggtttcttaaaacaatttggcttagaaaaagaagttaaagtgaacatagaagctaaccatgcaactttagcgggtcacagtttccatcatgaaatcgccacagctattgcattaggtattttaggctcagtcgatgctaaccgaggtgatccacaattaggttgggacacagaccaattccccaatagtgtagaagaaaatgcattagttatgtatgaaattctcaaatccggtggttttacgactggtggattaaactttgatgccaaagtacgtcgtcaaagtaatgataaatacgatcttttctatgggcatatatccggaatggacaccatggcaatggcattacgtattgcagcaagaatgatccaagacggtggacttgataaatttattgctcaacgttatgcgggatggagtgctaaacttggccaaaatatcctacaaggcaaattaagtcttgaagaagtggcaaaatatgcacaaagcaataccttagcgccccgcttacaaagcggacgtcaagagatgctagagagtttagtgaatcgttatatttttggttaa

SEQ ID NO: 686 - DNA, 699 bp, Proteus mirabilis
aataacctagtttataaatttaacgacaataggtttctatcggttatgaaaaacggctggcttaagcaattacttgatttcgctccactattagtgttttttatcttttataaatggcaagatattttctatgcttctggcgcattaattgtagcaacatggatctcagtcggtttaacatggcttattttccataaagtcgaaaaagcaccactgatcaccgcaatcgttgtaacgatatttggtacattgactatcgctttccattcagatgtctttattaaatggaaagtcaccgcaatctacgccatttttgcgctagtgcttattgcgatgcaactctttacgccgaaaacattaatggaaagaatgctaggtaaagaattagcgatgccagcgactaattggaaaaaactcaatatcgcttgggtactgttctttttagcttgtgcgctgggtaatctttatgtcgcattttctttatctcaagaaacttgggtaaactttaaagtctttgggttaacaatattaaccttaatctttactgtgattagtgttgtgtatatctggaacaaccggttacccgaagaagagacgaaagaggaatcaacagaaagtcatacatctgaaacatcagataacggaacaacatcaacatctaaagtattacataaagatgtgacatctaaatctgaataa

SEQ ID NO: 687 - DNA, 693 bp, Proteus mirabilis
aataaaacagtgacgccatataacatattgattgttgaagatgaaaaagagatcttacgattcgttcgccttgcattagagaacgaaggttttcgtgtttatgacgcctcagaatgtcaacgaggattaatagaagcagcatcaagaaaacctgatttagtcattcttgatctgggattacctgataaagatgggctttgctttattcaagatttccgtcaatggagtagcacgccgattattgtgttatccgccagagattctgaacaagataaagttgatgctttagacgctggagctgatgattatttaactaaacccttcggtatgagtgaattactagcccgggttcgtgcttcattacgtcgttttgtcaaacaagaaacagaaacgactcaatttacatttggtgatatcactattgattgggttaaaagaatagtcactcgccaaggcgtacccattcactttactccgaccgaatttcgtctactcagtgaacttgtcaacaatagtggaaaagtattaactcaacgtcatttaatgcagcatgtttgggggcctaactttgtagagcatagccattatttgcgaatttatatggggcatctacgtcagaaaatagaaaccgatcccacctgtccagtgcacttaattactgaaacggggatcggttatcgttttatgccttaa

SEQ ID NO: 688 - DNA, 930 bp, Proteus mirabilis
gttcgtcaagtactttatggcatactcttaaaaattcgttgtatcactgaggataaacagggagaaggaatgactgaattgctatctgatttacgcgtgatttatgatctgcatagccatactactgcatcagatggcgagctctcacctgatgaattaatcgatagagccattgaaaaacaaattacggtattagcgataaccgatcacgatactactgctgctatccaacctgccaaaaattatattgcagaaaaaagtttacctttaactttgatatcaggtgtcgagatatcaactttgtgggagaatatagaaatccatattgttggattacagattgatatcgaacaccaagctatgacgacatgcctagcaaaacagagtcaatgccgtgaaactcgcgctaaaatgatcggcgaacgtttagctaaagcgggtattgctggggcatgggaaggggcaagtgccctagcgaaaggcgggcaagtgacacgaggacactttgcgcgttttttggttaatgaagggcatgtggcatcggtcaataaagtatttaaacgctatttagcaaaaggaaaaacaggttatgtaccgccacaatggtgctcaattggtgacgctgtcacggctattcatcaagcgggtggagttgcggtattggcacatcctggtcgctatggtctatcctctaaatggttaaagcgattagtgctttattttaaacaacaaggtggtgatgctatagaagtggcacaatgccaacaaccaccacaagagcgagaacaacacgcagctttagcacaagcttatgatcttaaagcttcgttaggttctgattttcatcgcccttgctcgtggatagagctaggacgtaatttatggttacccgctaatgttgaacctgtatggacattatggcagggataa

SEQ ID NO: 689 - DNA, 276 bp, Proteus mirabilis
agagcgcaagtaaacactgaagagatttccgaaaaaaagaatataacattatatgttaaaaagttgcatcatcttgattataaggaaaagggcatgaaagcagggcgatacattggtgtgatgtctggtacaagtttagatggtgttgatgtggtgctggcagccattagtaataaactggttgctcaacaagccaaccattttttaccttatcctcaaaccttgcgtcaacgcattttagccgtttgccaaggcccaacctgtgacgttgcatga

SEQ ID NO: 690 - DNA, 1260 bp, Proteus mirabilis
ggggttaaagtgtctcaggacaacaattatagtcagggcccggtgcccatatccgcaagaaagggtggattagcgttaacctttgtgatgttgggattaacgtttttttcagccagtatgtggactggcggcgctcttggtactggtctctcctttaatgatttcttcctcgcagttcttatcggtaatcttctccttggtatttacaccgcatttcttggttttattggttctaaaacaggtctcaccactcatcttcttgctcgttactcttttggtattaaaggctcttggcttccctcatttttactcggtggtacacaagtcggttggtttggtgtcggtgttgcgatgtttgctattcccgttggtaaagccacggggattgatattaatctcctgattgcaatatcaggaattttaatgactatcaccgtgttttttggtatctctgcattaactatcctctccattattgcggttcctgctattgctatcctaggaagttactcggtatatcttgcggtacatgatatgggagggcttaatacactaatggctgtgaagcctgccgaacaacttgattttaatttagcccttgccatggtggtaggctcttttattagtgccggtacattaacggcggattttgttcgttttggacgtaaccctaaaattgccgtgattgtcgctattgtggcttttttcttaggaaatactttgatgtttgtctttggtgctgcgggagcggcatcattaggcatggcggatatttccgatgtgatgatagcgcaaggtttattactgccggcgatcattgtattaggtttaaatatctggacgaccaatgataatgcgttatatgcatcagggttaggttttgccaatatcacagggttatccagtaaaaaattatctgtggttaatggcattatcggcacattgtgtgcgctatggctttataataattttgttggttggttaacctttctatccgcggcgatcccccctgtaggtggcgttattattgcagattatctggtgaatagagcgcggtataatcaattcaatgctgacaaaatgcaaaatgtgaactgggtagccttacttgctgtggccatcggtattgctgccggtcactggttaccagggatcgtacctgttaatgccgtattaggtggcgcaatcagttacgcggtattaaatccaatattaaatcgtcgtacagctcgacaagcggagataagtcatgctgggtaa

SEQ ID NO: 691 - DNA, 645 bp, Proteus mirabilis
catcaaaaagtcgttgagggatatatgagccaacttttttacattcaccctgataatccgcaggctcgtttaattgaacaaagtgcggatgttttacgcaaaggcggagtggtaatttatccaacagattcaggctatgcgataggttgttgtttggataataaagatgcgatgacgcgtatttgtcgaattcgccaactcgataaacatcataatttcactctaatgtgtcgagatttatcagaaattgccacttatgcctatgttgataatgttgttttccgtttaattaaaaataatacgcctggtaactacacctttattttaaaagccaccaaagatgtacctaagcgtttaatgaatgataaacgtaaaacaattggtttacgtgtaccttctaatcctattgcgctggcattattggaaaatatcggtgagccattaatgtctaccagcttaatattaccgggtaatgattttgcagagtcagatccggaagagattaatgacttattgggtaaacaggttgatttagtgatccacggcggttacttggggcaaaagccaaccacggtgattgatttaacagaagatagccccgttattgtccgtgaaggaatgggcgatattacgccttttcaataa

SEQ ID NO: 692 - DNA, 714 bp, Proteus mirabilis
  unsure (94),(95),(98): Identity of nucleotide at the above locations are unknown.
ccgggaaaagtttgtaatgagtttaacgcaagaagggttagaatctataatgatttaaaatcatttattctgcaagaaaaagagataccaaaannacncacatcgggcgttattaataatagcattcatgtttattatgattggggtaaaagtcaatatttaacagcactctatcaagcagccaataagaattgttcacatataaatatgatgagattttcgaaagataattttgaagagataccagattatgatggaaacacgttaatcttaagctcagataaaattattagtgaaaagtttagcttaatacatcaagttaaaaataaatatctaggaatatgttgccaacaaatcttagcacaaaaagcacaagagaatatcaatacattgctaaaagaaaatatttggttatgtgatcccgctttatataaaacagcaaaaataaagaaattagaaaatgaaatagcggatcagggtaaacctgtcagtattagattgatggatgatttaaattgttgtttaaactttattcaaactcaccattcgctattatttactgatgaaaacccgattaaaagtgaggatgaaaagcaactgtgctttatacctttaacacaaacggagctgatttataattgttatatctataaatctaaatatcactcgagtatattgaacaggtttgttgatttaatcaaagaattggaatga

SEQ ID NO: 693 - DNA, 1047 bp, Proteus mirabilis
aggtcaggagttttccacaccatggcaacaataaaagacgtggcaaaacgcgcaggcgtatcaaccacgactgtttctcatgtgatcaacaaaactcgttttgttgctgagaacacaagagcggcagtttgggctgcgataaaagaattaaattattcgccgagtgctgtcgcacgtagtttaaaagtcaatcacactaaatctattggtttattagccacgtccagtgaagcaccttactttgctgaagtgattgaagctgttgaaaatagttgttatagcaaaggctacacgctaattttatgtaattcacataataatcttgataaacaaaaagcttatttagctatgttggcacaaaaacgtgttgatggtttattagtcatgtgttcagaatatcccgatcatcttctttctctcttagaaggttatcgtaatattccgatggtcgtaatggactggggaaaagcccgcggtgactttactgataccattattgataacgcattccatggtggctatatagccggtcgttatcttattgaacgaggtcatcgtgatattggtattatccccggccctctagagcgaaataccggaggcggtcgtttacagggctttttaaaagccatggaagaagcgaaaattacggtaaaagaagagtggattgtacaaggtgactttgaacctgaatctggttacaaagccatgacccaaatgctcaatcaaaaacaacgccctactgccgtattttgtggcggtgatgttatggcgatgggggcaatatgtgcagctgatgaattaggattacgtgttcctgccgatatttccattgtcggctacgacaatatccgtaatgcacgctatttcacaccagctttaaccacggttcaccagccgaaagagcgtttaggacaaatggctttttccatgttactcgaccgtattgtgaataaacgcgaggatgcacaaactatcgaagtacacccgcgtctagtagaacgtcgctctgttgccgatggtccatttattgattatcgtcgctga

SEQ ID NO: 694 - DNA, 972 bp, Proteus mirabilis
ccatatttggttattaccggccaccctattagggggagcaatactcttattagccgcagataccctgtcaagaaccttggtatcccctgcggaaattcctgtaggacttattaccggacttcttggtggaccttattttctttggcttattttacgacaaccagcaggacgcatgtcatgatggaaaatcaacacactccattattatatggcaataacttgagctataaaatcggcaataaaactattcttgaggatgtttctattgcacttaataccggtgagcttgtcacaatcattggtccgaatggtgctgggaaatcatcattattacgtttattgaccggctatactcccccgacacaaggagaatgtttttttaaagggaaaacttactcacagtggaatagtcaattattagcgcaaaaccgtgctgttatgcgacaaaacagccagctatcattctctttttctgtagaagaagtcgtcgctatgggaagagcgccacatgggcaaaaacataaacaaatcgcaatagaaaccgcgctattacaaaccaattgtttaaagcttaaaacaagagattaccgtcaattatcaggtggagagcaacaaagagtgcaacttgctagagtgcttgctcaactttggcaaccgacacctgagaatgttgcgctatttcttgatgaacccacatcggcacttgacctctaccaccagcaacaaagtttgcgtttattaaagcaactggtcaaaacgcaaaatttgatggtgtgttgtgttctgcacgatctcaacctcgcctccctttatgctgatcgtattttattactgcatcagggaaaattagtttgcgaaggtacacctcaagatgtactcaccgctgagaatattgaaaaatggtatggcgccgaggtcagtgttaatactcatcctgagttatctcaacctcaagtttttttacgcccataa

SEQ ID NO: 695 - DNA, 861 bp, Proteus mirabilis
ctatgtttggtagtcgtggtgctgaacaactgggtatttatcgtcatcatcaccaacataataaggagtgtcatcatgattgagttgctgttaccgggctggatcgccggtatgctcttagcgatggccgcaggtccattaggctcctttgttgtttggcgcagaatgtcctattttggcgataccctcgcccacgcctctttattgggggtcgcttttggcctgctgtttaatatagagcctttttatgccgttattgccgtaactttgctgttagctattttattagtttggttagaactaaagcctcaactttctgttgataccttgttaggtatcatggctcatagcgccctttctttagggcttgttgtcgtcagtttaatggccaatgttcgtgttgatttaatggcgtatctctttggtgatttactctccgttaattaccaagatgtgatcagtatttttattggtgtcgttattgttttattagtgattatccgttcatggcgtccacttctttcaatgactattaatcaagatatggcttttgtcgatggtgtgaatattcaacgcgaacgtttaaaattgatgatgatcaccgcattaacaattgggttggcaatgaaatttgttggtgcacttatcattacgtcactattgattattcccgcagcaacagcgcgccgtttttcacgttcaccagaacagatggcagtgattgccgtcgctgtaggtatgtttgctatcactgggggattaactttctctgcattctatgacaccccagcaggcccatcagtagtattagccgccagtagtttatttgtattgagcttgcttgtaccagcaaagcagtag

SEQ ID NO: 696 - DNA, 312 bp, Proteus mirabilis
ctgataatggtggtaaaaaagtattatagtgacaatccaactgaaatgatttatcagctcaccggtatggtgatccctttaaaaaatttacgcgcttggttaattggtttaccgggtgatgccacggattttgaactcgatgcaaatcatcttttaaaatcggttacatggccaaccccagaaggtgattgggtggtaacctaccaatcctatgacaccgcaataacaccgaacttgccacagcgccttgaattaaaacaaggtgaacgcacgataaaattaaaaatggataactgggatatacagcaatga

SEQ ID NO: 697 - DNA, 1740 bp, Proteus mirabilis
ggtaacccggtgaatattcaggcttttctttcagaaaaaatcagtatggcgatgagcgctgctggcgcccctgctgatagcgaaccacttgtccgtcagtcagctaaagtgcaatttggtgactatcaggcgaatggtgtcatgggagcggcaaaaaaaatgggtatcccaccccgacaactcgcagaaaaaattctggaacaccttgatatcacagatattgcagataaagttgaaatagcaggccctggttttatcaatatcttcttatcacccgtttgggttgcacaacaagccgaattcgcattagcggatgagcaccttaatattaccaaggtaacccctgaaacgattgtgattgactactcatcacctaacgttgcaaagcaaatgcatgtgggtcacttgcgttcaaccattattggtgatgccagcgcacgtactctctcttttttaggtcataatgttattcgcgctaatcaccttggtgattggggtacgcaattcggtatgctgattgcttatttagagaaaaagcaaaatgaaaatgccgcagatatggcattagcggatctcgaagagttctaccgtgaagctaagaaatgttatgacgaagatgaagtattcgctgaacgtgcccgtaattatgtcgttagactacaaggtggtgatgaatactgccgtactatgtggcgcaagcttgtcgatatcacaatgcaacaaaatcagctaacttatcaacgccttaatgtcactttaaccgaagatgatattatgggtgaaagtctttataacccaatgttgccgggtattgttgctgatcttaaagcaaaaggtcttgctgttgaaagtgaaggcgctactgttgttttccttgatgaatataaaaacaaggaaggcgaaccaatgggagtcattatccagaaaaaagatggtggttacctttatacaacaacggatattgcctgtgctaaatatcgccatgaacaattacatgcaaaccgcgtattatattacatcgactcacgtcaacatcagcatttaatgcaagcttggactattgtccgtaaagcaggctatattcctgatagtatgtcactcgaacaccatatgtttggcatgatgttaggtaaagatgggcgtccatttaaaacgcgctcgggtggcacagtacgtttaactgacttactcgatgaggctcatgaaagagcattaacattaattcgcgaaaaaaatcctgatatggatgaagaggaattaaataatattgctcgtgtagtgggcattggtgctgttaaatacgcagatttatcaaagaacagaaccaccgattatattttcgattgggatctgatgttaagttttgaaggtaatactgcaccttatatgcaatatgcctatactcgtgttgcctctatctttaaacgtgcagaaatagatgaaagcgcattaacccagcctatctcattaacacagcctcatgaaaaacaactggcactacgtttagtacagtttgacgagactatcacgcaggttgcacgtgaaggtacacctcatgtgatgtgtgcatacttatatgatttagcgcagtccttctcaggtttttacgagaactgccctattctatcggccgaagatgacaatgtacgccaaagccgtcttaagctagcacgtttaacagcaagaaccttaaagcaaggcttagagactttaggtattgaaactgtcgatagaatgtaa

SEQ ID NO: 698 - DNA, 609 bp, Proteus mirabilis
gaatataaggtttatcctatgagtgatgcacaacaccaacagcgccaacaacgtttgaaagaaaaagttgatgcccgaattgcgcaggcgcaacgtgaacaaggcattttgatgatttttactggtaatggtaaagggaaaaccactgctgccatgggaaccgctacacgtgcggttggtcatcataaaaaagtcggtgttgtgcaatttattaaagggacatgggaaaatggagaacgtaatcttttagaacaagccggcgttcccttctatgttatggaaaccggttttacatgggaaactcaagataaagctgccgatacacaagcctgtttaaatacttggcaatatgcactgcaattactcaattcacctgactatgatttagttgtcttagatgaacttacttatatgatcagttttcattatctaccacttgaagatgtggttgcggctattacttctcgtcctgatcatcaaagtgttattattacaggacgaggctgtcatagacaattaatagaattatcagacaccgttacggaaatgcgtcctattaagcatgcgtttgacagtggtatcaaagcacaaaaaggaattgattggtaa

SEQ ID NO: 699 - DNA, 948 bp, Proteus mirabilis
ctaaataaggttatagagatgagcaaatatgatgcaatacagcgatttaatctctgttttcaacaacttgaaacagaaatcaatgctcttaccgattttcttcgtcagttaaagcaacttccttctgcggtttttgaattacctgaggtaagtaaagaagatgaacatgatgagataacaaatgttacagtgtcacctagttatgatcttgatgctttagaactctctttaaaattaatgaccaatctctttatctatgataatgccccacatgtcagtagcaagcgtgcgatacgtttaccgggggtactctgttttagtgtcagcaatcctgtatttaagaatgtaaaaacacaagtagagagcattaattcattaaaaaaacagctttcagatattgtgacgaaagagtctggtatttcgaaagaagaacgttttgattttgtccataatcagctaaaaggcttaattacacttaatgcttatcgcaccctcaccctactttctgatcctgatacagtacgttttggctgggccaataaaaacattataaaaaacttaactcgtaatgatgtgttagctcagctagaaaaaagtcgagaagccaatcgcgccgtacctccttatactagtgaacaatgggctgaacgtatcgataaagagataatgaccctttcacaactcccggaaaatgccaaattaaaaattaagcgtccagtgaaagtccaacctattgccagagtttggtattcggagcaacaaaaacaggtacaatatgcttgtcccctaccattattagctttctatattgataaagagtcagactttaagcccataataggtgaattagctgattatgatgtgaataatattcaaattcgccatcgccctaaagccaaaaagttacaattaattattccacgcttacatttatatcttgaaaaataa

SEQ ID NO: 700 - DNA, 732 bp, Proteus mirabilis
attttaaaggtacaccttatgctaattgatattcatcatttacgcgttcaatttgaacaaaatagacagattaagcaggtggtaaaaggtgtcaatctacaagttaaacaaggcgaaacctttagtttaattggtcgttctggttgcggtaaatcaactgtattacgggttatagccggattattacatcattggcaaggggatattaagttgttagggcaagcaattaagccacagcaacgctttcaaggtaagttacgccgtaacatacagatggtgtttcaagatccctatgcttcattacaccctcaacatcggatagaacgagcatttattgagccgttaaaaattcatcatattgcttatgataaaacaacaataacctcagcgttagagcaagtcggtttagaaggcgatattgcttatcgttatccacatcaactatcaggtggacaacgtcaacgtgtggctatagccagagcattactgttgcaaccacagttgttattgttagatgagccaacctctgcactggatatgtcggtacaagcagaaattttaaatctgcttaataccttaaaaaaacaacataacatgacttaccttttggtcagccatgatgcagatgttattgcacatatgtcggatagcgcagcgctaatggaagagggtcaattgacttgctattatgatagaaaagcgctttctcaagggcttcatcgtcttgattaa

SEQ ID NO: 701 - DNA, 423 bp, Proteus mirabilis
aatgttgaggtgtttatgattgataaaataatgacatatgttaataaattaacagaggttggtgtttttaataattataaatcaacaaattatatttccgatgtgtctaatacccctgctgtatataatacaaatattaaacagtttagcttaaataatgtaaataattatgtttatcttggatcaacaaatagtccactacttaataatatgggaattacccttgatgatgatggaaccttaatgttaataaaagggaaaacatatgatttatttaccggattaattcaaaagtactttaatggaggttttaaatataatgtatttcatatcaactctcaacatggtgatgatataaaatttaaagaactatatgtcgattataatgggtttttaattgggagtaagagagatagttcatga

SEQ ID NO: 702 - DNA, 399 bp, Proteus mirabilis
cgaagtgaggttcagatgaaaattacacaccttgatcatttagtattaacagtggctgatatcgaggcgagttgtcatttttatcataatgtattaggttttgagataattacctttaaacaagggcgtaaagcccttgcttttggtcatcaaaaaatcaatcttcatcagctaggaaaagagtttttgcctaaagctgctaaaacaacggcaggctctgcggatttatgttttattactgaaacgccattgttagacgtgatagagcatataaaccagcagggtatcaatatagaagagggtcctgtaccaagaacaggggctacaggacctattatgtcagtttacttacgtgatccagataataacttattggaaattgctaatattattgaatag

SEQ ID NO: 703 - DNA, 285 bp, Proteus mirabilis
tttgtagaggtcatcatgaaaaaagcccgttttactgaaactcaaatcgttaatattttaaaactcgctgattctggtatgaaagtggaagatatttgtcgccagaatgggatcagtaatgccacttattataattggaaatcaaagtatggtggtatggaaactaatgatattaaacgattaaaagaacttgaagatgaaaatgctaaactgaaaaagctatttgcagaagtcagccttgaaaatcatgccatgaaggagcttttcgcaaaaaagggttggtga

SEQ ID NO: 704 - DNA, 198 bp, Proteus mirabilis
ctatttttattgtatttaaagcctgaccgtgttctggtagcctttttcggcttattaaaattagaaatgtatcatgggcatcattttcaaaacgctgatgaactgattgataaaattgaggaatatatcgagtattacaataccaaacggatcaaggttaaattaaaaggcctgactcccgttgaatatcgaaattag

SEQ ID NO: 705 - DNA, 192 bp, Proteus mirabilis
aaaaatttattttctagcttttatctctatacagttatttataagttatgtataaatatacagctggacagttttcaccagaaaatcaccaaacacaacaataatccattaatacaaataattaaaatgataatatgttctcaaaaaaatctcgttctacaactgcactactcttttcatcacttattctga

SEQ ID NO: 706 - DNA, 192 bp, Proteus mirabilis
aaattgttatttaactattttcttacacacagtaaatcacaaaaaattgggttatttatggcaaaaggaaggttaaataatttatatgaaaaatcaaaaaacgaatcgtttttttgtttacggcattattattgttgcaattattgcagcaggtattttttggtggaaaacacaagcaccagcactccctga

SEQ ID NO: 707 - DNA, 429 bp, Proteus mirabilis
gtatttctatttatatcttttattagtgccttttttatatttaagttagcattatcattttctaagttaatattatcattttctaagttaacattatcattttctaagttaacattatcattttctaagttaacattatcattttctaagttaacattatcattttctaagttaacattatcattttctaagttaatattatcattttctaagttaatattatcattttctaagttaatattatcattttctaagttaatattatcattttctaagttaatattatcattttctaagttaatattatcattttctaagttaatattatcattttctaagttaatattatcattttctgtatctaagttagtattatcattttctatcgctttgcttacgagctgtcttattgcactaaagttaacttga

SEQ ID NO: 708 - DNA, 1713 bp, Proteus mirabilis
tccattctatttttaattttaatgactgaaacagaggagataacaatggtctatgactacattattatcggtgctggttcagccggtaacgttcttgctacccgcttgacagaagatcctgatgttactgtgctgctccttgaagctggaggaccggactacaggttcgattttcgcacacaaatgccagcagcattagcttatccgttacagggtagacgctataattgggcttatgaaacagagcctgagccacatatgaataaccgccgcatggagtgcggtcgaggtaaaggattaggaggatcatcactcattaatggtatgtgttacattcgtggtaacgcgatggattttgatgagtgggccaaattacccggccttgaagattggaattatttaaattgcttaccctattttcgtaaagcagaaacccgagatattggggctaatgattatcatggtgatagtgggcctgttagtgtgactacaccgaaaaaggggaataatgttttattccatgcgatggtcgaagccggtgtacaagctggatatcctagaactgatgatctcaatggttatcagcaagaaggatttggccctatggatagaacggtaaccccccatgggcgtcgagccagtacggcacggggttatcttgaccaagctaaatcgcgcaaaaacttaactattgagacacatgctacaaccgatattattgaatttgagggtaaaaaagcaagtggtgtgcgctattttaaaggaacgaataccacgccacagcatgtgaaagcacgtaaagaaatactgctttgtgccggggcgattgcatcaccacaaatcttacaacgctcaggtgtcggccctgaagatgttctcaatgagtttgatatttcgccagtacatgttttaccgggtgtagggcagaatttgcaagatcatctagagatgtatctgcaatatgaatgcaaacaacccgtttcactttatccggcgttaaaatggtataaccaacctaaaattggtgccgagtggttatttaaaggaacgggtattggcgcgagcaatcaatttgaagcagggggttttattcgctcaagtgaaaagtttgcttggccaaatattcagtttcactttttaccagtggcgattaattataatggcagtaatgcagtggaagtgcatggttttcaagctcatgtggggtcgatgcgttcacccagtcgcggacgtataaaaataacctcacgagatccacatcagcatccaagcatcttgtttaattacatgtcaacagagcaagattggcaagagtttagggctgctattcgtatcacgagagaaattatggcgcaacctgcattagatccctatcgcggtgaagaaattagtccggggaaagatattcaaacggatgaacagctggatgcttttgtacgtgaacgggcagaaacagcatttcacccttgtggtagttgtaaaatgggaaatgatgaaatggccgtcgtagatggtgccggacgcgttcatggtatagaaagattaagagttattgatgcttccattatgcccaatataattactggcaatttaaatgcgacaaccattatgattgctgaaaaaatggcagacaaaattaaaggcattaaaccattgccagcaagccaagcagattactatgttgctggacattcacctgccagaagaaattaa

SEQ ID NO: 709 - DNA, 315 bp, Proteus mirabilis
gaaaagctattcataccagatgaatacaatgttattctgttactaggcattatttttaggttaataaacaaacgatataaagggaaattcaccatgaatgagaagtttaaaacacaagcagatgttgaaacattagcgcaagaagttgcatgcctaaaaacgcttgtgacttatatgttaaaagcattaggtcaagcagatgctggacgcgttatcttaaatattgagcgagctatttccgaagttgctgatgaacaacaagcagaaaccttccgcaacacattaaaccaaattaaaacagcttatcgtcaataa

SEQ ID NO: 710 - DNA, 750 bp, Proteus mirabilis
atgattatatttatcaccggtgcttcagcaggttttggagaagctattgctcgtcactttattaaccatggacacaaagttattggtaccgcgagacgtcttgataaactgcaagctcttcatcaagaactgggcgatctattctatcctttacaattagatgtcaccgataaaaaagcagtcagtgaaatttatcatcaattgccagaacaatggcgctcaattgatgtattaatcaataatgcaggactcgctttagggttaagacccgttgataaagccaatcttgatgattgggatactatgatcgaaactaataataaaggtttagtgcatgtcactcgtgcattactaccctcaatggttgaacgtaatgtcgggcatattattaatatcagctcaacagcggcttcttggccttatatggggggaaatgtgtatggtgcaaccaaagcctttgttaagcaatttagcctaggcttacgtgccgatcttcaaggtaaaaaaatacgtgttactgatattgaacccggtcttgtggggggaactgagttctcattagtacgctttaaaggtgataccgataaagtagaacaaacttatgcaggagcagatgcgcttactcctgaagatgttgcacaggcggttttttggacggcaacattgcctgcacatgttaatattaatacgcttgagatgatgcccgtcagtcaatcttttgccggattaagtgtgcaccgacaaaattaa

SEQ ID NO: 711 - DNA, 213 bp, Proteus mirabilis
tcattaatattgtcagctaaaaccactttattactatctaagataaaagatgtttttacgctattttttattgaaatagcagtgttctttttaatattcaatatactattagcgttttttattattgatggacagtttgatatcttcaatataacttcttggttttcttttgatttattattatccattatgtattcacagctagtttcatag

SEQ ID NO: 712 - DNA, 2502 bp, Proteus mirabilis
ctaaaaatattaaagataaaaaagtacattggaagagagtcgatgagtatgagcagactatcattgcaaccccaaaggaacttatttatgagtaagataagttttagactaaaaacatctttgctattgatattaaatgcataccctttcttttctattgctaacaataatattcattctctatataaaagtgtattgtcaaatattgataataaaaccatcggcaagttattaaataatgaacatcctgatggttattactcaacaaatatttatatcaacgaaaataaaaaagaaaccattattttatattatgaaaataaagacggtatattaacaccaaggattaatgttaatgatttaattcgtttaaatattgatccatctttttataatattcctattgatttaagttctgatttgttattaagcgattacaatattgattttaaatataatttctcctcgcaatcattatatttaactattccacaaaaagccttagataataaaaaaaatatgcttgctagccaagttttatgggatgatggtgtccctgctttgtttagctcatattcttattttggcaaatataacaatcaaaataagatagaacacaaaatcagttttaactcaggtgctaacttaggtgcttggcgagtacgtagtaaaagttattatcatcatacggataagcaacagcaatttaagctatactcattatatgcttatcatcaattaaatacgctgttggcaacgcttaatgtgggggaatttcgaccaaccagtagaatgttatcaacagataaattaattggatttcaacttatatctagtaatttgctctctggtaatgatctctatatgaatagtcctatcatagaagagattgcagaatctcatgctgaaattaaagtgaaacaacaaggaagaaccatttatgaaactattgttcctcctgggccttttattttaaacgatctacctgttataggtagcaatgaattggtattagaaataaaagaagcagatggacgtataagaaaaagtactcattactttactacaatgccaaaccaattaaaaaaaggtcgttatcaatataattttatttctggatattcttatgatagatataaccagtttaataatcaaaataataaccctatttttttactgggtgagttctcctatggtattaatcaaaaaataaccgcttatggtgcaattagaaagaagctgaatagcaatactttcttttcaggattatcattagatttaggacgctgggggggagtagccagtgatattagttattttgaacacaataatctattaaaataccagttgcgctataataaacgatggagcaatattggtacttctttaaatatatcttctagccattatcaatcaataaaatctgatagtgttagcattagaaaaagtcaaacagacaacataaaaaatagctatacaatttctctctttcaaccgattaaatctttcgggacattttctattggttatcatcaaaattcttatgccaaaagaaaaaatgactttacaatcaatacttctctatcatcttctataaaaaaaatgaattatagtataaaatatcaatataaaaatgaaaaatattataatgacaatcatttttctttaaattttaatattccactaacaaatagctctcaatcctatcattgggtaagcaatcaatttgattatcatccaaacaataaaggttatataaatagtacgactataggtggaagtttattagaacactatcgcttaggctattctattaattaccgacgggattttagccacccaaatgctggctatcatacttcagtaaatactcagtataaggggagatatcaatcttattctattaatacaactaaatcgtctaataataaaaccaatttaagattagggattaatggtgcaatagtgttacatcaaagtggagtaactttggcacctgacttaggtaatacttttgctattgtaaatacgaatggcattgccggaattaaaactaatcgttcttcacaagccattacagacaataacggtaatttaatattaccgcacatcatgccatatcgtaaaaatactattggactaaacataaattcgttacctgagtttagtaatactaaaactcaaagtaaaatcatcgtacctactttaggagcggtagcaaaaatcaatttccctataaataggggctataatgttttatttacctcaaatacaccaattccttttgctgccaatgtaatggcatttgatgataataataatctcatttctagtgattctgtctatgaccacaatagaatattcctctccggaataaaagaaagcggaacggtacaagtaaaatggggagatacagaggagcaacaatgtttcttccattataacgtaaaaaatgaaagtaaaaataattcaattattaagaaacaaatttattgccaataa

SEQ ID NO: 713 - DNA, 207 bp, Proteus mirabilis
gttttagtattactaaactcaggtaacgaatttatgtttagtccaatagtatttttacgatatggcatgatgtgcggtaatattaaattaccgttattgtctgtaatggcttgtgaagaacgattagttttaattccggcaatgccattcgtatttacaatagcaaaagtattacctaagtcaggtgccaaagttactccactttga

SEQ ID NO: 714 - DNA, 2412 bp, Proteus mirabilis
cgaatagtattaattatgataaagttatctcctatttctttactcttattatttacgccctatgtatatgcaaatgcactttacttacaagcaattgaaaaccacaatggaaatattgatttttcactcttgcttaatgaaaattttctcgaaggaacctataacataacaatttatataaataacaataaaaaacaaaattctgagatatcatttaaaaacaaaaacaataacttaactccaataataactctatttgatttaaaacaatggggaataaacaccaattattacgagcctttaaaaaataagttagacaacgatatcgttgactatgatttattaaaaaaattatttaatataaaattagaaattaacaaacaatcgatttactttaaagtaccattaattgcgatagaaaaaaacacttcatattccaaagaaaaattggatgatggtgataatgctgctttcattaaatacaactatcaaggccattattataaacaaaatagtttaaatggacaacacatacataacctacagctatataatggaattaatttatttgcatggcgttatcgtcaagatctaaactataataataataataattctttttctataaaccagcaatatgtatataggacacttagaaatattaattccattttaactatgggtgatttctatgcttattctcctaacttaaacacttataaaatactaggcgtgcaaatcaatagcgataatgcaatgaaagatggctccctagtaggttatgcacccattataagtgaaaccgcctatacctatgcagaagttagtattgagcaaaatggagaaacactatatagcacatctgtaccacctgggccatttactcttaataaccttccctctttaggtacaaatggtgaattagtattaattataaaagaagaaaatggcgaagtaagaaagaagaaaatctggaattattcttcacagtatttattaagaaagaaccaatggaattattactatactatgggtttagtaaacaatcctcaaaaaagacagtttccttctaataagaaaaaagaactattaactcaattgaatttaagctatggagtgagcaattatttaacgacaatgataggagctgaaaaaaaaggagatgatattaaagcacttattggaaataccctaggattaaatatcctgggtatagtctcattagaaaacgcttggataagagagaaatatcatcaacaatatcagtccaataagattaattaccaaaaagtattttctatggaaaatacaactatttcattaaactcatcattctactttagatttaaagagaattatgctgtaaataaagaatataagaaatatgatttaggatttcacttttcacaatcattaaataataatattgctttaacgttggggtataatattgcaacctattatcactcaaaagaaaaaagccaacgactttttattaatactagttcaaattataaaaaactttcctattcattagagctagagaatagcaaagatcagtatagcaataataatcaattatcaatttttttaaattaccctattggtcaagatctctctcattgggcaacagcaaggatcaattatgataatagagaaaaatattttcatgagaatatttcatttagtggaaatacattagaaaataatcggttaaattataaccttgatttttctaaaaataataaagaacgcttagattcatcaatgaaaattaattatttaagtaggatagccaaactaaatataaactctcgatttaataaagatagttattctttaggctatggactcaatggcggcattgtgtttcataatggaggaataacgttagcccaagatctaaatgatagttttgctatcctaaattttgcaggtgctaagaaagtaaaaataataggaaagccaacaatagaatcagaccgaagaggttatttaatcattcctaatttaactagttatcataacaataagttccacattgatgcaaaatcattagattataattataatattgataattatagctatcatttaattcctactaaaggagctattattgcaaaaaatattaaggtaactaaaggagaaagtgctttatttacatttcaccaaaacattccttttggtgcaacagcctatgtgaaaaattctgatggcaccctatccgatatatcctatgtaaatgaagataataaattatatatttctaatttacctatttcaggaaagatttttgtaaaatggggaagttccaacaaacaacagtgctcatttaactatcaattaaatgataatgaaaaacaaaatagaatttattttaaaactgtaaattgcattaaagaggaataa

SEQ ID NO: 715 - DNA, 501 bp, Proteus mirabilis
tttgaagtatttttcaccctatattatgaggcgactatggataactgtattttctgtcaaattgtagcgggaaaagcaccttgccataaaatttgggaggatgaacatcatcttgcgtttctttcaatcttccctaataccaagggttttacggttgttattccgaaaaaacactatccaagttatgcttttgatttaagcgatgaagccttagcgttattgatcatcgccactaaaaaagtggcaaaaatcctagataaaacattcccagatgtgtcacgcacggtgatgttttttgaaggttttggcgttgatcatgttcatagcaaactcagcccaatgcacggtacgggtgatatgacaaaatgggcgcccattgaaaacagacaaaaaattttctttgataactaccctggctatctttcatctcatgattttgagcgcgcaaatgatgaggaattagcgcaattagctgcgcttattcgccaaaatagtcagtaa

SEQ ID NO: 716 - DNA, 348 bp, Proteus mirabilis
aaaggagtatttatgactgctaaaattgatccaaaagcattttttgacttaccctttgagaatggtaaagacattacagataaagaattaaaagccgcttatgatgcagggcacacttttatccatattgatttaagtgatgcgcatttctcaccacaaattaccttgttcaatggtaatgaattagatcgtattcgcggtggtgtaattcgtattgataataactcaacgaaatctactttagttgctgaagggccaagtaaaaaaccagagcaattaaaagccggttattattaccacgcttcaggtactacaggttgggatattattgttaagcctattaaataa

SEQ ID NO: 717 - DNA, 1656 bp, Proteus mirabilis
ctgggagtatttgataagatgataaatgtaactaaaaaaagtgcgctagcgatcgccattggtactatctttggttttacggcgctcaatgctactgcggctgttgtgcctgatggggtaaaactggctgataaacaagagttagtgcgtaataatggctctgagccacaatcacttgatcctcataaaattgagggtgtacctgaatcagcattagcacgagatctatttgaagggatcacgattgtagggcctgatggtgaaattctaccgggctctgcgactagctgggaaaataaagattttactgtttggacgtttaaaattcgtgaagacgcgaaatggtcaaacggtgaccctgtaacagcgcaagactttgtttatagctggcaacgtttagcagatccgaatacagcatcaccttatgaaagttatctacaatatgcccatattgttaatattgacgatattatcgccggtaagaaaaaaccgacggaactaggtgttaaagcgcttgataataataccttagaaatcacattatcagaggccgtaccttatttacctaaattgctagctcactcctcgatgtcgccagtgaatcaaaaagtgattgaaaaatttggtgaaaagtggacgcaacctgcgaactttgttggcaatggtgcttatgtactgaaaaattggacggtaaacgaacgtattgaattagagcgtagtccaacctattgggacaataaaaatacggttatcaataaagttacttttttacctatctcatcagaagtcaccgatgtaaaccgctatcgagcgggtgaaatcgatatgacttatagcaatctgccgattgaatttttccaaaaattgaaaaaagagatcccagatgaattacgtatcagcccatacttatgtacttattattatgaaattaataatgagaaagctccctttgacgatccacgagtacgtgaagcactaaaactatctatggatagagatatcatcacctataaagtgaaaaaccaaggtgatatccctgcttacggatttacaccgcctttcaccgatggcattaaagagagtaaaccagagtggttcgcttcttggacccaagagcaacgtaatgaaaaggcgcgccaattattagaagaggcgggttataacaaagccaatccattaaaattcaagttactgtataacacctctgatctacataaaaaagtcgcgattgcggcctcttctatttggaagaaaaacttaggtgctgaggtttctcttgaaaaccaagagtggaaaacgttcttagatacacgtcaccaaggtaattatgatgttgcacgtgcaggatggtgtgcagattataacgaaccttcttcattccttaacatgatgctgtcttacagcagtaataataccgttcactataaaaacaaacaatttgatgcgtatatgaaagaatctttacgcgtgaaatcggatgatgaacgtgcagaaatttatcaaaaagcagaaggtgtattagataaagattctgccattgttccactttactactacgtaaacacccgtttggttaaaccttatgtcggtggttattctggtaaagatccactggataatttacatactaaagacttgtatattattgctaaataa

SEQ ID NO: 718 - DNA, 1035 bp, Proteus mirabilis
ttatgggtattactaatgaataaagccttagtcggtaaaaaaattctcattattgatgatgaggttgtatttcgcaccatgctcactgagtatttttcacacgaaaaggcttgcgtttatgcgactgacaatggtagccaagcattgttgttacttgaagagggactaagacctgatcttattttatgtgatatcagaatgcctgttatgaatgggccgacttttttatgtcatctagagcagcgtcattggtctttccctgttattgctatttcatgtactgacaacatggctgaaattgatgatatgttgcgctttggcgctcaggacgtttttcttaagcccgtaactaatttagctaagttaaaacagaaggtcattgaagtattatgtccaggtttttttgagtctgaattaattgcaaggggacaacttggacctctttggaataacttacgagaacagcctcattatattcaatcctttgttaaacagatgcaaccgcaagttaaacaaattgtcgcaggatataatgttaattatcgtcaattaaatgatgcatcccaaatggggttgttatttgatatagcgactttatcaaaagatcaaatcattttttactgtgttgacgtctctaatgatgaagaaaatgggttactcgttgcgctgcttttaagggtggtttttaatcgtttcctaaaagctactgagaaaagacgcttcttacctagtatgtataacatattgaataaaatcaataaaatgcttgaggatatgggggtgagaggatcattcccgctgattttaggttattaccacaccaaggaaaaaaatatattattagcgtcagcaggactacgagctgaaataaaaacagagaataaaaaatatgttttaaatagtggtatacctttaggaacactacactctttatatattaaccaaataaagtgtgtgggaatagattggcaatgtaaaatttggaatcagcaccataaaattaatttaatgttctcacctatacataaacgttaa

SEQ ID NO: 719 - DNA, 1818 bp, Proteus mirabilis
tctttatcattagcgtttgtaaagctttttattgagaatttttctcaatttgttttttttgacaattttgggctagccagttttttaagttacaatagccaaatcgtttatctaaaagacataattatgcgccctattttacttattagtactatgctactggcttcaataagtatgacttgtatggcagagatagctaccaaagctacagagctatctgtcgcgcaagagcctacaaacattcatcaaaatggctttgtctattgtgttgatggcagtgtaaatacctttaatcctcaactttcgagcagtggattaattattgatcccctagccgcgcaactttacgatcgtcttttagatgttgacccttatacctatcgtttgatccctgaaattgccgctcgttgggagtctctcgataatggcgcaacttatcgcttttatttgcgtaaaaatgtgtcattccagacaacaccttggtttacgcctacacgtaaactcaccgcagacgatgttatctttagttttgagcgcatgttttctgccaataatccttataatcaagttaatggtggtaaatacccctattttgatagtttaagtttggcagataatatcaaatcaattaaaaagttaggcaaatacaccgttgaatttaatctaaaatctcctgatgcttcttttttatggcatttagcaacccattatgcgcctatcctttcagaagaatatgccagtaaccttgaaaaatcgggtaatcaatcgcaacttgattggaaacctgtaggctcagggcctttttaccttgatgaatttcagccaggccaatttgttcgattactgagaaatgagcaatactggaaaggtcagcccaaaatgcaacaagtggttatagacacgggtgcaggcggtactggacgtatatctaaactcttaacgggagagtgtgatgtattagcctatcctgcggcaagccaattaaaggtcttacgtgatgatcctcgtttacgccttacattacgttcaggaatgaatattgcttatcttgcgtttaatactaataagccaccgtttaacgatctaaaagtgcgtcaagccatcgcttatgcgattaataatgaacgactaatgggatctatttattacggtacggctgaaacagccgcatcggttttacctcgtgcctcttgggcttatgataatcgcgctaaaattaccgaatataatcctgaaaaatcgaagcaaatattaaaagagttgggacttgaaggacttaaattaaacctttgggtccccagtgctccgcaatcttataatcccagcccgttaaaaatggctgagttaattcaagctgatttagcccaagtaggtatccaaatgaatattcgacctatagaaggtcgctatcaagaaaccagtttgatggatagaactcatgatatgactttatcaggatggtcaacggacagtaacgaccccgatagttttttccgcccattatttagttgtgcggctattagttcgcaaaccaatttaagtcattggtgctcaccggcatttgataatgtgctacaacaggcgctttatagccaacaactggcctctcgtatagactattatcaccaagcacaagatattttagcgcaagagctaccggttttaccattagctaattctttacgtatgcaggcttatcgttatgatattaaaggacttgtattaagtacatttggtaacgcttcttttgccggtgtgtatcgcgaagcagaagttgatgaggatagtcacaaccaagaggctacaacaaacccatga

SEQ ID NO: 720 - DNA, 600 bp, Proteus mirabilis
gcaatgtcattagaagaaaaaaatattgataaaccaagaacaaagccagccgaagttcgtttagaggagttaatgaacgccgcagaaacactatttcttgaaaaaggatttgaggccacaactgtcagcgatattgtaaaacaagcgggggtcgctaaaggaacgtattatcactattttacggcaaaaacagatattctcgacgcactgcgaactcgatatatggattggtatattgataaagttgagcaagcaatggcaagctgccaacttcaagattttcgcgctaaattaaaacagtggtgtgaaaccagcgttattgcttatgttgaaaaacaagaattacacgatatgctttttcatcaagtctttcatcaaagcggtaatattcatgaaaatagggcgctacagcagttacaaacaatattaatggggggggcagagaataaaacgtggcaagttctacagcctgaattaacctgcacgcttatttatcatggtatgcatgctgccgttgataatttagaacacagtacggaatacacaccacaaacattaggtgcgctattatatcgacaatttacacaattattaagttaa

SEQ ID NO: 721 - DNA, 186 bp, Proteus mirabilis
ttaatcccattcaactccattcacctgcttaaaatcgcaatcgcatatcccttcttacactttagacagcaaaaaactacttactcccccaaacagattaatcaatcaatatatctaacaaaagaagtaaacgctttttcatcactattctcgattatttcattaaaactaatcattccagtataa

SEQ ID NO: 722 - DNA, 675 bp, Proteus mirabilis
cttcatacatttcagcttgatattatactcgcccgtttagcctctttattttatgaggctttttctccattttttaacaattttggcatagcaatgactgattacttgcttttattcgttggtaccgtcttggtgaataactttgtactcgtcaaattcctcggtttatgcccatttatgggtgtatcaaaaaaattagaaaccgcgataggaatggggtttgcgacaacgtttgtcatgacgattgcctctattagctcttggctaatggatacctttattttagttcccttagacttactctatttacgtacactcagctttattttagtgattgctgttgtggtgcaatttacagaaatggtcgtaagaaagacgagtccaacgttatatcgtctattggggattttcttacctttaattaccaccaactgtgccgtattaggggtcgcgttactgaatatcaatcaatcacatacctttatgcaatcagcagtatatggttttggtgctgcggtaggattctccttagttatggtgttatttgcagccattagagaaagactggctgtcgccaatattcctgctcctttcaaaggctcttctattggcttaattactgcgggtttaatgtctcttgcctttatgggttttagtggtttggtgaaactgtaa

SEQ ID NO: 723 - DNA, 1611 bp, Proteus mirabilis
  unsure (1083): Identity of nucleotide at the above locations are unknown.
tatcagcaattagttcaggggcactcagtattaagaaggtttaaaatgcgcttagaagttacctgtaaagatcgcatcgggttaacccgcgaattactcgatctgcttgtattaaaaaatatcgatttgcgtggaattgaaatctttcctattggtcttatttatctaaatttttcgcaaatcgattttaatatatttcaacctttaatggctgaaatcagaagaattgagggggttatcgatgttcgtactgtggcttttatgccatcagagcaagagcatcgagctatgtggacactattagaatcagtacctgtccctgtcttttctattaataccaaaggtcaaattaagttattaaacccagctacacggcatctgtttgaattagatgaaaatgataaaaatgaaaaatcttttaaccaactgatacctaactttaatatccatcgctggttagaacaaaaagatcctcatgctgaaattatctccatcaaattaaaaaaacaacattttgatatggagattgtgccaataaaactgactgatgataatcagtttaatcattgtgttggtgcgctcattttattgaaatatcgcggaataattcatgagcatccgaaattaattgttaatgataattcgggatttgaacaagttattgctgttagcacccccatgaaacaattagttgaacgcgctaagaaaatggcaaaaatggatgatcctttattattagtgggggatacggggacgggcaaagatctatttgctaaggcttgccacttattaagtcctcgagccagagagccatttttaggcctcaattgtgcctctatgcctgatgatgtggttgaaagtgagttatttggttatgcggcaggtgcatatcctaatgctatcgaaggtaaaaaaggcttttttgaacaagccaatcgaggcactgttttgctggatgaaattggcgaaatgtcgccacaaatgcaaattaaactcctgcgttttttaaatgatggtactttccgtcgtgttggtgaagagcacgaagttaaagttgatgttcgaataatttgtgcaacacanaaaaacttatgggaattagtacaaaaagggctatttagggaagatctctactatcgacttaatgtattgacattaactctaccaccgttgcgggaaagaaaagcggatatcatgccgttagcactgcattttattaatcaatattgtttagagcagaaagcatcaaaacctgttatttcccctgatttatctgcttatttagtacaatatggctggcctggtaatgttcgtcaattaagaaatacaatttatcaagccatggctcagttagtaggcaatacattgcgacctcaagatatcgccttgcctgagcatactgcggatactttatttgatgaagatttgcttgaaggctcgttagatgaaatgactaagcgatttgaagcttctattttaaggcgtttatatcgtgattatccaagtacacgtaaactggctaaacgtttaggtatttctcataccgcgatcgcaaataaattacgtgaatatgatttaacaagtaaaaaagcggataaaacagagaaataa

SEQ ID NO: 724 - DNA, 2067 bp, Proteus mirabilis
atgaataaatttttggaatttctgatgacaactcttaatagctcaaaaaaaccacagaaagacaagctcaattctgttgtttttttcgcttccgcaacgctgattttagcgttctcttttttcactattttaatgacagataccgccaatgcgtggatcattaaaacactaggttgggtatcaaaaacctttggttggtactatttattagcggcaactttgtacattgttttcgttattttcgttgccacatctcgctttggtaatattaaattaggcccagaacaatcaaagcctgaatttagtgtattaagctggtctgctatgttgtttgccgcggggatcgggattgacttaatgtttttctcagtcgctgagcctattacccaatatatgctaccgcctactggcgaaggtgaaacaatagaagcagcccgtcagtcgatggtgtggacattattccactatggcctgacgggctggtctatgtatgcactgattggtattgcactcgggtattttagttatcgttataatttacccttgaccatccgctctgcactttatcctatctttggtaatcgtatttatggtcccatcggtcatactgtcgatattgctgccgtattgggtactatttttggtattgccaccaccttaggtattggcgtagtacaacttaattatgggttgaaagttctcttcgatttaccgcaagggttaggtgtacaaggtggtttaattctactttccgtaattatggcggtgatctcagccacatcaggcgtcaataaaggcatacgtattctttcagaattaaatgtattactcgctttagggttaattttatttatcctatttgctggtgatactgaatttttattaaatgcgttagtacttaatgtcggtgattatgtaaatcgattcttaggaatgacactaaatagctttgcttttgatagaccgacggattggatgaatagctggacacttttcttctgggcttggtgggttgcttggtcaccttttgtgggcttatttttagcacgtatctcaagggggagaactatccgtcaattcgttataggcaccttgatcatcccttttgtattcacgctattatggttgtctatctttggtaatagtgcactttatgaagtgatccacggtaatcaaacctttgctgaaacagtattagcctcaccagaaaaaggcttttattctctacttgaactctatccgggatttggtttaaccgcttccgtagcgactattacaggattacttttctatgtaacctcggcagactccggttcattagttttaggtaatttcacttctcaactgagtgatataaataatgatgccccaaattggctgcgcatattctggtctatcgctattggtctattaacattaggtatgttaatggcagacggggtttctgctttgcaaaataccacggttattatgggattaccttttagctttgttattttctttattatggcaggactatataagtcattaaaagtagaagattttagacgcgtcagttcattaaacaccaatgcgccagcacctctttatggtaacaccaccatgaactggaaacagcgtctaggtcgagtgatgaatttcccaggtactacctatacccaacggatgttagatttagtttgtaccccagcgatgcaagatgtggctaatgagctgtcattacgtggtgcaaatgtctcgtttaatctttacccgctggaagaagagcctcgtttaaaccatttagaattagtggttgatttaggccaagagcagcattttatttatcaaatatggccacaaaaatattcagtacctgcatttacttatcgtgctcgtcgaggaaaatcccattattaccggctagaaacctatttatgggaaggttcacagggtaacgatttaatggactacaccaaggagaaagtgatcagtgatattctcgaccaatatgaaaaacacttaaactttattcacttaagtcgtgaagcgcccggtgcaacattaacatttccagaatcaaattaa

SEQ ID NO: 725 - DNA, 471 bp, Proteus mirabilis
ttaatgaaattaaaacctcagacaaacgttttgcccgagcaatcccctaaagcccctattacgggttggttacttgcccctttggcttatttgctgttgtcgatagtgggcttaggtttaatgtctgttttatatttaatacgatatttttcagatttttcgattatccaccagctaccttttcatgtggtatcaagctggtatctttccgtgttaacaacatgggcgatgtttgcatttaccgcttatttgttaagacagtttttttaccgcgctaaaaattttcctcgtttatttattatttggttattaattaacttattgttggcgataaaaagtttcggttttgcccctgttgatgatcaaaccgcggttaagtcactattatgggccgttatggcaactgtctgctttgtgccttatatcaaatatgctaagcgtgtccgtgaaactttcacacaagatcgataa

SEQ ID NO: 726 - DNA, 198 bp, Proteus mirabilis
ataacgaaatttatcaatatccaatttaacgagatattgatattgacgttgaaaatttgtgtgatcagggacatcagatatccgtcgactaaaacattatctggtgttctttactgtaatgtgcatttatacacttatttaggtgctttttatgggggcacttcacattgggcgagggtttacggcgtttttcgctaa

SEQ ID NO: 727 - DNA, 477 bp, Proteus mirabilis
  unsure (104): Identity of nucleotide at the above locations are unknown.
cttgctgaattgggttttaacgtgcgttgctggagtcgtagtaaaaagcaaattaatcaggtagagagtttttatggtaccgatcaactgagcgattttgttanagagtgtcagttgttaatcaatctatacccttatacaccacaaactcatggtattttaaatttctcgctttttgaacagcttaaaccttcttcttatttaattaatttggcaaggggagcacatcttgttgatcaagatctgctagaagctatcgatcaaggttatattgctgatgcctctttagatgtatttagccaagagccattaccgggtatgcatccgttttggactcatcctcgtatctctattacaccgcatattgctgcttttactattccagatattgcaatggatacaattgttgaaaatattcaacgtattgaaaagggcgaaacaccttttggtgttgtggatatgaaaagtggctattaa

SEQ ID NO: 728 - DNA, 531 bp, Proteus mirabilis
ataataacttctataattgcaatatctacagtgactaatgaggttataatggaaggtgttcaacttaggcttgcggagcctcatgaagcaaaacgattatggtatttaagaaataaagcgttacgttttggctgtcaacatgtctatccgcccgatatattagccacttggactcctgatgaaatgcctgacggctatagacaatctattattaataatcctttctatgttattgatgataaaaagttgtctattcccgtggcttctggttttttagatcttaaaactggctttgctgaagccatttttacattaccggaatgcatgggaaaaggatatgcaggacttattcttaaacagctacaatatgaagctaaacaaagaaattttgttcagttatttttagatgcaacgcctaatgcgatgctattttatttaaaacaagggttcactgttttagaagagcgagagtactattctagcttggctcaggcaagtttacactgttatcgaatgtatattgatttataa

SEQ ID NO: 729 - DNA, 900 bp, Proteus mirabilis
attgctaattcagctaaaaaaaaggtgagaggaatgatattaagtttgaattcaattaactgtgataataatgaacttgttgatagaactgttttttttatctctgacggcaccgctattaccgcagaagtcttaggccatgcggtactctcacaattcccattaaaaatgaaaagctataccttaccttttgtatcttctgtagaaagagcggaagaaataaaaaataagattaatgaaatttataaaaaaagtggcgccaagcctctggttttctactctattattagtcctgacgtaaaacgaataataaatagtagtgaaggattctgtcaggatattgtgcagtcattagttctccccttagaaaaagaaattggcgttcaagcgctacctcaattaaataaaacgcacggtttaacagaaaaaaatctcagcaaatatgatgctcgaattgctgctattgaatacactttatctcatgatgatgggatctctttacgcaatctcgaccaggcgcaagtgatcttaatcggtgtctcacgctgcggtaaaacccctaccagtttatatttagcgatgcaatttggcattcaagcggctaattacccttttactgctgatgatatggattttttaaaattgcctcctgaattaaaagagtatcaacataaattgtttggcttaaccattgccccagaacgccttgctgctatccgtagcgaacgtcgtgaaaacagtcgttatgcatctattcgtcaatgtcgtattgaattagcggaagttgaagcgctatttaggaaaaataacattccttacctaaatacgacaaactactctgttgaagaaatttccactaaggtaattgattctatgggattagccagaagaatgttctag

SEQ ID NO: 730 - DNA, 246 bp, Proteus mirabilis
ttatataactcggtcgtctccgtcgagcatcggtgctactctgtttttttcaataaattaaccatttctgacatccgtttagatctggaatttaattcttttattatatccaaggctgtaattgaagggttggactctatcatttttactacatcatttatttcgctaactcgcgctgatagttcgacaatagatgtacgcctattattttcttgtagatctccccacatctcgtcggcatcatag

SEQ ID NO: 731 - DNA, 492 bp, Proteus mirabilis
aacgcttttttctcatacttcaacaggttatttatcaaggagagaaaaatgaatacattaaattatcactcaacagagaatggattcacgctaatggaattgatgattgtgattgccattatctcaattttaagctcagtggcgatccctgcttatcatggttatatccaaaaagccgccttaactgatgtattacaaaccctgtcgccttatcgttctgcagtggaactttgtcactatgaacatcaatataaccaatgccatgctgatgccagttttatgcctcaacaatttcgtagtcgataccttactgatattcatgttgccaatggcgttattagtgcaaaaggtaaggctcaactagaaggactaaccatcgtaatgactcctgcagcaaacagtaaagagacacttccccaatggcaaattaactgcacatcaactaacactgcgttacaaacgctatgccataaggtttttaaatctcattaa

SEQ ID NO: 732 - DNA, 294 bp, Proteus mirabilis
caccgatgctcgacggagacgaccgagttatataatcaatcagttatccatttctggtgtcttattcgtgtcctgattttatatcacttaaaaataccagagctcaaatcaataaaatgctctaatgataacttaccttcaaacttgtctccatattcccgattcattgtctgcatgtctaatttgaatgatatattcttaaatttacctgatttatttatgggaattaatttattatctaaaaaaaacttaataacttttttatgcccttcaatatcatcaatatttaagtaa

SEQ ID NO: 733 - DNA, 222 bp, Proteus mirabilis
aatatcggctcaggggacttacccactgacgaacatctcagagaaattaggtgggtgctgttaagcaccttatctatgaactattgtattattttaattgtagaaagcaacctattatctgttaatttcgtggtgtgcgcatgctttctgaacaaatctactttgatgttgaaaaagtgcgatcatggtgcttgccttgatcgtgtaaagcttgttcaatag

SEQ ID NO: 734 - DNA, 243 bp, Proteus mirabilis
ttttatttatcctatccgttattatcgtcctttcacggtaaaaaagtagtccttggcgcaaattattttttaaaattgagaataatctataacctttgtgataacagcgcacagagcagaatagcggctattttattaaataaaacagccgttaataacaacgcttattctgtactttgttctaaagcggttttgattgcatcagggattgaactgccatgtcctttccccgtaaagaggtaa

SEQ ID NO: 735 - DNA, 243 bp, Proteus mirabilis
caaatggcatctatacatggtcatgaagtattacatatgatcctttcatcaaaagtggcgtttacgcaaagatcacttatcgaggcaattcatcaacgttttggggaagaagcgcgctttcatacctgttctgctgagaatatgacagcggccgaattagtggcatttttagaaaaaaaaggaaaatttattgctgctgatggcggttttactaccagtgaaaacaaaatttgtcgccattag

SEQ ID NO: 736 - DNA, 2055 bp, Proteus mirabilis
cttcagggatttgttatgaaatttaaaataagtgctttaacagcctgtattttaatgacttcttattcactacatgcacaagaagataaagtagaacgattagttgtatcagcctcagggtttgcacagcaacaaacagatgcacccgctagcattacggtaatcaacaaagaacaattagagaaaaaaccgatacacgatcttgctgatgccgtaaaaggggttgaaggcgtcagtgtgaatggtaatgcaaataaacaagaaattactattcgtggcttacccggagaatacacactgattttggttgatggcagacgtcaaaatagtcgtgaatcacgccctaatgggagtggtggatatgaaggtggatttattcctcctgcggatgccattgaacggatcgaggtaatacgtgggccaatgtcatcactctatggctcagatgcgatgggcggtgtgattaatattattactaagcctgttactaaagagtggcatggtgcagtttccatggggggaacattgcaacataaccgtgacgcgggagattctatcaatggtgatttttatctttccggcccattaattgaagataaattaggtttacaactttatggtagtagctacttacgtgcagaagataaaattacgtatgggcaagggcgtaacgataataaaaatattacggccaaattagcttttactcctacagataaccaaaccattttattagaagctggacgcaattcgctacaacgcacgacaacaccgggtaaatcgatgagcgaatttaccaatcgtggtggacgtcttgataaaaacaaaatgctagaaacgaataatgaccgtaaccattgggcattaacttataaaaatcagtttgatattttgcactctgagttaagtgtttatcaagagcaaaccaagcgtgttcaaaagacggaaggtgtagataaagcgacaggaaatagctacaaatattatgaagatcgccgccctgaaatcactaatactgttttcgatgctaaatttaccgcattccttcctgataatgtgatgacttttggtggtcaataccaatatgcacgtttaaaagacgaatcttcagtcggtggtaaagaggtcaaacaatctacgatcaccgctgatcaaaaagcgttatttttagaagatgaatttagtgtcacagataatttagccctaactgggggaatacgttttgatgatcatgaatactatggtaagcactggaacccaagagcatacgcggtttaccatttaaccgacgaatttaccataaaaggagggattgctaaggcctttaaagccccgagtttacgagaaattagccctcaatatggtacatcaacggaaaaagggcgagcgattatgtatggtaatcgtgacttaaaacctgaaacttcggttagccaagaaattggtgttggttatgataatggtgatggttttaccgccaatgtgaccttctttaatacagaatttaaagataagcttaccaactacgataccggtgaaatcgatcctattaccggattaaaactgtaccaatatgataatgtgggtaaagctaatattaaagggattgaaaccgcggttgcattccctgtcgctgataactggcgagtaagtgctaattacacttatatcaactctaagcgtaaaagtgatgacgaaaaattaggctctggtgaatcattaaaaggttatccattggatatgacaccaaaacatagcgccaatgcgcgtgttgattggcaatacgatgaagctaccagtttctatgccaatactgcctatactggtaagcaaatttgggcggctcaacgaaatggttatactggcgctcgttatcgtagtggttatacaacctttgatttaggaatgacctataactttaataaaaataccatgctaaatttagccgtattgaatattaccgatgaaacgggtcctgcggtcaacgataaaggggggaactgggtcgttgatgaaggccgtcgttattgggcaaatatcaaatatagtttttaa

SEQ ID NO: 737 - DNA, 396 bp, Proteus mirabilis
aaaagagaatctatcgacatggttaaatcacccgcgaagaaaacaaccaaaggctttgaagaaaccctttgggatactgctaatcaactgcgaggcagtgttgaatcttctgagtataagcatgtggtactcagtttggtgttcctgaaatttatcagtgataaattcgaagccaaacgcagccaattaatcaaaaatggtcaggaagcttttgttgatatggatgttttctatcaacaagataacgttttctttttaccacaagtatcccgttggtcttatgtccaagagcgtgcgaaacaagatgatatcgcggtgattattgatactgcattatccactatcgaaaaaagcaacgcatccttaacgggcgcattacccgaaatccaactttaa

SEQ ID NO: 738 - DNA, 192 bp, Proteus mirabilis
aaagtcgcttttaacttaattaaatattttcaaaaccgctctcagtattcttcttttttctctaaaaaacctattttttggttaattgattttttccaactggtaatttacatagcaaaaatcacaacaaatacaataacaataaaaattaaacaaatgattttatttgtagataacgcttattctctctaa

SEQ ID NO: 739 - DNA, 1116 bp, Proteus mirabilis
aaaagagctttcatgaataatactatccatacagcaacagagtttattgagcaattgttacgtcacagccttgctcaacgtgtttctgatcttcatttagagccacaacaaaatagcctgagaattcgcgcgagaattgataatcatctagtattattttctccccctgacaatcaattagctaacgagatcctgacacgtttaaaaatcctcgcgaatattaatattgccgaaaaacgcctaccacaagatggtcaatttaattggtcttaccagaaaaacaattattcaatacgtgttgcgacacttcctactttatatggagaaaaaatagttttacggctcatgaataatctgcaacagccacaattagcacagttaggttttcaaacaattcacctaacactattaaaaaaatatcttactcaacctcagggaatgattttagtcaccggccccacagggagtggtaaaactttaacactctatagttgtttacaatatttaaataaagataatcgtaatattaatagtattgaagatcctattgagttacctctccatggcattaatcaaacacaaataacagaaaaagctggtattacttttgcaacaatattacgggcgctattacgccaagatcccgatgttattatgataggtgaaatacgtgatcaacaaacagcagaaatagcaataaaagcggcacaaacaggccacctagttttatcaacactgcatactaactctacccaagcaacactcgcccgtttggctaatttaggcatcgcaaaagatttaatcgactcttgtgtaaaattaattatttctcaacgtttagttcgatgcttatgtagcaactgtaaatacccatcacctgaacagaaaaatttcattattaataatcaacaaattatattacccaattggcaagcaacaggttgtcaattttgttattccggctacaaaggcagaacagctatttatgattgttttgaacttgccaagcaatcacacccctcaccttacgcactatttaactcaggtattgaactgataaagaaggggatcacgtctttagatgaagtttatcaagtagtcggagatattgaatga

SEQ ID NO: 740 - DNA, 543 bp, Proteus mirabilis
aaggatctcacggtgccaatcataaaaaaaactatttcgggcgttgatctccgtgcaagtttttatttgacttcccaaagtttaggatatccttcaaataaacaggcaatattaatggctgatattgccacattaatagctaaatggaggaatggcttagaggtcgaaatttatacggaaaattatgaatttagatatggtaggatcaagtcttcacgttttaacgcctctggtgaggaaagcgtatattatgcaacttactttcatactcgtgccaagccaaaggacaatgatccatttctaataattacttttgatcccgttgttggacaagacgattttatgttcattgagaccattattgatcatagaacctattttggttcaccgggtgcaggtaaaactaaatctcatattgaaagacggtcatctgatttaaaacgccgcattgaaaatggaaaaaaaattagttccgaaccttcatcttcagttcaaaacgttaataaaaataacaatgattcgcctgatcaagaaaataagtaa

SEQ ID NO: 741 - DNA, 384 bp, Proteus mirabilis
ggggcatacaccatggactatgaatttcagcgtgatcttactggcggtatattggcccgtttttcaatggatcatgaggcgattggttattggttaaatgatgagatccaaggtgatatcagcttaatcgatcaaattttgactgagatggacgaagttaaaggcagtgagaaacagtggcaattgattggtaaagaatacagcttatctattgatgatgaggaaattatggtaagggcgaatactctccattttgaaaccgatgatttagaagaagggatgagctactacgataatgaaagcatcgcattttgtggattagatgattttgctactatgctacaaaaatatcggttatttattctggaaaatagaagaagttaa

SEQ ID NO: 742 - DNA, 201 bp, Proteus mirabilis
ataaatataacgcttactaagattattattaaaacacctttttttataaaaaatactaataaaatagatagatttaaagacttattaattatagttttacttcttattaagatttattttctacacttaatgcgacatatcctaaatttgtgttttcgcactaatagatgtggtgttaattctttaataccttatatttga

SEQ ID NO: 743 - DNA, 2694 bp, Proteus mirabilis
aaacagataacagataaggaatacaccatgtcagatatgctgaaaaatgacgtggatccgatcgaaactcgcgattggttacaagcgatcgactcggtcatccgtgaagaaggtgttgagcgtgcacagttcctgattgatcaggtattaaaacaagcccgtaatggcggtcttgatattgctttaggtggctctgtacacagtgattatatcaatactattcctgttgaagatgaacccgcttaccctggcaatctggaattggaacgtcgtatccgttctgctattcgctggaacgcagtaatgatggttctgcgcgcgtccaaaaaagatttggaactcggcgggcacatggcgtcataccagtcttctgcaactttatatgaagtttgctttaaccacttcttccgtgctcataatgacaatgatggcggtgacttagtttacttccaaggtcatatctctccggggatctacgcacgtgcattcttagaagggcgtctgactgaagagcaattaaataacttccgtcaagaaattggtggtaaaggtttatcctcttatccacaccctaaattaatgcctgaattctggcagttcccaaccgtttcaatgggcttggggccactatctgcgatttatcaagcaaaattcttgaaatacttagatcaccgtggcttaaaagataccactaagcaacgtgtttatgcgttcttaggtgatggtgaaatggacgagccagaatctaaaggtgctatcactatcgctgtacgcgaaaaattagataacctgtgcttcgtggttaactgtaacttacagcgtcttgatggccctgttacaggtaacggtaaaattgttaacgaattagaaggtatcttcgccggtgctggctggaacgtgatcaaagtgatgtggggcgaccgttgggatgcactactacgtaaagacacttccggtaaactgatccagttaatgaatgaaacactggatggtgactaccagactttcaaatctcgcgacggtgcttatgttcgtgagcatttcttcaatcgttacccagaaactgccgcattagttaaagatatgactgatgacgaaatttgggcgttaaaccgtggtggtcacgatccgaagaaagtttttgcggcattccaaaaagccaaagaaaccaaagataaaccaaccgttattttagctcagaccatcaaaggttatggtatgggtgaaacggcagaaggtaaaaacatcgctcaccaagtgaaaaaaatgaacatggacggtgtgaaacatttccgtgatcgtttcaatatccctgttagcgatgagaaagtagcagaactgccttatatcacttttgataaagattcagaagagtacaaatatctgcatgctcgccgtcaggaactagaaggttacttacctgctcgtcgtactcgttttgatgaaaaattagaaattcctacactggaagatttcagccagttattagaagagcaatctaaagagatttctactactatcgcattcgttcgtgcgttgaacgtaatgttgaaaaacaaatctattaaagatcgtttagtccctattattgctgatgaagcacgtacttttggtatggaaggtctgttccgtcaaatcggtatctacagcccgaatggccagcaatatacgcctcaagatcgtgaacaagttgcttactataaagaagacgttaaaggtcagatcctgcaagaaggtattaacgaactgggtgcgggtgcatcttggttagcggctgcaacatcttacagcactaacaacttgccaatgatcccattctatatctactactcaatgtttggtttccaacgtattggtgacctatgttgggctgcgggtgaccaacaagcacgcggtttcttaattggtggtacttcaggtcgtacaacgctaaacggtgaaggtttacaacacgaagatggtcatagccatattcaatcactgactattcctaactgtatctcttacgatccggccttcgcgtatgaagttgctgtcattatgcaagatggtttagagcgtatgtatggtgataaacaagaaaacgtttattactacatcacaacgttaaacgaaaactatcatatgccagcaatgccagctggagcagaagagggtatccgtaaaggtatctataaactggaatctctggaaggcgcgaaaggtaaagttcagttactgggttctggctctattttacgtcacgtacgtgaagcagcacaaattctgtcaactgaatatggtattggttccgatgtgtacagtgtaacatcattcactgaattggctcgtgatggtcaagattgtgaacgttggaacatgctacatccatcagaagagcctcgtgtaccatacattgctcaaatcatgaatgatgcaccagctgttgcttcaacagactatatgaaactgtttgcagaacaagttcgcacttatgtgccagctgacgactatcgtgtcttaggtacagatggtttcggtcgttcagatagccgtgaaaatctgcgtcaccactttgaagttgatacttcttatgtgattgttgctgcattaggcgaattagctaaacgtggtgagattgatgtgaaggttgttgaagaagcaatcaaaaaatacaacatcaaccctgaaaaagtaaacccacgtctggcgtaa

SEQ ID NO: 744 - DNA, 819 bp, Proteus mirabilis
acaaataaaacaacttcatcagcattacttagaattagctcaaaaaagcaatacaggacaatagccatgagtgaagaaacctcaacaattatttttgaacacccgcttaatgagaaaatgcgttcatggcttagaattgaaaactcattaattcaattaaatagttttcaatctattaattcattatcttctgcattatctttttttcgtgccgtttcagaatttattgaagttttagatcgcggggagatccgcgcagagctacttaaagagttagaaaaaagacaaaaaaaactgcaacagtggttatcctttcctaatgtcgataaagagattgtcagtcatattattaatgagttatcagaaagtgcttgcgcattaagtaaagcaccacgtattggacaacatttaaaacaagataaaatcatcagcttagtaaaacaacgcctcagtattccgggaggatgttgtagctttgacgtccctactttgcatttgtggttaaatcttcctcaaacggtgcgtactgaaaagttaacttgttggcaggaagggttatatcctctacaaaatgcattaaatgccctattaacacttattcgtcaatcagatacatttaaaccggtattaagccataatggtttttatcaagacagtacggaagaaggtgaattattacggatcaaactacttgccagccagcaaatttaccctcaagtctcaggacacaaaaaccgttatgctattcgctttttgcctcttgacagtgagcatggcacaatcccttctgaactaccttttgagatttcatgttgttaa

SEQ ID NO: 745 - DNA, 1125 bp, Proteus mirabilis
aaattgaaaacgataactattaaaatcagtctttttgttttgtcactgtttttccctctcctaacaaaagcacttgttattccagataatggaacggggtatataggtgaattaacgcctcctcaatcatatatgtcacttagtagtagtggtaatacctatggagcggctgtaggtgttaataatgttgtagattattgtagtaaaaacagtgcacaatggcagagttttttattcccattcccaggaagtcaagagggggagtacggattaaaattatataataaaaatgcaagtgaagcggaaaatagggaaaattatttagttgcagctatcaatggaatagtatctatcgatgcggtgtattatcagaatggaacatattctccgactcgaattactctgcgccgaggaaaagaggtttctagaacagctgagtatgcggatcaatttgtctatcgtcacccaatgtgctggtatggttatatatcacgtgtaaacaatactagtttgagaataagctcttattctatttatgcagtaggtcatgttaaacctggtatttacgattttgtagctccgatatattttactacagctcaaactgcaactgatgctcctccagatctatcttcagttcctttttcatttggtaatggtcctattcacgtcttaaaaacatgtaatgtttctcctgctagctcaacaaacatacaatttgctattcaactagcacaaaattttaagtcagccaagttacttgagcaaagtgtcgctagtatgcttgtctcttgtcctcattcaggaaatatgtatgtgacattaaaaccctataatgagctagtcaatgggagtaaaactgggatgacaatgtctccaagtatccctttgaaaaataaagaagttgcaccttatatcacggtatctgatgcaactaaaacaataactaatgcagtatgtaataacaattcctccgaagctttagagttttatgcaggacaaccttcaggcaaatataatgggggatctgtttataagtcattatcattcaacctttgtgccaatgggaatatacctacgaatacttataaaggaagtattgatgtatcgttcctgattgaatga

SEQ ID NO: 746 - DNA, 363 bp, Proteus mirabilis
aaaatgaaaacatcagaattaattaagaagctacaagaaatagataaaactgtaccttttgatgctgacattgttactggtgatgactggctcccttgtggtgttgaaaatgtttaccacgccccacccaatacatatattcaattcaactcctatgatgccgacgagatgtggggagatctacaagaaaataataggcgtacatctattgtcgaactatcagcgcgagttagcgaaataaatgatgtagtaaaaatgatagagtccaacccttcaattacagccttggatataataaaagaattaaattccagatctaaacggatgtcagaaatggttaatttattgaaaaaaacagagtag

SEQ ID NO: 747 - DNA, 765 bp, Proteus mirabilis
aataagaaaactgttgataatttatttaatcttcagttttctttacttattacaaataatgatataaatgagaaacaatttaaaatattatctcgtttattatgccgtgaagctgtagacagtttattgcaatccacatggtttttacgcaaaaaacattgctcagtgccattaactaaagaaaatattaatgccgtagtaaatttggctgataaataccaatctaatatatcagatattaattggaacgctttaaatgcaaaaatcaacattgctgatcatgcacgttttattcaagctatcataaaacctatttttatttggtgggttgaacatataacaccgcatatatttacactttatgagataaaaaaagagctcgaatatcaaattaatcaatgtgaaaacattaaattatttgaagaaaaggaaccatcaaatatagcctcttcttttttatctttagaagatataaaaacaaaattagaagctgataaagcacggttcgtcgtgatagatgatttgttgaaaaaggatattaaattagttatagaagcttgggaaaaagagccggtattcaataaaaaaataaataatacattagagtacttacaaaatacacaaccgcattctgagttattacaaccattatgggatattttaatcactattccacaacaccctgaaaattgtaaaaaactaaaacactggctagtagaacactctttatgtttaattaatgatgaatttatgtggcatgtataa

SEQ ID NO: 748 - DNA, 216 bp, Proteus mirabilis
tacttcatgaccatgtatagatgccatttgttagcccttaatcatataagatgtatttattatgcatctttttgggagggaaactttgtttttaatcataaaaaagcgatgacaaaaggtcatcgcttcaggtcgctgataaataatatttgcgccgtagtaaagaacggtttatttctcagcttgttgaagtattttttgcatttcatcttttag

SEQ ID NO: 749 - DNA, 468 bp, Proteus mirabilis
aaaacgacgacgatatcttgttgtaataataagatattaaagcaggagctaatatcactcgtgactttatggaaatcacatttaacagtttcttggtttacacagttattttcaactagtgtttacgttatttttgaaatagcattgctgttatatccttggccacctggctttatttatatctgggttcctttgttacttttacttatattaggttggtattttagccaaaaaaatatcaataaaaggaaaggggatttagtgctgcttaatggcaatcgtattcaatggaaatatcatgaatggcagattgcaaaacaaccgtggatcagccgatttggtgcaaaaataacgttagattctatcttaaataataagcaaatcacgctatgggttgcttttgatagtatgccggaaaatgagtggcgaaatttttcacaactgctgatgcaatacccagatatttaa

SEQ ID NO: 750 - DNA, 204 bp, Proteus mirabilis
tgtagtttagccatactctataactataataaatcctctccgttggatgtgaactgtgacgcgagaggtttttatcttaagagtactctcaatggaaaaataatatcgtatcaaattaaattcctatgttgtttaatccatcataatgaaaaaagagccaagctcataatgaacttggctcttaacatttacactttgtcttga

SEQ ID NO: 751 - DNA, 426 bp, Proteus mirabilis
caaaacaaagcgttttgcagtaatctcatcgctgattttttgctactttctccctttaaaacctctggtggtatgacaaatatgttgtataaatttacccccattattctgctgataatttccaatatctttatgacttttgcttggtatggccatttaaaatatggtaacaagccgttaattatagtgatcttactcagttggttaatcgcttttgttgaatactgttttgcagttcctgcaaaccgtatcggccacaactattacagcgcagccgaattaaaaaccattcaagaagtcatcacactaaccatttttgctgttttttcggtgacttatttaggtgaaagtttcacacttaaccactttatcggttttattttaattggtgcgggtgcgctatttatttttaaggggccattttaa

SEQ ID NO: 752 - DNA, 1395 bp, Proteus mirabilis
gaaactttggcaacatcaacaaggataacaatgatgaaatcaaaaataaaacaaatgattgctcactactttaaaactaaaaaagagcctaaaaactatgatttttaccctaatcatatcgccgtacttgagaaaccgccgacaccttatagtcgtattattgcaataataatttcattaagtgtgattatatttttactctgggcatatataggtaaattagatgtgctttcttcagctataggaaaattagtggtttcaggttattcgcaacaaattcaaatttatgaacatagtcgcttaagcgccattcatgtaaaaaatggccaacaagttaccaaaggagaagcgttattaacacttgatattttaggtgttgatgaagagattaataatctaaaaaataagatagaaaatctattattactaaaaattcgttatcaagcattaggtcaaaacacccgacctgatacaattgatgattttaatttactaaataaagaaaaaaaagaagcggttctattaagttatcaaaaagaaaaggatgaatttgatgctagtattaatcatattaattctgaaatagaaaccaacaataaaaacaagcttcttactcaccaagaaatcaattcattaaatgaattaaaaaacaatattgaaaaacgctttaatataaagaaaaaactctatgataaaaaaattattagtaccatggagtttttagaaaataaaaaggagttattagaaattaatcaaatcattaaaagaaaatcatcagaactggttattttatccagtcaagagcaacaatatataaaaaatcgcgatagattagaaaaacaaaaacacctagagtggcatgacaaatttaaacaatatgaaagcggagtttttatttatcaacaaaatctttatcatgttcagaaacgtcaacaattaaaaattgttcgttctcctgttacaggtacagtacaacaactcgccgttcataccctaggagccgtattgcaaccttcacaagcggtgatggtgatagtgcccgatactcagcataatgttgctgaggtgaatattctcaataaagatattggttttatctatccgggtcaaaaagcggtgattaaaattgatgcttttccttatacccgttatggcaccattgaaggcaccattgtcaatatagcaaaagattccatacaacatgaacaattaggcttagtttatcccgtcctgattgaacttgataagcaagtgatgggtgaagatgaagcacaatataaactggctacaggtatgtctttagttgccgatataaaaattgaaaaacgtcgagtgattgattatttactcagtccaatagaagtttatcaacatgaagcattaagagaaaaataa

SEQ ID NO: 753 - DNA, 837 bp, Proteus mirabilis
tcaaaaatggctcaactccaatcaagattagtgtactcaatgattggatggcatcacgtgatctcccaaaacccgatggttatagtttccgtagttggtttaagcgccacaaagcagaaggaaaaaaataatatgttaaacgaacaaaatcgtgctgagtttctgcaaactattgctcaaaaattaggacgtgaggtgacgcatacgccaaaaccacaagatccccctattaataatttagctaaaacacgcttaacaaatttaacccaagatgaattatgcaaagaatttactgattttgcacaaacccagcaagtaagatgcgttatcactaaaccagaacaagtgataaatagcttaatagcgctttgtgaaagctatgattgtcaaggctcagtgataataagtggtgatgagcgcttaaatgcacttggtgtaacacaagctattagtgaaaaatatgaaacttatatttgggatcctaaactcggtcatgaaaatattattcatgctgagcgctctcaaatagggattgtctttgcggaagcgggattaacagaatctggcgggattgtgctgttttcttctccggaaaaagggcgttctgtcagcctgttacctgaaacctcgattgttattttacgcaaaagtgacattttaccgcgagtggctcaacttgcagagcgtttacacaaaatggcacaagatgggatcagaatgccttcatgtatcaatttaattggtggtgcaagctcaacggctgatattgaattaatcaaagtatggggagttcatggcccagttcatgccgcttatcttattattgaagattgttag

SEQ ID NO: 754 - DNA, 423 bp, Proteus mirabilis
ccaattaatttatcatcccagtcatgcgttatgataaaatgcattttaaatacaacaataagaagtgagagtaccatgtcaggtaaaagaattaatcgagagaagcaaaccatccaaaaaatggttgctctgtatgaacgagcgcatcctaataccgaccccgagtattatcagcaattagtgacatatgcttataaaagactagataaatgtcgctatggtgaggaaaaacccgcctgcaaacaatgcccaattcactgctatcagccagtaaaaagagcagcaatgaaacaagtcatgcgttgggcggggcctcgaatgctaatttatcatccctatttagcaattaggcatcttattgatgataagaaacccgttcctgcattaccggctaaaaaatctaaacgtttatcgggaaaataa

SEQ ID NO: 755 - DNA, 453 bp, Proteus mirabilis
cagtcaaatttagtaaaaaatttattattgggagccaacgtgaagataggtacgcttttaatttcttacagtttactcacaatgagtttgctctctttttcctcctttgctcaagtaaatcacgatcccctgaccaaatgttatgagttgtcaacagatgcaagccaaacaaccattaaagcttgtctattagatgaactaagattatctgaagagcagttgaatgttatctataataaaagcaaaggcgaccttgaagatagtgactctatcgcggctaaaagtgctattgatgcattagtcagttcacaagagcagtttattctttttagaagtagtgaatgccaacgtcaatctgctttaatgatggggggcaatggtgctgatgaagtactgctggcttgtgaaataaaattaaatcaatggcgagctaaattattactcactaattaa

SEQ ID NO: 756 - DNA, 729 bp, Proteus mirabilis
  unsure (53): Identity of nucleotide at the above locations are unknown.
agtattatttatatttttaaatttataaaaaggaatggctatatgaaaaaatngctatttagtcttgctacgctgattgtaatgtcaacaccagcattagctactccaccaggcgctaacttaaaaataaacggtgatattacttcccctacttgcaccgttaatgctggtgataatgatattattattgattatggtgtaatatccccctcttttattcctgctgaggaaaattacgcactaggagctaagagtgccaatatcaaaatatcctgtgatgcaagcaattatttaacacttaaggtatcagatacttataaaacaagttcaacagattcagcgaaaattagcgtttttggattagttaatgcaaaaaatacagaacaagagattggtggatatataattgatgtcattgatatcaaagttgataataaacgagcttatttaggaagagtggcagataagatttggactggatcgtctgcaactatttttaaagataccttaacagcgttaactagtgaacctcaagcccaggttgataaaaacaatttaaaacttatagcaggaaaagtgtttaatgcaaaaatacaaataggagcttataacgaaagtaggtatgcgtatattttatcaagaaaaaaattggcacaaaacaatatcgatttaactgatggaattgattatataggtgaagctgtttttacttttaactttggtgtctaa

SEQ ID NO: 757 - DNA, 291 bp, Proteus mirabilis
tactgtatttatatacagtttatttgccttggtatggtgaaaataatgcgtgtggaaattttatttaacaaacaatctaatgtcactgactcactatttccgctgttagaacatgaactaagaaaaaaaattattcctatttatcctgatatgcagtttcgtatcgcttttagtagcatgaatacgatccaagtcacgggcgtaaaagatgaagctaagcatgagcatattatggagttaattcaaagtgtttgggaagatgatagttggctccaaacgaatgatgattaa

SEQ ID NO: 758 - DNA, 1257 bp, Proteus mirabilis
cgggcgcattacccgaaatccaactttaaaatcgccattgtggtggatatgtggctgacgggctttgatgtgcctgagctagataccatctatatcgacaagccgctacaaaagcataaccttattcaaaccatttctcgagtgaatcgtcgttttgaggggaaagagaaggggctggttgttgactatatcgggattaaaagccgtatgaatatggcgctggcgatgtattctaaagccgataagtctaactttgaagatgttcagcaatccattgtagaagtccgtaatcacctcaatttgctttcacaggtatttcatcaattcgatagtcgcgattacttttcaggctcgccaacacggcaattagactgccttaatcgggcggctgagtttgtcctgcaaaccaagaaagttgaactgcgctttatgggcttagtaaagcggttgaaagccgcttatgatatttgcgtgggcagtgaagatatcacccaagatgaacgtgaacatatccatttttatttggctgtacgctctatagtctataaattaaccaaaggtgatgccccagatacggcgcagatgaatcaaaaagtacgtgagatgatagcggaagcccttaaagccgaaggcgtggaagagatcttcactttaggggacgaaaaagctgaaaatatcgatatttttgatgatgaatacatggctcgtatcaataaaatcaagttgccgaatactaaaatgcaactgttgcaaaagatgctccaaaaggccattagtgatttccaaaaggtcaatcagctgcaagggattaatttctctaagcgtttccaagcattggttgagcagtataaccaacgcaaagaaaatgatgtgctcaatggcgaagagttcgacgatttcactgcacaaatggcggatatgatttatgacatcaaggcagaaatgatgtcatttgaggatatcggcatcgatatggaggagaaagcctttctcgatattttgcagcatatgtgccagaaatacgattttacctacgatgacgacaaaatgctggcacttgctaaggacatgaaacttattgtcgatgacagcacacaataccctgactggagcaaccgggaagatatcaaagcgaagctgaaagttgacttgattttgttattacatcgttatggttttccgccagtggccaatgatgaagtatataaaagtgtgctggaacaagccgagaactttaagaaatatcaattggggtga

SEQ ID NO: 759 - DNA, 189 bp, Proteus mirabilis
tgtggatatctgcttgaagtatcttcaataactaaagatatattgcctaacatatcgcgtcgttgcttatcatttaatgcacaaagtagagatttagtgactatttttaaagcagcgagctcgcattcgatttctcttaagttgttatccatgatttacctgtcagtatctaatggattattaatataa

SEQ ID NO: 760 - DNA, 720 bp, Proteus mirabilis
ataggaattcaaatgaaaaagaaattactctggttacccattttattcagtatggtgtcaatgccagtgtttgcagataacgctgctattaaagcgcaactggcaaaaatgcagataaaagcagagagcattcaaccgacaccgatagtggggttaaatgcagtgctttctgataaaggcattttttatattactgatgatgggaaataccttacagcagggccgatttataatattaatggtgaggagcctgttagtatcgctaatcaagtgatcatgaaaaaaattgattcactgaaaaatgaaatgattgtttataaggctgctaatgaaaaatatgtgatcactgtttttaccgatattagttgtccttattgccaaaaattgcatcaagaagtaccagagctaaataaacaaggtgtcacggtacgttatttggcatttcctcgtaacggggtgaaaaataatgtggtcagtcaacagatgaatgccgtatggtgtagcggttttcctaaaaaatcactcgatagtgcgtttaaaggtgacaaaattattgcgattgatgactgtaaaaaaattaatatcaatgagcactttaaacttggcactatgatgggcattcaaggtacgcctgcgattgtattacctgatgcgagtatttatggcggatatatatcggcgactaatctacttgaattattaaataaaaaagagaagtga

SEQ ID NO: 761 - DNA, 1200 bp, Proteus mirabilis
atgaaattacattttatctatcgctataatgcattaacttatcaaggagaatggctaagtggcaacattgtcgctcaatctaaacatgaagttattgatcaacttattcaacaacaaaaattaccagtaaaaattcgcctatatagggtaataacctttcaaaatagtgataaacaataccgcattcaacttcttgaacagttagcgttattacttcattcaggcttagcacttttgcccgcattaacactgcttaaagaagaatgtcgttatttacattggcaatgtgttttaaatgatattatttttcacctaaatcaaggaggcgcgctgtctaaacagttaagtcgttatccactctattttcctgctaatttaacccattttatttatattggtgaagagagtggtaagcttgatgaagttctcttattacaaacaacacaattaaaaaaccagcgagatttaataaaaaaaataataaaagcttttcagtatcctctattcttattattaacattaatcgttattacaatatctatgttgatctatgttttacctgaatatcaatctttatacagtgcatttaatactgagctaccgacactaacattaaccttaattagatgttctcaatggttttctcaatatagtttaattatcctgctgtttatattaataatttcttatagctattacactattaaacatcacaatgctaaatttcgcgacattgaacaacgatgttggcttaatcttccttacttgggcatcttattaagatatcaccagctacatattatttttcagataatgacgattacacaacaagctggattaccactattacagggattaaaaattattacagagcaattaacgcattcactgtatcaacgagcactcactgatatgatagcgcatattactcaaggcaaatcacttagctcatttatgcgacataatcctctattcccgccaatctgttatcaattgatctcttcagcagaaaattctggacaactacagtttttttgccagcaacttacccactggttttatcatcaattagaagaacgtcttgatagtgtaaaaacatggcttgagcctattttaatgacactgatcgcattgattactggcacgcttattattgcgatgtatcttccggtgttacaactaggtgataccatacattga

SEQ ID NO: 762 - DNA, 258 bp, Proteus mirabilis
tatcaacaacagaaatcatctcaattaaattcaggagagataatgagcgaaaaattaatagtgaaatgcccaacatgccgaaccgaggtaatatgggatgaaagtagcccttatcgtcctttttgttgtaagcgttgccagttaatcgatttaggcgaatgggcggctgaagagaagcgaattccaagtcaaagcgaaagcaatgacagcgatgaatggagtgaaatgccagagcaagatcctaagccgtttaattaa

SEQ ID NO: 763 - DNA, 1458 bp, Proteus mirabilis
ctcgccggacaaataaataatgaggtcacgatgagtactgaaattaaagcacaggtagtggttctcggtgcaggccctgcgggttattccgcggcgttccgttgcgctgacttaggtttagatacagttttagttgaacgtcactctacattaggtggtgtttgtctgaacgtggggtgtatcccttctaaagcgttactccacgttgctaaagtaatcgaagaagcgaaagcattatctgaacacggtgtcgtttttgatgcaccgaaaacagatatcgacaaaattcgcatctggaaagacaaagttatttctcagttaaccggtggcttagctggcatggctaaaggccgtaaagtaaatgttgttaacggcgaagctcgattcacaggctcacatacattgtctgttgaaggtagtgaaggtacaacaacaatcactttcgaaaatgctatcgttgccgcaggctctcgtccaatcgaattaccttttattccacatgaagatccacgtgtgtgggattcaacagatgcactacaactgaaaacagtaccagagcgtttactggtcatgggtggtgggatcatcggtttggaaatgggtaccgtttatcatgcgttgggctcacaaattgacgtggttgaaatgttcgaccaagttatcccagcggcagataaagacgtagttaaagtctttactaaacgtatcagcaaaaaattcaatctgatgctagaaaccaaagtgaccgccgttgaagcaaaagaagatggtatctatgtcacaatggaaggcaaaaaagcaccagctgagcctcaacgttatgatgctgtattagttgctatcggtcgtgtaccaaatggtaaattattagacgcaggtaaagccggtattgaagttgatgatcgtggctttatccatgttgataaacaaatgcgtactaatgtacctcacatctttgcgattggtgatattgttggtcaaccaatgctggcacacaaaggtgttcatgaaggtcacgttgctgctgaagttatctctggtaagaaacattactttgatcctaaagttattccatcaatcgcttatactgagccagaagttgcatgggttggtatgactgaaaaagaagcgaaagagaaaggtgttagctatgaagtagcaactttcccttgggcagcatctggtcgtgcaattgcatcagactgtgcagatggtatgactaaactgatttttgacaaagaaaccaaccgtgttatcggtggggcaattgtcggctctaacggtggtgaactgttaggtgaaattggtttagctattgaaatgggttgtgatgctgaagatatcgcattaaccatccacgctcacccaacgctatacgaatcaatcggtatggctgcggaagtatttgaaggtagcatcactgacctgccaaatccaaaagcgaaaaagaaaaaataa

SEQ ID NO: 764 - DNA, 576 bp, Proteus mirabilis
tatgattttaaatgtagaaaaaagaggggtgttgtggagattaagcaaggctggctaacgggagtaaagcacgttccatcgccaaattatgacaatagacctgaaggtgaaatcccttcattgttgattatccacaatatcagtcttcctcctgggcaatttggtggaccttatattgatcaactgtttaccaatacgcttgctgttgatgatcatcctttttttaatgagattgcacatctgcgtgtttctgcgcactgtttaattcgccgtgatggtgaaattgtgcaatatgtgccttttacggcacgagcgtggcatgctggggtttccttctataaagggcgagagaaatgcaatgatttctcgattggtattgagctagaaggaaccgatgagtgtgactttacgccgcagcaatatcagcaattatcgacactcactcagcaacttattgaacactatccgggcattaaagaaaatattaccggacatagtgatgtcgcacctggtcggaaaacagatccgggacctcattttaattggtcatattaccgagcactattagcaaaataa

SEQ ID NO: 765 - DNA, 720 bp, Proteus mirabilis
atgaaagttaatttttatgcaacctgtcttggtgatgtgctaaaagcagattcggcacgagataccgtattattgctcgaaaaattaggttgcgaagtattatttcaagagcgccagggttgctgtggtcagccagcacttaatagcggttatgttaatgatgcaaaacccgcaatgaaatcattaattgagacattagaagttaatgattatccgattatttcccctgcaggctcttgcacttatgcgattaaaggctatcccagctatcttgccgatgagcctcaatgggcgcagcgagcccaaggtgtggccgatcgtttaattgatcttaccagctttatcgtcaacaccttaggtgtggttgatgttggcgcccgccttgcgggtaaagcggtttatcacccctcttgtagtttaacgcgaaagttaggggttgttagtgaacctttaaccttattaaaacatgttgaaggactcgaaatgttacctttcgccaattcagaaacttgttgtggttttggcggcaccttctcagtaaaaatgtcagaaatttccggtgaaatggtcactgaaaaagtaaaacatatcatggaagtcagccctgattacgtcattggtgcagataccagttgtttaattaatattcaaggccgtttaagtcgtgaaaagcgtcctgtcaaagtgctgcatattgcacaagttttaatgagtcaataa

SEQ ID NO: 766 - DNA, 327 bp, Proteus mirabilis
acgttgcctaaacctcccattagtgcccaagcttcaccattacctatatgggtgaatatattgccaccaccgaccatggcacccatactggttccattaccgactttagtgaaaatattccccacagcgcccattatacctagggtttgcccatcgccaacatgtgttagtacattaccaatacctagcataatgcctgaaagatcaccattacctactttagttaagatattggcacctccaagcataacgccatgtatgttaccgtttccgatatgtgttaggacattgccacctccccccattatggctaaaatatcaccttga

SEQ ID NO: 767 - DNA, 795 bp, Proteus mirabilis
tgttgttataactgtaatttagtgacaatacccatacatgatttttgtcaggaggtttttgtgaaagtaaaagcaatggtattagcatccatgttagcccttggagcaccctcaatcgctttagccggggcggtacctgaaggaccccatataactacatcaggtaatgcaacaattaaagcgactcctgatatggcgacacttaatattcaggttagtgaaaaagcaaaagatgcagctcaagctaaaaaacaagtggatgagcgtgttgcaaaatattttgcctttttaaaagaaaacggtgtgacgaaagaagatattgatgctgccaacattcgtacacagcctaattatgagtatgataaaaaagcagaacgttcggtgattaatggctatacagcaacacgaaccgtagatgtaaaaatcaaaaaacttgatcagcttaataccttactggatggggcattagcagcagggctaaatgaaattaataatgttgagtttggcgttaatgatccagaacagtacaaagccaaagcacgagaagtggcaattaaaaatgccatacaacaggcaagttcagtggcaaaagggtttggtgctgatttaggggctgtttatagcgtaagttatcgcgcaccagaagcaacaccttatccgatagcacgaatgaaaatggatgctatggcattaagtgccccgtcaccggaagcagtaaaagagacctatcaacaacaaagcattgagtttaaagattacgttgacgtggtatttgaattaaaaacagctaaataa

SEQ ID NO: 768 - DNA, 864 bp, Proteus mirabilis
  unsure (851): Identity of nucleotide at the above locations are unknown.
tacttatataataattttgggcgaaaaatgaatacaatacaatgtggtgaaaacactaaacaagattgcgttattcaaaaactctcttatttttatccgcaatatcaaatattagaaaataaccaaaaagctttatacataatcagaaataatgcgctggtattacaaaactgcacaaatacaataactattaacaaagatcagattattttcttacaacaaggaaattataccataaaaacgctaggcaatgagccttgtgaaacaatttatattcctctttctgatgatttcttaagaaatttcatgtcaaaaaatagtgatattctcagtaatatcgatagagaggaaaatttctcatcggcttttatctgttttgaagattcacctctgatccatttttgtagtaatggttttgattatctttcttcacaaaattgtccagatacttttactcaattacgtattgaagaaatgctcattctattactttcttccgaacaaggtgccaatcttatggcgttactacgccaattaagtcataggcaagttgatcgcttgaaaatatttatggaaaaaaaccatctaaaaaattggaagctaaaacagtttgctcgcgagtttggtatgggtctcaccacatttaaagagttatttaatcatgtttatggaacatcgccaagaacatggatatgcgaaagaagaattatttacgcacatcaattattattaacaacagaaatgagtattgtcgatatttctatggaatcaggattctctagccaatcttactttacacaaagctatcatcgacgttttaatatgacaccgagtaaagcgagacatcttanattaaaattataa

SEQ ID NO: 769 - DNA, 1311 bp, Proteus mirabilis
cgatcacataaaaaaataaaccaagagcaacaacagttaaatcattcgttagtgactcttcaacaacaaaaagcacaagcagatgatcaattaacacagatcccagcgttgaagcttgagttacaaaataaggttaatgaattagctgagctgaaaaaaagtttatctacgggtgagaaagcttttgatgctttgatttcagaaaaaaatggtgtaatcgctaaattagagaaagctcaggcagatcttgccaataagtatcaagcattggatacccaatttaaagagaacaataccaccattgggcaacttaaagaaagcaaaatagcgaacgataacgcttatgctcaattagagaaacaactagcagaaaaacaatcgcttactgataaattaacgacacaattaacacaagctaaagatcagttagcaaaacaaaattctgaaagtaaccaactaattgcttcattaaaacagcagcaagtagaatcgacggctcaatttaagcaacaagaaagtgttttagcgaattctcaaaaagagtttaatgaagtctctaagcagcttgaagctcagcgtgcgctaacgaaaacacttgaagaaaaagaattaaaattaagtgagcaactaaaagaaaaagagagtgaaattaaaaaaataaatagcgaaaatgcgaatgctcaaaaagagtttaatgaagtctctaagcagcttgaagctcagcgtacgctaacgaaagcattagaagaaaaagaattaaaattaagtgagcaactaaaagaaaaagaaagtgaaattaaaaaaataaatagcgaaagtgcgagtgttcaaaaagagaataaaacattaaaacagcaattggataaagctatgggagaagggcagattattgcaagtcagcttgcatatgcctattcaattatcggtaaagataatgcccaacgaaataaatcaattctgtcggaaatacaaaaacagaactatgtgcaatacgatgataacacttactttaaaatcctaaaacaagggaaacctgtggattcaattgcaggtaaaacagttgttttcgctatgcatgaacaattaaccgatggtacagtaacacttaattatgacaaagctaagccgttaattttaccataccgtcaacttccactgcctcttaatacttttgttgctaaagcaggcttaaatggcaaagctaaaatttatattaaacctgatggcgggtatgggaaagatggtatcccagggcaagtacctccagaatcgatgtctatagtgacaattgaaattttagctatcaaatag

SEQ ID NO: 770 - DNA, 819 bp, Proteus mirabilis
catttcaataaccaaggtaatagttatccaataatggcttctagcaatatggcttacacaaagatccgccaaccaaagctttctgatgtgatagaacaacaacttgagcatcttattttagaaggcaccctacgtccgggggaaaaactcctgcctgaacgtgagctggcaaagcaatttgatgtatcgcgtccttcattgcgtgaagcaatccaaaaattggaagcaaaaggttttttattacgccgccaaggtggtggaacctttgtgcaagataacctttggcaaagctttagcgatcctctcgctcaactcctcagtgggcatccagaatctcaatttgatctgttagaaacacgccatgcccttgaaggtattgcggcttattatgctgcattacgcggtactgatgatgatcttgagcgtattaaagccagtcatgctcgcattattgatgctcatgataaaggggatatcgcagcggagtcggatgcggtattgcaataccaattaatcgttacggaagctgctcataatgtcgttttgctacacttattaaggtgtatggtgccaatgcttgagcagaatatccgacaaaattttgagtttctttatacacgtaaagagatgttaactgctgtaagtgagcatcgcacacagatttatcaggcgattattaatagagagccagaagcagcccgtgaagcttcacaccgccatctggcctttattgaagatgttttgttggatatgagtcgtgaacatactcgtcgtgagcgttctttacgccggctccaacaacatcctgatttattttag

SEQ ID NO: 771 - DNA, 2148 bp, Proteus mirabilis
gagaaaaataatagcgagatatctatgaactatataactaaaaatacgccatctcttcatccttcaattattgatgggcttatttatttttcaaaaaagaataaaggaacattaaaaaaagagcagcttattcattttttaggtaatgacgacaatctctctgaattaaatatcatagaagccgctcaacaactcaatttaaaatgcgaattttcattttttaatagtgaaagtgagtataaagataaaataattattgatacacttatcgaaattaatggttattggtatattctaaaaaatagaacaagtgataaattaattattattgacccaagcactaacacagagagtcattatcatattgataaaaaaatcacttataccacactgctaattattaataagatatttacccctaaacagagcaagtttagcttaatgtggtgtattccatcactattaaaacaaaaaaaatcattatatttaatttttattttatcttgttttattcaattatttgctttagttaatccaattatttttgaaaaaattattgataaagtattaacggggagaagcctctctaatttgcaagttttaggggtactccttgtgctgattgccattatagagcctatctatcttttattacgagataaactttatgcttttgtttcttgtaccctaggtgccgaattctcagggaaaatttatcaacaccttattcggctacccagtcagttttttaatcaacgtcaatctgggcaaattattgctcgtattcaagagcttgctcatattcgccagtttattactggctctgcgttgatgatggtactggattttatttttattatcgtatttctttcagtaatgtttgcttattccgtattattaacttggataaccatagcagcattagtcgtttactttttattttggctgatacttggccccatgatccgttattgggttgaacaagagtatcaagcaaatgctgataatacgagcttattaacagaagctattaatggtatagaaaccataaaaataacagcaacagaacatcaatttattgaaaagtggcaatataaactcactaattatatccttaagcgtttttcagcggccaaaaaagcgttacttgctcagcaattaattggggctattcataaaattactatggcaattatcttgtggcatggtgttaatctgattatgaaagcgcaattaagtgtgggcgaattagtggcttttaatatgtttgccacccatattacacaacctattttacgtttagcccaactttggcaagatgttcaacaaacaggcatctctatacgtcgtattggcgagattgttaatactcccacagagcatcagcatcaaggacttgctactgtacctaatattgcaggaagtatagtattttctcatgtacgctttcgttatacagccaatactccagatgtgattgagcaactctctttttcgatccccgcgggcaaatttattggtattacaggcccctctggttcaggaaaaagtactatcacacgtttaattcaacgtttttatactcctcaacaaggccagatttatattgatggtatggatctcgccattgccaatccccttactttacgccaatcaattagtgttgttttacaagataattttttatttagtggcactattatggaaaatattcggttatcaaaacccgattgtagtgaagaagatattattgaagcgagtaaattagccggcgcttttcattttattactcaactccctgagggatttaatacacaagtgggtgaaagaggtagtaatttgtcaggagggcagcgtcagcgtattgcgctagcaagagcacttttacctgatccacgaattcttattttagatgaggcaacatcggcgttagattatacctcagaagcagaaattttagccaatcttccggctatttgtaaaaatagaacggtaatttgtattgctcatcgacttaatgctatttctatttcagattatatttatgttattgataaaggtcgtatattagaagaaggtacacatagcgatttattaaataagaaaacactttatcagcaattgtggcaacaacagacacagcaataa

SEQ ID NO: 772 - DNA, 213 bp, Proteus mirabilis
atcatggataacaacttaagagaaatcgaatgcgagctcgctgctttaaaaatagtcactaaatctctactttgtgcattaaatgataagcaacgacgcgatatgttaggcaatatatctttagttattgaagatacttcaagcagatatccacatcacaatgaagttataaatcttactgagcaatatgtgaaaaaacttatccaagcataa

SEQ ID NO: 773 - DNA, 927 bp, Proteus mirabilis
atctgccacaatatactattggttgctattctttttattaggattataagtttaaaaggtggtctaatgaatgaattacctgcgagtttagatgaagcaacaggttggtttgttgctaatcaagaactctttattcaatatgctgtgaatatcgttgctgcattcttgatcctatttattggtctttttgtcgctaaaatggtcagtaaaggggttgcacgaattttaacgttacgccatatcgacgcaacggttgtgacattcttgtctgtcttggtgcgttataccgttattgcattcactttgattgcagtattaggtcgattaggggttcaaacagcttctgttatcgcagtacttggtgcggcaggtttagcggttggtttagcattacaaggctcactctctaactttgcagcgggtgttttaattgttatcttccgtcctattcgtgctggtgaatacgtgatgattggtgctgtcgaaggtacggtgcgagatgtacaaatattctcgaccacattacgttcagcggatgaccggatcattgttattccaaatagcaaaattatcagtagtgaggttattaaccttagccgtgagccaaatcgtcgtacacaaattattgtcggcgttgcttatgatgctgatattgataaagtcaaaaaagtgctcggtgatgttgttgcgcaagataaacgtattcaacataaccaaggcgtgacaatacgtttacatgaaatggcgccttcttcattaaactttgtggtacgtgtttggaccaccaatgatgatgcatggccagtttattgggatcttatggaaaactttaaacgcgcgctagatgcaaataatattggtattccattcccacaaatggatgtctatatgcatcaagcacaaaataccgtgatgaaagcagaataa

SEQ ID NO: 774 - DNA, 231 bp, Proteus mirabilis
ggtattaacaaagaggaaataatacatacactagaaaattgtcagcatatcattttcactcacttatctgtttttccgcttattattatttctttgttatcgggtgcaagtagcgaaaatttctgccacttaacaatcaggtttattctgtttttgctgcttgttttttctacagactttgacgcttgtttatttgaaatcgcgttaagtacgatcgcttataaagtctga

SEQ ID NO: 775 - DNA, 657 bp, Proteus mirabilis
caaatgataaagtcattaaataaagatgattttaattatcatcgattgatacaacatggaaataattctttgaaaatattcatatttagctttctctctctgattatcttacccatttctgtttcccaagcgataacaccgacacaaaataaacagctggtggcttatgcaacggatctacctagagccgttatttatgatccagcctaccgtaaaattaattatcctaatggtgatgtgcctgctcattatggggtgtgtagtgatgtgattattcgtagttaccgaggaattggcattgatttacaaaaattgttacatgaagatatcaaagccaattttgcactttaccctagtaagcgtatctggggacttagtcgacctgatactaatattgatcaccgcagagtacccaatttggaagtttttttctcgcgtaagggaaaggtgaaacctattagcaaagaggcgtcagactacttgcctggtgatattgttagctggcgcttagataatgggcgtcctcatattggtctcgtcatagacaagaaaagcagtgataatcagcgctatttagtgatgcataatattggttttggacaagtcgctgaagatgttttattttcgtggaaaataaccggtcattacagttattaa

SEQ ID NO: 776 - DNA, 1038 bp, Proteus mirabilis
aataaatcaaaagaggtgaatgtggaaattttagttacgggtggaatgggatatatcggtagtcatacatgcgtgcaaatgttagaagcaggcatgacgcctattattttggataacctcagtaatgcaaatgaagaggtacttaaccgaattgaagcattaacaggaaaacgcccactgttttatcagggggatattcgtgacgaaaaacgactggccacaatttttactcagcactctattcaatcagtgatccatttcgctggattaaaagcggtaggtgaatctgttgaaaagcccatcgaatactatgacaacaatgttaacggtactttggtattagttcgttgtatgcgtgatgcgggcgtaaaaagtattattttcagctcatcagccacggtttatggtgatcctcaaactgtgcctattactgaagagtcacctgttggtggcactaccaatccttatggcaccagtaaatatatggtcgagcgtattttgtctgatctctatattgcagatgagagttggtctatcagtttactgcgctacttcaatccagtaggtgctcatccatctggcactatgggggaagatcctaagggtattcctaataatttaacgccttatatctcgcaagttgcgataggtcgtcgtgaaaaagtcgcggtatttggtgatgattacccaacaaaagacggtactggtgtacgtgactatatccatgttatggatttagctgatggtcatattgccgccttaaatgcgttaggagaaaaagcagggttacatatctataacctaggcacagggaatggcaccagtgtgattgaaatgattgaagcatttcgtaaagccagtggtaaagcaatcccttatgaaattcagccacgtcgcccgggagatatcgcacaatgttggtcaagtcctgccaaagcagaaaaagacttacactggaaagccattcgctctattgatgatatggcagccgatgcttggcgttggcaatcacaaaatcctaacggttatctgaaatag

SEQ ID NO: 777 - DNA, 1557 bp, Proteus mirabilis
aaaattgcaaacttaaggataaaaataattatgtcagactatctatcatttttactgggaattgttcctttagccgttctgatttttatgattttaaaaatgaaatcggccgttcatcacgctgtcctcgtttcgctaattatcactgtggctctcgctatttttcattggaataacaccctacaatttgcctctgtatctgtactttatggtgcggtaaagggattatggccgattatcatcgttattctggcggctatttacagctataacctaatgctaaaaacaggaggaatggaggtattaaaagacgtattagcggggatcagcgatgataaacgcgtacaagttttacttatctcttggggttttggcggttttttagaagcagttgcaggttatggtacagcagttgctattcctatcggtattttaatcgcactaggttttgatccctttaaagcagctgtcgcttcactagtcgcaaatacggtacctaccgcatttggtgccgttggtattccagtgtctattttggcacaaaataccggccttgatgtattggtgttaagtaaaaccattattatccaacttggtttattcaatattctattaccttttgtcattgttgctattgctggtggtggtattaaagccattaaaggtgtcggctttattactttaatgtgtgggatcagcaccttaatccctcaatatattgtcgcagctaatttaggtgcagaattacctgcctttgcaggaagtctagtcagtctgattgtggttattttcttggctaaacgcatgaaaacaggccatgataaaagtaaacagccaacaaaacactcagctaaagagctattagtcgctagctctatctatctgtttacttttatttttatcttagcctgctctccgctattccctacaatccaaaccgcagtaggaactattgcaactaaaattccttttgtattaagtgatactcaaactgaatatcaaactattgcttggttaagtacgcctggggtattgattattttagcgagttttgttggtggcactattcaaggtgcaagcctttcaacactcttttctgtattagtaaaaaccacaattcaattaaagaactctattattgccattatggctattgttgcgatggcaacggtaatggatttcagtggcatgattggtagcattgcggaaacattagttaactttactggcgctggatttatctttattgcccctgtcattggtgcactaggaacgtttgtaaccggaagcgatacaaactctaacgtactatttggcaagcttcaaaccagtgcagcggcaaaactccatgttgatccctttattctcgcagcggctaatacctctggggcgactggcggtaagatgatttcaccacaaagtatcgcgatcgccgtttcggcgaccaaaatggatgggcaaagcagtgccattatgcgagaaacattaaaatattgtattgcctatatcatcattctaggtgccaaaatcggcattatttatcacctaatgaattaa

SEQ ID NO: 778 - DNA, 615 bp, Proteus mirabilis
actattcccctaaatgcgacgtttattcttatgtcaatacaaaacacattaccagattactcagcaattgattcattattacaacaacatgccgtgcctttaactgccgcagagatgcatggcttaattactgggtttatttgtggagcagtacatgacaatagttggaaaactttgttacatgaactgactaatgagggcttagcgttccctaaatcgttatcagaaccccttgaatcactttatcacgtcactcatgagcaacttgatgacagcgtatttaatttttctatgctgttacctgacgatacagaatctgtttttcctcgagctgatgcccttgcagggtgggttaatcattttctattaggattaggtgttgcacaacctaagttatctgagcataaagagttgacggaagttatcactgatttgcgtaatattggtgcattaggctatgaagaagatgaaaatcaacaagagcttgaagatgcactcgaagaagttacagaatatgtcaaagtctctgttcagctgtgctatatcacttttgtcgcctcaaaagagacaacaacagaaaatgataaacaagatgaacaacggacattacattaa

SEQ ID NO: 779 - DNA, 183 bp, Proteus mirabilis
acgataaaaaattgcaaacttaaggataaaaataattatgtcagactatctatcatttttactgggaattgttcctttagccgttctgatttttatgattttaaaaatgaaatcggccgttcatcacgctgtcctcgtttcgctaattatcactgtggctctcgctatttttcattggaataa

SEQ ID NO: 780 - DNA, 1203 bp, Proteus mirabilis
tggcaggaaaaatttaaggctaaaatcagcatgaatgtgattattgtgggtggtggaatggcgggtgcaacgttagcactagcactttctgcattaaataagggtaatatttccatttcgcttattgaagcgcgagagccagataatgggcatcccggattcgatgccagagcgatcgctttagcgcatggcacagcaaagcgattagcacaaatcggattatggtcggtcttaaaaccctttgtgacacctattaatcacgttcatgtttctgatagaggccattgcggttttgtgaacataaatgcacaggactacgatattgacgcactgggttatgttattgaattacatgatgcggggcgtcaactgtttgcacagttgaaaaaacaacccaatattacgctatattgtcccgctaaagtggagcatgttcagcgccatctcgataacgttgaagtgacacttgatgatggtacacaacttagcggtgatttactggttgccgcagatggtacacattcacccattggtcatcaatgtcatattcaatggcagaaaacgccttatcatcaagttgcggtgatcgccaatgtaaaaacagagattgatcccaaaggttgtgcatttgagcgatttacacaatttggtccattagcaatgttacccatgagcgaagggcgtagttcattggtgtggtgccatcctattgagaaattagagcaagtttcacaatgggatgatcaaacaaccattgcacagttacaacgggattttggctggcgtttgggtaagattgaacaagtagggcagcgtcattgctatccattagttttgcaaaaagcacagcaaatgatcagccatcgtttagcattgataggtaatgcatctcaaaccttgcatcctattgcagggcaaggttttaatcttggtttacgcgatgtaatgacattagccaatacattaacctcggccatacaatcaggtcttgatatcggcagttatcgcgtattatcacaatatcaacagcttcgcgaacaggatagagaaagtactattacgatcactgatggcttagtgaaagtgtttgcgaatcgttgtatgccgttaattatctcccgtaatctaggcttaatgacgatggaattagtgcctgcacttcgtaacaaattagcacaccaaacattaggttggacaaactga

SEQ ID NO: 781 - DNA, 426 bp, Proteus mirabilis
gttaggtgttttatgaagattagagaaaatgatttttgggtttatttttcatctaaaaatgaaagcaatagcacaaataacgacaaaattggtaagtggatgtatttttttaatgatgcggaattcacagaaaaaatatgtcaaaaagcaattttaaatagtgtagtcgagcattgtaaatatacgaataatgctgaatctggagttgcgtgtttttacttaaatattgatgatattgaagggcataaaaaagttattaagttttttttagataataaattaattcccataaataaatcaggtaaatttaagaatatatcattcaaattagacatgcagacaatgaatcgggaatatggagacaagtttgaaggtaagttatcattagagcattttattgatttgagctctggtatttttaagtga

SEQ ID NO: 782 - DNA, 663 bp, Proteus mirabilis
ttttttgccctgaagtgcatccgtttattttctgttaaaatagctcatattaaatatttagtagtaagaaaattaggagtaaatatgaatattctacttattaacggtggacaaaaatttgggcattctgcaggacaattaaaccgtacattacatgatatcgctctggcacatttggcgacattagggcatcaggtaaaagaaacacaaattgaagaaggctatgatatcaatgaagagatagagaaatttatctgggctgatactattatttatcagatgctgggctggtggatgatgatgccatggaaagtgaaaaagtatatggatgaagtctatacttatggtcacggcaaactatatgaaaacgatggacgtactcgtcatgatccaagcaaacaatatggtagcgggggattgttgcaaggtaagcaatatatgatctccgtgacttggaatgcccctattgaagctttcaatgaatttggtaatttctttgatgggcgaggggttgatggtgtctattttgcttttcataaatcacaacaatttcttggtttatctcagctgcctacttttatgaccaacaacgtcattaaagagcctaatattgagaaagatattgtagaatataaagcacatctaaccaaagtctttggctaa

SEQ ID NO: 783 - DNA, 189 bp, Proteus mirabilis
ttagataagaatgctgtaaatattgaatggctagtaaatatagctaaagttaaaatagtgatcgagatctgcttttttcttaataaaaaatcgtcatatataccaaaaaaggggatgtcttattattactctctatttttaattgtgactaaaacgactattgttagggtattaacaaagaggaaataa

SEQ ID NO: 784 - DNA, 1176 bp, Proteus mirabilis
atgggcaagaaaaaacaaacaaaatacccattaccaagaggtgtgactattcgccaaaataaaattaaagaaacacttattattacattcacttataaaggggttctttgtagagaacctctctctaggttagagataaacagcaaaaatattaaatatgcagaaaggctactcgcagaaattcagaataatatcgaaaaaaacatttttaactattcaaagtattttcctaactctaaaaaattaaatttatttggtgttaataatcgcgaaaaaagggttattgattatctagaagagtatttagttatttgtgaaactcgaaatttatcaccatcaacaattaatggttacaaaaaatgtaaaagtgccttatcagatttgcaccaattgcatgtttcatcactcactcctgcgatcctaaaaaattggatacaaaagcaaactactgtattaaaaactattcgtaatcagttatcttttttacgaagctcactagatgaggccattactgatgggattgtatcaatcaacccagtcagccttgtatcggcatcaagatatcaatcaaaaaataacagtgctgaaagtaactatattgtcgacccattatcaccaaaggaagtctctgccctactcgttgcggcaaagtacgagcaatggaaaaacttattccagtttgccattaatactggattaagaagctctgaactatgtgcattgagatggagtgatatagatttcatagaaaatactgcacacgtgcaatccgccagcgtggttggagttattaagaaaaccaaaactaaagctggtaccagaaaggttgaattgaatagtgaagctctgaacgccctgaatagccaaaagcaattcacgtttatgaaagatgatgtcattttcgaagacccaaaaacaaataaagcctggacaggcgctgatgcaattagaaagaaagcatgggtaccaacattgaaaaaggcaggtatccgatatcgcaatccctaccaaacgagacatacctttgccacgaggcatattagccaaggtactaacttgttttggctagctggacaaatgggacataaagggcctgaaatgttgtttaggcactatgggaagtatcttaaagaatatgatgggaatactataaatactctatatactaatacataa

SEQ ID NO: 785 - DNA, 1074 bp, Proteus mirabilis
ataagagagaagattatgtcaaaactgatttttgatcccgttgagcatcctcatcgtcgttataaccctttgactgggcagtggatattagtttcaccccatagagcaaaacgaccatggaatggcaaagatgaaaaacctcagatagcgacacttccctcttatgatccacattgttatctgtgcccagggaatacccgagtttcgggtgataaaaatcctgattacacaggcacttatgtttttaataacgatcactctgcattattgacagaccaatatagtgttgaagtatccgataatccactcttccagactcaagcagtgagagggatcagtcgtgttgtttgtttttcccccgatcatagtaaaactattcccgaattacctattagtagcctacgtaaaatcattgatacttgggataaccaaatagaagcgctaagtaaagagtatctatgggtacaagtatttgaaaacaaaggtgaaacaatggggtgctctcaacctcatcctcatgggcaaatatgggcgagtgattttttacctaatgaattagcacgcaaagatagccaattaaaagactattttaatcaatatggccgtaatctattaatggattatgttaaagctgaatctgaagacggtagtcgaaccgtggttgaaactaaatactggttagctgtcgtgccttattgggcatcatggccttatgaaaccatgctattaccaaaaagtcatattcgcagaatgagtgaattaacggctgaacaacgtgatgatttagccttggcaataaaaaaattaaccagtcgctacgataatctatttcattgttcatttccttattcaatgggatggcattttgcaccttcttttaaagagggcgaaagcattgagcattggcaattacatgccctgtattatccgccgttattacgctctgcgacagtacgtaaatttatggtgggttatgaaatgttggctgaatcgcaacgcgacttaacgccagagcaagctgcttataatttacgccaagtaagcgatatccattataaagagcaagaaaattag

SEQ ID NO: 786 - DNA, 192 bp, Proteus mirabilis
gaagtttttgaaaatcgttttcacttaagagaagcaacaaagaaagaaagagaaacaatgcctctcttagctagctattatgcgctgaatgaaaatattttttcaagagcaatatttgctttttgtagtcaaatttctactaatgcagtgcataatatgggatgtgataatttattgaatgatataacttaa

SEQ ID NO: 787 - DNA, 1866 bp, Proteus mirabilis
atgtctattgaaattaaagtccctgatatcggtgcagatgaagttgaagtcaccgaagtgatggtgaaagtcggtgatcgtattgaggaagaacaatccttgatcaccgtagaaggcgataaagcgtctatggaagtgccatcaccacaagcgggtattgttaaagagatcaaaattgccgtgggcgacaaagtcgaaactggctctcttatcatgatctttgatactgaagagggtgctcaggcacccgctcaagaagccgctcctgcgccttctgctgccgcacctgctgcgagcgaactgaaagaagttcatgtaccagatatcggtggtgatgaagttgaagtcaccgaggtgatggtcaatgtaggtgataccatttcagaagagcaatctctgatcacggttgaaggtgacaaggcttcaatggaagtcccagcaccttttgctggcgtagtaaaagagatcaaaattgctgtcggtgataaagtgagcacaggctctcttatcatggtatttgaagtagctggtagcgcgccagcaccttctgcatcagctccggctcctgcagcatcagcaccagcagcctctgcaattaaagatgttaatgtaccagatatcggtggtgatgaagttgaagtcaccgaagtgatggtgaaagtgggtgatactattgctgaagagcaatctctgatcacggttgaaggtgataaagcttctatggaagttccagcaccttttgccggtgtagtaaaagagatcaaaattgctgtcggtgataaagtgaaaacaggctcactgatcatgacctttgaagttgccggtgccgcaccagcagcacaagcgccagcagcgcctgcagcatctacatcagcagcaccttctgctccagcaaaagcgcctgcttctgcaccagcagcaaaagaagaatttgttgaaaacgaagcttatgtccatgcaacacctgttatccgccgtttagcacgtgaattcggtgtgaacttagcgaaagttaaaggaaccggtcgtaaaggacgtatcttacgtgaagacgttcagtcttatgtgaaagagttaattaaacgtgctgaatctgcacctgctaatgctggtggtggattaccaggtatgttgccttggccgaaagttgacttcagtaaatttggtgaaattgaagaagttgaactaagccgtatccagaaaatctctggcgctaacttaagccgtaactgggtaatgatccctcatgttaatctgtttgatgaagcagatatcactgaggttgaagaattccgtaaacagcaaaataaagaagctgagaagaaaaaactggatgttaagatcacgccattagtctttgtgatgaaagcagcggctaaagcactggctgatatgcctcgctttaacagctcaatttcagaagatggacagaaactgatcctgaaaaaatacatcaatatcggtatcgccgtagatacacctaacggtttagttgtacctgtgtttaaagatgtaaacaaaaaaggcatcttagaactctcttatgaattagcagaagtttctaagaaagctcgtgcaggtaaactgactgcatctgatatgcaaggcggatgcttcactatttctagccttggtggtatcggtactaccggttttgcaccaatcgttaatgcgccagaagttgcgattatgggactgtctcgttcttcgatgaaaccagtctggaacggtaaagagttcgtaccacgcttaatgttaccaatgtcattatctttcgatcaccgtgtgattgatggtgctgacggtgctcgattcatcactctgattaatcagtacatgagcgatttacgtcgtttggtaatgtaa

SEQ ID NO: 788 - DNA, 639 bp, Proteus mirabilis
ttccttgctgatggattaatcatgacacaaccccctgttttccagcaaagagatcagatacgtaaagctatccgccaaaaacgccgtcaacttactgtggcacagcagcaagatgctgcacataaactctctgaacgggtactccatcatcccaaagtcaagcaagctaaaacaattgccttatttctctcttttgacggcgagattgataccgctcctctaatcactcatttatgggatttaaataaacaggtttgtctgcctgtattacacccttttcatcgccatcatttactttttttacgttacgctcccaccacgcagttagtgaaaaatcgttttaatatttttgagcctccactcaatgtgaataatattattccaatatctgatattgatattatctttacgccactggttgccttcgatgaaagcggtcagcgactcggtatgggcggaggtttttatgatagaacattagaaaactggcaacggcagtcattttatcctatggggcttgctcatacatgccaacaagttcattcgttaccgagcgcaaattgggatataccgttacctgaaattattacacctgataaagtatggcgttttgatgaacgactgatacagagaaattaa

SEQ ID NO: 789 - DNA, 708 bp, Proteus mirabilis
aggaataatgatatgaaaaaagtattactcagtcttgctatgctgagtgtaatatcaacgccggtattggctaaagctcctgtagctaacttaaaaatcaatggtgatattaagccaccaacttgtactattaatggggcgacacaaagtgatatgatttttgattaccgagtcataagcccaacgcttatccctcaatcgaaaaactacgaatatcctaacggtatagtccaaaatacagttacgattgaatgtgatgctaaaacatatttaacctttgttgcatctgacacttatgacagtgcggaattagctaataatacgctagcacagtttcatttagttgataaagaaaatcctgaaaccgcagttggagcagcctcttttttgtgggaggatgtgactgttgatagtaaaccagcgtacatttcacgagcaaatgatgttactatcacagagacaaattactataacgttctatacaaaggcgcaaccaatggttggacatcagaacaacaaaaaggcaatgttagtaaagaatctctggcactaattccaggtgaagttttccaagcagtttttaaagatgtatataaaattccttcttttcttttatccaaagatgcattaaataaaaaaggaatagatttatctaatggcttagattttatgggtgaagctgttctcacttttaactttggtgtctaa

SEQ ID NO: 790 - DNA, 2619 bp, Proteus mirabilis
caaagaagcgaggagaaagtcgtgctagaagaataccgtaagcacgtagcagagcgtgcagctgaaggtgtcgttccaaaacctctcgatgccacacaaacagccgcacttgttgagctattaaagtcccccccaaaaggcgaagaagaattccttcttgatttaattgttaaccgtgttccacccggcgttgatgaagccgcttatgttaaagcaggttttttaacggctctcgcaaaaggtgaaacaacatcaccgcttatcacgccagaaaaagccgtagaattattaggtactatgcaaggtggctataatatccatgcattaattgaagcgctagataacgacaaactggctcctattgcggcaaaagcactttctcataccttattgatgtttgatagcttttatgacgttgaagaaaaagcgaaagctggcaacgtttacgcgaaacaaattatgcaatcttgggctgatggagagtggtttactgaacgtccagaacttgctgaaaaaatcacggtaaccgtgtttaaagtgacgggtgaaaccaatacagatgatttatcaccagcaccagatgcttggtctcgtcctgatatcccattacacgctctagctatgctaaaaaatgcccgcgaaggcattgaacccgaccaaccgggtagcgttggcccgattaaacaaatcgaagcactgaataaaaaaggtttcccactggcttatgtgggggatgttgtcggaacaggctcttcacgtaaatctgcaaccaactcggtactttggtttatgggggatgatatcccttatgtaccaaataaacgcggtggtggagttgtattgggtggcaaaattgcccctatctttttcaacacgatggaagatgccggtgcattacctattgaggttgatgtttctaaattaaatatgggtgatgttattgatatttacccatacaaaggtgaaatccgtaaccatgaaaccaatgagttattggaaacctttgcactaaaaacagaagtactgattgatgaagtgcgtgcgggtggccgtattcctttgatcatcggtcgtggattgacctcaaaagctcgtagcgccttaggtttaccacctagcactttattccgtcatgccaaagcagtggaacagagcgatcgtggtttctcacttgcacaaaaaatggtgggacgcgcttgtggtcgtgatggtattcgccctggtgaatattgcgaacccaaaatgacctccgttggctctcaagatactacagggccaatgacacgtgatgaactgaaagatttagcatgcttaggtttctccgctgatttggttatgcaatcattctgtcataccgccgcttatccaaaacctgttgatgtaaccacccatcacacgttacctgattttattatgaatcgtggaggggtttcactgcgtccgggtgatggcattattcactcatggttaaaccgcatgttattgccagatactgttggtactggtggtgactcacatacacgtttccctattggtatttcattccctgcaggttcaggcttagtcgcttttgcagcggctacaggggtaatgccattagacatgccagaatcggtgttagtacgctttaaaggtaaaatgcaaccgggggtaacgctacgtgatctggttcatgccatcccactttatgccattaaagaagggttattgaccgttgagaaaaaaggtaaaaagaatattttctctggtcgtatcttagaaattgaaggtttacctgaacttaaagttgagcaagcttttgagctagctgatgcatcggctgagcgttctgctgcgggttgtacgattaaattagataaagcaccgattatcgaatatctacaatctaacattgtcttattaaaatggatgatagcagaaggttatggtgatcgtcgtacacttgagcgtcgtattacggcaatggaaaattggttagctgatccgcaattacttgaagcagatgcggatgctgaatatgctgctgtaattgagatcgacttaaacgaaatcaaagagcctattctttgcgcgccaaatgatcctgatgatgctcgtctattatcagaagttgcaaacagcaaaattgatgaagtctttattggctcttgcatgaccaatattgggcatttccgtgcagcgggtaaattactcgaccaacataaaggtcaattaccgacacgcttatgggttgcaccaccaacaaaaatggatgcagcacaactgactgaagaaggttattacagcgtctttggtaagagtggcgctcgtatcgaagtgccgggatgttcattatgtatgggtaaccaagcgcgagtggcggatggggcaacggttgtttcaacatcaacacgtaacttcccgaatcgtttaggtacgggggcgaatgtctaccttgcatccgcagagcttgcggcagtggcttcactgttaggacgtctaccagagccacaagagtatcttgattttatcaataaagtcgatgaaacggcggaagatacttaccgttatctcaattttgaccaactagagcaatatacagataaagcaacacaagtgattttccaaaccacggtataa

SEQ ID NO: 791 - DNA, 936 bp, Proteus mirabilis
tacacagtagaacataaaatcaaagagaatctgtcaatgaaacgtcctgattatcgggccctgcaagcccttgatgccgttattcgagagcgtggttttgaacgagccgcacaaaaactatgtattacgcaatctgccgtttcacaaagaataaaacaacttgagaatctatttggacaacctttattagtacgtacggttccgccccaacccacagagcaggggcaaaagctactcgcattactgcatcaggtcgaaatgttagaagagcagtggttaggtgatgaaaatagtggctcgacgcctcttttactctctttagctgtcaacgcggatagtttagctacttggttattgcctgctttgcacccggtattaacacaacttcctatccggcttaatattcaagtagaagatgaaactcgtacccaagagcgattaagacgtggtgaagtggttggtgctatcagtattcagccccaagcattgcctagctgtctagtcgaccaattaggcgcattagactatctttttgtggcatcccctgattttgcccaacgctattttgcaaatggggtcactaaatcatctctgttaaaagcccccgctgtcgcatttgaccatcttgatgatatgcatcaggccttcttacagcaaaacttcggtttatctcccggtagtgtgccctgccatattgttaattcttccgaagcctttgttcagttagctaaacaaggctcaacatgttgtatgatccctcatctacaaattgccgatgagctaaaaagtggtgaattgattgatttaacgccaggattatgccaacgccgcatgttgtattggcaccgttttgccccagaaagcagaacgatgagaaaggtaacggatgcgttacttgattatggtcgtaaagtgcttaagcaagatgaagagtaa

SEQ ID NO: 792 - DNA, 657 bp, Proteus mirabilis
atgactcaagatgaattaaaaaaagcagtaggttgggccgcccttgaatatgtaaaaccgggtactatcgtgggcgttggaacaggctctacggcttctcattttattgatgctcttgcaacaatgaaaggtcaaattgaaggggcagtttctagctcagaggcttcaacggcaaaactaaaaagctatggcattcccgtttttgactgtaatgaagttgattcgctcgatatctacgtagacggtgctgatgaaattaaccatcaaatgcagatgatcaaaggtggtggtgcggcattaacccgtgaaaaaatcattgcagcggtggcaaaaacctttgtgtgtattgtcgatgaatcgaaacaagtggatgttttgggtaaattccctctgcctgttgaagttatcccaatggctcgctcttatgttgctcgcgagctggttaaattaggtgggttacctgaatatcgtgaaaacgtcgtgacggataatggtaacgtgatcttagacgtttataatctcactattctgaatcctattgagctagaaaataaaattaatagtattgcaggggtggtcactgtcgggcttttcgctaatcgcggagcagacattgtattaatggggacttctgaaggtgtgaaaaccattaaatga

SEQ ID NO: 793 - DNA, 300 bp, Proteus mirabilis
caaacaggagaaaagatggccgtcgatcataatgattttatttcccagccaagacgcgcggaaattcaacctgaattctcacatataattgaatgtgttgtgacaaatctaacacgttactttcctaagcttatacacagtctatacgtatacggaagtgtagctgaaggccgggcagaagtaggtaagtctgatctggatatgacagttattttcaaatatgaacctgatcagactattaaagagcaatttgcaactgttcagtctgttcttgaaaaaaaacaatcccgttatcagtaa

SEQ ID NO: 794 - DNA, 693 bp, Proteus mirabilis
ctaattatggataataagcgaacacagcgggatattatatttagcataatatggattatttggtcatgtgcattaatggctttttggcgatatcaaatagctggtgagcttttgatcacccttatcctaatttttagcattattatttactctataactttgaggttaaaaaaaacggcaatgtttagtcgaaaaacagaaacaccaaaagccgcggagcctattgctccagttatggcagaagaaaaaaagcctatgccggagcaaaaattgtataccattattgctaaaggcactgtatttcaaggtgatattaacgttgatggtgatattcaaatttggggtaaaatttcagggaatatcaatgtaaaagatggcgtgatccgtgttatgcatgcgggccaagttgaaggggaattaacggcgccagacatcattattgatggttttgttaaaggtatttgtgccgcaaacaatcttgatattctagagcatggtgaactacgtggcactagtcgttgtggcagtatgtcaattaaacgtggcggtgtctttactggacaatctgaacaggttgaacaccaagctaaagccgttgcacagcaacgtgttgtatctattaaagaaggtacagttaataccaataaagagtctgtaactgcagaaagtaaactaaaagaaaataaaaaataa

SEQ ID NO: 795 - DNA, 633 bp, Proteus mirabilis
gtgatagcacttccatatgaacggatttttatgacacaacaaactaatggggcttttggccccttttcagataccatcaattttattattgaacttgataaactcaaacgcgtttaccgcaaaaataatgtattagacaatagccgtgctgaaaataccgctgagcatagttggcactttgctgttgcagcaatgagttttcaaccttatgccggtgatattgatataggtagagcgatccagctagctttagtgcatgatattgtcgaaatcgatgctggcgatgtgatggtttatgatgttgctgctcgtgaagcgattaaagagcaagagcaaaaagcagccagacgtattttttcgttgttacctgcaccacaaagtgaatattttcttaatctctggcttgaatatgatgcagcacaaacccctgagtcacaatttgccaatattttagatcgcgcaatgccaatgttaatgaatctacataacgaagggcaaagctgggttgaaaataatatccgtttagaacaagtgattgcacgaaatctatttatcgaaaaacagtggccagaattttggcaatacctctatcctcaattactagaggctcagaaaaaaggctggttaaaataa

SEQ ID NO: 796 - DNA, 1023 bp, Proteus mirabilis
acagtgtatcggattaactacatagcgggtgatgtcatgactcaaaattctactcagacaaaacgccctcatgccgcaatcaatttaccactcaccttgatctctttagatgattggtcattgataactgcaacaggggctgatagtgaaaaatacttacaaggccaactaacagcggatattgccgcattaccgactacagagcacactttagccgctcattgtgaagctaaagggaaaatgtggagtacattgcgcattttccatcaacaagcaggatttgcttatatattgcggaaaaatgttgctgaaaaacaacttactgagcttaaaaaatacgccgtattttcaaaagtgacttttactgaaaatacagatgcggtgttattaggacttgcggggcaaggcgcggcacaagccttagcggaattcttccctgagatcccccgtaaagccaatgaagtggttaatcaccaaaatagctacttactgcaactcccgttacctacagagcgctttttaattgttacagatgaagagactgccaaaaaactagccacgacattgcccgcagaaaccagtgatagtgaccagtggttagcccttgatatcgaggcgggttatcccattattgatacccctaatatcgaacaattcttaccacaagcgactaacttacaagcattaccattaagtatttgctttaaaaaaggttgctatacaggtcaagaaatggtgtctcgtgccaaattcagaggcgcaaataaacgtgctatgtatctgttatcaggtggcgcagcacaattgcccgacattggcggtagcgttgagtggcaattaggtgaagataaatggcgcaaaacaggcacggtattaagtgcggttcgtatggccgataacacgattatcgccgaagtggtgatgaataatgatatggatgctgacagcgtatttcgtgtccaaggtgataccaccagccgcttaacgattaaacctttgccttactctttagaagatgagtga

SEQ ID NO: 797 - DNA, 2103 bp, Proteus mirabilis
atctctatttttaaccacattgcatttaatatgaaaaatagagaaagcacgaaatttataaaaagcatcaatatcattcttaatctttcgggaaaacaattagataatacaaaaccaaacattaataaatacgatgatactatcgcatcattagaaaaaaaacatgcttttaaactaaagaaaaaaaatattcattatatttttaaaaaacaattacactacccaataatttttttagatcgttataaaaatatatttattcttttaaaatataacaataatgaatttctaatttataatctacaaactgacaatatggagacatggaataaagagagattaataaataacagtataaatcactattactatctggactttgcagaaaagcatttttttgatatcacttggtttgtcccaacctttatgaaatatcgtatattatttcaaagtgtattattttactcgttaattcttcaactgctagcacttgcctcgccgattattacgcaaataattatggataaggtaattatccatcaagccctatccacgcttgatgtgttaataataggtcttatttttgtcgccgtttcagaatctgtattaaaggggataagagagtatatttatcatcatacagcaaataaaattgatatgttgctaagtttgaaattaactaaccatttattcaaacttcctatcagttattttaaatctcgccaaacaggtattattgttacacgagtaaaagagcttgatatcattcgagagtttataacaaaaaccttattaatgttattggttgatttctcatttatctttattttcctatttgttatggcttatttgtcattaaagttaacattaatctttcttgccaccatcccactctattttatcttagctaaattaattgcccctaaaatagaaaaaaccgtacaacagctttatcaatattcagcaacaaatagtgcttttttaacagaaacgctaggaggtatagaaacaataaaaagcctttcattagaaccacgttttacacaacagtggcatacgcaaattcatcaactgactaatgaaaatttaaaattacaaaatattgataacttatcgcaatacattgtttcatttttacaaaaaataacgacagcgatacttttatgtctaggtgcttttgaagtcatttcacttgcaatgacaataggtcaactcattgcttttaatatgctattaaaccactgtctacaacctttaagttctgcaatagaagtttggggaaagtatatccgagccaaaacggctatttataatttacaagacattcttaatctcccaatagagcaagaaaaagccaataagaaaatgaccttacaaggtgaagtgagttttgagaatgtcagttttagttatcaacatgatgccccccctgttgtaaggcaaatttcatttagaataaatgaatatgaaactattggtatcgttgggacgtctggatcagggaaaagtacattagcacgcatcatcgcagggctttatatcccacaattaggtcaggttaagcttgatgacattccggtttgtgaaattccccccgcagtattacgtcaacaaatagggtttgtcttacaagagaattttttatttcatttaaccgtgctcgacaatatccgtttaacgcaaccatcagcctcattagatgatgttattcatgtagctaaattagcaggtgctcatgagtttattttaaaacttcctttagggtacgacacactcattgctgaaaatggcagatctttatctgggggacaatgccaacgtattgcaattgccagagccttactctcatctcctaaaattttaatttttgatgaagctaccagcgcattggatggtgagtctcaagccatcatcgaaaaaaatcttccccttattacccaagataagaccgtcattatgattgctcatcgcctttccacaataaaaaactgtgaccgcattattgtattagaaaaaggccagataatcgaagaaggcaaacataatgaattgattagaaaagatggcgcttataagaaactttggcaacatcaacaaggataa

SEQ ID NO: 798 - DNA, 1065 bp, Proteus mirabilis
aagaagtcgctgagcggactcaagtcctcagggggtatctttgactatgatgccaagaaagagcgtttagaagaagtcaacgcagaattagagcaacctgacgtgtggaatgagcctgaaaaggctcaggcgttaggaaaagaacgctcatctcttgaagctattgtagaaacaatcgaccaactcgaacaaggactagaagatgtttctggtttacttgaccttgctgttgaagccgatgatgaagaaacatttaacgaagcagttgctgagttagaaggattaaacaaaaagcttgagcaattagagttccgtcgtatgttctctggtgaatatgacagtgctgattgctatcttgatttacaagcaggctctggcggtacagaagcacaagattgggcaagtatgctaatgcgtatgtacttacgttgggctgaatctagaggctttaaaacagaaattattgaagagtctgacggtgatgttgcaggtttaaaatcagcaacaatcaaaatcataggagaatatgcctatggttggctacgtacagaaaccggggttcaccgtttagtgcgtaaaagcccatttgactcaggcggacgtcgccatacttcatttagctctgcttttgtttaccctgaagttgatgacaatattgatattgaaatcaacccagccgatctgcgtatcgacgtttaccgcgcatcaggcgctggtggtcagcacgttaataaaacagaatctgcagtacgtattacccacgttcctactgggcttgtcacacaatgccaaaatgatcgctctcagcataagaacaaagatcaggcaatgaaacagatgaaagcgaagttgtatgaactggaaatgcaaaagaaaaatgcagataagcaagtgatggaagataataagtcagatattggctggggtagccaaatccgctcttatgttctagatgattcacgaattaaagatttacgcactggtgtggaaacgcgtaatacacaagcagtgttagatggtgatctcgataaatttattgaagctagcttaaaagcgggcctgtga

SEQ ID NO: 799 - DNA, 183 bp, Proteus mirabilis
tccagagaacgcaatttgttaaatataaaattaaacttgattaaaaatcagcgtgttaattacaagcttaagtttatttttaaacattattttaacaaatatgagcaattaacgtacaacgcaaacgatacctttactttgaacttatcactaagagaaaaaataaaccataagttaaaatag

SEQ ID NO: 800 - DNA, 645 bp, Proteus mirabilis
ataattattaggatattttgcatgttaacaacattttttcaggggtttttattaagtgcagcaatgatattgcccattggtgcgcaaaatgcctttgttttgcaacaaggtagtaaaaaacaataccatttaatgagtgcatttttatgcgctttaagtgatgtgatattaattagcgggggagtctttggtggaagtgcattactgagccaatcagaatatcttttattactgatcacttggggcggtgtggcttttttattgtggtatggatggaatgcgtttaaaaccgcttttacaaaagagattgaattatcacaacataaaaatcaagtgaaaagtcgttggcgggtgattgtaactttagttgccgtcacttggctaaatccccatgtttatcttgatacctttgtagtgcttggcagtatcggagggcaattatcagcagaattacgtccttggtttacttttggcgcggtattcgcatcgattagttggttttttgctttatcactactagcggcttggttttcacctattttaagccaagtgaccgctcaacgtatcatcaacttgtttgtggggtgtgtgatgtggtttattgctctgcaattggccgctcagggatggaaaaacctcttttaa

SEQ ID NO: 801 - DNA, 225 bp, Proteus mirabilis
tcgttatatagttattttagagagaactgccctcttcaccataaaagtaaacgattacattatactgaatactttaattatatgataaaactgatattaattggtttttatcataccttattaacatccacgctaatatgctttacagtgaaattaagagtagcctcaatagatgaattgaagagaagagagtgtgatttatatctattagttaataccaattag

SEQ ID NO: 802 - DNA, 1041 bp, Proteus mirabilis
tgcagaataagagttatttatgaggtggatatggcaactatcaaggatgtggcaaaagaagcgggtgtttctgttgctacggtatctcgggtcattaataactcaccaaaagcgagccgagcatcgatagagattgtcaattcggcaatgcaaaaattaggttatcgccccaatgctgctgcgcgagcgctggtcagtcaaagtacccaaacattaggtgttttggtgcatgacgtatccgatcccttttttgggaccttggtcaaagcggtcgataatatcgccagaaaagcgggaaaacatattctggtgtgtaatggttaccatgatgcgcaagatgaacgccaatctatagaactcttgatcaacagccgttgtgatggtttagtgatccactctaaggcactttctgatgaagagttgttagcttatgccaatgaagttaatagcatggtattaattaaccgttttatcccagaaattgcggaacgttgtgtcgccttagataactataaaggggcatggattgctaccgaacaccttattcgccaaggccatactcaaatcgcctatatctcatccactcaccatattgaagataccagccaaaggcttgcgggatataaagctgctttagcggcttataatattagtttgcctgaaagctatgttgaatatggcgagccagaaggcgaagggggagagcaagcgatgatgcgtctattaaccaagtcgatagattttacagcagtggtcacctataacgactttatggctgctggggcattatcggtgcttgatgaaaatgagatccctgttcctgaaaaaatttcagtgattggctttgatgatgtacttatcgctcgttatattcatcctcgactaaccacggtacgttatccgatacatatgatggcagagcaagcagcaacattagcgttaaagctttctcaaggggaagtcctaatccaaaagcagcgtatttactcacccactctggttcagcgcaactccgtttataatttaagccatctttcttaa

SEQ ID NO: 803 - DNA, 1107 bp, Proteus mirabilis
aaagagggaagaatggcaaaacagactccgttatatgatgagcacgtcgcctgtggtgctcgtatggttgattttcatggttggatgatgccactgcattatggctctcaaattgatgaacaccataatgtgcgtcaagatgcaggtatgtttgatgtatctcacatgacgattgttgatttacatggcccgcaagttaaagactttctacgttatctattagcgaatgatgtcgctaaactcaccgaaaaaggcaaagcactttatactggtatgctaaatgcgtccggtggtgtgattgacgatctgattgtttactactttgatgagactttctatcgtctggtggttaactccgcaacccgcgaaaaagatttagcgtggatcactgagcatgccaaagattatgtcgtcgatattcaagtacgtgatgatttagcattaattgcagtacaaggccctcacgcacaagaaaaagtacagcgtttattaagtgaatcgcatcgccaaatagtggcagcgatgaagcctttctatggcgtacaacttgatgatctcttcgtcgcgacgacaggttataccggtgaagcaggttatgaaatcgccatgccaaaagagcaagctgttgattattggcagaagttattagcagtgggggttaagcccgcggggttaggtgctcgagacactttacgtttagaagcgggtatggatctttatggtcaagagatggatgaaactattaatcctcttgaggctaatatgggatggacgattgcctggttacccgaagatcgtcaatttattggtagagaagcattagaaaaattacgcgcaacaggcacagataaactggttggtctggtgatgcgagaaaaaggggtgttacgtgcaggtagtgccgtgcactttaccgatgatttaggtgaattaagagaaggagttattactagtggcacattttcaccgacattgggctttagtattgcattagccagagtacccgcaggtattaaagatagcgcaattgttttattgcgtaatcgtgaaataccggtagaggtggtaaaacctggttttgttcgttcaggtaaagcattggtataa

SEQ ID NO: 804 - DNA, 960 bp, Proteus mirabilis
agaagagagagtaaacccgtgacccagaccaagttatcgacacaaacgacaacagataataaccaagaagataatgacgttatcatagaacaatttctcgatagtatttggctagagcaagggttatctgcgaatacactcagcgcttatcgtttggatttgcaggcgttaagccagtggctggtcacacaaaaactcaattggttatcggtgacgacgttagatttacacgcttttcttgccacccgtttggatgagggctataaagcaaccagtgcggcacgactgttaagtaccttacgtcggttttttcaatatctttatcgtgagaaattacgccaagatgatcccagcgctttgctttctacacctaaattacccaaacgtttacccaaagacttaagtgaacagcaagtagaaaatttacttagtgctccttgtattgatgagccaatagaattacgcgacaaagcgatgcttgaggttctttatgcctgtggattacgggtttctgagctagtaggattgtctttatctgatattagcttacggcaaggggtgttacgtgtgataggtaagggcgataaagaacgattagttcctttaggtgaagaagctatttactggttagaacaatatctgcaatatggtagaccagcccttatgcaagggaaaaccgatgatattgtgtttccaagcttaagaggccaaaaaatgacgcgacaaacattttggcatcgtataaaacattacgcggtgatcgccggaattgattcagagaaattatcaccccatgtgttgcggcatgcctttgcaacacatctattaaatcatggagcagacttgcgtgttgtacagatgttattggggcacagtgacctctctacaacacagatttatacccatgttgctacagagcgcttaaaagtgcttcatcagcaacatcacccaaggggataa

SEQ ID NO: 805 - DNA, 846 bp, Proteus mirabilis
ataagtaggagtctactcatgtctcaattagacggtaatgctatttcacaaattcaaaatatggcggtggcttcattaagtctcgatgcaatagagaagtcattatgcccagcgattgttcttccgaatgactttaaagtaagtagtttagaaaatttacaagaaggtcgtttccgctttcgcggggaaatgaaaacaaccagtatcagcgactttgttaaatactcaatcaagaatgcaattgatgaaggtgttagctgctttattgatgctgatgaaatgagtgccgaaactatttttaatatcggcacaattggcgaacccggtcatgcagataacacagctgctgttaagttaaaacaaactgccccattcgcagcgctattaaaaattgatggtgttaaacatcgtcaaaaagaattagccgagtggttagaagattggcgtgattatttaatggcgttcgatgctgacggtaatattttagatataaaacaagctatttctgctgttcgccgtatcactattgagtcaacacgttctgctgaacatgaagacgctgattttagtgcaaaacgctcggtattagaaaatgttgaagccagaagcaaagatgtaatgcctactacatttcaatttacctgcactccgtatgatgaattaaaagaacgtagcatcaaattacgttatagcgtgcttactggcggtgatgttcctattttagtgctccgcattgttcaacttgaaaatcttgaagagcaaattgctcaagagttccgtaatctgctttgcgatgaattcgatgaaagtgaaatcgaaacatttatcggcaaattttcagcgtaa

SEQ ID NO: 806 - DNA, 513 bp, Proteus mirabilis
cagcgatttggcgctgtgaatatggagaaaatgatgaataaagtaattttatctttggttgcagcgatgtctttgtctgcttgcgcacaagcggttgatagtttggaaaaagtcgctccttatcctaaagcaaaggaaaatcaaattcgtcatgttattgagttagaacaaaaagaaaacgaaggcaattaccaagttgagttgatcgtgggtaaagagatgatggttgattgtaatcgtcaatggtttggtgctgagttagataaaaaagatctcgaaggttggggttatgattactatatcgtaagcgacttaaatggcccaatgtctacgatgatgggttgtcttgataacactaaaaaacccgcctttgttcaagctaatatggggcaagcggcatttatccgctataacagcaaattacctattgttgtctatgcaccaaaagatgtagatgtgaaatatcgtgtgtggtctacttctgacgaggttaaagattcaacaaagaaataa

SEQ ID NO: 807 - DNA, 207 bp, Proteus mirabilis
ttattatatggggtttatagtagtttattgattaagtttttatttgttggtgatgttgggtttatttttataagcattctatttaaaataattctaaaggatgtatgtgtaaggtttattgttctagttatttattacttaaatcaaatgactttaatttacaagataagttacgtttaccgagtagcactgatatctatttattaa

SEQ ID NO: 808 - DNA, 8424 bp, Proteus mirabilis
aaaaatgatggtcgtttcaataataaactgacaacatttaatcaggaattacttgatgatgctcagcaagccattaatcgtttaagcattaatgctgggatccgacaaaaatcggcaaacgttcttccctcttttacatcagaccttaatggagatgacgtagcaacctatcaacaaccttctcttcgttcaggcaatcttcaatatcacaaaataggagctatcgcggtcaatctttctggattaggcgaaagccccatttttgaaacgctaaaacaaaaattcaatgtaaaaattaagaatagaaatacttactttacttttattttggaaaaaaatagtggtcgtatccaaaaaaatatttatttggataacatcaatgatcccactcagcaaaaaataatagaacactttattttagctaattattcaaattttgaagcaatgcctaatgaacttcatttagaaaatgacaaaattaaatcaagtcataacaacaaagataggatacttgcagaatacgtagaacataaatggcaaatgctaactgattcaaaagtcatgtcagttgatgaactacataaagttgcaagtgttaaaggcaaaatacaaggcgaaagttataaatcaatcattacaactctctcggaataccatgaaaaagaatcgaatacaaactgcttaccaatagagaaattgagagtgctagctcagttgcgaaaccaaattgatggttacctattaggacaccccgactctgaacgcaatgatggattgaaacagttacaaactcaagtcaatacacgttataaacacgcatcggctttaatacaagatagtcacaccatcaacgctgatagcagctttagtcgcttatacgattcactttcaaatgccaatttaaaaagaagtaaacacatttatattgatattaacggacactttgtcactgaaggaaaaaacaatctgcaagggaaaaatagactaaccagcggaaaagaagtgattgagcgagtaaaaaatgccgtagaaaaagaatatggcgcaccgattgccaataaagtcttcagtcaatttgcaaataatgaattcgctgaaaacggcgagggtattgatgtttcagggttaaaaaaaattcacagagctattgagcgggaactatctcctcatagtgcaaccttatatatctggaaaccaagcaatcatagtaatttgggacacgccacactacaaataggtcaaggtcgcttactgttaaacacagaagacgcacaaaataatcataaagaaaactacatcagttggtggcctaacaaggcgaagtcatattttgatgtgatgggagtcccctcacaaccaaaagagtcgttagcatcggatgttgcagcagaagaaaatgatggctttggtttaaattacaaatataaagaactaaacagatatgaccgactcatgaatattgcgaaaggtgaaacggtcaccactgcagatgatttatctcttgcagacgcaaaaaatatattgacgatcccaaattatatagaaaattcaaaaataccgcgaacaattggacagccttttattgatgaatgggtaataactcagaaaaaactcaacaacatcgccacaaattttctagaagctgtacaaggtaaatttagtggaaataccataactataaatggtgccatgatactattgacagagcccacgttactatcaaaaagaaaaatcccactttctgttgcacagccttttattgaacaatgggataatataaaaacacaacaagaagatatatctattcaattattaaaagcgatgaagacttggatacaagaaggtaaggatccaacgttaacgaaaaaacgaattgctttagtagaaaacgaatttgctgagcaaaaacaaaaaagtattgacagatttaaaaccagcttacctgatgaaggacgagtattccgtattaatttagaggggttagacgttgctgctatgcaagctgaatggcaacgaattaaaaattcacctaatggtcgttatcatttattaacccaaaattgttcgagtatcgtagcgaaagttttaaaagcgggtggcgcagatgaactgattggctataactggcaacctaaatataatatttggacaccaaatcaaatgttcgcatttgctcaagagttacaagaagcgcaaatggcacgacaacaaagtagaatgattccacctaacttacacgcgttgtcaggttctgaaaatatccgtcaagagctagaaaacacctcccctcttatttctgctgaacaaaagctcaatattgtttttagtgaacaggaaacgggttttctactgacacaagcatcagatgaaacgaatgaaaaatttatttatataaaaaatggagataatcaagaacaacaaaaaataatgagtaattttatactcactcattatcgtgattttgactctatccctgagcaactttatttcttagataatacaatcgtgtcactcgataaaaaccattcacgaatattatcagaaaaagtcggtgaaaattggcaacctgttgcctattcgaatctaatgactgctgatgaattaacctccgctgcagaggtgacaggaaaagcacgcggtgaaaattataaagcgatcattcaatcgcttagagattatgaattacaaagtacaaatacaaacaacacaccaatagatatatttcagcaactatccacattacgtatacaaattaatagttatctgcttaaacaccctgattcaaaacgtaacgaagcattgcaacaattacgcgaccaagttgatatacgttataaacatgcttctatcttattaagtaatagccagcaagttgattcaaataatacttttagttatttatatgagattttttcaaatgctaacttaaaaatcaacaaacatatttatcttgatgaaaacggcaactttgttacaaaagggaaaaataatttacaaaaccaagacaaacttatcagtggtaaaaatgcaatcacaagcattaaaagattggtcgaaaaagagtatggcagtgaaattaccaatcaggtatttaatcaatttacagaaaatgaatttgcccaaaatggccatggtattgacctgtcaggattgaaaaaaattcaccaagcaattgaacaacaagtttcaccaatcagttctacactatatatctggaagcccagcaaacatagtcgcttgggacatgctgcgctacaaataggttctgggcgcttacaattagatagcgatagtgtgcaggataaccatgataataattatgtcagttggtggcctgccgggagcaaatcgctcgcaaacccactgaatattacaacagaaaaaaatcctgatttaaaattacgctggtatgatttaagccaaccagtgagtcgctcaacaaatttcatgactttacaaattgatattcaagaagaggaaaagacgaatttcaaattaaataaagatgaaggggaaaatgacagacagttaaaagaatttagagataaaacgaatcttacccgaggtctcgaaaatattacacctgaaatcgcaggcttactgttgaatgctcctcattggataccagaaacacttatcccacctgaaatttcacacccctttattaaacagtggaaaagcccaaatagtaatctacttgaagtatcaacaaacttttcaatcgcagtgaaaaactggctaaaagtcgcctttccaacagcgatgattaaccaaacctttgcattggaaatcaagaaaattaaagaaattgaagaccgaaaaacagaaaatttcaaaacaagtgtcgctgatgatacaaatgatggcgtggtgtttcgcattaatctagagggacttgatgccgccgccatgcaaaaagagtggaagcgcattaatagccagtctgatcctcgttaccaattattaaccaagaactgttctagtattgttgctagaatattaaaagcaggcggagcagatcaactgattggtcatcattggaaacctcgatttggcatatggacaccaaatgagttgtataaattttctcaaaagatacaggaagcacgcttagcccaaattgcggtacaacaaggcaaacctatacattctaatttacaagcattatcagaccacaataaagtggctattgataatgacggtacatcaccaaacgagagaaaaaatcttagcccattaacacgtttttttaatgatcattttttcggcagctatgaacgtcgtagagacatgacaacggtgatgagaataaaaaatgaagaaaaaataacattaaaaggggatgcaggccgtcttacaggatcatattacagaggaaacgacaatattccagaagctaccgataagaaagtagtactatttttacatggttcaaattcccctaccgaaaaacaatcctctagtttttatcattattataaccaacaaggcatcgatatgttagcgattaacatgagagggtttggcgaaagcgatggctcgccaacagagcaaggaatgtatgctgatgcacaaaccatgttccgttatctcgttaatgataaaggtatcgatcctaaaaatattattattcatggttattccatgggggcaccaattgcggctaaattagccagcgatatttcagctaacggtcagcatatagctgggctattcttagatagaccaatgccaagtatgtcaaaagcaattgaatcttatgatgaatatagccttaagaaattgactggacaactcgcaaaaaaaatcaatggccaattctccgtagaaaaaaatctacagggtttctcaaaagatatccccattatattgctcactgactgtggcgagctgggcattggtggtgaaaaaatgcgcactaaattacttgataaaggatatctagttaaaggagaaagaaccgatgtttctcatttagagagccttaagttgatgaatcaatacggtaaacaaataatatcaagtttactatccccagagtatgtaaataacaccaatcacagaaatgcgttagattcgatacaaaacccgataaaaaagaataaggtgactgattgggggatggtatatgtaaaacccaatgataatgggggtgatagtcgttttgatagccagattattatccaaacagaggatgatccgatagtcgctcaagcagcttcggcacttgccgctaaacatgccaaaaatagtatcgtggtacaattggatgccgatggtcattaccgcgtagcttatggcgacccagcacaactttcaggtaaaatacgttggcagcttgttggccatggtcgtgaaacaaccgaaaataatcatttacgccttagcaactacaatgctgatgagctttccaatcaattggttaaattcaataccgtattcagcaaagaaaataatatcaatacaactcctgaacatatcagtattgtcggttgttcattaataagtaatgacaagcaggcaggatttgcccaccagtttatcaatgcattagatcaacaaggcattcgtagtagcgtttctgctcgagtaacagaggtcgccgttgatagcaatggtcacaaatacaccaaagataacaacggagagtgggtagccaaacaaaaccaaaacaaggtagtgttaaattggaataaagaaggcaaaatcacgactgaatttgagcaaatacataatggtgttgctgaaggtgatattgatttgactaaaataggtgcttcagctgacaacaaagtacgtggcgcaattgcagataataatgaagtctttaccgcccccaaaaaaggtaaaaaatcaaccaaacaaagctcatcaggaagtgataattcatcactaagctattctggcaatatccaagtcagtgtgggtgacggcgagtttacaacggttaattggggaacctctaatcttgggatcaaagtaggtactggcggatttaaatcactggttttcggtgataacaatgtgatggtacacgttggtaatggtgatagtaaacatagtgttgatattgctggctatcaagctttcgaaggtatgcaattatttgttggtacacgtaacgtcagctttaatctggggcgtagtaatgatcttattgtgatgttagaaaaatcaattccaacccctccactgatcaacccttttgatggtgctgctagaatcaccaaagttctagagtcaatcgcatgctcaggtgaaaataatgataatgattggttgtcggtacaaaacgatcagtggacactcgctggcgctaaaaaatttgccatagatatgtcaggaatagaccaaacgagcaatgttgactataaaacactgactgatctgaattcacagaataagcgtagtagccgtggattaaagagtgatctagaagccacactaaacaaaaaatataaccagtggttaggtggtagtggcaataacaacgagatgggaaaaatcagccgagctgagcaacttcgtcaactagatagtaaaatcgcttttaatttcgccattggtggtcaaggtgctgatattcaagttactgccgggaattggaacttgatgtttggtgataatatccagtctattatagacactaatcttggctcattatttggcttaatgacgcagcaatttacagcaactggtatggtggaaaccacctttacttataccccccaaaacttaccaactaagttaaaaaataaattgctaggtcggttagccagcgtgagttcagacacgactctgggggatatttttggagtagactctaccacagatggaaaaataatctctcgtaatggtgagcccattgatgttgtcgctattttgaaagatatgctcgctgtagtgactgagtttggaggtgaaaaactgtccgcatttactgatccgactaaattattagataacctccaatcatctattaatctgggcaaggatggtattatttcatttgctgaaagccatggtttaaaagaaaaagcgacagaagatcaacaaaatgaatctgaagtttcaattaatgcccaaacaccaataacaacgagtcaaactgaaaatagcaagatcacagaggaaaatgatcgccctttcggcttcaattcgctaaatatccccaatctatttgccacaatctttaataaagataaacaaacagatatgcgtgatctcgcagaaaacctcaaagaaaatttagcagctgatgtactgaacatggagaagaaaacgctcgatttcttgcgtaatagtggtcatttaaaaggcgatggtgacatacatgtctctcttggcaactataatttcaactgggggggagatggtaatgatctcggcgcttacctaggagataataataatttttggggtgggcgtggttcagatactttctatgcaacggggatctcaaatatttttactgggggttacggaaatgatctcggcgtcttgatggggcgctcaaacatgatgtttggaggcgatggagatgacactgctattatcgccggtcggatcaataatgtctatttaggtgacggactcgataaagcatttgtctttggggaaggcggtgaaattcacactaatgcaggtaatgactatgctgtcactaccggtaactacaatcgcattttcagtggtagtgaacaagattttgttgtcacaattggtaaccacaaccaaatatccttagaagaaggcaatgattttgccaaaatttttggtaactacaataggttgaatggagggggcggtgatgacgaaattcaactaatgggttatcacgccgtagttgatggaggcgatggaaatgatcaactaattgcagcttcattctcgaaatttagccttcttaatggtaatacaggtaatgatattatcatattaggtggatatcagaaccacttcaaaggtggaaacggtatcgatagcttcctgattaataataatgtgattgattgttatatagacgatattagccaagaagataatattgtacttggagatattgattggaataaattatggtttgaacgcagtggctatgatttaaagatctcacatattcgcttcccacaaaatacaggggaacaagccacatttgagcgcattggctcaactacttttactgattatttcaatggtaatcaggcaaaaatcgttatcgcaatgactgataaagatcactctgatcagcgcgaatatacggctttatcaagcaatgcactcgctattcaaattcaggccatgagtacatttcctatgaaggcaggcgcatccggatttttcgataatataagtgatgaggctaaacaaatgatagccgtagcttggacagatacaatttcaggaaaaggcatattagtgtag

SEQ ID NO: 809 - DNA, 1542 bp, Proteus mirabilis
cttaaaagcgggcctgtgaggaaaaacatgtcgcaacagcaacaaggtgcggagcaggcacctgatttaaataacgaactgcaaactcgccgcgaaaaattatcagctttacgtgataatggtaacgcattcccaaatgatttccgcagagatgccatgtctgacgaattacatcaaaaatatgatgcaatgagtgcagaagagttagacgctgctaatgtggaagttgctattgcaggtcgtatgatgactcgccgtattatggggaaagcatctttcgctacattgcaagacatgggcggccgtatccagctttatgtctctcgtgatgatctgcctgaaggagtttataacgagcagtttaaaaaatgggatctcggtgatattttaggtggccgtggccgtgtatttaaaaccaaaacaggcgaactgagtattcattgtactgagttacgtttactgactaaagcactacgtccgttacctgataaattccacggtctagctgaccaagagacacgttatcgtcagcgttatttagacctgatctctaatgaaaattcacgtaatacttttaagatccgctcgaaaatcatgtctgctattcgccaatttatggtgaataaaggctttatggaagtagaaacaccgatgatgcaaactatcccaggtggagcaagtgcacgtccgtttatcactcaccataacgcgctagatattgatatgtatctacgtattgcacctgaattatatttaaaacgtttagttgttggtgggtttgatcgcgtttttgaaatcaatcgtaacttccgtaatgaaggtgtatcaccacgtcataaccctgagttcacaatgatggaactctatatggcttatgctgattatcgtgatcttatcgaattgactgaagagttattccgtacattaactcaagatgtattaggttcgactatcgttaaatatggtgatgaagagtttgatttcggtaaaccgtttgaaaaactgaccatgaaagaagctatttgcaaatatcgtccagaaaccaatatggctgatctagatgatatggataaagccgttgctattgctcaatctattggtattaagattgaaaagagttgggggttaggccgtgttcaatgtgaaatttttgaagaagtagctgaaagtcatttgatccagccaacttttatcattgaatatccagcagaagtttcaccactggctcgccgtaatgatgataatccatttattaccgatcgctttgagttctttattggtggtcgtgaaatcggtaatggtttctctgagcttaatgatgcgcaagatcaagcggagcgttttgaagagcaagtgcgtcaaaaagaagcgggtgacgatgaagccatgttctttgatcatgactatatcactgcattagagcatgggttaccacctacagcaggtttaggtattggtattgaccgtatggtaatgctatttaccaatagccatactattcgtgatgttattttattcccagcgatgcgtccgggaaaataa

SEQ ID NO: 810 - DNA, 939 bp, Proteus mirabilis
gcaaccagaggtaatatgttactacaaaccattttagcagcgctgggccctattatcttagggcttttagttggctggctttccggtaaatatggatttattaaaagagagtattcacaagcctttgctgattttgtcgttaaaattgctctgcctttttcactctttttagcggcaacccaagcttctccgtcggttttctttaatatcgactatctattagctctcgcggtaggattaattgtttcttatcttattggttttttaggcggcaagttcttttttaaacatgataaaaagaactcagcaatgcaggcattatcggtttcatttcctgatatggcttattgtggaccaccagtattactggcaacagtcggctcatctggtttgattgctatggtggtgggaaatttgatctacacggtaattattttaccttttactatcatgatcattagtggtgccaaacaaggaaaaagcattttacagtcattgcttaatgctatctctcagccattagttttcctgcctattttgggggctatgctagctatttttggcgttaagctaccagagattttacaaaactcagtgaatgaaatagggaaaacatctggtggtgtagcattatttttcttaggactattaatttcagggctcaaactcaaagttaatactgaaattgtttttaatgtgataataaagaatgttgtacaaggggcattaattttaggaacgggatttgcacttggattagaaactgaattattaaaagccgtctttctaattggtgtattgcctactgcaacagcggtgcctgctttagctattacaaataaggcctatgctgatatggcaacgggcactgtattattaagtacgctatgttcattactttctattattggtggtatcactattgtagaaatgatgtaa

SEQ ID NO: 811 - DNA, 1440 bp, Proteus mirabilis
gtcaataagggggctgcaatgtctattaaaaccagtaatatcgattttagaccacgcttagcgcatgaaatgaatgataccattatgcgtaacgccgttgttatggcacaagagcgcattggagccaatcgccaaataatggtaaaagagttaggtgattgggaagcgtggcgtgatcgcgcagaacaaatccgtaaccatgttcttgaaaacttagacgcttatctttatcaattatcagaaaaagtgactgaaaacggcggtcatgtctattttgccaaaacggcagaagatgcgacacgctatatttgtaacgttgccaaacagaaaaatgccaagaaaatcgttaaatcaaaatcgatggtaaccgaagaaatcggtatgaacaaagccttacaaaatgaaggtattgagattatcgaaaccgaccttggtgaatatattctgcaactggataacgatcccccttctcatattgttgtaccggcgatccataaagatcgctaccaaatacgtaaagtgctaaatgaaaaattaggttatcaaggtagtgaaaccccagaagatatgaccctttttatcaggcaacgtattcgacaagattttctttctgctgatattggagtcacaggttgtaactttgcggttgcagaaacaggctcagtctgtttagtaactaacgaaggtaatgcacggatgacgaccacattacctaaaacccatattgccgttatgggaatggaacgtgttgcgcctacttttgaagaagtcgatccactgatcacgatgttatgtcgtagtgcggttggctcacgcctaaccagttataacacttgggtaactggacctcgtgaagcgggtaatgttgatggccctgaagagtttcatttagtgattgtcgataatggtcgctctgaaattttaggctcacaatttaaagatattctacgctgtatccgttgtggagcctgtctaaacacctgtcctgcttatcgtaatatcggtggtcatgcttatggctctatttatcccggccctatcggtgcggttatttcgccactcttaggaggctataaagattttcatgacttaccttatgcctgctcattatgcaatgcatgtaatgtggtctgtccggtcaaaatccctttagcacaattgatccttaaacatcgtcgagtcatggcggaaagtggtttaacaccaaaagctgagcgtcgtgtaaccggtatgtttaattacattaatgcgcaccccacgctttggaaagttggcatgaatgtaggggctaagatggcgggcttgatgatcaaaaatggctcaactccaatcaagattagtgtactcaatgattggatggcatcacgtgatctcccaaaacccgatggttatagtttccgtagttggtttaagcgccacaaagcagaaggaaaaaaataa

SEQ ID NO: 812 - DNA, 195 bp, Proteus mirabilis
atgaataagggcgttttagtaagtaaaaaacgaagaatagaaaattttaatgaggtaatattaaatcttagtgacaataattttgcgtggcatttcaaagaaaaaatagaggatcgtcattttattttttatattctcctttttttacaaaaatcagttatgctattaaaaaacgacgacgatatcttgttgtaa

SEQ ID NO: 813 - DNA, 438 bp, Proteus mirabilis
tatcaaattttaagtatcaaaatattaaaggagtttgacgaaatgatacgatgtgttcgcttatggaccggagaagatggtaactctttatttgaagaaggtatcatcgaatttaaggatagttcacgaggtgatagtgagagtttgccaattgctgtttcagagttatcgtttagagaaacaacttcgggtggttcatatgattggcatcaagatcccgttcctcgttatgttattacgttatcaggaacattagagtttgaaacaaaagatggctcaacttttatcattaaacccggtgatgtgttgttagcgcaagataacagtggcactggtcataaatggcgtcttatggatgatgaaccttggcgacgagcttatgttgtttacaaagaagatgcaggattatgttttaaaccgaccaaaacaactaagtaa

SEQ ID NO: 814 - DNA, 1248 bp, Proteus mirabilis
gatacttttattatgaaatcatttgatgttgttattgctggtggtggaatggtcgggcttgcattagcctgcggattacatggctgtggattacgtatagcgataatagaaaatcacccagtcaccacgcatttccatccgcaagatgattttgcattacgggtatctgcgattaatactgccagtgagttattactcaagaaattgggggtatgggaaaacttaacggcattacgtacagccccttatcaaggtatggaagtatgggatcaagatagttttggacgtattgcgttttcagcgcaacaagaagggttatctcatcttggcactattattgaaaatcatcttattcgtgaagtgctgtggcaaaaggtcaccagtcatagtgatattacctgttattcccctgctcaaattgaacgcattgtgtggggagaaaatgaagcctttatcagcttaaatgacggtgaaatgttaaccgctaggctggttgttggcgccgatggtgcgaattcttggttgcgtaaaaatgctgatattccactgactttttgggattatgaacatcacgctttagtcgcaaccatacgcacagaacaaccccatgataatgtggcgcgccaagtgtttcatggtgaggggattttagcctttttacctcttgcagatcctcatacttgttctattgtgtggtcgctacctagctcattggctgaagattataagagtgcagataaaacgcgatttgaacgtacgctaggtgttacttttgatatgtgcttaggccagtgtgaattagtcagtgaacgtatgacaattccattaacgggtcgctatgcacgtcaatttgccgctccacggttagcgttattaggtgatgccgcgcataccatccaccctttagctggacaaggggttaatcttggctttatggatgttgctgaattaattggtgaaatccgtcgtttaaaagcagaaggtaaagattttggtgagtatctctatttaagacgttttgagcgccgccgtaaacatgccgctgcggtcatgttagcgactatgcaagggttccgagaattatttgaaggtaataaccctattaaaaagtgggtgcgtgatatcggtctttcgttagcagatagtttaccaggagtaaaaccaaagttacttgaacaggcgatgggactttctgatttaccagaatggctaaagcataaaaattctgtttcagctgaaaaaatctaa

SEQ ID NO: 815 - DNA, 678 bp, Proteus mirabilis
caagattttatagtattgaagtatagtggaagaagtttaatttatgccaaaaaagcatatgatttaggaaataaagaagcggctgagttaatttattggtactatatgcaaaatatctgtgaagataaagataatatcaataaagcagactactatcttaaagaatggttaacaacaggagaagaacctagtaaatacagctcttctaatgaatacaaatattctagtattagtatcattgctgattattatttagagtcaccgtgtttagttgaacgaaaccttgataaggctattgagtggtatcaattatcgttagattatccatatgaaataaatgattttttgtattctgaattaaataatatgtatactaatgcaccaaaatacataagtaaggatcctttcgtgaatgtgtatttatctacactaaaaaatcataacgattatattttagatatgaatattcgattaggaaaaatgaattttgcaatatcttcttttgacaaactttatgaagcacttctactcaaaggtgatgtgaaagaagcatattattatggtttactattaaattatgatgtgaataatgtcgctatgttttattctttatctgacattgagcgtaaaaatattgaatatcgtgttgctgattatttaaaagaaatacaaaaataa

SEQ ID NO: 816 - DNA, 393 bp, Proteus mirabilis
tactgccttataaccgtatacactactaaacacgtagcacagattttatgtcaggaaggaatcatgtccgcacaacccgttgatcttcaaatttttgggcgctcattacgtgtcaattgcccaccagaacaaaaagatgctttactggcttctgctgctgaacttgaacaacgattacaagatctcaaagaacgcagtggtgtttccaatactgagcacttaatttttatcgtggcattaaatatgagtcatgagttggcagaagaaaagttaaaaacgagagactatgcctacaatatggaagagaaaataaaaatgctacaacaatctattgaacaagctttacacgatcaaggcaagcaccatgatcgcactttttcaacatcaaagtag

SEQ ID NO: 817 - DNA, 1182 bp, Proteus mirabilis
ggatttattatgcaggcactgattaataatgtgactcattcttttacctctatttttggttatgccccaacacattttattcaagctccaggcagagttaatctgattggtgagcatactgattataacgatggttttgttcttccttgtgccattgattatcaaatggtagttgctgccgccaaacgagatgataatcttattcgtgtgattgcggttgattatcagaatgcgcaagatcaattctctctcgaacatcccattgagtttttacctaataaaatgtgggctaactatattcgtggcgttattcattttttacaacaagccaaatatgtatttcagggtatggatattgccattacaggtaatgtgcctcaaggggctggcttaagctcttcagctgcattagaagttgctataggacaaacagtaaaaacactttatcaacttcctattagtcaaaaagaaattgcccttaacggtcaaaaagcagaaaaccaatttgttggatgcaattgcggtattatggatcagcttatttctgcatgtggtgaagagagccatgcactattaattgattgtcgttcattagccactacggcggtaaaaatgccagaaagtgcggtagtgatgatcattaactcaaataaaaaaagagggttagtcgatagcgaatataatacgcgtcgtcaacagtgtgaggaagcggcaaaaatattaaatgttactgcattacgagatgcgaccttagcgcaattgcaagcgaaaaaaacgctgatgaatgataaagtatatcgacgtgctcgtcatgtgatcaccgaaaatgagcgtactttacaagcggctgaggcgttaaaacaaggcgatcttactaaacttagtgagttgatggcacaatcacatatctctatgcgtgatgactttgaaataaccgttaacgaagtggatacactggtagaaattgttaaatcagtgattggttcgcaaggtggcgttagaatgactggcggaggttttggcggctgtgtggtggcgctggtgactcctgatttagttgcaaaagtgacacaagcggttgaagcccaatataaaacccaaacaggtttaaaagaaactatttatgtctgctctgcaagccaaggggcgggctatctggagataactaatggcattaaatga

SEQ ID NO: 818 - DNA, 1731 bp, Proteus mirabilis
agccctattattatatttgaattaatacctttatctcgaggtaaaatgaaaaaaaaagttgttttattaacactattaagctgtttttctaccagtggattaagcgcaaatgaaacaggaaatttaggctcaatcagtgaatcaaggcgtgcattgcaagatagccaacgtgaaattaatcaattaatagaacaaaatcgctatcagcaactgcaagaaaaagcggtaaatatttcacctaccccaactttaattactgagtcagaacactgtttgcctataaaaggcgtttatattcaaggtattactttacttactgagaaggatctcaattcattatctccattaccagatcaatgtattaagagtgctgatattaatcgcctcgtgaaagaactcactcagcgttatcttcaacatggttatattactgcacgtatccaatttttacgtcctaaccaacatggcgaattaggtctgtatgctattgaagggtttgttgaacgtattgaaggaggtgatcgaggtgttaacaccacactactatttcctcgaatcaaagggcaaccattaaaactcgctacactcgatcaaggcttagatcaagctaaccgcttgcaatcaaataaagtcacagtggatattcttcccggtaccgaattggggggctctgtcattaagttgtctaatcaacgaaaatcaccttggcatctcaatatcgctagtgacaattatggacagaaaaattcaggccgctggttaatacgaacgaatgctagtttagatagcccattaggtttatctgattttgtaagcttaaatgccaacataacaacagataacccgaatacccgttttaatcgcgcttatactttgctctattcaattccttatggtggttttacttttagctcttttggtagttattcggagtaccaatttcaccaaaaattacaaacacgtactgtcagcttatatggcgataccactcaagtaggtattagaggcgattatgcttttagccgtagccaaaaacaaattgataccttaaatattcaagtcactcataaacgtatacgcaactactttagccaaattcgtttagatctcagtagccctaaattaaccacgattgaattagggattaatcatttgcagattattccaaatggcgtattgagcactaatttgagtgttgaaaaagcggtcggctggtttggcgcagaggaaacaccctatatcactaacggtaatggtaacgactatcgctttacaaaagttaagctatttgccaattggtatcaacgcttttctctatggcgttctacatttttattcaatagtacttttttaggccaatacagccacgatacactccccggcgttgaatggctaagtttaacagacaaaaacgctattcgtggttttgatcaaagcacactttctggtgataacggtggctatttacgcaataccctctcctatccctatcgacttaaccacttttctatcacacctcgtataggggtagatatcggtcaagtaaaacaacatggtaactacaaaggatggcaaggtggttacggcctaagctccggcttaaatattcaatatcaacaagcacaactcgaccttgaagttgcaaaaggcgagttactgtatcaccaaacaaattccaataaaaccaaagatcctactcaactactggttaaattttcatacttattttga

SEQ ID NO: 819 - DNA, 1332 bp, Proteus mirabilis
ataattactatgaaattaaagcagagtgcttgcctcgcttttatgatgtttccggcgctgtcttttgctaataatgagtttaattttgtcattgaagattttgaccgttatttagaagcacaacagcccgttgatattaagcctgaaccctctgcaacaatttcatcttcatctactcccgatcagcgtagtggaacggtgcgttccactgtgacattaaaggaaaagccaccacaaaaaccacaacaaaaaattcagcctaaacagcctgttgtacggaatgaacatcaaaccgtggtacgcaatgagcatcggccagtagtggcgactccctctgtacctcaggtgactttgtctgaacaatgctctgtggtatctacaaataccaacaaaataaacagtgattacactcattatttaacaccactgctttcgtttgtaccgattaaaccgcaatttacccctgaggacttgaatcggtattatcaaagtaaatccgtggtctataatcctctaatgctttatacgcgtaagcgttatccagggcagccatatcagtctactgataatactttattagatttcattccaaatacagtgtattcagtgactgaaataccttttcattttttatatcaatttaaacgttctttgcttgaccataagcaacctctctttaataaagagctattaaatcgtttagcaaatactcgcgaaaaatatcaacgtctgtatcagaaatttactgaacaaaccgcgttattaactgaaagtttaactaaactgcaaaccgcagaagaaaaagttcaacaattaacagcggaattggcaaaaacgcaagataaactggctgtagcgaataatttacttaatgatgatagcctaaaacagtctgtggctaagttacaaaatgaattagcacagtctaaaaaagagcaggatacgttgcttgcacaattagctgaaaaagatcagttgctgtttgatgcgacagaaaaaaataaagtattaactaaacagcaagaagattttgatattcaggcacaaaaattaaatcaattgactacccatgttgctcaacttgagcaacaaaaacagcagctacaatcacaatatgggcaggctcaacggttattaacaaataacagtgctaaaaaagagattgaggtactacaaaattctttaactaatttatcagcagtgcgccaatctttagaaaatcaattagctaaaaacaaagcctcttttgaagctactctagctaagaataatcagttaattgatacccaacgccaacagatagctcaacttaacgatcacataaaaaaataa

SEQ ID NO: 820 - DNA, 969 bp, Proteus mirabilis
gagaacgctatgaaacccgttgtaatactttatcaaccgcttccagaaaaactgcaacaaaaattatctgccgttgctgaggtaaaacagtttaacgcgctctctctcgattgtgccgattttaaagccaccctcgctcatgctgaaggattgttaggtgcaggcggtaatatcgataaacactttattgaaaaagcgccaaaactaaaagccgtatcaacgatttctgtcggttatgataatgtggatgttgccacgctcactgaacgtcatatcaaattgatgcatacacctacggtattaactgatactgtcgctgatacaatgatggcgcttgttcttaccgtctctcgtcgtattcctgaactagctgataatataaaacaaggtttatgggtaaaaagtattacgccggattggtatggtactgatgttcaccataaaaccatggggattattggtatggggcgtatcggtaaagcattagcacaacgcgcccacttcggttttgatatggatattatttaccattctcgtactgaatataacgatgttaaccagcattttaatgctaaattttgttccctagagatgcttttacaacaagccgattttgtctgcattactttaccgctaacaccagaaactcatcatctgttaagcgcaaaacagtttgcattaatgaaagctgacgcctatttaattaatgccggacgcggtgccgtggttgatgaaaaagcattaattaacgcattagagcagcgacaaatagctggagccggattagatgtgtttgagcaagagccactgccaacctcttcaccacttttaaccatgaaaaatgttgtcgccttaccccatattggctctgcgactaaagagactcgctatgcaatggctgaatgtgccgttgacaatctgattgctgcattaaccgataatgtaaaagaaaactgtgttaatttttaa

SEQ ID NO: 821 - DNA, 306 bp, Proteus mirabilis
agtgaacatattaaagagcagaatatgactatcgatatagaaaataaagcacgaataaattgggcatgtcgccgtggaatgcgtgaactagatatttctatcatgccttttttcgaaaacgagtacgacacactctctgatgacgacaaaaggctctttgttcgtttacttgaatgtgctgatcctgatttatttaattggttgatgaaccacggccgccctgatgatgaagatctttattacatggtaaagttaattcaagagcgtaatagaattcgtatggctgaaattgttaataagtattag

SEQ ID NO: 822 - DNA, 1647 bp, Proteus mirabilis
aaggaaaatattatgcatacagaaggtgttggattaagcacaatagattatgcaatctttgccctctatgtcatcattattattagccttggattatgggtttctcgttcaaaagatggagctaaaaaaggaacaaaggattacttcctcgcgggtaaaacactgccttggtgggcgattggttcttctcttattgctgctaatatctcagctgagcaattcattggtatgtctggctcaggattttcgataggtcttgctattgcatcttatgaatggatggcagcattgacgttaatcattgttgctaaatactttttacctatttttattgaaaaaggcatttataccattcctgaatttgttgagaatcgttttaaaagtcgtaatttaaagacgatcctcgccgtattctggttagcactctttattttcgttaacttaacatctgtattgtatttaggatcattggcgttagaaaccattcttggtgtgccgatgatgtatgccattattggtctggcactatttgcggttatctactcgctttacggtggactttcagcggttgcatggacggatgttgtacaagttttcttcctgatcctcggtggacttttcacgaccgtacttgctgttagctatatcggtggtgatggaggaataatggaaggcttaagtaagatgacagccgccgcgccagatcactttaaaatgatcttagcaaaagaaaacccacaatttatgaatttgccaggaattgctgtgctaatcggtgggctatgggttgctaacctctattactggggctttaaccaatacattattcagcgtgctttagctgctaaatctattaatgaagcgcaaaaaggtttagtgtttgccgctttcttaaaactgattgtgcctattttagttgttgtgccggggatcgcagcttttgttatcacaaccgatcctacgctgatggcaggattaggaacaatggcacaggagcatatcccaaccttagcgcaagcggataaagcctatccttggttaacacaattcttacctattggggctaaaggggttgtgtttgcagcactggcagcagctatcgtttcttctttagcttccatgcttaactctatcgcgactattttcacgatggatatttataaagaatatattgggccaaaatcctcagaaacccgcttagttaatgtgggacgtattagtgcggtgattgcattgattattgcttgctttattgcgccactgttagggggcattgatcaggcattccaatatatccaagagtacacaggtttagtgagtcctggtatcttagctgtattcttgttaggactattttggaagaaaactaatgccaaaggggcaattataggggttgtactctcaattccttttgctttattcctaaaattaatgccactaggaatgccattccttgaccaaatgatgtatacctttattttcaccgcggttgttattggtttggtcagcttaacctcaacgaaaagtgatgatagcgtaggggcgattgtattaactgatgcaacatttaaaacccaaagtgggttcaatattgcttcttatatcattatgatcatcctctgtgtgctttatgctgtattttggtaa

SEQ ID NO: 823 - DNA, 2427 bp, Proteus mirabilis
ggactatgtatgagtggcagaataacaaaaattaatactatcaaaaagatggcggtatttcaggattttcaatggtcatcatcagtaagagatgatggcaataatatcgctgaatttaaaaatataaatattatttatggcaggaattactcaggaaaaacaactctatcaagagctttcagagctcttgaaacaggaataatatcagataaatacgactcagcagaatttcaattttctttcgataccaataatataattacacaagatacattgctcaaccatggtcaaataattagagtattcaatgaagactttatcaaagaaaaccttcgttttattgtagatgatgagcaaactataaattcatttgttattctaggggaaaacaatgcaaagattgaagaggaaattcgtaagaatgaagaagaactcggaaatgaagatgataagtctggacttatttctatcttattagatgcagataataaggtaaaggaggctgataaaattcactccaaacgatcgatagacttagaagataaattacgaaataaagcaaatcaatcaggaactggaattaaacacaacaagatttttggtgatgctaactataatgtatctaaaataaaaacagatatattgacaatttctaagaacacgtattcaccaatatctggagataaagtaagtaaacttcaagatcttttaagggaagttcctaaaccaactataccagagtcgccgccattagacctacaatattctataattgaatcagaagctaaaaaattagttgaaaaaaaaattcaaacttcggaaactattcaggaattactaaataatgcaatactagcatcgtgggtaagaacggggagagaattgcataaatacaagcaagagaaatgtgcattttgcggtaatatacttccagaggatttattgcaaaaaatagacaagcattttaataaggaatcggaagaacttcatgaatccttaaatatcctacttagcacaatagaaaaggagctattaaaaatacctaacctattaaagataaaaaccatagacttttattctaattttgctaatgacttaaataccctcaatgatgacctatcaaaattatctatagattactccaaaagcttaagtttaataaaagaacaaatcgaaaaaagaaaaagcgatattttcactccattagaatttcattcatctgtatctgttgaggattcaataaatgaattaagatattcatatgaaaaaattcgaagtaaatccaatgatttcacgaagtctcttaatactgaacaagtaaaagcacgtaatgagttacgtcttcacgaagtttataaatttataactgatattaaatatgtagatgaacgtaatactattaataaactgctaaaggaaaaagaagatttagaaaaaacaagtattaacataaaacaaaatgtcgatgaaaaaaggaaaaagattaatgaactcaaagggaaattaaaagatgaaagcaaaggagccgatcgagtaaatgactatcttaataatttttttgggcatcaatatctatctcttaaagctattgaagaaaaattagatgggaaaatttctcaatatcgattcgaagtaactagaaataataagaaagcctttcatcttagtgaaggggaatgtagtctgatcgctttctgttattttatggccaaacttgaagatgtagaaactaaaggtaaccaacccataatatggattgatgaccctatttgtagcttagatgctaaccatatatttttcatatatagccttataaatgcaaaaattgtaacagatgaacaatataatgatggagaagaattaaaaacacgaccgcgttttaagcaattatttatttcaacacataacttagattttctaaagtatctaaaaaggctgccaggtgctttaaatagaaacaaatcgcaatatttcattatcaatagaactgaacaaaaaagtactataacattgatgcctcgatacctaaaagattatgttacagaattcaattttttattccatcaaatatataaatgtgcaaatgctcaagttgtaaacgatgaaaatcatgattgttattacaactttggaaataatgcacgaaaatttcttgaagcatttttatattataaatatcctaatgctatggaaaaagatgacaagctatctcgctttttcggcgatgatgcattagcagcatcattaacagatcgaatcaataatgaattttcacatttagcgggcgtctttgaaagaagtatctcacctattgacgtccctgagatgaaaattacagcaaaatttattttgaaaaaaatagaagaaaaagatccagaccaatattcagctttacttcaaagtattggtcaacaagataatagttaa

SEQ ID NO: 824 - DNA, 438 bp, Proteus mirabilis
agcattggtataaagcattattattttaaatggagagtacggtcaatgagtcaaatacctagtgaattaaaatatgcgcaatctcatgagtggatccgttctgaaggcaatggcgaatacactatcggcatcactgaacatgctcaagagttgttaggtgatatggtgtttgttgatcttcctgatgtaggcagtgaagttgatcttggggatgattgtgctgtggctgaatcagtaaaagctgcatcagatatttatgccccattatctggcgaaattattgcagtaaatgaggagttagatggttcaccagagctggttaatagtgatccctatggggatggatggttatttcgcataaaagcaaaagatgaaagcgaattaaacgatctccttgatgcggctggctaccaagagttagttgaaaacgaagagtaa

SEQ ID NO: 825 - DNA, 588 bp, Proteus mirabilis
ttgatattcattgttatccttcaatataggagagttaagatgagtcattttaacattggtgttgtagtcggaagcttaagaaaagattcctataataaacaaacagcaaaagcattaacctcgctatttcctcaagaatttacttttcagttccttgatatcggtactcttcctctctacaaccaagatgatgacgacaaaacacctgaagccgttgtcgagtttaagcaacaaattaagcaatgccaaggcattatcttcgtaacacctgaatataaccgctcaatccctggtgtgctaaaaaatgcgttagatcaagcctctcgcccttatggtactaatgcatgggatagtattcctgctgggatcatcggtgtttcaatcggtaatattagtactgctattgcacaacagcacctgcgtaattcattagcatttttaaatatgccaaccttaaatcaaccagaatgttttttaaaatggtatgatggaatggtagaaaacggtcagttttctgaaaaaacagcaggttttatgcaaaactgggttaatagctatattaactttgtaaagcataatcaaaaatag

SEQ ID NO: 826 - DNA, 4770 bp, Proteus mirabilis
tctacattcatagcaacaaatggagataactctatgaaatcaaaaaactttaaactttcaccctccgggcgacttgctgcgtctttagcaataatttttgtctctcttaatgcttatggtaatggcatcgtgcccgatgcaggccatcaagggccggatgtctctgctgttaatggcggtacgcaagtgattaatatagtcacgccaaataacgaagggatttctcataaccaataccaagacttcaatgttggcaagcctggggctgtatttaataacgcattagaagcgggacaatctcaacttgcgggtcatttaaacgctaacagcaatttaaatggtcaagctgcctctttaattttgaatgaagttgttagccgcaacccatcattcttattaggtcagcaagaggtctttggtatcgctgctgaatatgtgctttctaacccaaatggtatcacatgtgatggttgtggttttataaataccagccgctcttcattagttgttggtaatccgctctttgaaaatggtcagctaaaaggctatagcaccctcaacaacaccaatttactatcacttggtaaaaatggcttaaatacaacagggttgttagacttaattgctcctcgtattgatagtagagggaaaatcactgccgctgaaatttcagcctttactggacaaaacaccttctcacaacattttgatattctctcttcacaaaaacccgtttcagcattagatagctatttctttggtagtatgcaatcgggtcgtatccgcattattaatacggctgaaggtagtggagttaaattagcaggtaaatttaccgcagataacgacctaagtgttaaagccgataatattcaaacagatagtcaagtccgttatgacagttacgataaagatggcagtgaaaattaccaaaactatcgtggcgggatcacggttaataatagtggctctagtcaaacactcactaaaaccgaattaaaaggtaaaaacatcacattagtagcgagtagccataatcaaatcaaagcctctgatttaatgggggatgatatcacgttacaaggcgctgatttaactatcgatggtaaacagctacagcaaaaagagaccgatattgataatcgctggttctactcgtggaaatacgatgtgactaaagagaaagaacaaatacagcaaattggtagccaaattgatgctaaaaataatgcgacattaaccgcaactaaaggagatgttaccttagacgcggctaaaattaatgcggggaataaccttgcaattaatgccaataaagatatccatatcaatggattaattgagaaagaaagtcgtagtgaaaatggcaataaacgtaaccatacttctcacttagaaagtggtagttggagtaacagccaccaaactgagacgttgaaagccagtgaattaacggcaggtaaagatcttggtttagatgctcaaggctcaataacggcgcaaggtgctaaactgcatgcgaatgaaaatgtgctggttaatgccaaagataacattaatttaaacgtccaaaaaaccaataatgataaaacagtcaccgataatcatgttatgtggggaggtattggtggtggtcagaataaaaataataataatcaacaacaagttagtcatgcaacacaattaaccgctgatggtcaattgctccttgccgcagataacaatgtcaacattaccggtagccaagtaaaaggcaaccaaggtgcttttgttaaaaccacacaaggtgatgtcgtcattgataatgcgatgagtgaaaccatcagtaaaatcgatgaacgcacaggaaccgcgtttaatatcactaaaagttcacataaaaatgaaactaataaacaaacatctacaggtagtgaactcatttccgatgcacaattgaccgttgtcagtggcaatgatgttaatgtcattggtagtttgatcaaaagcgctgataaattaggtattcattctttaggtgatatcaacgttaaatcagcacaacaagtcactaagattgatgatgaaaaaacatcattagccattactgggcacgccaaagaagttgaagacaagcaatatagtgcgggctttcatatcactcataccaccaataaaaatactagtactgaaacagagcaagctaactcaaccattagtggcgccaatgttgatctgcaagcgaataaaaatgtgacttttgcgggatctgatctaaagactaccgcagggaatgcctctattacgggtgataatgttgcctttgttagcacggaaaataaaaaacaaacggacaacacagataccactatttcagggggttttagctacacaggaggtgtagataaagtcggttctaaagccgattttcaatatgacaaacaacatacacaaacagaggtaacaaaaaatagaggcagccaaacagaggttgcaggtgatttgactattaccgcgaacaaagatttgcttcacgaaggggcttctcaccatgttgaggggcgttatcaagagtctggtgaaaatattcagcatcttgccgtcaatgatagtgaaacatctaaaactgacagcttaaatgttggtatcgatgttggcgttaatcttgattatagcggtgtaacgaagccagttaagaaagcaatcgaagatggtgttaacacaaccaaaccgggtaacaataccgatttaactaaaaaagttacagcaagagatgcaattgctaatttagctaaccttagcaatttagagacccccaatgtcggtgttgaagttggtattaaaggtggtggtagtcagaaatcacaaaccgatagccaagccgtttcaacctctatcaatgcaggaaaaatcaacattgatagtaataataagttacatgatcaaggtactcactatcaatcaacccaagaaggtatttctctcacagcaaacacccacacaagtgaggtcgcgcaagataaacatcaaacgacattccatgaaacaaaaggcggtggacaagttggtgtcagtactaaaacgggcagtgatattaccgttgctattaaaggtgaaggccaaacaactgataacgccttaatggaaacaaaggctaaaggtagccaatttacctcaaatggcgatatttcgattaatgtaggtgaagatgcccattatgaaggtgctcaatttgatgcacaaaagggcaaaacagttatcaatgcggggggtgatctcactcttgcacaggcgactgatactcatagcgaaagtcaatctaatgttaatggtagtgcaaatctgaaagtgggcaccacgccagagagtaaagactatggtggaggtttcaatgcagggaccactcatcacagcaaagagcagactaccgcaaaagtgggtgctatcactggctctcaaggtattgaattaaacgctgggcataacctgactttacaaggtactcatttaagtagcgaacaagatattgcattaaatgcaactaataaagtcgacctacaatcagcgagctctgagcgtactgaaaaaggcaataatttatctggaggagtacaagcaggctttggtaaaaaaatgaccgatgatgcttcatctgtgaatggtttaggtagtgcccaatttgctattggtaaacaagatgagaaaagcgtatctcgagaaggaggaacgattaataactcaggaaacttaacgattaatggcaatagcgtccatcttcaaggagcacaagttaatagtaaagatactcagctaacatcacaatccggtgatatcgagatcacatctgcgcagtctactgattataaaaacaattggggaacagatattggctttaatggcaaaaaaaccaataccaccccaaaagaagttacagaggagaaacctgctacctctattcataacatagggggtaaattactggttaatgtggaagatcaacaaaaaacgagccaccaaaatgcaaccttagaaacaggtacattaacgattaatagtaataaagatctgacactatctggtgctaatgtgactgctgatagcgttacgggtaatgtcggtggttcactcaatattgctagccaaaaagagagtaatcgccatgtcactgttggcgtcaatgttggctataaccacaccaatgatcctaaatcaagccaagtgaataaaacggctaaagccggagggtcattattagagaaaactatcaaagatacgattgattcaggaattaaatcatcaaccgatgctatctctgataaatataactccctctcttcaactattgcagataaaacaggtatcagtgatgaaactaaagccaaaattgatcaaggttttggtaaagtcggtaatggtattaagaatatcgtcacaggtgctgagggtcatactgctaatgcggatatcaaagtcactcatgtagataatgatgctgtcactaaaaccacctccttaactagcaacaacgacctatcattaaatgtgaatggctcgacaaaactcaccggagcagaaattgcgagtaaacaaggccaagttgatttagggggaagtagcgttaaattagaaaatattgaaggtcatcattatgaagccggcgccgatcttgatctgaaatcctctgtggtggatttagcaaaacaactggtaggtggagatatttcttttaaatcccccgttaaaacgaatgaaaccgtcaatacaaaagcatctatttctgaaaagaaataa

SEQ ID NO: 827 - DNA, 237 bp, Proteus mirabilis
aaaagaatcattcccgctatttttagtaagataatattttcaataactgttaacaaacatcattttaagattttctcctgcgttcttttttcactttctatgcttattccatttcacgtattctcaccttataacttgattgctctgacaataatctgcacacaaatgcacttgaaaaaaaataaaatagctattagcgatataaaaggtctatttttaattatcacttttagataa

SEQ ID NO: 828 - DNA, 204 bp, Proteus mirabilis
gtgatccacattcctgcttctggttttatttatatggcttcaataattaaaagcatgctggaaaatccatgcataaacaaagagtttgaaaagctaattgcagcagatctacttcctattcttcaaaatgaaactaatatgactgaaaattttactgcccttcatttaataaaaaaaacaaataatagaagaataattttatag

SEQ ID NO: 829 - DNA, 246 bp, Proteus mirabilis
cttggtggcatttgtaaaattgtgtggagagaaagtatgttctttgaatgcataccgatttcggtatattgcaaactttttgacgaaacaactgatgcaataaataaacggttacaaagacaattctggcatgaaggagttcaagttttaaaagtggaaggatccaaggagcgctggattgatataattgaggtaaataaatgggcaagaaaaaacaaacaaaatacccattaccaagaggtgtga

SEQ ID NO: 830 - DNA, 624 bp, Proteus mirabilis
acgaacgcaatgacttatacagttgctcttacaggtggtattggtagtggtaaaacgaccatcgctaatggttttgcctcactcggcgtccctcttgtggatgcggatgtcattgcacgattagtggtagagcctgattcgccaggattaaaagccttacagcaacacttcggtgacactattttattgcctgatggcaagttaaatagagcgcaattacgtcatattatttttcaaaatcaacaagaaaaagcgtgggtaaaccagttactccatccacttatacaacaagagacgcaaaaacaaattcaacaaattcgcgccccttattttatttgggttgttcctttattagttgaaaataaactaacacatttagccgatcgtattcttgtggttgatgtgactgaagaagaacaaattaccagaactatgcaacgtgatggtgtaagccgagatcatgtactcaaaattttacaagcccaagctaaaagagaacaacgattagccgttgctgatgatattattgaaaatcacgataatagcttaaatcaagatgaacaaataaaacaacttcatcagcattacttagaattagctcaaaaaagcaatacaggacaatag

SEQ ID NO: 831 - DNA, 204 bp, Proteus mirabilis
aaaaagaaaattatcgatttattcattaaaatgattaattatatggagaaagtctttatggcaattaacgaaaaatttgtccaagaaatatcaagcattaattataataatggtatattttcactctattttgtcggtcaagatcctcataaaatagcacaaggtatcatgccagaaaaagatgaagaattagccctaaagtaa

SEQ ID NO: 832 - DNA, 579 bp, Proteus mirabilis
ctaattagaatgagaataatgatggaattggctactcctcgattacgtttacgagaatggcgtgaaagtgataaagcgccattttttttacatattaacgcctcagcatcggtgatgcgttatttcccttcaccacttacccgcgcagaaagcgatgcaatggttgatacattgcgtgataaatttattcagcaaaatggttggggactttgggccgttgaattaaaagagactcaagagcttattggctttgttggattaaatattcctaatgcccctttgccttttaatccgtgtgttgaaataggttggcgtattgcacaatctcattggcgtaaagggtacacttatgaggcggccttaacagtattaaaatatgcttttgaacagttgaaactggaagaagtggtggcatttaccgccgtgaccaatttaccctcagaaggggtgatgaaaaaactcggtatgaagaagtctgaatattttatgcatccatctctagataaaacacaccctttagcacaacatgtattataccgattaaaaaaagcagactttattttcccgataaacgtttag

SEQ ID NO: 833 - DNA, 861 bp, Proteus mirabilis
ttgatgagaatactaatgttatgtggaatgataatgttatcttctattgtgcaagcaagacctaatcaacaagttcctcaactcacaccacaagtatcaacctattatcacattatggaaaaagaggttgagcatcaaggaaagcagtatcgcttttttcttgcgatccccaaaaatacgcctaagacaacagtgctgtatagtgttgatggaaatgcacaatttccacttattgtgaatgaagcactagcgcaagcgaaaaagccattacctgttattgcaagcctaggctatgtaggtgaaaaggcctattttatagcggaaagaactcacgactataccccaagagtacatggcgaagcctttgccaaaggcggtaatgttgaacagttttatcagtttatggtaagccaattaaaaccctatgtactagcacagatggcgcaagaaaacatcactattactgagcaatcactatttggacactcctttggtggcgtgtttacgctatatgtattatttaaccatccagacgcttttcaacgctatattgctgctagcccatctctttggtggggaaaaggtgagtggatcactcaagataaatggcaacagatccccaataatgttgcggtgaccattacattaggtgaattagaagaaacccctgatttttctcaaatgagcgaagagcaacgcttgcgctatcaaacgcgtagtagctggcttactcctcgacaactctgtgattatcttactgatgccggcaaaacatgccaattttacctctttacggggaaaggacatggcagttcaatccctgatgcaatcaaaaccgctttagaacaaagtacagaataa

SEQ ID NO: 834 - DNA, 666 bp, Proteus mirabilis
ttcaaaggaatagatatgaataaactcagtgaaacagaacgccaagcgggtgtacaacttctctcacaactgaaaatgtttaacgaggcggttgtttattttgaccaacatatagaacctgctttttggaaaagttttgataagtgtattgaccgatttatcaaaaataataattgggcaggtgatgctgattatgaaaacaaagggtattgctggctcgcaccgaaaaattggcttattgaagatgataactgtaaatattattttgcaactagtacaactgttgatgaagaactcgactataccttagccgttctgactggtcagggcattgagcaagggaattttggtttcgaatttcaattgaatgccgcgcattttggaggagccagaaaactggctagttataacaattcaatgtctgaaaaacataaagaagacaaagaaaaattaataaaaataggcttaaaagatcaggtaaaaggtaactattttattcctatcataattgattcaaaattacttgctgattgttgggcgctcaatggtgaattcccagtagagcatgagattttttctccgcttagaaatgcccttgagatactattcgaatcaactaacacattggataatatgttccgagatgccattgaagtgagtgaataa

SEQ ID NO: 835 - DNA, 1197 bp, Proteus mirabilis
ttaaccgttttgattgtggagacgagggtagtgaaacagaacactactttggtacgcaaaggtgacagtacattagtacctgtcgcgggtttaacggtatttgctatcgcatcaggctatttaatgagtttaattccactatctatggatagttttggtattgatactttttatgctagctggttagcaagcatttactttattggattacttataggttcagtgatgatcgaacctattattgcaaaaatagggcataggctctcttttgtgctgtttttattgttgttagcattcaccgtgagtattttgccactgttaccttatttatcggtatggctagtatctcgctttttcggtggtatggcggttgcgggtatctttgttgtagtcgaatcatggttattaattggtgataatcctaaagagcgagctaaacgcttgggcttttatatgacatcactttatggtggcacaacattaggtcagcttgctattggtgccattggtacgcaaggggcaattccttttatcgcggtattggcattgctattaattgcagtgttacctcctttgttttttaaacaaggacaaccccaatgccacgagcataaaagtttgtcacttaaacagattagccggctgaataaagcttctttagtaggttgtatggtttctggcgttgtgatggggagtatttatggcatgatgccattggctttaaatcaaggacaatttaacaccgaccaaattggggtgttgatggcagcaattattttaggtggtatggttgttcagcctattattagcaaattgtcggtgatgatgagtaaaaccctattattagccatgatgtgcttagttggggtatttgcgatgggcatgacttatctgtctaatgactatgtggtgttaattattgcattagctttattaggaatgtcatcttttgcactttatcctattgctatcacattagcttgtgatcatgttaatgcgagctatattgtggcaattactcaggtgatgttattaagttacagcgtgggttcagcaatggggccattaggcgcaggtatgtttatgtcacaagcaagtaacggcattatgaactttttctttgtcgtgttattagcgacagctgtatatatgttatttgccagtttacgacgcaaaagccatattgtgcttaactaa

SEQ ID NO: 836 - DNA, 402 bp, Proteus mirabilis
ggaaaaatgatgtccttattgaaaaataaaaacaatgttttagctctgtctatggcagttactgttctcacactatcgggatgtagcattttatctggtgatagccaacctgtggaggtggtgccaacacaggtgcaatccacggtaacttcacctgctgataataattatcaacagatgaacgtaggggagcaaaaactggcatcacaaacagcatgtatcaagcaacttgattctttaaaaacattttcaccagcagagtataaatctatggtggatgaatttaaggaaatcagtgaaattaatgcgttataccgtagtgttgaaaataccgccagtaagataagcttagcattattaaaaatgagtatcgaatttaagaccgaaggtactatgtgctaa

SEQ ID NO: 837 - DNA, 5475 bp, Proteus mirabilis
gggaaaatgatgtcaaaaattttaaaagatttagagtttacttttacaggaaaacgttatggtacagatggaaatgacgatattgatgccataggttttggagggatcatttatgcaggaaagggacacgatacaatcacagtcggaacattagcagttaccgcttacaccggagacgggcacgattttgtcagagggggaagtgcttatcttaagattattgatgagaacggtgatttagatgtcagaggattaaatgcatggggagaaattgaaaagtccggtcatggcgatctgaaatatgttggtgcttctgccgcgattaagattaatcatactggatatgaatatggaaatatcaattattcaggagctgctattgcaaatatcatcacccgtaaaggcgcaattagtaatatcaactaccaaggtgctggcggttacaatcaaatttggcatgaaaccaatactggcaatatgacgtttaaaggggggggaggctataataaattggttcgtacttggtttaatagctatcaaaattcaaaaggaaatattaattttgaaggattaggcggaggcaacggaatcttctctcgcgttgaaacaggtgatattaaatttaccggaggtggcttagaaaacgtcttaatacgcgaaggtaaatcaggcgatatctttatgtatggagcaggagccaataataggcttacacgtatcagccgaaatactgatacctataaagaaacaagtggcaatatctatttttcgggggggggaggttataatcatatctattccaatatagcacaaggcaatatcacattttatggagctggggcttacaatgagatcattcgtacaactcaagttcatcctcataatgatttattagttgaatatacaaaagctgaaaatatttttctaacaagtgcttatatgttaaatctagacttagataaaagtattaattttctaacaagtgataataagcaaaatttcgaatccggtaaacctgttgaagtaaaagcgattaaatcattgcgagaaccaaatacttatttgtttaaaacaccgggcccaggggataccaatttattcatatcagactatggtcgtcgagattatacctttaataaagtcaaaatttacaatgatcctgaaacgggaaaacttcaatacgattccgaactttggcgtataacgcctgatagtggggacattaggaacatacgttttgataaaaaaaattttgaggatacctataatcttagtgtggtcaataattgttggaatacattagaaaaacaagaaattatcgaatcaccacgtttcacaaaaataaatgctgatagccactatcaattatctaatttaaaagtatttcaacacattaatacagaacaaatccaaagaaagtctctagaaacaatcaagttgggcgtagcacaagaactttttaaagacgataattctgctgaatgctctggtgatatcaatttcacaggtggtggcgctggtaatgtcattaaatctgatgttacacaaggtgatatcaattttacaggtggcggcatagcaaatgtaataaaacataactctaattatggtaataccaactttactggtggaggcgcagccaacatcattgtaaaaaaaggtcaaagaggagacctaacatttgatggaggaggattagcaaatgtcttactacatcaaagtaaagaaggaagaatgaacattaatgctactggtgccacgaatgtattaatccgaattggtgacggtgaatataaagcacatcttacggcattagggaatgtttctattcacaaaggacaaggtgatagtcatatcacaatgttaggaggattaaatacccatacccagattgatagtcatcagcgtgataaggctttatggcgagcattaggcggacttaatgtcatgacacaagtcggtgctggtactattacatctttactcggcggcggtggaaatgtcctgactaaaatgggtgaaggcgacctaagtagcatcatgttaggtgatgctaatatcattacacatatcagcaataacaaaataaaatcaaatacttacactatcaccctaggtggattaaatattttaacaaaaaaaggtcaaggtgatattttagccataatggggggaggtggcaatgtcctaacacatatcggaaacggtaacatacatggcgttatgcttggaggtgccaatatcttaactaaagtaggtaatggtgatctttcaggcattatgctaggtattggtaatgtactaacacatgttggcgatgggcaaaccctaggtataatgggcgctgtggggaatattttcactaaagtcggtaatggaaccagtatgggtgccatggtcggtggtggcaatatattcacccatataggtaatggtgaagcttgggcactaatgggaggtttaggcaacgtctataccaaaataggcaatgggaatactttggcactaatgatcgccaaagggaatgtgttcactcatgtgggtgatggaatgtcggttgctctaatgttagcgataggcaatatagccacaaaagtgggcgatggcatgacattagctgcaatgattggcagtgctaatatttttactcacattgggcatgaagaaacctttgctgcaatggtgggtaaaggtaatgtccttaccaaagttggcaatggattaacattgggattaatgctaggtgtggctaatatttatacccatgtcggtgatggcattagtattgggctgttttctggtaaagcaaatatcatgaccaaagtgggtaatggaaccacattatcagcgatgtttggcaaagccaatattatgacccatatcggtgatgggataactggcatacttgcattaggccaagccaatatcataacaaaagtgggtgatggcattgcgggaatcattgctggtgcgaaaggaaatatcgttactcatgtaggtgatggaataaccgctgcgatcctcggcggaaaagcgaatattttaacaaaagtgggtgatgggctcaccgtaggtctgctgatttcaaaggtgggaaatattatgacccatattggtaatagcaccacgattggttttgccaaaggcaacgccaatatcatcacaaaagtaggctatggtttaggcattaatgcggcatggggtaaagctaatattttcactcatatcggcgatggtgaacgatataacttcgccaaaggaaatgccaacatcattaccaaagtaggtaatggacaagaaacctctgttgttaaaggtaatatcaatattattacacacgtaggtagtggaaataattatactggtgcatggggcaatgggaatgttgtaacacaaattggtgatggtcgtcaggtcgccttagcaaaaggtcatgcaaatattgtcactatgctcggaaaaggtgacaactatggcatagtttggggtaaagccaatatttcgacaaaagtaggtaatggcacgcaagtcaccatagcaaaaggccaagcaaatattacaacaaccgtaggtgatggcctaggtgttaccgttacatacggcaacgcaaatatcaatactaaagtggggaatggtgtatctgtaaacgttgcttgggggaaatataacgtaagtaccaaagtgggtgacggcttaaatgtttcggtcatgaaaggtaccgctaatgcaaatatccatgttggtaacggtttaggtattaacgcctcttacgcaaaaaacaatgtcatcgttaaaattggcaatggtgatatctacagcttatcggttgcttctagtaatactcaaagtaataaactcgctactttcttcggcaatataaaacagagtgtacttggtgtggtcgggagtcaggctattaactatttagtacaaggtgatgatgtaaccacttccggctcccgcaaaggcaaaggcgctattcatttaattgaaaaatcttcaatcgacggtttcaaaatgaacaaaatcgacgaagtgaagagtaacattgatataaatttaaaaggtcatatcacagaggtagaaacccctagtttaagtgatgttaatacagatgaatccaacttaaccaataacagtccgaatttgatcataaatggtgactttaaacatggatttaaacctgtaacagaaggttggaatattgcatatactcaggataaaattacagcaattagccaatatggacatagagcctctattgatacaccaactaatactaataataaagattattgggatggtggacttatagcagaatacaaggaagaatatgaaccaaatatcgctatatatcaagatattagtggtttaatgcaaaatgaggtgattgaattaagttttgagtatgaacgacaagataatacgccaacagagaataaattaagtgttatctggaatggtgaggttgtcttcacttcatcaagtgatgataagtcaatagcatggcaacaacaacaaattaaattaaccgcaaatgcagaaaataatcgtcttatttttaccattccaggctctgatggcttgcaaggaaataattacagactaagaaatattgtcgctaaatcagctgtagcaaatataaacaagcatatctcagattctgatgcgacaaaaaatgccctcgctgacaaaaagaaggcagatgccaatcgtcaaaaactaactgatgaaaaacaacgcctattagaccacatctctaccacacagactgaacttgaatcgaccgatcaccttgcactggagaaaaacggccatagagaacgcgatgccattcttgaagaagctaattcagtaacacacaatttgaccacagttggtcaaacactggaagtactcagcgaatattcacaagatgcccccccctcagatcaaccatggagtgagccattcgcggaaggaattttaaaggatgtacagaagagcttaattaatactaaaaaaattgtttcagtgcctgttaataatattaaaactcagtatgttgcaaaccttacaaaggtgaaaaaatcgataaaaaaatcggaatatggcgttattcaaagtgaagaacattgtcaagaagtgcaactcgatacttccaaagcaaaaaatgatgcagataaaagatactcagacgcgatagataaaaaaaatagtgctcaaatggcagagaaaaaagcatcaaccatggtggaagatgcgagatcacgaggagatacggagcaaaaaacagcgactagcatatcggataaagcacaaaaagaagctaaatctgttcaactgaaagaaagtgataaacctaatcgtcacagggcgcatggtagcggtttatccggagaagcggcctatgtagagggggctgatgataatccatccagttatatcaaaccaatatcaactaaaaaaatgatggtcgtttcaataataaactga

SEQ ID NO: 838 - DNA, 273 bp, Proteus mirabilis
aggtcagcgattgttatggacattagtcaagatattagacgtttaggtgaaaatctgaaagggcgtttggcgcctgatattgttgattttgacttagaatatatagaccactcagaaagtattttagcttttgaaacgttatgcgatcacatagctgactatgatgtcgtaataaccagtgatgagtataagcagatcattggtattgtaaataagctaaatcttgagttagatgatagatatttatatataaatccagataatattaagtga

SEQ ID NO: 839 - DNA, 237 bp, Proteus mirabilis
gaaaaggagattcagatgagcacttttattcgtcgaagtcgcaacgttgctctagccattgatgctggacgtaaaagtggtagtgctaacatagaaggtaatacccctgctgatattcaagccagcctgctgaaaagcttaggtgagtttactgcatctattccaactacaaaacaacaaccttacgtgaaaggatctcacggtgccaatcataaaaaaaactatttcgggcgttga

SEQ ID NO: 840 - DNA, 579 bp, Proteus mirabilis
attaaggtttttatggaataccaattcaaatcatatagtaaaggcagcaagaaaaaatcattaccttcttacatctttgttatcctgtactgctcttggttagcttatctatttttgtcgctttatttaggcgataacattgtattatttgaatggtttcctaaatggacgattattattatttttgctattttcacagggattattgggggaatatggcaccctttttttcgcccatcaaagtatgttatcagtgattattggggggcttttcttggccttatgataattattccaacttttaatgtgcttgcttatttatcattagaccaaacaattcactaccaaacacaatatcatatcgtctcgccagggcctgaacgtcttaaagcccctcaatgtgaatatggtatacggataaaagaaatttatacaggggaatgggttttttggtgtattagagatccaaaatcgaaaaccaaggaaaatacgggaaccgtatgggttacagcaaaaacagggcctattggtgcagatattgttgattatcagttttactctcctaacgctcagcaataa

SEQ ID NO: 841 - DNA, 747 bp, Proteus mirabilis
tattgctttgttatttatcctctaaaaaggaataatgatatgaaaaaattattacttagccttactatgctggcgataatatctacgccagtgttggctaaatcccctgtagctaacttaaaaatcaacggtgatattaagcccccaacttgtactattaatggagcaacacaaagtgatgtaattttcgattacggagtcataagcccaacacttatccctcaatcgaaaatttattcttatcctgccagtatggttcaaaatacagttacagttgaatgtgatgcaaaaacatatttaacctttgttgcgtctgatacttatgataatacagaattaagcgttaataatacgtcagactggtttcatttagtagataaagcaaatcctgaaactgcggttggagcagcttattttgtatgggataatgtgactgttgatggcaaacctgcgtatatttcacgagcaaacgatgctgctatcacagggactaactactataatgtcctatataaagggccaaccaatggttggacatcaaaacaacagacagaatcggttgataaaggctctctggctctaatttcaggtgaaattttccaagcaaatttcagacagggaattgaaagtaatcctactcaaacctttattttatctagagatgaattaagtaaaaaaggaatagatttatctaatggtttagattttatcggggaggctgttctcacttttaattttggtgtctaa

SEQ ID NO: 842 - DNA, 450 bp, Proteus mirabilis
gtgaggtttgtaatgtacaaaaaaattctagttcctatcgatattctagaagacgagctttctcaggaactgatcactcacattgaacaaattgctcaagttggcaaacccgagatccacttcctcaccgttattccaaatgcagaacttttcttcggtattgagtttgccgctattcctgaaaaatttaaagactcttcagagcgcactcgcctcgcttttattgctctgcaagatatgatcaaagatgcgaaaattcccgatgagcaaattgtttgcaatgtcggtgttggtaatgcaaaagatgaaattttagagtatgcacgtcaaatcgatgcagatttaattgctattgcttcacatcgtcctaatgtttcttcctacttattaggctcaacagcatcatctattgttcgccatgcaaaaatgtcggtattggtgatccgttag

SEQ ID NO: 843 - DNA, 264 bp, Proteus mirabilis
ctgtctagctttttgccttacaactgcgcactaatgccaaccgtcgaaaagcgaaacccacaccgacagccaccagtcgcaaggcagtaccttatttaccgatatgaagaccgcagactgagtaatagaaatggtatagctgcaaatcaagataaaatatctacttttatggttgaaagcgatactccaatagtccttaatcatggttcgtctacaaatataaatagagttatctataaagaacaaatattaataaataattaa

SEQ ID NO: 844 - DNA, 225 bp, Proteus mirabilis
ttatttttagtatgggcgtctattaatattatattaattaactttctttttattttgttattactcgttattagtaaatatttttatattctatttaaatctagttttaataactgtaatgaccggttattttccacgaaaataaaacatcttcagcgacttgtccaaaaccaatattatgcatcactaaatagcgctgattatcactgcttttcttgtctatga

SEQ ID NO: 845 - DNA, 543 bp, Proteus mirabilis
acgaaaagagtccaacttttgcgggtcgttcatcaggggggggagcagatgccgaatagtgaagaaagaaaatcaacctcatactattggatctacggtataatggtgaagtttgtcagtgaaacgtatgatctaataaggctgtttatgatagataaaaaaaaactacatattgctgcaggtgtgatttgtgataagcaaaataatgtatttattacccaacgccctttgacatctcatatgggaggatattgggagtttcctggtggaaaactagaagataaagagacgccagagcaggcattataccgtgagttgcaagaagaaataggtattaatgtgacacaatgccagttgcttgaaacggtagagcatgattttattgataggcatattacattatcattctttttagtcacagagtgggaaaataaaccttacggtaaagaggggcaactttcccgctggatacctattatgtccttaaatgccgaagattttccgccagctaatcgctctattgttgccttattgcaaaaataa

SEQ ID NO: 846 - DNA, 1326 bp, Proteus mirabilis
aggataggagtgggtatgaataagcaagaatttttatcccgtcgtcaggcattattagctcagatgaaaccagcaagtgcagctatcttttttgctgcgccagaagcacaacgcaatgctgatagtgaatatccctatcgccaacatagtgacttcttgtatctcaccggatttagtgagccagaagctatccttgtgttgattaaaagtgatgaaacacataatcatagcgtactgtttaatcgggttagagatttaaccgcggaaatctggtttggtcgtcgtcttgggcaagaagctgcccctgaaaaattaggtgttgataaagcgctaccttacgaagatgtaggtgagcaactttatcaattactcaatggattggatattgtttatcatgcccaaggtgaatatgcgtttgccgatgaaatcgtctttaatgctctggataccttaagaaaaggctctcgccgtaatttaaaagcgccacaaacgcttattgattggcgcccaatagtgcacgaactgcggttatttaaatctgatgctgaaattgaattactgcgcaaagccggaaaaatttctgcgttagcccatactcgcgcaatgcaaaaatgtcagccaggtatgtatgagtatcaattacaaggggaaattgaacatgagtttatctctcatggtgcgcgtttcccttcctataacagtattgtcggtagtggtgagaacggttgtatcttacattatactgaaaatgaaactaaaatgcgtgatggggatttagtccttattgatgcaggctgtgaatatgaaggttatgcgggtgatattacgcgaactttccctgttaatggtaaatttagccgtcaacaacgtgaaatttacgagattgttttaaaatcactcaatgtatccctcgaattgtataaaccgggtacaagcatcaaagaagtcactaaacatgtcgtgtatatcatggtggaaggcttagttaagctcggcattatgcacggtgatatcgaacacctcattgagacaaaagcctatcagcgcttctttatgcatagcttaagtcactggttaggtcttgatgttcatgatgttggacactatggcaccgatcgtgatcgtatcttagagccgggtatggtgttgactattgaaccaggactttacattgcgccagatgcagatgtaccacaagagtatcgtggtattggtattcgcattgaagatgacattgttattactgaaacaggtaatgaaaatttaacggctatggttgttaaagatcctgatgaaattgaagctctgatggcaggaaaaatttaa

SEQ ID NO: 847 - DNA, 1740 bp, Proteus mirabilis
cgttttatggttactattgaaccgacattacgtcggcgtgtggcgaaagcaacagcattgccagaaagcctcgatcccttattacggcaaatttatgccaatcgaggtattacctctgaaactcagctcgagcgctcgttaaagggcttattgcattatcaagatttaaacggtattgatgttgctatctctttattagttgaggcattaaagctgcaatcgcggattgttattgtaggggattttgatgccgacggtgcaaccagtacagctcttgctattaaagcgttacggcaaatgggatttcagcaagtaagttaccatattcctaatcgttttgatgatggttatggacttagccctcaagtggttcatgatgtggcgaagaaaggcgtagatctgattattacggttgataatgggatctcctcttttgaaggtgttgatgttgctcatgaatatggtatccgtgtattggttactgatcaccatttgccgggtcactcccttcctcaagctgatgcaattatcaatcctaatttagcggattgtgcctttttgtcgaaatcattagcgggtgtcggtgtcactttctatttaatgaccgcattaagagctgaattagaaaaacaaggttggtttacagcacagggattagctcgccccaatatggccgattaccttgatttagtcgcattaggcacggttgctgatgtggttcctcttgatgaaaataatcgtatttttgtttatgagggattacgccgtattcgtgcaggacgttgctgtgcagggatcaaagccttgacggaagtttcacgtaaaacgttatcacaattagtcagcagtgacttaggttttgcattagggccaagacttaatgcggcagggcgtcttgatgatatgtctgttggcgttgctttactgttaactaatgatattggtgtcgcccgtgaaattgccaatgaactggatggattaaatcagactcgtcgtgaaatagaagcaggaatgcaagaagaagcatcgacaatttttcgccaatttatcaccacacaagatgacttaccgaatggattagctatttatcatccacagtggcatcaaggtgtggttggcattctcgcttcacgaattaaagagaaactacatcgcccagtgattgcttttgccccaagcggtgatggtttactaaaaggctcaggacgctctattcatggtgtacacttgcgagatgcattagaacgtttgaatacgttaaatccgggattaatggtgaagtttggtggccatgcgatggcggccggactatctctggaagaagataaatttccactttttcagcgtcacttttcggcacttatggcggaattagtttctgctgaacaattacaaggcgtgattttaacagacggcgagttaagcgacagtcagttatctttacctattgcggaaatgttaagagaagcagggccttggggacaagcctttcctgagccacttttcgatggcaaattcaccttactacagcaacgtattgtgggaagcaaacatttaaaaatgatgcttcaaccgataaatagccatgtaatgattgatgctattgcatttaatgttgatgttaatatatggccagataacagtattaaaacggttgagcttgcctaccgattagacgtcaatgaatttagaggacagcgcaatgcacaactgctggtggagcatatttggccttgttaa

SEQ ID NO: 848 - DNA, 1251 bp, Proteus mirabilis
atggtcaaggtatctttggaaaaagaaaagataaagttcctactattggaaggtgtacaccaaagtgcggtagagaatttaagagcagcaggttataccaacattgaatatcataaaggtgcattatcgggagaagaattaaaacaagctatccgtgatgcacgctttgtggggatccgttcccgcactcacttaacagaagaaatttttgcagccgctgaaaaattagttgctgtaggctgcttctgcattggtactaaccaagttgacttagatgcggctgcccgtcgtgggatccctgtttttaatgcacctttttcaaacactcgttccgtggctgaaatggtgttaggggaattactgttattactgcgtcgtattccagaagctaatgctaaagcgcatcgtggtatttgggataaacaagctaaaggctgttttgaagcgcgaggtaaaaaactggggattattggctatggtcatataggcacccagttagggattttggcggaaagtgttggtttagatgtctatttttacgatattgaaaacaaacttcctttgggaaatgcaacccaagttcgtcacttatctgaactgctgaatatgtgtgacattgttagcttacacgtgccagaaacgccatcaacaaaaaatatgattggtcacgaagagctattacgaatgaagccaggcgctattcttattaatgcctctcgtggaactgtggttgatattccggcattagcacaagcgctagagagtaaacatttatcaggtgcggcggtggacgttttcccaacggagccgggggcaaataacgatccgaacgatccttttgtatcagaattaattaaatttgataatgtgatcttaacgccacatattggtggttcaacccaagaagcccaagaaaatattggttatgaagttgctggtaagttagctaaatattctgataatggttctacattatctgcggttaatttccctgaagtatcattgcctagtcatggtgatgatgtaaaccgtttactgcatattcatgaaaaccgtccgggtattatgaatagtatcaataacgtatttacagaagaaaatattaacgttgctgcgcaatatctgcgtactgctggcaatgtgggttatgtagtaattgacgttactacacaaacgaaagcacaagctgagttagtattgcaaaaactaaaaggactaccgggtaccattcgtgctcgtatgttgtactaa

SEQ ID NO: 849 - DNA, 1512 bp, Proteus mirabilis
gtaattggggtctgtatgaataaaactattagtgaacatgtagatgtcgcgctcattggtgctggcattatgagtgcaacacttggcacacttctgaaagaactagagtctaatttaaaagtcgcgatgtttgaaagacttaatgattgtggtcaagaaagctctaactcatggaataacgcgggaacaggacatgctgctaactgtgagctaaattatacgccaccaaatcctgacggcaccgttaatatcagtaaagcgttagaagtgaacaccgagttcgatttatcgcgccaattatggtcttatttagtaacaaaaggaaaaattgccgatccgcgtgattttattcatgcttgccctcatatgagttttgtttggggtgcagataacgttaaattccttcatcaacgctatcgccaaatgtctgccaatcactgttatgaaaatatgcaatacagtgaagacaaacagcaaattgaagattgggcgccattaattatggaagggcgtgatccgaatcaacagcttgctgtcacccgagtagctactggtactgatgtcgattatggcgcattaacacatctattagttaagcaactttctcaacaagataattttgagttgcactataaacatgatgttattgatatcaaaagaaatgagactggcggttggaatatcgaagttaaagatctcaccacccatgataaatacctaattacagctaaatatgtatttgttggtgccggtggacgcgctatcgatttactccaaaaatcaggtattccagaaggtaaaggctacggtggtttccctgttagtggtatttggctgcgttgtgatgaagataaaatcagctctcgccatcatgccaaagtttatggaaaagcagatgtaggctcaccaccgatgtctgtcccccatcttgatactcgtattattgcaggtaaacgctccctactctttggcccttatgctggtttttcaagtaaatttttaaaacacggctcctatttagatttatttgagtcaattcgccccagcaatattgaacctatgctagatgtcgcgaaagataactggtcattaactgaatatttaattggtcaagtattacaaacgtcagcacatcaatttgaaatgcttaaacagttctatcctcaggctcaacatgaggattggcaagaagctgttgcaggtcaacgagtgcagattattaaacccgcagctaaacatcatggcgtattagagtttggtactgagctaattagtagcgcagataaatcattttcagtgttattgggggcatcacctggcgcttctacagcagcatttattgccatcaatatcattaaatcttgctttaaacagcaacttgaaaatgagggttgggaagatcgtcttaaaacgattattccaacttatggtattgatctcaaaatagatgccgatgcttgtcgtaatattcgtgcatcaacggctaagatattaaaattagaaacaccttag

SEQ ID NO: 850 - DNA, 2262 bp, Proteus mirabilis
tttttactattgtgctatatttatataaaaagaatgagctttaaaaggaatattatgtctcgtaaaattaaaaatatacttatctccatttttttagtatttatggcctttgggctttatctcaataaaaatcaaatccaaccagagttaaagccaaatggttatagttattatcaaaaaggtgactataaagaggcgtttaattatttttcacaacatgcacaaagtgatccgcaagcggcatttagtttagcaatgatgtattgggatggcataggggttgataaaaatgccttagcttcacaaaaatggttaataaaatcagcaaatttacaaaataaaaatgcactttataatttaggatatttacgtaacaaaggattaatccaaagtcctactgatgatgctcaaggattaacgtcattaactaaagctgctgatttaggctcttcaatagcgaaagattttttacatgaccttaattttcctgtgatttattatgatcaaaaagaatatacgctactccctatttatggtgagcaatcttggtctgaaaaaaaaagaacacttgaagaattagaaaaattagcagaagaaggcaataaagaagctgtatatcaatatttagagaataaggattcagtaaaacaatcaaaaaagactaaaaatatgatacgtccttttattgaagaaaaagatcctaaaatgatgtatttaaaatataagttaataagtcaagatattaacttactttttgattcagcatatttgaactatcctgaggcaacatatcttctgtatcaaatctacaagggtgataagaaaaactatccccttcaagaaaattcttttttagctaatatatatttaaaaaaatctgctgatttagcgcatcatgatggactaattaaaataatagaggaattaaataatagtaatacattatcatcaaattattttagaaacttgcttgaaaaatatattgatacattattattgaaatatccaaactctccacaagccatgctagcgctcgctaatgtctatttaaaaccaaatagtagtttttataattttgaaaaagcacttaagctggtagagaaagcatataacatacagccatctcctgaaagcaaattattattggctaaattatattctaatagtgagggggttcatcagaatattagaaaagcagttagttttctgaaagaaaacataactaatgataaattgacaggtaaaagccaaagagaattagtaaaaatatattttgattttggtgcttctgattatcttaaaaaagaagagattgtgaatattttaagagagagtgtaattaaaaataaatcagctggtacatttaatcaaaactatagcttagctcatttttatgcagatcttcttttagaagaagatgtcgccaataatgaagaatatgctttttcattatatcaaaaagcacgaggttatgcctatgaagctacttttcatcaagcaattgcgactattaaatataaaaatataatagatgatcaagctcttattaatattgtttcagaattgaaagatgatttagaaagcagaaggttgaccgaaaaaaaacgacaggaaggatatagtattcttttccgatatggaatggattcacagtatgtaattgattttattgtggaacgttcgctatatgatgataaaataagaaaggctattcaaccattattaagtcaaaatacaaatcttgtatttcaatatacaataaagaatataatacatgagaactcagctaacaatattaatgaagataatttaaaaaaatattataaggatatatttaaattagctgaaataggttctattgatgcaattaaatttattattacaaaagagtataaagataagagtgctggtgatgaaatttatcaagactattcttttgataagttaactaatatcactattaaggaacgtttggcttggcgaaaaaaatgtgcagatttaggtaattttatttgcttaaaagaattagctataatttatcgagacggtaaagagggggttagaaagaacattgcgaaagcatctgaatatgaacgacgtattagcatcaattcgtctcactttgagctggaatcagaaaaatatgaaatagatagaagatggaaggaaaaaagagataatacacttgattatttactaaaccaaaaagagagtagtaaacaacaactagaattagcaagattttatagtattgaagtatag

SEQ ID NO: 851 - DNA, 951 bp, Proteus mirabilis
ggtaggctatttatacagaataagattattattatgacacataatcacattgatgatattgagttgaatatggctgagaaaacacaatctgacaaattcaaagcggccaagaaaagcacgttggtcagtgtttttgttaatatctttttatccatatttcaaatcacaattggtttcttctcacattcccaaggcttaattgctgatggtattcattcactgtctgatttaattgctgacttcgtggtgttaattgcgaataaaggcagtcaaaagcaacccgatgccgatcatccttatggacattttcgctatgagaatgccgcttcattagtgttagggacgattttattgattgttggtttgggaatgatattttctgctatccataaaatgttagatccttcaatcattcctgatgttcatagcatcgcgctttatgtggctttattggcattagcggctaaagaagggttatttcgttatatgttagctgtagccaaaaaagtcgattctagcatgttagtggccaatgcttggcatgcgcgctcagatgccgcctcttctttagtggttgcaatagggatcattggtagccttgctggatttaaattctttgacccactagcagcacttattgtcgggctatttgttggccgtatgggatggcgttttacctatcaagctttgcaagatctcatggatagaggtgctgatgaagaaacacttgaacagatcaccaatacattaatcaccacaccaggagtacaaggggtacatgatttaaaaacccgtcgtgcaggtgattatttattagttgatgtccatttagaaattaaaggcgaattaacggtcaatcaaagtcatgatattgtggtcaatgcccatgatagagtacttaaacagcatgcacagattttaagtgtgatgatacacgtcgatcctgcttaa

SEQ ID NO: 852 - DNA, 837 bp, Proteus mirabilis
gcagaagtattaaccttagcgttcattacactgaaatatataggtcatcaacaggaaatattccgaatggataacttaacggaacatcgcaattcatctttggcaaattggcttccagatttttttaaacaatggcctaaaaatatcgattggtctagagaaaaaaagcacaccaaaattgatatcaatacagcagaattaactcagtttctcaaccaactgtctgctccccttaaattagtacagcatcgtgctttatcgtttgatccatgggaagtagcaggccttgaacgtaaagaagttcgcaatacagccatccttgcttggcttcttgatcctaaggggactcatggttttggtagattaccattgcaaacactgttacagataatacggcacaacaaaaatgatattccaaaagattatcatcactattgtcgagtgcaagttgaaaccaatccaactggcgattgcaccaatcgtgttgatatagaaatcgatgctgataattttcttctatttattgaagtaaaaattgatgctaatgaacagccagaacaaatagcccgatactgtaaggatgccaaacagcgttccatgtcacggccatgggctgttgtctttttaacaccacaaggaaaagaatcacagacccgtggtaaagactttaaatctgaatatgtgccatgtttatcatggcgccaactcgccagtagtttggaagaccccttgcaatcgcactataacgaattcatttctgctgataactactctccatcacgccaaatagcagcacatgccgtattttgctttcttaatcgaattcgtcaattttaa

SEQ ID NO: 853 - DNA, 624 bp, Proteus mirabilis
ccaaagtctttggctaaaaatcaaacggctcaaaaggagtgttatatgcgctatatcattatctttttgagcctcattttatatggatttaatcttatggcttattcagaacaaacgctggtatttatccgtcatggtgaaaagcctaataatgatagcgggcaattaagttgtcagggattaaatcgtgcattagcgttacctaatcgattgataacacaatttggtcagcctgatgcgttatttgcagcagcaccaaaacaaaataaacttggaaattcattacgctctcttcaaactttaacacctcttgcggtgaaaacatcactgccaatccatttaaattaccatgccaaagagatagacccattacgtaataaactgctgagcgaagaatatcagaattcagtcatttttattgcttgggagcatgataatttagttaaagtagtaagggatattatggcgcaatttggtggtgatccaaaagctattcctaaatgggaaagtggtgattttgatagtatctatatattaaaaataatcaaagaagcagataagaaaaaagtgctctttgagcaacagcatcaacagctaaatgatgtgcctaaacagtgtccttag

SEQ ID NO: 854 - DNA, 1074 bp, Proteus mirabilis
ctaatggcattaaatgaaaaccgtttttttaagcctgaacagatgaccacacaagccgcttttgatggtttgcctgctcaagtcgtgattttgacaaaccgttttggtatgtctatctccattatggatattggtgcaacatggttaagttgtattgtccctgtgaatggctatcgtcgcgatgtgcttttaggatctgcagatatgaaagcccatcaacagcaaacggcctattttggcgcaacggtagggcgttttgctaatcgtattgcaggggctaaattcaccatcgccggaactgagtatcgccttgttgctaatgaaggcaacaatacgctacatggtggtaaacaaaattttagccatcgtcgctggactattgtggcgcaatccacacagtcggtcactttaagcttgctatccgcagatggcgaacaaggatttcccggtaccgtcgaagccagtgtgacatatacattaacggatgataatgaagttcatatcaattatcaggctattagtgataaaacgacagcgctgagtttaactaatcatgcctattttaatttagctggggagcatactcagcgaacggctcttgaacatgatttagttatccacgcttctcactacttaaaaaatggcgcgggtaatattcctacaggggaaattgtcgatgtgactgggacggggttcgattttcgccaattaaaacgtatcggcatcgattttatgcgagatgaatgtcaaaaagccgctaatggctatgatcatgcgtttattttagacaaacaaaaaatagcagataaagcatcgattgccacagttattgcccctgaaggtgagcttaaaatggatgtttttactaccatgccttctatacagttttatacaggaaattttttggcacagagtaaaggaaaaactcgtcgttatggtaattattcggggctggctttagagacacaatattttcctgatgggccgaatcatcctgaatggggtgagaaccaaggtattttagctgcaaatactccgtggcatagccaaacaatatataaattttatcagtaa

SEQ ID NO: 855 - DNA, 246 bp, Proteus mirabilis
agatcgcaatttctttcattaggaggttatatgttctcagaaagacaatcactggtttctcagttaaaaaatacccatcctcgtttccaagctctctatgataaacaccatcgacttgatcaagaaattgctaaattagaaggacctaatggcgcaggctacaatgatgaagttgcaaaactaaaaaaagaaaaactctatctaaaagatgaaatgcaaaaaatacttcaacaagctgagaaataa

SEQ ID NO: 856 - DNA, 258 bp, Proteus mirabilis
tatgcaaaattatcgcattgctatcgtaatagttcctcggaagaatatatggaaaaaaaattagttaacatagaacatgaagttgcggcattaaaagtgattttaaaatcactattacttacattaacaaataaacaaaaggaatctgttatatatgatataaacaaaaccattagaaatgcttatgctgaacatccacaataccaagacataatagaaaaaaccgaacaatacataaaaaagatactccaaaaatag

SEQ ID NO: 857 - DNA, 585 bp, Proteus mirabilis
cagttattttcaaatatgaacctgatcagactattaaagagcaatttgcaactgttcagtctgttcttgaaaaaaaacaatcccgttatcagtaaaattgattttgattgtggtctgttagaacaggttctcgatccagataatgtactcagttggggatactggattaaacatcattgtcactgcgtttatggcgaggacttaagccatcactttcaagctttcaaaccttcaaaagctattgcagtggccgtgaatggtgactttatggaggttttggacaaactagtcattcaaataaaagcatcttctaatgaaaataaaaagttacagcttcggcgctcggctgcacgaaagcttatcagagcaaccaacatccttcgtagtgaacaagataatgactggccggactctctccatgagtaccgcgccaaatttaattcacggtatcctgcattagcggaagatatggattacctattagaaattagtattaaacctcgagagagcatagcagactttgaaaaacgggctatggcatttgcccgctggcttagctgcgaatttaataaccaaaaagcctaa

SEQ ID NO: 858 - DNA, 441 bp, Proteus mirabilis
aaacgattttcaaaaacttcttatattactttaaggtcagataaaacggtatctggtatgagcaaacattctaacgattttatttatatgcaggataatccctgtatgcattgtggtgcatgttgcgcctattttagagtctctttctattgggctgaaatgaaaagtggtggtggtgttgttcctgacgaatttaccgaacccttaaccccttttctatcatgtatgaaaggaactaatgagaaacaaccacgctgtgaaaaattgattggtgaagttggtgaatgcgtgagttgtgcaatttatgaacagagaccatccccttgccgtgagtttgaacaatcttgggctaatggcgtaaaaaatgaagcttgcgatcgggcaagagccgcttttgggcttcctcctcttcctaatatttctctaccgcattctgcgtag

SEQ ID NO: 859 - DNA, 636 bp, Proteus mirabilis
gcttcgttttcaacaaattcttcttttgctgctggtgcagaagcaggcgcttttgctggagcagaaggtgctgctgatgtagatgctgcaggcgctgctggcgcttgtgctgctggtgcggcaccggcaacttcaaaggtcatgatcagtgagcctgttttcactttatcaccgacagcaattttgatctcttttactacaccggcaaaaggtgctggaacttccatagaagctttatcaccttcaaccgtgatcagagattgctcttcagcaatagtatcacccactttcaccatcacttcggtgacttcaacttcatcaccaccgatatctggtacattaacatctttaattgcagaggctgctggtgctgatgctgcaggagccggagctgatgcagaaggtgctggcgcgctaccagctacttcaaataccatgataagagagcctgtgctcactttatcaccgacagcaattttgatctcttttactacgccagcaaaaggtgctgggacttccattgaagccttgtcaccttcaaccgtgatcagagattgctcttctgaaatggtatcacctacattgaccatcacctcggtgacttcaacttcatcaccaccgatatctggtacatga

SEQ ID NO: 860 - DNA, 576 bp, Proteus mirabilis
aaaaagttttctggtacaatagtgacctttattagcaaaaatatcctaaaaatctttatgaaaattggtctattttacggttccagcacctgttataccgaaatggcggcagagaaaattcgtgacattctcggtgaagagtttattgatcttcataatgttcaagagtgcgatattactctgatgcaagagtatgacattcttattttaggtattccaacctgggactttggtgagatccaagaagattggctcgcaatttgggaaacgctaccaacattagatctcaaagataaactcgttgctatgtatggaatgggtgatcaaattgattatggtgaatggtttttagatgcattaggtatgctctaccaccatttactgccaagtggtgttaaatttatcggtttttggcctattgaagggtatgaatttaccagtcctaaaccacttactgatgatggtaaacattttgtcgggctcgcattagatgaggtgaatcaatttgaagaaagtgatgaacgtttatcacagtggtgtatgcaaattttacgagaaatagaagaaaacttgtaa

SEQ ID NO: 861 - DNA, 207 bp, Proteus mirabilis
tgttctgtttcactaccctcgtctccacaatcaaaacggttaatcatgcgctgttttctcgaagccagacattggcactcctttcatctagaaaagatgaaagcaatagtgatgaaaacagtgggtggcgtccctaagttaggggtgcgtgaatatagctcgttactaaaaataaataaaattataaaatctaatgctagcgagtaa

SEQ ID NO: 862 - DNA, 1473 bp, Proteus mirabilis
tttactgaattaaccccccctagatgggagaaattgatggcacaaccgtttattcatacctctgagctttgctggtcatctcaagaattggatttaatggctcaagcgatcgagtcttgctttttgcaataccaaattagaggtgaggttgtcggttatgatgaaggcgcaacatttaccctctttagaatcgaattgggtagagggataaaagtctctcaagtgatagcgttagtgccagaattgtgtcgttccctgagcgtcgttgatataaaagttattgattttattgcgggtacaccttatatcggattgcgcgtgactaacacatatcgtcgagcggtgccttttattgaatgctttaatcaatggaacgaaaacaatgggttatcttccctttctgtcatgttaggagaagatattataggagaaccaataggctgggatttggctcaaatgccacatttacttattacaggtgtaacgcgctcaggtaagtcaatgttaatgcattccttggtaatgagcattttatacagaaacccaccggataaagttcgctttgtgatgtttgatacaagccagcttgaactcagtttatacaacgatataccccacttattgtttcctgttgcctctgattctattgaatcaataaagccattatcgtttttagtctctgaattgcaacgccgtcaaaaattatttagtgcgttaaatcagcgcaatttgagtggttacaataaggtaatatcaaatgcaaaagagttaggtaagcctatacctgatccttttgggcgctctaataaaaattatagtgagcatccttatttagacagtgagcctgaaattgttgtttgtgttgatgattacgttcaattcattggcgagtataaacaaataggggaaatgttagttctattgagccagcaaggtcatgcggttggtattcatctaatactaacgactcgtagccctttatccaccggtatcggttcacagcttcgaattaatattcctacgcgtattgctctttctgtgtcgtctagggctgattctaatttaatccttggacagtatggcgctgagtcactatttggtttgggtgacatgttatttgtatcaccgagtttctctggacctataagaattcaaggtacttatgtgagtgattcagatattagggatgcagtcgattattgtaaacgatggggaagcgtgagttatcttaatctttatgatgatgtccagaatacaaatatgtcagctgaagagcttgactcattatttgctcaagtagttgaatttacggtagaaaaacagtgggtttctatttcaggtattcatagacaatttcgaatcggttataacagagcagcaaggattatagagcagttagaattacagggtatcgttagtgaacaaaattgtaatggcaatcgagaagtattagctccacggtttgatagctag

SEQ ID NO: 863 - DNA, 2895 bp, Proteus mirabilis
attcaggaattacccgcaatgacacaaactttaactcaattagaatatcgtgatgaatttattcgtcgccatattggctcatcgccagaacagattaaagagatgcttgatgttgttggcatctcctcattaaatgaattaacacaaaagattgttcccgataatatccaattagcaacgccgcctaatgtcggagggggggctactgaacaagaggcattagcagaactaaaagcgatagcccgtaaaaataaacgttttacctcttatatcggtatgggatatgcgccttctgtattgcctcctgttattttacgtaatttgctagaaaatccaggttggtataccgcttatactccttatcagccagaagtttctcaagggcgtcttgaatcattacttaactttcaacaagtaaccattgattataccggcatggatttagcctctgcttcgctattagatgaagctactgctgccgctgaagctatggcaatggcaaaacgtgttagtaaactaaaaaatgcggagcgtttttttgtcgctgatgatattcatccccaaacactagacgtagtaaaaacccgagctaacacctttggttttgaagtgattgtcgataaagctgaaaaagtgttagagctagaaggtgtctttggagtgctattacagcaagtcggcacaaccggtgaaattcatgattatagtcagctcattagtgaactaaaaacgcgaaaaattattaccagtgtagcggctgatctaatggcactggtgttattaacggctccagggcagcaaggagcggatattgtattaggctcagcccaacgctttggagtgccaatgggatatggtggtccacatgctgctttctttgcctgtcgagatgaatataaacgagccatgccaggacgtattatcggtgtctcgcgtgatgctgcaggtaacagagcgttacgtatggcaatgcaaactcgtgaacagcatattcgccgtgaaaaagctaactcgaatatttgtacttcacaggtattactggccaatattgctgccatgtatgcggtatatcatgggcctgaaggtctaaaaaatattgctcagcgtattcatcgcttaacggatattttagccgcgggtttaattcaaaatggcatgacattacgccatcagacatggtttgatactttaaccgttgaaacagcggataaagcgggtgtattacaacgtgctaaagatgctgaaattaacttacgaaccgatattgttggcgcagtaggtgtcactttaagtgaagtgacgactcgcgaagatgttgtcagattgattgagattatcagtggtaaagctttctctgatgacattgatacattagatgcattggtagcttcttcatcgacctcaattccaacggcaatgttgcgtaaagatgcggtgttaacccatgaaaacttccatctttatcacagtgaaactgaaatgatgcgctatatgcatcgtttagaaaataaagatttagcgcttaaccaagcaatgatcccgttaggctcatgtactatgaagcttaatgctgcggctgaaatgctgccgatcacatggcctgaatttaccgaaatgcacccattctgcccaccttatcaagcgcaaggctaccagataatgattgagcagctatctaattggttggctgccataacgggttatgatgcgatgtgtatgcaacctaactcaggggcgcaaggggagtatgctggcttgttagctattcgtcgttaccatcaaagccgaggagaaggaaatcgccatatctgtttaattccaagctcagcccatggtacaaaccctgcatcagcccatatggcgggtatgacggtggttgtcgtggggtgtgatgaaaatggtaatatcgacattgcagacttaaaagcgaaagcagagaagcaccaagctgagctttcttgtgtgatggtgacttatccttcaacccacggtgtttatgaagagggtatacgtgaagtttgtgagatcattcatcaatatggcggacaggtttatcttgatggcgccaatatgaatgcgcaagtggggatcacgacgccaggctttatcggctctgatgtatcacacttaaacttacataaaactttctgtatcccccatggcggtggtggcccaggtatgggacctattggcgtaaaagcacatttagcgccatttgtacctggacatagtgtcgttgaaatggacggtgttacgacccaaggtgccgtgtcagcagcacaatttggtagtgcctcaatattacctattagctggatgtacatccgtatgatgggctcagaagggcttaaacaagcgagccaagtagcgattttaaatgctaactatattgctcaacgcttaaaagatgactatgacatcctctattctggggcggaaggttatgttgcccatgaatgtattattgatattcgtccactcaaagctaactatggtatcagtgaaatggatgtggcgaagcgtctaattgattacggcttccatgcgccaaccatgtcattccctgttgcggggacattaatgattgagccaacagaatctgaaagcaaagttgaaattgaccgctttattgatgcgttactctcgattcgtgctgaaattgcacaagtcgatgacggggtatggccgattgatgataatccgctagtgaatgcaccacatacacagtatgaattagtgcaagaatggtcacatagctatagccgtgaatgtgcggtattcccaagtgaagcaacgaaacgcaataaatattggccggcagtaaaacgccttgatgatgtttatggtgatcgtcatttgcattgttcttgtgcgccaataagtgattatgaataa

SEQ ID NO: 864 - DNA, 189 bp, Proteus mirabilis
gccaatttctcgacatcccaccaaacgtacccatatggcagtgcacccaatgggaaaacctgcggtgacacattatcgtgttatggaacatttccgtgcccatacccgcttacgtttgcgtctagaaaccggtcgaactcaccaaattcgtgtccatatggctcatatccatcatccattaattggtga

SEQ ID NO: 865 - DNA, 390 bp, Proteus mirabilis
cgattaatctctcttatgcttaacattgcaatagctgtatttatcggcggtggtttaggtagcgtactacgctggctaattagctaccgcctcaattctctttttccccattttgcaacggggaccttggtcgctaactgtattggtgcctttattatcgcctttggcattgcttggtttagtaaggctcccaatattgatcctatttggaaaatcatgcttaccacaggtttttgtggtggcttaaccaccttttctactttttccgttgaggtggtcgccttatttaatgaaggacgaataggctgggcattaggcaccatgggggcaaacttagcgggctcgtttctgatgacggcattcgcattctggctactccgtgaaatgtag

SEQ ID NO: 866 - DNA, 801 bp, Proteus mirabilis
tataaccgatttcagggagcttcacggagagactcccaaacctattcagaggataatcaatacgtgatgagacgcatgaaatacctagtggcagcggccactgtaagcctgttactttctggctgttctagttcagacaaagacgcaactgctgatatgtctccttctgagctttatgcaacaagccaagaaaaattgctagatggcaattatggagcggctatcaaacaactggagtctctcgataatcgctatccttttggtccttactcacaacaagttcagcttgatctgatttatgcttattataaatcagctgagttaccaatggcgatttccgctattgaccgctttatgcgattaaacccaacccatccaaatattgactatgttctatatatgcgtgggttaacagctcaggcattagatgatagtgcattacaaggattctttggtattgatcgctcagaccgtgatcctcagcatgcaagagtggctttcaaagactttagccagttagttcgctactatcctgatagcctctacacagcagatgccacaaagcgtcttgtttttcttaaaaaccgtttagcgaaatatgaactctctgttgcgaaattctataccaaacgaggggcttatgtcgcggttattaatcgagttgaacaaatgatgcgtgattatccagataccgaagctacacgtgaagcgcttgtgtatatggaaaatgcctacaaaaaactaggcttaactcaagaagcagataaagttgcctcactgattgcagccaaccctgcttaa

SEQ ID NO: 867 - DNA, 372 bp, Proteus mirabilis
ggtacgcctttatcctcgacaacagccgttgctggcctgttcgtttgctctgtcggattctggatgtgcatccgagtggattttatttctggcttcagcaactacattcacaacgttccgtcaccacatcagataaatgatgcagtagtggtgttcccagctgaaagcaatattccaccggtttacatatatgcgggttatcccggtaagatatatctggatgaaaaagataccagggatgaacaggataaagaatttaatcaggtcaaggatgcggtgaagtttaccgctgctttttacaaagaaacattcaatgtatacggtgagaaagcagagcaatttgtatgcacttttttaattagaatgcaataa

SEQ ID NO: 868 - DNA, 753 bp, Proteus mirabilis
gccattagattttggagggtttcccgctgcggggttaacgagatgatcacaaaaaaattaagagaatcgatatttgaacatgtaaaagccgaatatcccaaagaagcttgcggagttatctgtcagaaaagtcgagttaaaaaatactttccttgtagcaatctttcagataacccaacagagcattttgagctttctccagaagattacgctcttgctgaggactggggtgagccaatagcaattgtgcacagccattgtggtgatggtgtaacgactcaacctagcgaaatagataaattacagtgtgatgcaactggattgccttgggtgatcgcatcatgtccagagggtgatattcgaattatttaccctcgaggtgagcgtgaattagaaggacgtccttttgtgctgggttatgctgattgctggtcgttaattatggattactaccaccaaaaacacggtattgagttacataactacagcgttgatcggcattggtgggaagaaggcgaaaacctgtatatggataactacgagaaagcgggttttgttgacgtcactggcgagccgaaagagggcgatatggtgattatgcaagtgcaagccgatgtgcctaatcacgctggtgtgattatgaatggtatgctacttcatcacttatatggacaactgagcagactggttccttacagcgattactggcgggatcggacggtaaaaatagtgcggaggaaagagtttgtatga

SEQ ID NO: 869 - DNA, 1050 bp, Proteus mirabilis
ggaagtttatcgatggccagcacaaatcaaccagcacatactgaagtaatcgatcgttggctggaacaagctggctcatcggtaacagagtataatttttatcaactcgttgaattgttaaataaaataattcatcaagatgtcaactcgatggaggatgacagcggtattcttcgctttaaatcttattcaaatattgcatttccgacgcgagatgtcatttccattgaaaaaaataatgtcgaacaatatgaattagaagtcgcttttttaggcttacaaggaagtcagtcccccctaccaggctattatctggatgagtttgcttgggaagatgcacaacagatagaaggtatctccgcttttctcgatatcttcaatcatcgtctgatagcgttactttatcggatctggcgcaaatatcgttactacatttgctttgaaaatgaaggtcaggattcattttcacaatatatgttttctctcgttggattaggtaatggagctaatcgcggtcggatcaaaatcaaccatagcaaaatgctcgcttatgctggtcttttggcgagtccaagtcgctcttctgatgtgattagtagtcttatatctcactgtttcgacttagaaaatgtaaaagtaattggttgggagacacgccgtgttcctattcctgaatcacaacaaaacaagttaggtacgatttctcatcaatccggacaaaaatctcgcccacgaatgttattaggggaaaattttagtctgggctcacacatatatgactgcaatggaaaatgcaccatcgaaatcagtgaattaagtttagaacgctatatgcgttttttacctaacggcagtgatttcgcaccattagttgcctttgtttcttacatttttcatgagcaattagcttgggatttacgtcttagcattgctgaaaagcaagccgaagggttccgtttgggtcaccaacaacacaaccaattaggctggcaaagctttttaggtcaacccgcaaagaaaccggatgtcaccattacggtattggaataa

SEQ ID NO: 870 - DNA, 546 bp, Proteus mirabilis
aagaggttatctcactttatggcaatcataggaatattcttcggcagtgataccggcaacactgaaaatattgccaaaatgcttcaagaaagattaggcgcggataatgccgaagttcatgatatcgcaaaatccagtcaagaagacatcgaagcatttgatattctattactaggtattcctacctggtattatggtgaagcacaatgcgattgggatgactttttcccaacattagaagatattgatttcaacggtaaacttgttgctctatttggttgtggtgaccaagaagactatgcagaatacttctgtgacgcaatgggaactattcgtgatatcattgaacctcgtggcgcagtcattgtgggtcattggcctactgaaggttatcattttgaagcatctaaaggtcttgctgatgataatcactttatcggccttgcgattgatgaagatcgccaaccagaattaactgaagagcgtgttgacgcttgggttgctcagatcaaagaagagatgagccttgacgaaattctgggataa

SEQ ID NO: 871 - DNA, 396 bp, Proteus mirabilis
gctcaactatctaacgatcaagatatagtaataaggcgtggatattatatgaaactaaagcgtaatagcttctatctgatagttttactttcactcgtcacgttaaatggttgtcaatcctttcatgttgccaatgataattggcaaggaaaagataaagcacagcattttttattttctatggtagcctccgcaggagctaatgcttacgcagatcatcagaactattcttatcgagaaggattagttattggcttatctttttcaataagtttaggcgtcgctaaagagctttatgatagtcgaccacaaggtacaggatggagctggcatgattttgcttatgatgtggcaggagccgcggctggcagtttactctatcagcaattgaaataa

SEQ ID NO: 872 - DNA, 300 bp, Proteus mirabilis
acagcgatatcctattttaatactaaccaatttactgctttatgtggtacagcacttgtttcaatggcatatctagatatactttttagtaacattcatctgcacataaatcttatgaaaaaattacttcttgttgttatcgcactactggcttttggctcccttgggggcgtttttcttgccggactaaatatttatacgcgctcaaccacaccggtagacacagagcaaactcaacctaatcgctcaccagcacagcaatttccagctctaccagatagctcaccatcgacgaaataa

SEQ ID NO: 873 - DNA, 207 bp, Proteus mirabilis
gatttttcatcaataaggttgttttttggatcttttttcgacaaaatgattaaccagcgagcaaacgaacacttttctcgaaaattaatgcaaaaagcagttgacggatttgtctgtaatacgcataatgcgccccgcaacgccgacgaaggttatgcaaaaaaagatggctatgtagctcagctggttagagcacaacactcataa

SEQ ID NO: 874 - DNA, 783 bp, Proteus mirabilis
ttattctcatcgttttatcatttgaaacagttaatgactattcaaaaaaaacgcatgagtattcaattaaaaaatataaattgtttctacggttcgcaccaagcactctatgatattaatctagaatgttctgctggtgaaacaatggttctgttaggaccaagtggtgcgggtaagagctctctaatgcgggttctaaacttattagaaatgcctcgttctggtgaattagacattgctggtctacattttgattttggccagcaaccgaatgcgaaagcgattcgtacattacgccaaaatgttggcatggtttttcagcaatataatttatggccacacttaacggttcttgataatttaattgaagcaccttgtcgtgtattaggcttggcaaaaccgcaagctaaagaaaaagcgatgaaattacttgagcgtttacgtttaagtgattatgcacaacgttttccactgcatttatccggtggacaacagcaacgtgttgccattgcaagagcattaatgatggagcctcaggtactgttatttgatgaaccaacggcagcacttgatccagaaattacggctcaagttgttgatatcataaaagagctttctgaaactgggatcacacaagttattgtgacccatgaagttgaaattgcgcgtaaagccgcaagcaaagttgtatatatggaaaacggccgtattatagagcaaggtgataatcatcatttcactgcccctcaaacggaagcttttgctaattacttgtcacactaa

SEQ ID NO: 875 - DNA, 870 bp, Proteus mirabilis
cgtgtaacatcagcatcattgcatctttatactatcaaggggcttattatgtcgtaccgcgttattgcactggatcttgatggcacattgcttgatgaccaaaaacgtatcctaccgggatctttaactgctcttaatcttgccagaaaagcgggcgttaaagtactcattgtaacaggtcgtcaccatgttgctattcatccattctatcaagcgctagatcttgatacacccgctatctgttgtaatggtacttatctttacgactacctcggtaaaaaagtgcttgaatctgatcctttaacccccgaagaaacacgcgcggtactcgacttggttaaacaaaccgatgtgcatcatttagtctatgcagatgatgcaatgatgtatgatcaacttaccgctgccgtacaacgtacacttaattgggctgatactcttcctctggcacaacgccctaatttagtcaaagtagatgatttttaccaagcaatgcatcatgttgattctatctggaaaatagcgaccacaacccccaatcacgatgagttacgtgctttaatcgaacaagtagaacaacaagtcggcttagagtgtgaatggtcttgggtcgatcaagttgatatcgccaagaaaggtaatagcaaaggtcgccgtttacagcgttgggttgaagctaatggcatgaagatgagtgatgttatggcgtttggtgataacttcaatgacttaagtatgttagagcatgttggtttaggtgttgctatgggcaacgcatcagatgaggtcaaagcacgcgctaaactggtgactaaaaataataatcagcccggtattgcagagactattcataaatatattttgtcttaa

SEQ ID NO: 876 - DNA, 1785 bp, Proteus mirabilis
ccgcccgcatcaaaacttcataggatgcccaatcagtaccgaaaattagccatcatcgccaaaaaagctatacaaggtagaagaatgacatttcaaattgcagacacactctattataacggcctaatctataccgctgataatagtaacaatttcgtcgaagctatcgctgtttcccaaggcattattattgcaacaggcacaaaatcgaatttacttgcttactgtaatgaaaaaacacagcatatcgatttacagaagaaaatggtgatgcccggcattattgatgctcatatgcatccattttgggggggagccacattagcaggttgtcaccttgattacctctccttaacaatcgatgaaattctatcgcgtatccaacgctatcttgatgctgatcccaccgatagtgatacagcttggttgaaagtgtcagcatggtatcgtgaagggatgcaaccggaagggatacaaatgacgcgttatcaccttgatagcttaaatacgtctcgccctatcttacttttttctagtgattgtcatagcgtattagcaaattcccgcgcactagaattattaaatattacggctgaaacccccgatccccctgatggcaatattgaacgtgatggtgatagaacacctattggtattcttgaagatgcaccagctatgcaggctattgatagtctaccgcctttaacggcagagcaaaatctacaaatcgcacgccatgtacaaaagttgctcaatcaacaaggggtaacgactatcatggatgcacgtgttggtgagccacaattacgtgcctttaataccttgcgagaagcgggtgaattaacggttcgtgttgagaatgcggttgaaattacccctgatgatgtggctgatattgcagctattcctcatgctgtacaacaagcaataacacgattctctcactggcatcaaatcagccaaggcgcgcaacccagtgtcgctattcgccatattaagctttttcttgatggtgtattacaagcgccgattatgacagcacgtttacacgccccttatcgtattaatgtcggtacggatgaaacgcctcattggcaagattcagagcatgttggcgatctctatttttcacctgaaatcttgacgccattagtcactgagattagccgtgcaggttatcatcctcatattcataccgtcgctgaaggggctattagtgtcgcacttgacgccattagtgaaatgcgcaacgccttgccagaaaaagatattcgccccggccttgcgcataatgaattaatgtgtgaaaaagattatgcgcgctttgcccaattaaatacctacccttttctctcctttcaatgggctggcgtagagcaacataatattgataaagatcttgaaatgttaggcaaagcacgttgccaatatctagaaaccgccggtaaatttattgatgcgggagtgactgtcgcatttggcagtgattggccgattgatccattaaatgagtggtatgactttaaagttgccatgactcgacaaaaagatccctctcagccacgtttagataatgatcgcaatctcaccttaatcgaagtattacgagccgccaccatcaatgccgcttatgcactagatatggataaacagattggttcattagaagtaggaaaattcgccgattttattgtcttagatagaaacttgtttgaaatatcggcagaagatattgaaaatgtcagggtattgtgtacgataattgcggggaaacccacaatttag

SEQ ID NO: 877 - DNA, 1419 bp, Proteus mirabilis
tgcattaaatcaataacaacaatactgcatcacgacactggggaattaattatgactggtttaattattgccgcgctagttactgcgttggtagtttatttgctggctcgaggttataaacctcaacctgtgttattactcggaggcatgctgttattgctccttacagcttctctcgatctcaaccctttattaccggaaaataaatctacacaatttaagtattttgatattttccaaatttttaccgatattatgagctcgcgtttagcgggtttaggtttaaccttaatggcaattgctggtttctcacgttatatggaacacgtgggcgccagccgagctttatttgctatttttgaaaaaccattaaaaacgattaaatccccctacttattactggttatttcatttttagtcacacaaattttagttatttttattcctagccatgcaggtttaggaatgttactcatggtaacgatgtaccctattttaattcgctcaggtattagtcctctatctgctttagctgttatcggttgttgtcaatttattgatcatggacccggctctggaaatgttattatggcggctaaaacagcggatattgaacctgcagtctattttgttcaacaccaactccctatcactattcctattatcattgcggttgctattacccatttctttattcaacgttggtgggataaacgtgagggttttgttttcgacccaacagctattgataatgtaaaagaagaaggaagtcaggtgccattatcatatgccttattacccgtgatccctttaattctcattattggttttagtccgttatttcataattacattaaattagaagtgactaccgcaatgattattagtacggttattgcactagtctttgaatatgtgcgattgcgcgatgctaaagcggtaatgaacagttttatgttattctttgaaggcatgggaaaacagtttgttttagttgtatcgttgattgtatctggggaattttttgctaatggattactaaaaagtggcgcggtagataccttaattagttctgctcaagatgctggctttggtattgctgcgatgattattgtgatgagtgccatcttagcattagcagcctttttaatgggatcgggtaatgctgcattcttttcatttgccgcattaacacccaaaattgctgcgttcttaaaagtcgatgtcatcactttaattttacctatgcaaattatgaccagctttggtcgcacagtttcacctattacggcagctattgttgctattgcaggaattgccaatgtctcacctttccaaatagtgaaaagaaccgcaattccaatggctatcgccgctaccgttaacttagcgatgacattctggtttttatacacataa

SEQ ID NO: 878 - DNA, 1740 bp, Proteus mirabilis
tctgttgaatcgatagcattgatgcattatcactcatgtagctctacacgggataaaaagagaaccaaaatgaaatcagatattgaaatttcccatcaagcaccgcttttacccatccaagatattgctaaaaaaataaatgtagaccaagacgatattgaattttatggcaaatacaaagccaagtttagccagagtatttggtcaaaaatcacctcaaaaaaacagggtaaattggtgcttgtcacttccattaatcccacaccagcaggtgaaggtaaaaccaccgttacggtaggattaggacaagcccttaatcaattaggcaaaagtgccattattgcattacgcgaaccctccttaggcccttgttttggtctaaaaggaggagcggctggcggtggatattcacaagttgtaccgatggaagatctcaatcttcattttaccggtgattttcatgctatcacctctgcaaataatttattagcagcgatgttagataactcgctttatcaaggtaatccccttaacattaatcctaaaaagattatttttaagcgctgtatggatatgaatgatcgcgcactacgtcatttagtgattggattaggtggcgacaaagatggggtggttagagaagatagctttgttatcaccgttgctagcgaaattatgtctatcctttgtttagcaaaagatattaatgatttaaaacagcgcttagcacgtatcatcgttgcatataactatgaaggcgagcctgttagtgctgaagatctcaacgctgtcggcgctatggcaaccttacttaaagatgcccttaatcctaatttagtacaaacgttagaaaatacccccgcgattattcatggtggcccttttgccaacattgcccatggctgtaatagcctaagagcaactaaacttgctcttcaactggctgatatcactgtaacagaagcgggatttggcgctgatttaggtgcggaaaaattctttgatatcaaatgtcgcataggcgacttacaaccagactgtgcagttttagtcgttaccactaaggcattaaaatataatggtggcttaggcaaaacacagtgggatcacgaaaatctcaccgctttggcaacggggatcgaaaatctaggtaagcatattgaaaatctgaaaaaatatggtgttcctgttattgttacagtaaatgcttatgtgacagactctgctaaagagcatgaatttatcgcccaatattgccagcaaagaggatgtcgttttgccattagtcaagtatgggagaaaggtggcgcgggtggtattgaattagccaatcaggttattgatacactagaaaatgatgcaccacagtttcaattactctaccctgataatatgcctttaaagcaaaagatagagaccattgctcaaaaaatttatggtgcaaaaggggtgacttacaatgctaacgcccaagagatgctaacaaaaatcgaggatatgggctttggccatttccctatttgtatggcaaaaacgcaatattctctatcagatgatcccgcattacttggtcgcccgactgattttaccattaatatccgggaagtgtatgtcagtgctggtgcaggctttgttgttgcattaacgggcacaataaatacgatgccaggattacctaaaaaaccggcagcaatggcgatggacgttgatgatcatggggcaataaaaggactgttctaa

SEQ ID NO: 879 - DNA, 258 bp, Proteus mirabilis
gctttagaatcctcaagtttatcaataataaattgctgtaattctgagccttgcaaaagggtcacctttttctatttagttaactcaatcgagaaaataacaaagcgctattttaaaggaatttataccaataaatctattttactcgatgatttattccagttgtcgatagcaaaaacatctatcaagtatggttgctattcgacgcttgatttagaaaaattcatatatgcctatttattgcgccataataaataa

SEQ ID NO: 880 - DNA, 1125 bp, Proteus mirabilis
gacatgagatcagtgaatgagcggttaatggatgaattgattgctcactccctgttttctggtcgctattctacaggggtggctagacgcatgataaaggcacttaatgagtttgatgctgaattaactgcttcacttatagtgtctttagatgatacctccatcgatgttaatagtttcactgcaaggcgattggagtcgttgctgtccagcgttagaagtattaataagcgtgcagttgatagtgctttttcattgttaacagaagaaatgagagcgcatgcattatatgaggctggctactacccatcactgtttgatgctctactacctgatgttgttctacgcaaatatccactaatgagcattacagaggaaatgctattttcctcagtcatgtctcgcccatttcaagggaaattactttctgaatgggctgatggattagaatcagatcgcatgacacgcataaataacgctgttcggaatggttatttaaatggtgatagtgcggtagaaatcggacgtaaaatcagaggacatgcaaaccaaggttataaggatggcgtattgcaactaagccgagctaatgcgacgacaatagctaaaacggccattagccatttacaagcaacagcgcgagatcagtttgctgatgccaataaagacattcttgattgtaaacaatggttatctaccctcgataataaaacatctcacgattgcattattcgggataggttgagatacacgctggaaggtaagcctattggtcataaagttccttatctacaaggccccggaaaaatccacttcaattgccgctcaacagaaacgctggttaccaaatcgtggcgtgaattaggtatcgatttagatgagatggacgcaggaactcgtgcctcaatggacgggcaggtgccagcagataccaattttcttgattggatacaacggcaacctgaatggcgacagcgtcaagttttcggagaaacgcgattcagactaatgaaagagggcggtatgcatccttctgagttttataccgataagggagagtttatttcactagagcgacttagagagatagatgggcatgcatttagagaggctggatatagctaa

SEQ ID NO: 881 - DNA, 2481 bp, Proteus mirabilis
cctctgatgtcttgcaaatacaggagttttattatgaccctactcagtattgtgcttttcttagttctcatcggtatacttagttaccgaaaatacagccttgtagtaagcagtatcttacttattgcttatactttcgtgatgggtttagccaatatctggagctactggctattactgcccgttgcattgatattattaccattcactcttccttctattcgcaaagcatatatctcagcccctgcactaaaggctttccaaaaagtgatgccatctatgtctaagacagagcaagaggccattgatgcgggaacaacatggtgggaaggtgaattattccgtggagcaccagattggaaacaacttcacaattatcctaagccacaacttaccgctgaagaacaagcttttctggatggtccagttgaagaagtttgtcgcatgaccaatgatttccaaatcacacatgaactagctgatttacctcctgagatttggcaatatttaaaagaccatcgtttctttgcgatgattatcaaaaaagagtatggcggattagagttttctgcctatgcacaatctcgtgtactgcaaaagctcgcgggtgtttctggtattctcgccatcactgtaggtgtacctaattcattaggtccaggtgagttattgcaacattatggtactgatgagcagaaaaaacgttacttacctggtttagccaaaggtgatgaaattccatgctttgcattaaccagccctgaagcaggctctgatgctggcgctatccctgatagtggtgtggtttgtatgggagattggcaaggtgagcaagtccttggtattcgtctcacatggaataaacgctatattactttagcacctatagccacagtattaggactcgcttttaaacttcgcgatccagaccatctactgagtgataatgaaaatcccggtattacttgtgctttaattccaaccgacgtaaaaggggtagaaattggtcatcgccatttcccactcaatgttccttttatgaatggtcccactcgtggtaaagatgttttcgttcctatcgattttattatcggtggtccaaaaatggcaggccaaggttggagaatgctggtggaatgtctttcagtcggtcgtggtatcacactgccatctaactccactggaggcttaaaaagtgcagcaatggcaacaggtgcttactctcgaattcgtcgtcaatttaagcttcctatcgggaagatggaaggaattgaagagccattagcgcgccttgctggtaatgcttatctcttggacgcagcttcaaccttaattaccacaggtattatgttaggagaaaagcctgccgtactttctgctatcgtaaaatatcattgtacccatagagcgcaacgcgggattattgatgcaatggatattgttggtgggaaagggatttgtcttggcccttccaactttgtggctcgctcttatcaaggctcccccatcgccattacggtggaaggcgctaatattctcactcgtagcatgatcatttatggacaaggggctattcgttgccacccttatgttttagatgaaattgcagcggctagagataacaacttacacgactttgatcatgccttatttggtcacttaggccatgttgccagtaatacattacgtagcctttggttaggtatcactaatggtcgcttaagtaccgcgccaacaaaagatgaaactcgtcgttattaccaacaaattaaccggctcagtgccaacatggcgttactttctgatgttgccatgggggttttaggtggtagtttaaaacgtcgtgaacgtatttctgcaagacttggcgatattttaagtcatattttcctcgcctctgcggtgctaaaacgttatgaggatgaaggtcgtaataccgctgatttaccactggtacactggggtattaaagagtgtttataccaagcagaaaatgccattgatgagctattacgcaatttcccaaatcgttttgttgcaggagctctgcgcgccattattttccctctgggtaaagtgcagaaactgccttcagataagttagatagtaaagtggctcaaattatccaacaaccttctgaaacccgtgatcgtattggtaaaggacaattcctcacacccagtgagcacaatcctcatggtttaatggaagaagctctgctcgatattttagccgcagagccactgtttgaacgtatctgtcgactctatgaaaagaaatttagcttcactcaattagataaattagcggataaagccttagccgataaacgagtgactcccgaagaagctgatatcttacgcaaagcggagcaaagccgtttacgtagtattaatgtggatgaatttgactttgatgccttggcggtgccggcaaaaaagtcgtcaactgatacaataaaaacagataaagcagcctaa

SEQ ID NO: 882 - DNA, 183 bp, Proteus mirabilis
tctgctacttttccttgcccaattaaaggacgaatttgttgcaatatatctgacaataatgcgttagataacgttgtagtcacagctgattccctagacagacaagggcatcctgttggatgcccttgtgattatttgctaaaaatgtataactttttattagtcccaccaaacgtcaaatag

SEQ ID NO: 883 - DNA, 825 bp, Proteus mirabilis
aagcaaccgtcaactataccattgcctacgagtaaggtttattcgattgcttttgttttacggggcagaaaaactgccccattttcttctagaggtactatgttaaagttcattcttattttcttgactctatctgtatctatagtggctcaagccagtgtggttattatgggaactcgcgttgtttatcccgcaacgcaaaaaagtattaatgttcaattaaataatgacgatgaatcccccgcattaattcagtcttggttagataccggagatgcagctgcagcaccagattcaattcatgttccttttatcattactccccccatatttcgtatggagccgaaatcagggcaaaccatccggattgtctataccggtgaatcattaccacaagatagagagtctcttttctatttaaatgtcttagacattccggcaaaacctaaattggaagaaaattcggaaaactcagagggaaataacaattacttacaattagccgttcgtagtcgcattaagtttttctttcgccctgataatctcaacgtaacgcctgatgatgcttaccaaaaagtgacttggcatcaggaaggagcactacgcattaaagcgattaacccaacaccttattacatcacttacaacaaaatctcagtgggtcaggataaacagctaacgcctgttgaacaaagtgggatgatagctcctttttcttcaaaaatattttcacttaaagagaagccaatattaacaaataaagtcacttgggttgttgttaatgattatggtggataccaacaaggtgaatctactttggaataa

SEQ ID NO: 884 - DNA, 2325 bp, Proteus mirabilis
tccggtgagtcttttaaggaggaggtgcttatgcttaatcacgaattagagcttagtcttaacattgcattcgcgaaagcccgtgataacagacacgaatttatgactgtagagcacctgttgctggcgctattaagtaacaaatcggcgcgtgaagcattggaagcttgtaaagtcgatttagcagtcttacgcgaagagcttgaaatctttattcgtaaaacgacacctattttacccgagcatgtcgatagagaaacacagccaaccttgagtttccaacgtgtattacaacgtgctgtgttccatgtgcaatcttcaggtaaaaatgaagtttccggtgccaatgtgctagtggcgatttttagtgagcaagagtctcacgccgcttatctactacgtaaacatgatgttagccgtcttgatgtggttaattttatctctcatggcattttaaaagatgatcaacaaaacagtgatgatcagtctgatatgggcgatataaatgcacaatctcaacaagagatgccacaaggcgatgatcgcatggataattttaccactaacttaaaccagttggcgcgtcagggtaaaattgatccacttatcggtcgtcaagcggaattagaaagaacgatacaagtcttatgtcgtcgacgtaaaaataacccattactggtcggtgaatcgggtgtcggtaaaacggcaattgcagaagggctcgcatggcgtattgaacaaaatgatgtgcctgatgtgatgaaaggctgtacgctctattcccttgatattggatctttattagcaggaaccaaatatcgtggtgatttcgaaaaacgctttaaagcgttattgaaaacacttgaaaaagatgaaaaaagtatcttatttatcgatgaaattcataccatcattggtgctggcgccgcctctggtgggcaagttgatgccgctaacttaattaaaccactattatcaagtggtcgtattcgtgtgattggttcaaccacttatcaagaatttagtcagatctttgaaaaagatcgcgccttggctcgtcgtttccaaaaaattgatgtaattgagccttcggcagatgaaaccgtattaattattaagggattgcgtcagaagtatgaagcacatcacgatgtgcgttataccaataaggcaattcaggcagctgttgatttatcggttaaatacattactgatagacaccttcctgataaagccattgatgttattgatgaagccggtgcgaaaacccgtttaattgcaccaagtaaacgtaaaaagacgattaatgtctctgatattgaatcggtagtagcaaaaattgcccgtattccagaaaaaacggtttctagcagtgataagtcaatgctaaaaaatctggataaccaattaaaaatgttggtgttcggtcaagatcaagctattcatgccttggctgaatctatcaaaatgagccgagcaggtttagggcaagagaataagccggttggctctttcttattcgccggacctactggggtgggtaaaacagaagtaacggtccagttggcgaaagcgcttaatattaagctactgcgctttgatatgtctgaatatatggaacgacatacggtaagtcgtttaattggggcacctcctggttatgttggttttgatcaaggtggattactcacagatgcggtgattaaaaacccttattctgtagtgttacttgatgagattgaaaaagcacatcccgatgtgtttaacattctgctacaagtgatggataacggaacacttactgataataatggccgtaaagctgattttcgtaatgtgattttggtgatgacaaccaatgcgggtgttcatgaaacgcaacgtaaatcgatagggtttactgaacaagatcatagcactgatgccatggttgaaatcaaaaaagcgttttccccagagtttcgtaaccgtttagatggcattatttggtttaatgcgctatcagccgatattattgctatggtggttgataaatttattgtcgagttacaagctcaattggatgataaaggggtatcgctagaggtaagtcaagaagctcgccaatggttaagtgataaaggttacgataaagcaatgggagcaagacctatggctcgcgtaattcaagaaaatctgaaaaaaccattagccaatgaaattctgtttggctcgttagttaatggcggctcggtttctgtgaccttaaatgaccaagaaaataaattacagtaccaatttactagccaagaaaaattggctaaaaaagaagataccgttatttaa

SEQ ID NO: 885 - DNA, 1209 bp, Proteus mirabilis
tatcggttttttagattgacttcccttatattaggagacaaaggtatgtttgccttaacaaatgctgttatttatacaggttatgaccgtttagaagatcacgccattattattaacgggtcacgtattgagcaggtttgcccacaggatcaactaccaaaagatatagccactcgtgatatgcaaggtgcgattgtctcccccggttttattgatttacaagtcaatggctgtggcggtgtacaatttaatgacaccgcggaaaatgtcacagtaaaaacgctagagattatgcaaaaagccaatgaacgcttaggctgtactagctatttaccaacattaattacctgttctgatgaattgatgaaaataggcattgaagcaactcgcgcttatatgcaaaaacaccaaaataaagtgttgggattacatttagaaggcccttatatcaatatcattaaaaaagggacacatgatcctcaatttattcgtcaaccaagtgcacagatgattgactatttgtgtgataacgctgatgtcatcgctaaaattacactcgcaccagaaatggtcgatgaaaaatatgttcgtcaattaatcacagcaggtattgttgtttctgcaggccactcaaatgccacctatgaagaagcgcgtaaaggctttcgtaacggtatttcattgtcgactcacctttataatgcaatgccttatatttcaggtcgtggcccgggtcttgtaggggcaatttatgatacccctgaggtttacgcagggatcattgccgatggtttacatgttttatgggcaaatatccgtaacagtaagcgcttaaaaggtgaaaaactgttattagtgacagatgcgacagctcctgcggggcttgatccaaataaaaatgagatggatagcttcgtttttgctggaaaaacgatatattatcgcaatgggctgtgtgtggatgcggacggtacattaagtggttcatcactcacgatgattgacgctattaaaaatagtgtacttcatgttggtattccattagatgaaacattgcgtatggcaacactttaccctgcccgtgcgattggtgcagataacgaactcggtacaattgaagcaggtaaaatagcaaatattgcttcttttgataaggacttcaacctttgcacaacatttgtcaatggtattgaaataacagataactaa

SEQ ID NO: 886 - DNA, 297 bp, Proteus mirabilis
cttttaacttttaactttaatgataagtctattttaaaaaatagagtatatgcattgattggtaataatggtgtaggaaagacacaattggtatcaaaattaccttgtgatatcgccaatgataataaaaatttattctcaggtaaagttccactatttagtaagataatagccgtttcatacagtatatttgataaattttctattcctgaaaattcatctaaaataaattacatctattgtggattaagaaaaaaaataaaaacaaagaaagttatatatcagaagaagagttaa

SEQ ID NO: 887 - DNA, 219 bp, Proteus mirabilis
ccaccgtttccagtagttatccccctctatcgggcagatccccatacattactcacccgtccgccgctcgtcagcaagaaagcaagctttctcctgttaccgctcgacttgcatgtgttaggcctgccgccagcgttcaatctgagccatgatcaaactcttcaattaaaagtgtttgatgctcaaagaaatcgaaaacttagcttattcattatatga

SEQ ID NO: 888 - DNA, 1767 bp, Proteus mirabilis
agaggaactttgatcatgagagtactgcttccttttctcgcgttataccgtcgtcactggtttatgctgttactgggtattttgttggcaattttaacattattagccagtatcggccttttaacactttctggctggttcttagcgggcacgtcattagcgggttttgcgggcatttatagttttaactatatgttacccgccgctggggtacgaggtgcggcaatatttcgtactgcggggcgttattttgagcgtcttgtcagtcatgatgccacctttcgtgtactctcacacttgcgtgttttcacttttaagaaaattttaccgctctctcctggggggatcgcccgttttcgtcaaggtgaattacttaaccgtttagtagctgatgttgaaaccttagatcacctttatattcgggtgatctcaccgataattgccgcctttgtggttatcatgaccattatgtttgggcttgggcttattgatgctcgcttagcaaatacgctaggtggtattatgctcaccctgctggtggtattaccttttgtattttattatgccggaaagcccattggtcgtgatctcacagacctaagagggcaatatcgcaccgtactcaccagtatgttacaagggcaagctgaattaacaatttttggcgcccttccccgctttagacaaaatttagcgcaacttgaagcacgctggctgcgccgtcaagcacaacaagctaacttaactggtttatctcaatcgctaatgattttagcctcgggattaaccgccacactgattttatggttagctgccgatggtattgatgcccactttatgccagaagcactcatcgctctctttactttctgtgcattagcggcatttgaatcgctcggcccggtgactgtcgcatttcaacatttagggcaagtcatgacatcggctacgcgtattacacatttaattgagcaacaacccgatgtcaccttcccagcccaagggggagagataaaaccgagcgcctcattaacactacgggatgtctgctttacctatcctaatcaacccatgcctgtgatcaatcatgttgatctcaccattgaagcaggacaacatgtggcattactgggtaaaacgggttgtggtaaatcaacactcttacaattagtcaatcgcgcgttcgatccctctcagggcgtgatcacattaaatcatttatctcttgctgattatgatgaagcgacattacgttcaatgatgtctgttgtacctcaacgtgtgcatgtttttagccatactttaagagagaacttaattatggcaaaagaagatgcgacagatgaagagcttactcatgttctacgccaagttggtcttgaacaactggtcgaaaatgatgaaggtttaaatgcatggatgggtgatggtggaagacagctttctggaggcgaacaacgacgtttagggctggcaagagccatactccataatgcaccacttattttacttgatgagccaacagaaggtcttgatgcagatacagagcaacagatcctcgcgctattacagcaacattgccaaggcaaagcggtattaatgatcacccaccggctttctgggttagataaaatggataaaatttgtgtgatggatggcggtcacattgtcgaaaccggcacgcatcgtcagttattacaacagcaaggtcagtatgctaaatttcatcaaagacaagcattgttaatgccacatgatgaggcgtaa

SEQ ID NO: 889 - DNA, 1164 bp, Proteus mirabilis
cgcttctctcctgataaaacagtgtatgatcttttaaatcaacaaaaaatggtaaatgttatgagtagcagccaaacgctggttgttaaattagggacaagtgtactgactggtggttcacgacgtctggatcagtctcatattgtagagctggttcgccaatgtgcaaaacaacacgaaaaagggcaccggataattattgtcacgtcgggagcaatagcggcagggcgtgaatatttaaactaccccgatttgcccgcaacaatagcatctaaacaactgttagccgctgtggggcaaagtgctttaattcaggtatggaagcagctatttgctatttatggtattcatattgggcaaatgttattaactcgcgcggatatagaagatagagaacgttttttgaatgcgcgtgatacactgcatgcattattagataacaagattattcctgttatcaatgaaaacgatgccgttgctactgcagaaataaaagtaggggataacgacaatctttcggcattagctgccattttaggtggcgctgataaactcctgttacttactgatatcgaaggtctatatacggccgatcctcgtagcaatccggatgcgaagcttattcctgaagtttttgatatcaacgatgaattacgtcaaatggccggtgatagtgtctctggtttaggtactggaggtatggcaactaagttacaagcggccactgttgcagggcgtgctggtattgacgttgttattgccgccggtgttaagcctgatgttatcagtaaagttattgataatgaacctgtcggaacactctttcatggtttaaaaagcccccttgaaacgcgtaaacgatggatttttggtgctccagtcgcaggggttatcattgttgataatggggctgaaaaggcgattaaagagcaaggtagttctcttttacctaaaggtattaaagaaattaaaggtgacttttctcgagggtgtgttatccgcattcaaagtttgcaaggaaaagatcttgctcatggtgtcgcgcattataatagtgatgcgctacgcttaattgcggggcaccattcgcaagagattagtcaaattttaggctatgagtatggcagtgttgcggttcaccgtgatgatatgattgtgagctag

SEQ ID NO: 890 - DNA, 369 bp, Proteus mirabilis
gcaactaatccatcgagtagactatcaaccgctttactttgttgctgtgcagcggctttagcttccgctgctgctttggctttagcttctgcggctgccttcgcttttgcatcagcctctgctttcgctttagcatcggcttcagccttcgcttttgcctcagcttctgcttttgccttcgcttcttctgctttctgttttgctgctaattctgcttgtttcttcgcttctgcctctgctttggctttcgcatcagcttgctcttttaaaatacgatcgcgttcagctttagcttgtgcggcagcttcttcagcctgcttttgctcttctttcgctttagcagcggcggtggctgcttcacgacgttga

SEQ ID NO: 891 - DNA, 615 bp, Proteus mirabilis
aactgcctgtttaacttgaagaagggaaataaaatgcgattatgcgaccgtgatattattcagtggcttgatgaaggtaaattagtcattgaaccccgcccgcctgtcgagcgaattaacggcgcaacagcggatgttcgcttgggtaaccagtttcgtgttttccaaggacatactgcggcttacattgacctcagtggccccaaaaatgaagttaatgaggcccttgagcgggtgatgagtgatgaaattgtattaccagaaggcgaagcgttttatcttcatcccggagagcttgccttggcggttacattagagtctgtcacattaccggataatgtagtagggtggttagatggacgctcatctttagcgcgattgggattaatggtacacgtcacggctcaccgaattgatccgggctggcatggacacatcgtattagaattttttaattcaggtaaactgccattagcattaagaccgggtatggtgattggcgcattaagttttgaacctatgtcaggctctgcggataggccttacaatcgtcgccaagatgcgaaatataaaaatcaacaaggtgcggtaggaagtcggattagcgaagattaa

SEQ ID NO: 892 - DNA, 339 bp, Proteus mirabilis
agccaactgtttggaggatatatggcaactattacagttaaaaagtcacgcaagcctgagtttttacgtggagcatctgcaaatagacgtcacgccagacggaaagcagaagctattgcaaaaaagaatattgaattgaaattagaatcagtattccctcaagagaaaagacttacatcagtagaaaaaacactgtcattaagtcacataccagttactagaaatattgaacctaaattcaaaccatcggtagataactgttgcttacctaatgtagcagtattttcaggagttaaaacaaaacagccgagcagtgagttcggggtgacggcaagataa

SEQ ID NO: 893 - DNA, 639 bp, Proteus mirabilis
atatttatgttattaccgcaaaacatcatgattacaatggccttttttacctttttaaaagggtgtagcgattatttctctacctctgttttagcacgcctctcacctattcgttatcagcaattgtggcaagtctatttaattatctgtttttattggtcttttactatttctaattattcgttattaatattatttctattgtttagtttttacctcttaactctctcgtttttcgatgcagattatcttcagctacctgataacttaactttttggttacttttctttggaattacgcttaatttaacgccttatggcgtgatttcttcaacttgctctttttatggctgtttagtcgcaagtttgtttttttatagtatttattggctcggttattggatatatcaagaggctattttggggttgggtgatgtaaagctttttagtgccataggcgcttggtgtggaatagaactattaccttatatcctctttttcgctgcactattagggattgttatttatatgcttatttgggcttttactaatgtgaagataaagcagattgcctttggctcttgccttgcattttcagcgatagttgttttaagagtaaagacaataataatgtattga

SEQ ID NO: 894 - DNA, 291 bp, Proteus mirabilis
agaataatgttggataaaagttaccaactacttaacaagggcccaattagggctcttgttttaatcatggctctagcaatggcattttgtgttatgtgggatccgagtcgattcgcggctaatacaagctcattagcgatttggcaaggaatattactgatttgggctgtatgtgcaggggcagtttttggcttagcctatcgtcctaaacatgttgtagcgcaatatctattacatcccattcccgccattattattttagttgtagggctatattatttcttcttctaa

SEQ ID NO: 895 - DNA, 1089 bp, Proteus mirabilis
aatttattcccatatatatctccattaattataaaattaagaaatatagaaaattctcttttggtaaaaggatttagtatgaatagttttaactcaataaaaaaaccaacttatttctatctacctgatggtaaaattgttataaattatatgtatggttggcctaaacaaccacatagtaatatcaccaaaataacatatatattccctgattatgataaaaaaagaaattactcaaataaaaaatattcagtaacagaaaaagatagaatagaatcaataaaacataccgctaaagtatatgaattgacctatcttaaggaaaaaaaagaaaaagaaatcgcttcattaaaatattatagaaataaatattcaataagtaaaatagctgaattagaaaaagatatagaggatatagaaaatagtattaataaaaataagaatagtatacatccttatttttataatacacaaacaaccatatatcctcatcaacaagaagttatttccgatattcttaatgaaattgcctatataacacaagcaaagtttgttgcatctaatccagaattcgatgccgatataaaatttggtttttacgatgattttcatattagtcatggttcaatagaattttcatataccaccagaggttttgcaacctatcctagcaggtattcaacccctataaaaaagataaatattgatgaacaataccaatactctggaactatatttttaaatttatcatcacaccaatattataagataatacatcaaaatgatcttgataattatataaaaacagaaggtaatattggtgatgctttcaattttaaagataatggtactgttctgataataaaaaaaaccaatactctaattgaaacactaaaaaataataaatatcagccaggtacatatcattataaagttgttttgcatgaagttggtcatgcactcgggctaagccatagttggcaatacttagaatataaagataaaaatcatgtattagcttcatggaatattctggtatggggtatgatataccaacctcagagcctgctgattttgggtggtctttaa

SEQ ID NO: 896 - DNA, 1482 bp, Proteus mirabilis
gttttttccccatttggggttttatatttggaaataggcgttggtgcttatttcttttttagtcaaagtcaaagaggaaacaatgctatggttatgcaacatgctaaaccaggcagggtggcacttgccgttatgggcgcattgcttgtaactgcactacctgcgaaaatgtcttatgctgaaggatttattgatgactcaaccctgacaggggggatctattactggcaacgtgaccgtgatagaaaagagttaacaccaaacagtcctgattacggcaaatataaagccaatttacaccactctacctttaacgctaatcttgatttttcttctggttatctgggtgatttttttggtattgatttagctgcttttggtgctgttgaacttaacaacagtgggccagctgcacctaatgaaataggatttagtgatgcaaaaagtcgctgggatgaaaaatggacaggtgatcgcagtggcgtgagtatttataaagctgctgctaaatttaaattaggccatttctgggctcaaggtggatatattcaacctaaagggcaaacattattacgtcctcattggagtttcttacctggtacttatcgcggtgcagaagcgggcgctgtatttgatttcgataaaaatggtgaactctctttctcatatatgtggactgatgaatataaagcgccgtggtatcggaatatgtacaatttccgtaaggcagacttagagacaaatatcagttatttacactcttttggtgccaaatatgattttaaaaatagcttagtattagaagccgcatttggccaagctgatggttatattgatcaatattttggcaaagtttcttacgatttccctatcgcaaataatacattaaaaacctcttatcaattctacggtgcaaaagataaagtcaccggagggggaattaacgatgtttatgatggtttggcatggttacaagcattcactttaggctatacctacaatgtatttgattttaaagttgaaggtacttgggttaaagcagaaggtaaccaaggttactttttacaacgtatgacgccgggatgggcaacctcgaatggtcgtttagacatctggtgggatggtcgttctgattttaacgccaatggtgaaaaagcattatacgcgggagtgatgtatgatctaaaaaattgggatctaccgggctgggcgattggtacttcctatgtgtatgcttgggatgcaaaaccgagtagtaaccctatttatgaccaaagtaaacgcatcagagaaagcgcatggaatgccgatatcatgtataccgttcaagaggggagagcgaaaggtacgttatttaaactccactacactcgttatgataaccattccgatataccaagctatgaaggtggttttggtaatatcttccaagatgaaaaagacgttaaattcaatgtgatcatgccatttacgattttctaa

SEQ ID NO: 897 - DNA, 1020 bp, Proteus mirabilis
aaggctgtgtttcatgcgccctttaataataatgataaggaaagtgttactatgtctgcatcttatttaagtcgtgttaatgcgataaattggaatcgtattgaagacgaaaaagatttagaagtttggaaccgtttaaccatgaatttttggttacccgaaaaaattccactttctaatgatataccttcatggaataccttaacccaagctgaaaaacagttgactatccgtgtatttacagggcttacactgctcgatacgatacaaaatacggtcggggcaccaaccttaatgcctgatgctcagactccccatgaagaggcggtattatcgaatatctgttttatggaagcggtacatgctcgctcttatagctcgatattttcgacactctgcttaacaacagatgttgatgatgcttatcgttggagtgaagaaaatacctatttgcaaaagaaatcagatattattctgcgttattatcaagatagtgatccattaaagaaaaaaattgccagtgtatttttagagtcttttttattctattctggattttatttaccgatgtattggtcaggtcgagggaaattaaccaatacagccgacttaattcgtttaattattcgtgacgaagccgttcatggttattatattggctataagttccaaaatcagttattaaataaatcatcattagagaaacaagatattaaagactttgctttctcattattattagatttatatgataatgaagttaaatatacagaagatctctacgactctgtcggttggacagaagatgtaaaaaaattccttcattataatgcgaataaagcgctgatgaatttaggttatgaagcactatttccagatgaaataactaatgttagtccagcaatactttcatcactatcgccagatgcaaatgaaaatcatgatttcttttctggctcaggctcttcttatgttattggtaaaacgatcaataccgaagatgatgactgggatttctag

SEQ ID NO: 898 - DNA, 573 bp, Proteus mirabilis
atgcaacccccttcggcctcccctttagagattaatgtcgcgatctttattgctaaatacttggtttacttgttccctctgtctttagctttctattggctatggggaaatgaaaagcatattgatcagcaaaggactttagcttgtaaggctggggtcgctctgattattgccctctctatctcttggtttatcggtatgatagctccccatgatcgcccttttgcagccaatatcggttataacttccttgatcatgaggcaacgccttccttccctagtaatcatggtactttcgtgtttactatcgcactggcttatcttttttggcataacagtaaacgcattggcatgctgatgcttattttaggtcttgcgattgcttgggctcgtatctatcttggcgtccattggccaatagatatggttggtgcatttattgttgctctcctctcttgtgcattaagccaaatactttggtcacaaggcgggaaaaagttacaaaaagcgatccaccagctttatcaactctgctttgcatatcctattcgcaaaggttggacaaaagcttaa

SEQ ID NO: 899 - DNA, 798 bp, Proteus mirabilis
aataaaggcccctactttggggcctttttatctagacagttttggagtaaccctgttatgtccgtacttggtcgtatccactcatttgaatcctgcggtactgttgacggtcccggaatacgctttattgttttcttccaaggatgcctaatgagatgcctctattgtcacaaccgtgacacatgggatactcatggtgggcaaatcgtcacagttgatgaattaatgaaagaggcagtgacttatcgtcactttatgaatgcctctggtggtggcgttacagcttctggtggtgaagctatcttacaagcagaatttgtacgtgattggttccgtgcttgtaaaaaagaaaatatccatacctgcttagatactaacggttttgtacgccgttatgatcctgtcatcgatgaattaatggacgtgactgatttagtcatgctggatttaaaacaagtgaatgatgacattcaccaaaaactggttggtgtttctaaccaacgtacactggaattcgcccgctatttagctaaacgaggccaaaaaacctggatacgttacgtagttgtgcccggttggtctgatgatgatgattctgctcatcgtttaggcgaatttataaaagatatgaaaaatatcgaaaaagtcgagcttctcccttaccacgaattaggtaaacataaatgggttgctttaggagaagagtataaactcgatggtattcatccaccgtcaaaagagacgatggaaaatgttaaagcaattattgcatcttatggtcataaagtgatgtattaa

SEQ ID NO: 900 - DNA, 183 bp, Proteus mirabilis
agcaactcgtttacattaagtaaacttcgttactccacgccttgcctaaagaaaaagcttcttattataattataagaagaaaaaggagtggttatacgggtattaaaacattatggggctatagctcagctgggagagcgcctgccttgcacgcaggaggtcagcggttcgatcccgcttag

SEQ ID NO: 901 - DNA, 186 bp, Proteus mirabilis
attctcccaccctgctatactctccaaaaactaaccggatccgttatgaacctcgcaaacttatctcaagaagaaaaagacaaaatcaatgtcgatttggctacttcaggtgtcgcatataaagaacggctcaacatgccaattgttgcgtccaaagttgaacgacaacaaccagcacatttatga

SEQ ID NO: 902 - DNA, 264 bp, Proteus mirabilis
tatgtcccgttcgtcggtaacccgcttcagctctttctggagacgaatctcggcctgagcatccgactgtgcattattagtggaagaatccggaccgtacttctttatccaggcgtaaaggctgtgagtggtgatatcgagacgtgttgcaacgctggaaacagaatgaccacgatcaacaacctgtttgactgcttcaattttaaactcttcaggataacgcttaccgctcatgggcacctctctttaagtcatcttaaatga

SEQ ID NO: 903 - DNA, 1092 bp, Proteus mirabilis
ttaatgaaaccgacaaaaaaagtggtgattgtaggcagtaaatttggagaggtttatctcaatgcatttatacaacctcaagacaaatggcatcttattggccttttttccaaaggtagcactcgttctcgagaattatctaaagcattcggtattccactttttactcgatttgatcaactacctgaaaaaatagatctagcttgtattgttgtgcgatcagccattgttggtggcgaaggtagccaacttgcgcaagcatttttacaacgggggatctcggttgtacaagagcatcctgtacatcctgatgaaattaccagactacaatcattagcagaaaaaatgcattgccactatatcgttaacagcctctatccatataataaagcaggacgtttatggatagaaaacacacagaagatatatcagaaaatacaacaacgaccagtgtggggacaaattattacaagcaggcaattaatttattccgccttagatatatattgccaagcaatgaaattacaccctaatgatattacagtcacattagaaaaagataataccccgctacaatttctacggctatccacccctactggtgatttgcttttatgcctacaaaaacatttgtcatctaacgatcctgatcagcatagcctcgtgatgcatcatatgatattaggctggccagctggttatttaactctcgctggaagctatgggccagtagaatggaataatgcgctttatattcatcatcaccaagatagtaaaaaagccatgtatcaatctcctgccacgatggagcttgatgaaccactgtttcattcatttcatactccaccaaatagttggcaggatgtgatggaatgtgaagcaccagaagctattaattacttactggcagagatagataaatgctggcaattacctaatgataaaaaaccaatgattttacaaccccattaccaattagctttatctcaattatggataaaaacattgcaaacagcgggtaaagccattgatggcacaattgcgccatttaagcgaatgaacttcaccaaaagtagtggacggagaaaataa

SEQ ID NO: 904 - DNA, 288 bp, Proteus mirabilis
agagaggtgcccatgagcggtaagcgttatcctgaagagtttaaaattgaagcagtcaaacaggttgttgatcgtggtcattctgtttccagcgttgcaacacgtctcgatatcaccactcacagcctttacgcctggataaagaagtacggtccggattcttccactaataatgcacagtcggatgctcaggccgagattcgtctccagaaagagctgaagcgggttaccgacgaacgggacatattaaaaaaagccgcggcgtacttcgcaaagctgtccgactga

SEQ ID NO: 905 - DNA, 330 bp, Proteus mirabilis
aagaaaacgcctcgattgcggcaacaaacgaggcgtgttgttcaatggaattcaccatttaacgtacaaatatactgtatcaatatccagtttttatctcaagggaaatttcggtttcccttttttgatacagctttggaatggagaaattataccatgagacaaagaataaatcatgaatttaatggctgtgatgagtataaaaacatcatggaaaataggttattacaagaaataaccccactgggttgtcagcgtttaaaggaagcattgaaagacgcaaaattaaggaaagcacatcgggataagttattaggagagcgaaaatga

SEQ ID NO: 906 - DNA, 726 bp, Proteus mirabilis
actaccgcgttgattacaatatctatcgctgggagaacaatggctctggtggcgggcagacacgagcgaatgactcattctcaagtcatgttgtcgtatgggtggtgtgaaatggttggtgtagaaatttacacaaataataggctgatacaattaaccgataaactcgaaacaatatgtgttttgagaaaagcaactcctgatgaactaacgtcatcatcaggccctcatgatagttatccgagaatctatgcgttaaatagccaatggatggttgctccgatttccaaggtaagcatacctcaacacggagttggtcttgaagtttatgatgagcaagggaaaatgaaattttcatctcttgctaagttggtctgctttgagaaatattatgatgtcaatacggggagcgctggcaaaggctcattaagaatcgcaggcaaaagtggtcaccggtatggcatgattaagactcgctctatggggtattttcataatacaaacatacgaagctacatagaccctgacacgtgggatgaagtttggacattcaaaagatatagcgagcgttatgtcttggttgatgatgtgggagggttaacatttgagtatcgatacgagttcttaggagaagaggatggctggataagtatgcctccgagtcgagaaggttctggattaatggaacaagggcttatgatagacgtttcaatgttagaagattaa

SEQ ID NO: 907 - DNA, 282 bp, Proteus mirabilis
atcttagcgtttctgaaaaactcttcatgtgaatatgatagcaagcgtattctttcatcattagaagtgatagaattgaatattgatcctttattaattatatctattatatccattgataaatttatcataattaacaaccttttcctgttataccttttattgcggtattttgattcaaggctttttgtaagtgactccactcagcggctttatcaggcatctcacttttgccttttcaagataatcaacgacttttattttattttttgtatcagataa

SEQ ID NO: 908 - DNA, 195 bp, Proteus mirabilis
taccctaagttatttatctccgataattgttactattttctcttattctgccgatctgaattttatcatctcagtttcagcctgtctgactattcgagtgatttagctcaagcaaatgggaatattattttgactgaaacgttaacaattcgcataaaccgaattaaaatatcacatttctcgaccaacgattaa

SEQ ID NO: 909 - DNA, 324 bp, Proteus mirabilis
agaataaagttaaaagcctttttattagtgaagggcgagaaggtggtgatttgtacaagatcattaaagcagtatcaggaaatagataatcatttaataagagaggtatttatgaaattaaaattaggaaatatttgtattcgtccagaagataaagaaattagcattccagtagatgtatacatgggaaatgaagctgattttgaaccaccaaaagcatatctggtttatcaaactagctttgatgctaataagcctctttcggaatattttaaagaatccgaagaatatgcaagaaaaacaattaaagaattaaaccaataa

SEQ ID NO: 910 - DNA, 1152 bp, Proteus mirabilis
tacgcacttacctgcgctaataacaacaaggatatcattatgaaatctcgtgctgcggtcgcctttggaccaggagagcctttaaaaattgttgaagttgatgtgatgccacctcaagcaggtgaggtattgattaaaattagtcacactggcgtatgccatactgatgcctttaccctttcaggtgatgatcctgagggtgttttcccggccattttaggtcatgaaggcgcgggggtggtggttgaagtatgtgaaggcgtcaccagtgtcaaaccgggtgatcacgtgatccctctctatacagcagaatgtggcgaatgcctattttgtaaatcaggcaaaacgaatctctgtgtagcagtaagagcaacccaaggtaaaggcttaatgcctgatggcacaacgcgcttttcctataatggacaacctatttatcactatatgggttgctctacctttagtgagtatacggtagtagctgaagtatcactcgctaaaatcaatccacaagccaaccatgaagaagtctgcttacttggttgtggcgtgacaacaggtattggtgctgtacataatacggcaaaagtacaagaaggtgactcggtggctgtatttggtttaggtggcattggtcttgctgtactgcaaggcgctagacaagccaaagcaggccgtatttttgcgattgatactaatcctgaaaaatttgcattagcacgccaatttggtgccacagactgtttaaatcccaatgattatgacaaacctattcaagaagtactggttgaaatgactcagtggggcgttgatcatacttttgagtgtattggtaacgtcaatgtgatgagagccgctctagagagtgctcaccgtggttgggggcaatctatcattattggtgttgcgggggcaggacaagagatctcaacacgccctttccaactcgtcacaggtcgttcatggaaagggactgcatttggcggagtaaaaggtcgtagccaactacccaatatggttgaagatgcaatgaatgggaaaatcgaactcaaaccttttgtgacccacactttacctcttgaaaaaataaatgaagcctttgatttaatgcatgaaggtaaatcaattagaactgttattcatttcgattaa

SEQ ID NO: 911 - DNA, 798 bp, Proteus mirabilis
attcacattacaagaggcgatatcatgttggcaaaacgcataattccttgtcttgatgttcgtgatggacaggttgttaaaggtgtgcaatttcgtaaccatgaaattattggtgatattgttcccttagcagaacgctacgcgaaagaaggtgccgacgagctggtcttttatgatataaccgcctcttctgatggccgagtggtcgataaaagttgggtatcgcgggtagccgaagtgattgatattccattttgtgttgcgggtggtattcgctcagtagaagatgccgggaaaattctctcttttggggcagataaaatctcaattaattcccctgcactttctgatccaacactgatttcccgccttgccgatcgctacggtgtgcagtgtgtagttgtgggaattgatacatggtttgatgaaaaaaccggggaatatctcgtttatcaatttacgggtgatgaaaaacgcacacaacaaacgccatggaaaacgctcgattgggtacaagaagtacagcaacgaggtgcgggggaaatagtgttaaacatgatgaaccaagatggtgtaagacaaggctatgatttaaaacaactcgcactggtacgccaagtcactcaggttcccatgatagcttctggcggtgcaggtgaaatgtcacactttctggatgcgtttaaattagccaatgttgacggtgcccttgccgcttccgtattccataagcagatcattaatatcaacgaattgaaacagtatctcgcagaaaatggcgttaaggtaagaatataa

SEQ ID NO: 912 - DNA, 1206 bp, Proteus mirabilis
tactggattacgataaaaaacttgaacaagaaaatcaccaagggagcgaaaaacatgagtaattcgtctcaatcatcacctgcacacttttcttggcgacgtttatatgctctttgtttaaaagagactaaacaaatcacccgtgatcccagtagcgcgcttattgctattgttatccccctcaccctactgtttatttttggttacggtatcaacttagattcaagcaaattaaatattggtatattaactaaccaacaaagccaaccggcacaagagttagtgtatacttttaccaactctccctatattaacgccaccatcagcgataatcgccaattgcttatcgataaaatgcaagccggagaaattcgtggcattgtggttattcctgtcgactttgcgcaattattagcccgacaagatagcaaagctcccattcaagtgatcaccgatggtagtgagccaaataccgcaaactttgtacaagcctataccaaaggggtttggcaaatctggttacagcaacaagctttaagtcaaggcattcagcagcaaccattaattgaaattgagccaaggtattggtttaaccctgccgccatcagccaacactatattattcccggtgccgtcactattatcatcaccgtggttggggctattctaacctctttggttatcgctcgagaatgggagcgtggcaccatggaagccttactctcaacccaaattacacgcacagaattactgctttccaagcttattccttatcaagtattaggcagttttgttatggtgctatgtatgttggtcactgtctatatattaggcgtgccttaccgtggctcattatggattttagcgggtattacttcactatttttagccactgcactaggtatggggctattgatctccaccctaactcgcaatcaatttaacgcggcaatgatctcacttaatgcggcttttttacctgcggtgatgttatcaggctttgtgtttgaaattgatagcatgccattttttattcaagtagtgacctattttattcccgcacgttattttgttagtagcttacagacactcttcttagcgggagatattccgatgatcttaatgctagatatgtggctattaattgtttcagccatcttttttattggcttaacggcgttagcaacacgtcgtcgcttagattaa

SEQ ID NO: 913 - DNA, 957 bp, Proteus mirabilis
gtaatggctacgatgactaataatgatttagtaatttataacgatttagcacaaactgcgtttttagaacgccgtcaagataatttagcagtatttaatcaggcatcaaacggcgcaattgtgctggataacctttttattgagggggacttccgtaagcgtgcattttatcagatcggcggttcgattgagcatcgtgatgtaaactccacagcatctgtagagaacaaaaaaatcggcgcgggcgaatctgttgatgtaaaagcaccttggaaatatggtccttatgcaacgacagaagaagcatttaaacgccgtggccgtgatgtatcggagttctctgagttagtgggtaccgatgcggcagatgcttcactagagggttatatcaaatactctttagctgctttaggtgccgctattggcaataacaaagaaatggtggtgactgcggatattgcgacagatggcaagaaaacactgaccaaaggtttacgcagatatggtgataagttcaaccgcgtaaatctgtttgttatgcactcaaccacctacttcgatattgttgatcaggccattgacaacaaagtgtatgaagaagcgggtgtggttatctacggtggacagccaggcacattaggtaagcctgtgctggtaacggatacagcgccagtagatgccatctttggtttagtgccgggtgctgtgactatcactgaatcccaagagccgactttccgatcttatgaaatcaatgacaaggagaacttggaagttggttatcgtggtgaaggcgtggttaacgttggcgttctgggctatagctgggatgaatcaaaaggaaaaaaccctgatttaacacagttaggcaccgcaggtaactggaagaagcatttcactagcaacaaattaaccgctggcgtcatgattaaactgactgccgaagagggaaagtaa

SEQ ID NO: 914 - DNA, 312 bp, Proteus mirabilis
tacgagtatactgggttacattataatacgttcaggtactatgccccggatttaggccgttttacccagcaagacccaatagggttggcaggagggataaatttatatacttatgcgccaaatccattgacatgggtggatccttggggattacatgttcaacatggtattgatgtactagctgatgattggtgggttaagggggctcatgcacatattgataaaatagaaattgctataaaaccaggtaaatatggacaaataatatacaagcctgtatttagtaaaacagatgttaatacagtagcctag

SEQ ID NO: 915 - DNA, 540 bp, Proteus mirabilis
tacgagtatactgggttacattataatacgttcaggtactatgccccggatttaggccgttttacccagcaagacccaatagggttggcaggggggataaacttatatgcttatgcgccgaatgcgttgacatgggtagatccgtggggttggagttgttttaattcatcaaaacggtttgataaaagcaataatataacaagtcgctttattaatctattaacaggcaaaacacctagtgatgttgagcattatttaaagaataaaggatggactgtgacatatccacaaagtgctacaccagcaaaaactcagcatgtcgtttttgtaaaaacaacaaagtcgggagaagtatatcatttagattataatccagcaggtaaaactcatgggagtgattattggaaagtgataaaacctaatgatcctatagaaaaagtatatggtcgtataggccatggaaatttttctcattatgataaaataaaaaattcacctgtttatattgatggtgttttgatgaatccttggagtaagtaa

SEQ ID NO: 916 - DNA, 495 bp, Proteus mirabilis
tttcaggagttgtgcatgtctcaactaactcatattaatgctgccggtgaagcgcatatggtggatgttagcgccaaagctgaaaccgtacgtgaagcgcgagcagaagcctttgttgaaatgtcagcagaaaccttagcaatgataaccgaaggtcgacaccataagggagatgtctttgctaccgcacgtattgcgggtattcaagcagccaaaagaacatgggaattaattcctttatgtcacccattgctgttaaccaaagttgaagtccatttagaagcccttacagactcaaatcgtgtgcgtattgaatcagtgtgtcgcttaacgggtaaaacgggtgttgaaatggaagcactcactgccgcatcagtagccgcattgactatctatgatatgtgcaaagcagtacaaaaagatatggtcataggatctgtgcgtttattagaaaaaaccggtggtaaatcgggacactttaaggtggatgcatga

SEQ ID NO: 917 - DNA, 540 bp, Proteus mirabilis
agccatggtacacgtaatgcaagaagacagtcgccgtatgtacgaactcgaaaaactctggagctgagtttgaaattacagctcatcgccgttggtacaaaaatgccggactggatccagaccggctttatggattatcttaaccgctttcccaaagatatgcccttagaactcatcgagatccccgcgggtaaacgagggaaaaatgctgatattaagcgtattctcgaaaaagaaggcgaacagatgttagcagcggtaggtaaaggaaatcgtatcgtcacccttgatattcctggcgcccgttgggataccccaaaacttgccgagcaactcgatcgctggaagttagatggaagaaatgtcagcttattaattggtggccctgaaggtttagcccccgcttgtaaagcagctgcagaacaaagttggtctttatctccattgactatgccacatccgctagtacgtgtagtggtagcagaaagcctttaccgtgcatggagtattaccacaaaccatccttatcatcgggaataa

SEQ ID NO: 918 - DNA, 216 bp, Proteus mirabilis
acacgaggtacgttttctaaattgtggttaaagacgtctggtggtgtgtcagtgaggatctctaatgctttatccatacgaccacggaaatcagggactaaagtttcgatgcgaatattaggatttttttcacggatagcggtaatacaatcggcaaaatgttgtgcaccaccatcgcgtaggtcatcgcgatctactgaggtgataacaacataa

SEQ ID NO: 919 - DNA, 765 bp, Proteus mirabilis
ttacttgtcacactaaatcgggatctgacaatgaaaaaaatattatttgcagcacttctgaccagtattacactttctgcaacagcggctgataaagagactattcgttttgctactgaggcaacttatcctccatttgaaatgattgatgcaaacaatcaaatcgttggttttgatgtagatttagcaaatgccatgtgtgaaaaaattaatgctgaatgtacttttaccaatcaatcatttgatagcttaattcctagcttaaaattccgccgttttgacgcattaatggcggggattgatattacgcctgagcgtcaaaaacaggtagattttactgattcttactatgacaactcagcggtctttatcaccgttacaggtaaaatttccgatgttgcaagcttaaaaggcaagcaaattggtgtccaaaatgggacaacccatcagaaattcatcaatgaacaacataaagagatgaaaacggtgccttatgacagttaccaaaatgccgtgttagacctaaaaaatggtcgtatcgaggctatctttggtgataccgctgtggttaatgaatggctgaaaaagaatcctgaattaggtattgttggtgataaggtcactgatcctaactattttggtacaggccttgctattgcagtaagaaaaggtaatgctgatttacaagataaattaaacaaagcattatctgaagtaaaagccgatggcacctatgatgtcatttataaaaaatggtttgaataa

SEQ ID NO: 920 - DNA, 429 bp, Proteus mirabilis
tcaatgtggtttcaaaaagagattttacttcaagcaaaaccgagaggatttcatttaatcacacaggcactgttgcaagaattacccgaactcagacaatacaaaataggtattgctcatttttttattcaacatacttctgcgtcattaaccattaatgaaaacgccgatccgactgtacgtagtgattttgaaagtttctttaatcgctgtgtgaaagagcatgaagcttattaccttcacacttatgaaggcagtgatgatatgcctgcccatcttaaaagtagtttacttggtcagagtgtgtcggtgcctatttgccaaggggaattaaatttaggtacatggcaggggatttatttaggtgaacatagaaatcacggtgggcgtcgacgtattgtggtgacattacaaggagagtgttactga

SEQ ID NO: 921 - DNA, 1005 bp, Proteus mirabilis
ctttatcacacagcagataaatacagaaaaacgctcatgacagatactaataaaaaaaagttaacaatcaatgatatagccaaactttgtggtgtgggcaaatcgactgtttcaagagtacttaatcaagatcctatggttaatgaagaaacaaggaaaaaagttaactcaattattgagaaatataaattcacaccgtcaaaatctgcacgagcaatgcgggggtactctaatcgttcttttggtattatcgtcactcgccttgattcttatgcggaaaatcaagcagttagtgccatattgcctatcctttatcaaaacagcattgaccctattattttagaaagccaatttagccaagccaaagtagaagaaaacttaaaaatgctcgcccaccagaaaatcgatggcgtaatattatttgcattttcagggatcaatgcggctaacttagcaagttggaaacaaaaaatggttgttatagcaagaccactagaaggttttgtttccatttgtcatgacgatgaacgagctgttaacgctttaatgcattatttccatcgagacaaacattatcaacatataagttttatcgggatccaaattaatgatgaaacaacgggtttattacgttatcaaacttatcttcaatattgccagcaacatcaattaatatctcaagctcaacttggtgaacttaattatcaaagtggctatttacttgccaaacaagcattagcaagcaagcctcaagctattttatgtgcgaccgactctctggcctttggtgtacaaaaatatttagccgaacagaaaatagatcatattgaggtggcctgtatcggtcgtaatgatctactcacctttttatttcctcaaactaaattctatcgattaggttttagagaaagtggacaagaagctgctaacatattgatacaaatgctagaaaaaaatattcctgcacaaaaaatcattatatcaagtcatgacttaaacccatga

SEQ ID NO: 922 - DNA, 792 bp, Proteus mirabilis
attctccggttaacggttctcaacagtgggacagtgcaaatgtggattggggtaattagcctatttcctgaaatgttccgcgctataaccgagtacggggtgactggtcgggcagtgaagcatggtctgctgaatgtggaatgttgggatccccgagatttcacttatgacagacatcatacagtagatgatcgcccttatggcggtggtcccggtatgttgatgatggtacaaccgttaagggaagctattcatcaagcaaaagctgcggcaggtgatggtgcaaaggtgatttatttatcacctcaagggcgcaaactcgatcaacaaggtgtttgcgaattggctacaaatgagaaattaattctggtttgcggtcgatacgaaggaatagatgagcgtgtcattcagaccgaaatcgatgaagagtggtctgttggtgattacgtattaagtggtggggaactccctgccatgataatgatagatgcagtagcacgttttgttcctggtgttcttggacatgcggcttcggcgaaagaagactcttttgcagaaggattactggatcatcctcactatactcgtccagaggtgttagatggtatggcggttccggcagtgttactgtctggtaatcacgctcatattaatcgctggcgtatgaaacaatcgctgggccggacctggctaagaagacctgagcttctggaaagcctagctctgactgacgagcaaagagtgctgttagcagaattccagcaggaacatttgcaaagaacagcagagtaa

SEQ ID NO: 923 - DNA, 279 bp, Proteus mirabilis
cataaacggttatgcaaagagggctttagcgtgagtgcttatggcgttcaaaagctaatggctcagcttggcctagtcgtcactcagcgtgttgcttacaaagtcaccacaaaacgcaaacacagtgatgcggtagtcgataatttgttaaatcaaaatgttaatcctcacgcacctaacgaagtgcgggcgggtgatgtgacctatttaaaaacaggggagggctgggtgtatttagtcatcgtgatggacttatactcacgccgtattgcgggttga

SEQ ID NO: 924 - DNA, 840 bp, Proteus mirabilis
tatgattgcacatgtcatcataaggaaaaaatagacttaattttggtcatcaatatgaaactcaatgcattattaaactatcaaatacatcaaccagaaacagcaacgataaacaatttacctattgttttgatccatgggctttttggtgatctcaataatctaggcgtactaggtcgcgatctacgtcaagaccacaccgtgatacaaattgatgtgcgcaaccatgggcattctcctcatagtgaaagtatgcactatcacgatatggcacaagatgtattagccctgcttgatagcttaaatatcgcaaaagcaatcgttataggtcactcaatgggagggaaaattgcaatggcaatgaccgctctcgcacctcttcgccttgaacgtatcgtagttattgatatgtctcctgttgcttataatgttcgtcgtcatgataaaatttttgcagcccttgaagctgtcactaaagctcacgtcacacaacgtacagaagctattgctattatgcgcccttttattgaggaagacggcgttatccaattcctgcttaaatcatttaaaaaaggtgaatggttatttaatttacccgcaatcaaacaggcttaccccgatattattggttggcaagaagtgcctgcttggcatcatcccgttttatttatacgtggtggactatccccatatattttagatgagtatcgcgataatattgctcgccaatttccacaagcaaccgcctttgttgtcgccaatacaggacattgggtgcattctgaaaaaccagaaacagtaattaaggccattcgtcgcttcttagccaaaacagtataa

SEQ ID NO: 925 - DNA, 858 bp, Proteus mirabilis
agaggttgcaccatggaatttgattattttgttactccacaatggctttttgaacatcacgacgctcaagatctcgtgatagttgatgtcagtgcgcccatgcctacgcaagatattgactatcatcaacgctatcttgaacgtcatatccctggtgcccatttttttgatctggatgaaatcgccgataaaacaacatcattaccacatatgttgccatctgacacactgttttctgaaaccttaactcagttaggtatttcaaataatacaacagtgatcctctatgatatcggcaatctcttttcagcacctcgtggctggtggacttttactaccttaggttgtcacaaggtgcgtattctggccggtggtttacaagcttggcaagaagcggggttcccccttgaacaaggagaaacgcccaaagtcccagccactcacccttttatcgttacacgccacactcaacgccgtgtcgataaacaacaaatactggataatctgactacgcaacaaaatcaaatcattgatgctcgttcggcggatagattttatggtagagcaccagagcctcgtcccggtttacgtaggggccatattcccaatagtaaaaatgttccttgggataacttagttattaatggacaattaaaagataaagcgcaattacagcacatttttgaacaagcaggtgtcgatttatctcaaccaattattgtcagttgtggctcaggtatgacagcagctattctatttttggctttaactctattgggctgccagaatatcgcactgtatgatggctcttgggcgcagtggggagcagaaaacgcattaccttgtgaatgcgaataa

SEQ ID NO: 926 - DNA, 288 bp, Proteus mirabilis
tatttaagcacttttcattgtgactgtgagcagacacattcacatttttataagggttattctatgtctgtgatcctctataccaaaccaaattgtgttcaatgcagtgcaaccgagcgcgcattacaacaacaaaaaattcctttcactgcggttgacctcacccaagacactcaagcattagcaaaaatagtttctatgggatatcgccaagtaccggttgtcgttaatggtgacgaacattggtctggcttttgcccagataaaattcgtcaaatagcgcgctaa

SEQ ID NO: 927 - DNA, 1086 bp, Proteus mirabilis
tcagacttaacaaaaggatactcagtgacagtaatagcccatacacaggtagcgacccaagagattttcttagagcccgcagataatgaccgtttaatgagtttatgtggcccatttgacgacaatattaagcaacttgaacgccgtttaggtatcgagatcaatcaccgtgataaccgttttaaactaacgggtaaatcactgaatgtgaatgcagctgcaggaattttgcgacatctgtatgtggaaacctcacccattaaaggtgtgatacccgacatcgaccctgagcaaattcaccttgccatcaaagagagccgagtgcttgagcaaagtgatgagcatgtgcctgaatttgggaaatcgaccaatattcgcactaaacgcggcgtgataaaaccacgtacgcctaaccaagcgcaatatattgccaatatccaaactcacgatattacttttggtatcgggcctgcaggtacagggaaaacctatctggctgttgctgccgctgtcgatgcccttgagcgtcaagaagtacgccgtattttactgactcgccctgcggtagaggcgggtgaaaagctcggttttttacccggcgatttaagccaaaaagtcgatccgtatttacgaccactttatgatgcgttattcgagatgttaggttttgaaaaagttgagaaactgatagagcgtaatgtgattgaagtggcccctttagcttatatgcgaggtcgtacactcaatgacgcatttattattctcgatgaaagtcaaaacaccacaatcgaacagatgaagatgtttttaacgcgtatcggttttaactctaaagcggtcatcacaggtgatatcacgcaaatcgaccttcctcgaggtcataaatccggattgcgtcatgccatagaagtgctatctaatgtcgatgatttaagctttaacttcttccatagtgaagacgtggttcgccatcctgtggttgctaagattgttgtcgcatatgaagcttgggaagttgaagatcaaaaacgccgccaagcaattaaagcagaaaaagagagactgcagagagaaaatcatgagtga

SEQ ID NO: 928 - DNA, 321 bp, Proteus mirabilis
tatgagaggttcggaatgataaatgaagatttattcattaagaatatatattcaaaaaatcaggacagaatatctgtagcccttgtatatgacacgttatcaaaagaagcccacagaggttgtgggctgtattacgaaatatacgaaagctgtttcatcggtcttttgcgcgattatctttcagaacttaatgaagctgacacaaataaattaagacgctatgccgaaagcaaaggcacgaaaattgatgatgcatcctggagtgacgctctggaagctgaaagggagtgcagggctgaaatataccgcgagcagatgtaa

SEQ ID NO: 929 - DNA, 216 bp, Proteus mirabilis
gaggagaggttaataagtcaagtgatggcattggtgttgtcggtttttgtaacggcctatcattgcgcattaataacggatgaattaatgactgttgctgttgctgttgctgttgctgttgctgttgctgttgctgttgctgttgctgttgctgttgctgttgctgttgctgttgctgtgcaaaatgttgagccatctgtgcttgaggctcaatag

SEQ ID NO: 930 - DNA, 468 bp, Proteus mirabilis
agcatgataaccataagaaaagctgtactttctgatgttgagcagattaataccctgtatggctatttatttgctgagatggcgaaattacagccagaaagattaaaaccgggtaaacaagatgaagcatttattattaatggcattaaaaatgataaatttcatctgttagtggctgagttagaacagaaaattgtcggttttactattgcccaaatacaagagacaccgctatttaactgtttagtacagcgtaaatatgcctatatttttgatattgttgttgacccttctgttcgtggacaaggggcaggggcattgttgctaaatgccatgaaggcgtgggcaaaacaacaaaaaatgacccacctagagctttcagtattggctgaaaatgccgatgctaaacgtttttatcagcgagaagggttaaaagaagtcagtaccgtgatgggtattgctttgtaa

SEQ ID NO: 931 - DNA, 1080 bp, Proteus mirabilis
gggatctcaaccatgagccagaaaattctttttatcgatcgtgatggtactttgatcacagagccaccaaccgatcaccaagttgatagtctcaataagcttgcctttgaaaatggcgttattcccgcattactcaacttacaacaggcgggctataagcttattatgatcaccaatcaagatgggcttggtacagacagttttccacaagcggactttgaaccccctcataatctcatgatgcaggttttttcttcacaaggtattgtttttaatgaagtattaatctgccctcataaacctgaagacaactgtccttgtcgtaaacctgaaacagggttagtcacccaatatctggttgaaagtgctcttgataaaaccaatagctatgtgattggtgatagacaaaccgatctacaattagctgaaaatatggggatcaacggattacgttataacgccaatgaattaagctggtcagctatcagtgaattgctgacgaaaaaagatcgctactcccacgttgaacgtaaaaccaaagagacacaaattgccattgatatctggcttgatcgtgaaggcgagagccaaattagcactggagttggtttttttgatcatatgctagatcaaattgccacccacggtggctttcgtatgaatatcaatgtacaaggggatttagtcattgacgatcaccacaccgttgaagatacaggccttgcactcggcgaagcactgcgagaagcattaggtaataaacgcggcattgcacgttttggttttactttgcctatggatgagtgcctagcaagttgtgcgctagatatttctggacgccctcaccttgaatataaagcagaatttaaatatcagcgcgttggtgatttaagcacagagatgattgagcactttttccgctctctctcttacactatgggctgcactctacacttaaaatcaaaaggcaaaaacgatcaccacaaagcagaaagtctgtttaaagtatttggtcgtaccttacgccaagctattcgtgttgaaggaaataccttacccagttcaaaaggtgtgctgtga

SEQ ID NO: 932 - DNA, 1914 bp, Proteus mirabilis
gtgaaatcaactaatgggatgaagaaaagaaaacgcaccccgtttcgagattatacagcggagtcaaaactctttatccgccgtgttattgtcgcattttcagggatcttagttttaacgggcatcttagtttttaacttgtatcacttacaagtcgctcgccacgatgattatcaaactcgctcgaatgataaccggatcaaattagttcccatcccaccgagccgaggcattatttacgatcgtaatggggttccacttgccctaaatcgtactatctatcaattagaaatcgtaccggagaaagtggctaatatccaagaaacattggagagtttacgagaggtcgttgatttaactgacgacgatattgctgcatttgaaaaagagcgaaaacgctctcgtcgttttagttctattccgcttaaaacgtcacttgaccaagtgcaagtggcacgttttgccattaatcaatatcgctatcccggattagaaatcaaaggctatcaacgtcgctattacccttatggttcagcccttactcatgttattggttatgttgcaaaaattaacgataaagatgtagaacgtcttgaaaaagaagggctctatcctaattacgcagcaacccgagatatcggtaaattaggtattgaacgctattatgaatctgttttgcatggtaaaaccggttatgaagaggtcgaagttaatagccgtggccgtgtgatccgccaattgcatgagcaaccaccacaagccggtaaagatatctacctaactatcgatcttgaattacaaacctatattgaaacgctattaaccactagccgagcggctgtggtcgtcacagatcctcgtaacggcgagatattagcactggtttctaatccaagttatgaccctaacctatttgttgggggaatatctaatacagactatcaaggcctacttaataatcccgatagaccattaataaaccgggcaacccaagggctctatcctcctgcatcaacggttaaaccctttatgtctgttgcagccctaagtgaaggggttattactcctaacacaactatccatgatccgggctggtggcaactgcccggctctgaaaaacgctatcgtgactggaaacgttggggtcatggaaaactcaatgttactaaatccattattgagtcagcagataccttcttctatcaagttgcctatgatatgggtattgatcgtatttccacatggatgtcccgctttggctatggtgaatacacggggattgacctttctgaagagcgtaatggcattatgccaacccgagaatggaaacaacaacgatataaaaaaccttggtatcaaggggataccatccctgttggtataggtcaaggttactggacggcgaccccaatccaaatgtcaaaagcgttaatgaccttaattaacgatggtcaggttaaaacccctcacttactttatggcactaagttaggtaatgaaatgttaccttacgtggataaagagacacgccaaattggtgatatcaactccggttattgggagttagcgaagtacggtatgtatggtgtcgccaatctacccaatggtacagggcgacgtagctttgctgatgctccttataagattgccgcaaaatcaggtacagcacaggtatttagttatgaaacctataatgctagccaattagcagaacatcttcgtgatcataaattaatgattgcttttgcgccttatgaaaaccctaccgttgccgtctctataattttagaaaatggtggtgctggcccatctgttggggatattactcgccaaatacttgatcacattatacttggagacaacaacaccgagttgcctatttccccgccttcaccgcgtggctcagaggaataa

SEQ ID NO: 933 - DNA, 207 bp, Proteus mirabilis
caagccccaactttagagcgtgttggaattttatattttgagactcgcttagtggcaccagaaatattaaaaatccagttttctttattactgaatttaatatttactgatccaccattaccattattagtgctaccattaaatgtcacggcacctgaaattgctttttcaggaaactgtgtcattattcggtcatcccacaaatga

SEQ ID NO: 934 - DNA, 1710 bp, Proteus mirabilis
accataacaactgagttgcgacctgagagggaatttatgtatttagaaagagtggaaatagcaggatttcgggggcttaatcgcctttctctcccccttgatatgaatacggttttggttggtgaaaatgcatggggtaaaacttcattacttgatgcgttaaccttgagtttggggatcgaaacttatcaatatgcttttacagcagaagattttcatcgtttacctaatgagccagaaaacagtaaaaaaaacctacaaattattctaacttttactgaatcacgtcctggtcgtcatcgctcgtatcgttttcgtaaattagcacctgtatggatagctaatggagatgctcgtaagcatatttattaccgtattagtgcagaattagatgagcaacagaatgtcaaaacatttcgttattttctggataaagaaggtaaacagatccgtttagctaatggacaaaccaaagcgattattgctgaaatagtgcgtctttatccggtattgcgcttacaggatgcgcgttttatacctaatttaacaacagaagttattgactctcataatgagcctcatcgtgaagcatttaataataagatgagtgaattaacgaaagcattaattaataacccagacaatttatcagatgaagatttacgtgaagggttagatgcaatgcaacagttattaggacactattttgctgatcacggtgcgctactgtttaaatctcatttgaaacatcgcaaagtcagtgagccacatattcgaggatggcatgcactagaaaatattaataagattttagcgaaacctaatcagcgcaatatccgcttaattattttaggtatgttctcttctattctacagtcacgaggcagtgtcgaacttgatccttatgcaagaccgatagtgattgtagaaaaccctgaaactcgcttacaccctattatgctttctgtggcatggggattattaaatctcttttctttgcaacgcattacgacaaccaattcaggggagttactctccttagcgccactacaaagtgtttgtcgattagtacgtgatacagataaagttgccgcttatcgacttggcgacaaacaacttcatgcagaagaagagcgtcgtatctcttttcatattcgttataaccgaccttctgcactctttgctcgttgttggttattggtcgaaggggaaacggaaatctggctaatgaacgaattagccagacaatgtaactacttctttgaatctgaagggatcaaagtcattgagtttgcgcagtgcggacttaagccactgttaaagtatgctacctatatgggtatagaatggcatacgttggttgatggcgatgaggcgggtaaaaaatatgccgccaccgttaaagaatttgccgcaaaaagaaatgatgcggagcgtgaccgattaacacggttgccagcattagatatggaacactatttatataaagaaggttttcgcaatgtctatcatgaggttgcgggtgttcctgataatgaaaaatggccagtaagacgtgtgatcataaaagcgatacaacgttcatcaaagcctgatcttgccttaacggttgctaataatgctgcacaacgaggtattgatgctattcctactttattaaaggtgatgttttctcgggtagcatggcttgcgagaggaaaagccaattaa

SEQ ID NO: 935 - DNA, 240 bp, Proteus mirabilis
ttaatagggttacatatgaaaaagattatattacttacaatcatatcaagtatcgtctctctggctgggtgcaaagaagaagccaaaacgacaaagtggtatcgtgaccatccagatgaattaaaagttgtttatgataaatgccagaaaacagggagcgcatcagaaaattgtaaaaacgctaatgaagctcactggcaaatacagcagctaaacgctccagaagtagactttaattag

SEQ ID NO: 936 - DNA, 1242 bp, Proteus mirabilis
ctcatggggttgaaaaatttatttgaaaaagtagagcaccattttgagcccggtggtaaatacgccaagtggtatgtactctatgaagcggtcacaacggttttttatacgccgggtacggtgacacgtaatggttcgcatgtacgcgataccatcgatctaaaacgtatgatgatccttgtttggttatctgttttcccagccatgttctggggaatgtataacgttggtcaacaagcgatccctgctcttaatcagttgtatagtggtgctgagttacagcaagtgattgcttctgattggcactatgcacttgcacagtatttaggtgcatcattgacaccagatgctgggtggggaagtaaaatgctccttggggcaacttactttttacctatctatcttgttgtatttgcggtaggtggtttctgggaagtgttattttcccttattcgcggacatgaaattaacgaaggtttctttgttacttctattctgtttgcgttaattgtgccgcccacattaccattatggcaggctgctttaggtatcacctttggtgtcgtaattgcaaaagagatttttggtggaacaggacgtaacttcttaaaccccgcattagcagggcgtgctttcctcttctttgcttatccggcacaaatttcaggtgatcttgtttggactgccgctgatggtttctctggtgcaactcctctctctcaatggtctgtttctggtcaaagtgcattgttaaataatgtcactcagcagcctatttcttggatggatgcattccttggaaatatccctggttctattggtgaagtctcaacactgatgatcctaattggcggcgcaatcattttatttgctcgtatcgcatcatggcgcattgttgccggtgtgatggtgggtatgattgcaatgtcatatctgtttaacttgattggttctgactctaatccattattctcaatgccttggcactggcacctcgtattaggtggctttgcatttggtatgatgtttatggcaaccgatccggtatcagcttcattcactgataaaggcaaatgggcttacggtattttaattggcgtaatggctgtgctaatccgtgtcgtcaatccggcttacccagaaggaatgatgctagcaatcttattcgccaacttatttgcaccgctgtttgactatgtggttgttcaggcgaatattaagcggagaaaagctcgtggctaa

SEQ ID NO: 937 - DNA, 234 bp, Proteus mirabilis
gttagcaaaacgcctcggaatctaacccaccgcaccaacaccagagaaccaccctatcgctcacctagcgaggtaacaatgaaaactaactattacagcgctatgcgtgattgcatggcggtgcgcatcactacgcctcaagcacgtaaaaataaacgtacaagcccatggttgttcagtttagctgtggtcattgtaacaaccgttggtgtaataccgacatttgtgagttga

SEQ ID NO: 938 - DNA, 237 bp, Proteus mirabilis
agaaatgaaacgttggatatatgcaggcggaaaggtctggcgagggcttgtcagtcgtcgagaggcggagtcagcactatgtcatggaaaactttaatcatcattatcggctttattcttgcattactcattacagtcgctggtggcatttatctcttgattgataactcatgtactaaagaccaagtgagtttagaaaagcgctgtcagattgcactctcatatcatcggtactaa

SEQ ID NO: 939 - DNA, 480 bp, Proteus mirabilis
agccgccgaactaattggtatcgatatccacacaatttcaccaacggctggtcatgcataatgtcaaatagaacggtaatggggtttgattttggcaccaaaagtattggagccgcaataggtcaagaagttacagggacagcaaggccattagcctcctttaaagctaaagatggtattccagattggagtcaaatcgaaaaaatcattaaagaatggcagccggatttagtggtggtgggtttgcctcttaatatggacggtacagaacagctagtgactacccaagccaaaaaatttgctaatcgcttacatggacgctttggcgtacaaatcgccttacatgatgagcgccttagcacagtagaagcccgtgctcacctttttgaacaaggggggtatcgctctttagataaaggcagtgttgatgcaacttctgccgttattattttagaaagctggtttgaacggcagtattaa

SEQ ID NO: 940 - DNA, 987 bp, Proteus mirabilis
ataactggaactggcacaattatgagtaaacctattcagatggaacgcggcgtaaaatatcgtgacgccgataaaatggcacttattcctgttaaaacaatcgttacagaacgtgaagaactgctacgcaaacctgagtggatgaaaataaagttgcccgcagattcaagtaaaattcaaggtattaaagcggccatgcgtaaaaatggcctgcattctgtttgtgaagaggcttcatgccctaatcttgcagaatgttttaaccacggtaccgcaacctttatgatcttaggggcaatctgtacgcgtcgttgcccattttgcgacgttgctcatggtcgtcctaacgcacccgatccccaagagccaattaaattagcccaaacgataaaagatatgggattacgttatgttgttatcacctcagtagatcgcgatgacctacgcgatggtggtgcacaacattttgccgattgtattaccgctatccgtgaaaaaaatcctaatattcgcatcgaaactttagtccctgatttccgtggtcgtatggataaagcattagagatcctcactgacacaccaccagacgtctttaaccacaatttagaaaacgtacctcgtgtttatcgtcaagtgcgtcctggtgcgaactatcaatggtctctaacgttactagaacgctttaaacaagcccacccaaatattccaactaaatcggggttaatggtcggtttaggtgaaacaaatgaagaaattattgacgtgatgcgcgatctgcgtaaacatggtgtaacgatgctgacattagggcaatatttacaacccagtcgtcaccatcttcctgttcaacgctacgtcagtcctgacgagtttgaatatatgaaagagcaagcattagcaatgggctttacccacgccgcttgtggaccatttgttcgttcgtcttatcatgctgatcttcaagctcaagggattgaggttaaataa

SEQ ID NO: 941 - DNA, 729 bp, Proteus mirabilis
agcgctctgacccaaaggagatatacgatgaaaactcgctttcgtactcttattctggcttgcgtaattgcaagcccactggctcatgctggtattcccgtcgctgttgatgctgaccctatgcgggacgtgcagtgggcgcaggagttaaaacgctggatggaaacggccagacactaccagtcacaaatacaggcatataaagaccaactggcgacggccactggcgttcgtgatattgctgattttgtagatcaggccaaaggcctgaaagctgaccttgaaaagctgcgtaagcccggacaggctctgaatgatttacttctctccggcggttcctccgggcagttcgatgcgttgtacgagaagtataaaattttcgacacctgcaacacggcacaatcggggagttatgccaacgtatgcaagcagcaggtcatcaacaaggctattcagcttgagcaaaccgacgaggttcagaatcaggtaagccagaccctaggggaaatcaacagcctctccaacagggtagcgttagccaaagattcgaaagaatctcaagaccttgcaaacagtattcagctaaaatctgtcatgctgaacacgcttaccacccagtgggaaatgagcgtgaaagcagcagagaagcgcgaaaatgcgcttgaagcggagcgtgttaagcagtggaatcaacaacaattaaatgctcccgatataaactttaattaa

SEQ ID NO: 942 - DNA, 453 bp, Proteus mirabilis
atccgcatgaccgacaataataaagcgttaaaaaatgctgggttaaaagttacacttcctcgcttaaagatcttggaagtgctccaggatcctgagtgccatcatgtcagtgctgaagatctctataaaaaactgatcgatatcggcgaagagattggtctggcaacagtctatcgcgtcttaaaccaatttgatgatgctggtattgttacccgacataattttgaaggtggtaaatcagtatttgaattaactcaacaacatcaccatgatcacttaatttgccttgattgtggtaaagttatcgagtttactgacgatgctatcgaagttcgtcaaagaaatatcgctgaacgccatggcatcaaactttccaatcatagcctgtatttatatggtcactgcgccgcaggtaattgtaaagaagatagccacgcacatgatgagaagtaa

SEQ ID NO: 943 - DNA, 1248 bp, Proteus mirabilis
aaaatgatgacaacatccaacaatgcgatcctatctcaattagcacaaacttatggcacgccattatggatctatcaaggtgagactatttctgaacatattgagcaattaaaagcctttgatgtggttcgttttgcacaaaaagcctgctctaacattcatattttacggttaatgaaacagcagggcgttaaagttgattctgtctcactaggtgaaattgagcgggcgttggttgccggtttccaaggtggtcgcgagcgtagtgaaattatctttaccgcagatttactcgatgaaaaaacgattgaacgtgtggttgaattagatattccggttaatgcaggttctattgatatgcttcgccaacttggagaacgtcatcaagggcacgcggtgtggataagaataaatcctgggtttggtcatggacatagccaaaagaccaatacgggtggggaaaatagcaaacatggtatttggtatgaagatgtgccagaagcattagcggtaattaatcaatacaatttgagtttggttggtttccatatgcatattggctcaggggttgattatcagcatttagcgagtgtctgtgatgcaatggttgagcaagtactcacctctaatgttgatattaaagccatctcggccggtgggggattgtcaacaccttatcagcaaggagataaaagagtcgatttaaaccactatttctctttatgggatagtgctcgtcaacgtatagcgcaacaccttgggcatgatattgaactggaaattgaaccaggacgctttttagtggctgagtctggcgtgttagtgtcacaagtaagggcggttaagtcgatgggaaatcgtcattatgtgctggtggatgcagggtttagtgatttaatgcgcccagctatgtatggtagttaccatcaaatcacattattagataaatacggccaattaaaatctagcgagtttcaacaagaaaccatagttgcggggcctctttgtgaatctggtgatgtgtttacccagcaagaaggaggaatggttgctcctcgtttattacctccggcagaagttggtgattacttagttattcatgatacgggggcttatggtgcatcaatgtcatctaactataatagtcgtccccttattcctgaagtgttaatttcacagggcatacctcaattaattagacgtcgtcaaaccattgaagagctattagcgctagaaattaacctgtaa

SEQ ID NO: 944 - DNA, 1380 bp, Proteus mirabilis
cggtggatgaccaacgctagtgaggctattttgagtaatttatcactcgacttttcacaaaatgaatttcaacctctggccgcgagaatgcggcctgaaacattagaacagtatattgggcagaagcatctactcgctgaaggtaaaccgctaccacgggcgataaaagcaggccaattgcattcaatgatcttatggggacctccgggtacaggaaaaaccacattagctgaaattatcgggcgctatgcccaagcggatatagaaagactttctgcggtgacgtcagggatcaaagagatcagggccgccattgacatagcgcaccaaaatagaaatgcggggcgtagaaccatcctatttgttgatgaagttcatcgttttaataaaagccaacaagacgcttttttgccacatattgaagatggcactatcacttttattggtgcaacaacggaaaacccttcttttgaattaaattcggcactgttatcacgtgcacgagtttacctgctacgctcattgacagaaacagacattgaacaggtattacagcaagcattagatgatactgaacgtggattaggtgggcgtaatattattttacctgataatacacgcaaaatgattgctgaattagtcaatggcgatgcgcgccgttcactcaatctgcttgaaatgatggctgatatggcagaagtcgatagccaaggcaaacgaacgctaacagcggaattattaaaagaaattagtggtgaacgtagcgcccgttttgataataaaggtgatcgattttacgatcttatctctgctttgcataaatcagtacgtggctcggcacctgatgcagctctttattggtatgctcgtatcatcactgcggggggagatccactgtatgttgctcgtcgcttactggctattgcttcagaagatgtcggtaatgcagatccgcgtgctatgcaagttgccatcgctgcatgggattgctttacgcgggtaggccctgcagaaggtgaacgtgcgatagcacaagcgattgtttatcttgcttgtgcgccgaaaagtaatgccgtgtataccgcttataaagccgcactggcagatgcgaaaagtaaacctgattatgatgtacctgcacatttacgtaacgcgccaacgcaattaatgaaagagatgggcttaggtgcagagtatcgctatgctcatgatgaacctaatgcttatgcggcaggagaggtctattttcctgctgaaatggcacaaacgcgttattatcaccctgttaatcgagggttagagatcaagcttgctgagaaattagactggctttctcagcaagatcaaaatagtgtgacaaaacgctatcgcaaattgtaa

SEQ ID NO: 945 - DNA, 333 bp, Proteus mirabilis
ttgatagtgacactacaggtgatgtcatataatatgtctagaacacaagatgtaattaattatctaaagagtaagaagaaagctatatcttgtaatggaagcaaaggattattgctacaactcgaatctttgggttttgaacataaagaaggcaaaacggtaggacaccgtatattcatacaccaaagattgagctctatgtcagattacaaaacacattcagtggattgtggtcacaagccaaatagagagatgaaatcagcatacataacaaatacgttacgtgtgcttaataagtacaaggatgaacttgaggagatagagagaaaatga

SEQ ID NO: 946 - DNA, 2100 bp, Proteus mirabilis
caaaaagtgacaggtagtatgaaaaaatctatttttaattatacaacattttttatttcaatgagttattccttatttgcaaatgcaagccctgcaataaaatcaactgaaaatcggaacaatgaggtattagaggtctattcaacacctttgcatactccgcaagagaaaatggcgatccccgtttctgttctgacacaagaagatctacgcgctaatcgtagtgcctcgattgctgaaaccttaacatccttaccaggttttcatgccagcttttttggtggaggctcagttcatccagttattcgaggaatgtcaggcaatcgagtcaaggtattacacagtggcagtgatcttatggacgtctcctctattggtgcagatcatgcaatcaccagtgaaccctttttaagtcaacgtattgaagtattaaaaggcccttcaacattactttatggaggaggcacaataggcggtgcaattaatgttattgatagcaagattcctgtgtcagtgcctgaaaaaggctacgagggtgaattgcattatcaatacgattctgtttctaaaggaaatacaggatcagtaggattaacgttaggagaaaataatttagcgcttcgccttgaaggtactaaacgttatcaaagcgattacaaacaaccagaacctttacatcaaggagaaactagccgtttagcaggatcttatcaagataaccaatcggcaaatattggtgtatcctggctcttcgatgacggttatatagggattggctatggtgaacaacatcgtcgatatgggctgcctggtcatacgcattttcatgatcatgaagatgatcaccaccatcacgccccaattcgacctcctttaatcggccatcatcatcatgatcacaatcatgaataccctgatgaacaacataaacatggtactccttatattgttatggatagcaaacgatgggatcttcgtggtgaaaaaaacaatccattcaccggtattgaatcaatacgtttcagtgcagcccgaactgattatcatcatgatgaaaaagaaggaaatgaagtcagcaccacatttaaaaacaaaggggatgaattaagactgacatttatacatcaacctattttgggttggcatggtgttattggagggcaatttaatcagcgtgattttagcgctcaaggtgaagaagcttatgtgccttcaacaaaaacaaaaaatcactctctctttttattagaagaatatcaatttggtgatttccgttatgaattaggatttcgtcaagaatggcaatcactattaaattgggaaacccaaaaaaattataaacagagcggatcctctatttcagcaggattagcatggaatttcacacaagattactttttaaacttatcactttcacacacaaaaagattacccgttgctgaagagttatatgcaaatggtgttcacgctgcaagccgtactattgaaaaaggtgattctcatttaactgcagaagcggcaaataatattgatattggggtaaccaaagcaacaggtgatattcaatttaatgttaatacttattataatcgtattaataactatatttatggcaagtttacgggtgctgaattaaataatggatatcgaccattacaatatgtgcaacatgatgcagagtttaaagggatagaaggtaatatcgattattactattatcaggatagcttaatcggtttttctggtgattatgttagcgctagtttactgcacaataaaggaaatattccaagaatacccccttaccgattaagtgcttatttaaaacactacttaacagaaaatctcagtgggcaaattcgtattgaccattttgggaaacaatctaaaacggctgaatatgaaacatcaacctcatcttataatacagtcagcttaagcagtgaatataacggctatttagatcaacttgattataccctgtacgctaaaatcaataatatttttaatgaaaaagggaaggatagcacatcttatattaaagatgaaatgtatttaccaggtcgtaatattattttaggtgcaacactaacattctaa

SEQ ID NO: 947 - DNA, 333 bp, Proteus mirabilis
aaaaaggtgacccttttgcaaggctcagaattacagcaatttattattgataaacttgaggattctaaagctcaagacattatcgcattagatgttcgtggaaaatcaagtgtcactgattacatgatcatctgtacgggaacttcaaacagacacttaatgtctgtcgccgataatctggttgatgactgtcgtgaagcaggattacaacctttaggcatcgaaggacaaggcgtttctgattggattgttgttgaccttggtgaagccatggtacacgtaatgcaagaagacagtcgccgtatgtacgaactcgaaaaactctggagctga

SEQ ID NO: 948 - DNA, 195 bp, Proteus mirabilis
ttaacttttgcaacggctatatctatatcagctttagcttctaataactcaggcgcattatttaatgaattatttaatatatactttaaagagtttgcatgtgaattaaataatacacctcctaaaataacaaacgttattattttgagtttatttatagaaaacacagatattacctctaataagaaaatataa

SEQ ID NO: 949 - DNA, 666 bp, Proteus mirabilis
gagagtattgccgttatgagccaagtgttagaggttgaaaaacaattaagaaaactgatactcaacatggaactaggcccaggagaacggttaactgaacgctgggctgaagcgaaatttaacgcatcgagaactcccgttcgagccgcattacaaaagttggaatcagagggacttatatgtcgtgatggtatacgttggttagtggcaccaatcgatgccgatgaaatcgaacaattatgtatttaccgagaaatactggaggtagcagcattaaaactttcagtcagccagatcaccgaagaacagttgaacaatttggaacgcctgcttaaagaaaccacggtagattcaccagaagagagcatggaaaatgctggaacacgattccatagagagttggcacgcctttgtaataacgcatttattattgaagggataaatgatgccctacgtaggctttcgcgagcacgatggcttgatagagcgccgtctaatccagcgtgggatgagcatcgtgaaatatttgtcgcacttcgttcgagagatacggacaaagccgtagaactactcgccactcatttgtgcgaaagtagactccgtttactagataccattacatctagtaaacgtagcctaagagcaagaggcattgcgatatcctga

SEQ ID NO: 950 - DNA, 2016 bp, Proteus mirabilis
agtgccattgcacattttggggtttatatggaaaataaaggaactttatttaaatctatatcttttgtagcggctacaatggtaacagtaagctctgtagctgccacagaacagcatgataatacaataactgttactgcaactaagcgcattcaaagtagttttgatgtaattggtaatgtgaatgttcaaactgatgaacagttaaaaaaatctttagttaatcaaactgatgatttgagcgcagtttttcctgagttgttatctgcaaaccgaagttcgcgtatttataacaatatgactcttcggggccaatcttcggccgatttcttttctccgagtttgggactgtttgttgatggtgctccccagctttctcaatcgtatgctcaatctcttcaaggggttgagcaagttgagctacttaaaggcccacaaggagttatttatgggcgtggcacattgggggggattatcagtgttattaccaaaaaacccagtagtcacgctgaagcatggttaggggggcaatattttggtcaaggggaaagaatcaatacaggaggaagcactggctacatggaaaacggctgggcttttcaggggaatgttagtctcgatagaaataatggttctttgaacaatccagcatgggataaaaaaaatgttgatagcagagatataaaagctggatggttgtctgctaattatatttcccctgatatattatttgagtctaatttaaaagtaggtggagaaaattaccattctcatgaggaatattttgttcctttttcacctctttcacgttcaaaaattgatactgaatggttatatgaaacacctaatcttaaacgtaaattaaaaaacatttcctggaatacaggttatgattttaatgatgaatggaagtttaaaacgatactttcttatcaaaatatggatatagatagattgtttatggacgggacgttacaagatgattctcaggatattttgtattcagaagcaagagctaattatgaggggggggatctaagtggaattatagggatatcatttcaaaagatgggttatagacatgataatttatctgtagggaaagtcggaatgggaggaaaaaaatctgataatgatatttataattactctggatattttgatggtgcatacaggataaatgacaattgggagttaggtgcaggggctcgtttttctcacgaaaaagcaaaaactcgaatgattattttagaaaaaggaaaaggtgagtctaattataataataatgcagtttttaatgcctttattccacgagcaagtatcgcctggcttccaaatgagcagaatcgtatatggtttggagttggccgcggttttaaacctggtggttttaacaaagaaggggctgataaactagctctgacttcttataaatcggaaactgccacggaaatggaattaggttggaaatggcacagtgttaatgataaccatatggccgaaattactttatatcaaatagatagtaaagatgttcaaggatatgtaggtgttattggttatcaggcattatctaatatgggagattcaagaagtcgaggaatagaatatctttggaaatcaaagcttacccctaatcatagtatttcactgggtggcatgttcaatcaatcagagtttaccagtggagaacataaaaataaaagacctgcttatactcctagttatagttcattaatttcatgggatggtttatatggcaaggagcaaaagtggtcttctcggattgcagtcagatttaatggaccattttactttaatgagcaaaataatttagaacaagggcattatactgttgttgatgcatcaatatcatggcaccctacaaagcaatatgaacttggtatctatgcgaaaaatattggtgatactttatatcgaacgtatgcatttggtaataaagcacagctaggtaacccgagagagatcggggttcagggaagtattaacttttag

SEQ ID NO: 951 - DNA, 1686 bp, Proteus mirabilis
aattattctgccactatcaataataatttattgaaaaattccgctaaattgctcattattcccaagtcggcatatgccgtctttatagaaggtaaaacaaactgtatggaatggatcgtagatccgacgatatgggtaggtctttccacccttattgttctcgaaatcgtacttggtattgataaccttgtttttattgctattctagcagataaactcccagcaaaattaagagataaagcacgtatcacaggattattgtgtgctcttattatgcggattgtactgctatttagtctctcttggcttatcaccctaaccaaacctcttatcacactgtttgatcatcctttcagtgccagagacttaatcatgctcctcggagggatattcttacttttcaaagccacaatggagcttaatgaacggctagaaggtaaagatcataacgagggaaaacaacgtaaaaccacgagtttttggtctgttgttgcgcaaattattgtactagatgctgtattctctctagactctgttatcactgcggtagggatggttgaccatctcggcgttatgattgctgctgtaactattgcgatgttcttgatgatcctcgcaagtaagccattaaccacatttgtcaataatcacccaactattgttattttatgtttaagcttcttattgatgattggttttgccttagttgcagaagggtttggctatccaatacctaaaggctatttatacgctgccattggtttctctattatgatagagatatttaaccaactcgcacagtttaaccgtcgacgcttcttatcagcttctcgctctttgcgtgaacgtacagcggaagcggtattgcgcattattaatggtaaaccagaagcctctgaacttgaccctcacacttctgatttagttgctaatacagaagaggtgtttgatcctcaagagcgccaaatgattgtgcgcgttctgggtttaagccagcgaaacgtcaatagtattatgacttcacgccatgatgttgaatatgttgatctaaaagccacccaagatgatattcgccaattactagaagaagatccccattctcgtctcgttattaccgacgaagaaaatagcgacgaacctattggcgtggtaaatgttattcaattattaaatcaacagttacgtaatgaaccattagatttgcgtttattaattacacaacccttaatcttccctgaggggttatcactattacaggcattagaacaattccgtaatgctcatactcactttgcctttgtggttgatgagtttggctctgtcgaaggcattgttaccttaaccgatgtaatggaaaccatcgccggtaatttaccagtaagtacagaggaaaatgactctcgtcacgacttagtacaaaatgaagatggctcatggaccgtcaatggttttacaccactggaagacttggtgctttatattcctattaagttggatgaaaaacgtgagtatgaaaccttggctggcttattgatggaacacttacaacgcgttcctgccgtcggtgaaaaagtggttattgatggtattgaatttgaaccattagatgtacacaatcaccgtattaataaagtacgtattgttgaaccaacacctgaagacgaagaaaacgtcgacgaagcttaa

SEQ ID NO: 952 - DNA, 834 bp, Proteus mirabilis
tatagctctgctattttctctctgttatactttccttctcttctcggactagcatatgtatttatgggattaataattcaagagcaatgtgttattgttgatcataattgccccgactggctaataactcagtctgaagggaatccaactattgattatacagatggcttaaaagtttatgctatttttaaaagacaattcctttcaggtaaaagaagacgtaatagaaaacaacgtcaactgggggataattgtcctttaatttatgctttgaaaaaaaaggatgatttatatacaaatatttctagcataaaaaaactcaatgatagcttcaaaatcatttgcaataaacttatggaattagaacctaaagggtatcaactaataatatcaatgccttcagcccataatattagccctattatcgcaaaacgtttagcaaaaaaatttaatgccacatatttaactgatattttaagaaaaataacagtcgataatgcttttcaacttctcgataaagcagatattaatattgaagaggctaaaagtcttagtttcaaaattaaattacaagcaaaagaagttggacttaaaggagggttttcactaaaaagtatccctactgaatttaggaatatatttccaccatttgttttaaacacacaagcatcatccaatactgaaaaaatcagaatattacttgtcgatgatcttatggctacaggaacaacattaactacagctagggatatcattgcacaacagtatccaaatgccattatacatgctatctgcctattcagttcaataaaaaaacaaaacaaaaaaacttga

SEQ ID NO: 953 - DNA, 495 bp, Proteus mirabilis
gctggctctgctaaggagggttgcgtgactcagattctagatatgtgctgtggtagtcgcatgttctggtttgacaaggaagatagccgagcaatttacagcgacatccgcgcagagaaacatattttatgtgatggcaggaagttaaatatcacaccagacattatcgctgattttaaaaatctccccttccctgacggctcgttttatcaagttatattcgacccgcctcatttaattagagttggccacaacgcatggatgtttaaaaagtacggacgattaaataaagaatcatggaaagacgatttatcaaaaggatttagtgaagcatttagagtgttgaagccaaacggaacattggctttcaagtggaatgaaacgcaaatacctaccaagcaagttttagcgctaactgaccaaaaaccaacaatagtccagcgtgtcggcaagaacgataaaacgcattgggtgctgtttattaaggaggcgtga

SEQ ID NO: 954 - DNA, 1731 bp, Proteus mirabilis
tttaagtctgcttattggattatagtaggtcaatatgcgttttgctttgaggaaaaaatgaccatgaatgaggcagatgcccgcccaacgaactttattcgtcaaattattgacgaagatctggctaccgggaaaaataatagtgtccatacccgtttccctcctgaacctaatggctatcttcatattggccatgcaaaatcaatttgcttaaattttggtattgcacaagattatcaaggtaaatgtaatttacgttttgatgatacgaatccagtaaaagaagatgttgaatatatcaactcgattcaaaaagacgttcagtggttaggtttccaatgggatggtaacgttcattactcctctgactattttgatcaactgtatcaatatgcgattgagctgattaacaaaggcttggcttatgttgatgagttgagtgctgaagaaattcgtgaatatcgtggcacactcaaagagccaggaaaaaatagcccttatcgctctcgtagtgtagaagaaaacttagcgctatttgaaaaaatgcgtgcgggtggctttgaagaggggaaagcgtgcctacgtgcgaaaattgacatggcatcaccatttattgtcatgcgtgatcctgttctttaccggatcaaattcgctgaacaccatcaaacaggtaacaaatggtgcatttatccaatgtatgattttacccattgtatttctgatgcattggaaaatatcacacattctttatgtactttggaattccaagataaccgtcgtttatatgattgggtgttggataatatcactattccttgccaccctcgtcaatatgagttctcacgtcttaatcttgaatataccgtcatgtctaagcgcaagctaaatcagcttgtgacagaaaatattgttgatggttgggatgatccgcgtatgccgacaatttctggcttacgtcgtcgtggttatacggctgagtcaatccgcgaattctgtcaacgtattggtgtgaccaaacaagataacaacgtggaaatggcatcattagaagcttgtattcgtgatgatttaaacgaaaatgcacctcgtgcgatggctgttatcgatccggtacgtttagtgattgaaaatatgccagaaggtgaagagattttaactgcgccaaatcacccaaataaaccagaaatgggaactcgtgaagtaccatttagccgtgaaatttatattgatcgtgcagactttaaagaagaagccaatcgtcaatataaacgtctggtattaggtaaagaagtccgtctgcgtaatgcttatgtcattaaagcagaacgagttgaaaaagatgaacaaggtgaaataaccaccatttattgtacttacgatccacagacgttaaataaagatccggctgatggtcgtaaagtaaaaggggtgatccactgggtaagcattccacatgctattccagcagaaattcgtctttatgatcgtttatttagcgtacctaatcctggtgctgaagaggatttcttatcaaccattaaccctgaatcattagtgatccgtcaaggttttgtggaagcaagcttaaaagatgcggctattgaaaaagcgtatcaatttgagcgtgaaggttacttctgtgctgataagctttcgacagcggataaactggtctttaaccgtactgttggtttacgtgatacttgggcgaagatttcgaaacaaggttaa

SEQ ID NO: 955 - DNA, 285 bp, Proteus mirabilis
ccatcaactgccattgggcgatctttaatcgcatgcatacccaaaatagcactttgtggtgggttgataatcggtgttgacattaatgagccaaaaacaccaccgttagtaatagtaaaattaccgcccgttaaatcttcaacggttaatttaccatcacgacctttcactgctaatgctttgatatttttctcaatatccgccatgctcatcgcatctgcatcacgtaataccggtgttaccagaccacgcggtgttgatactgcaatactgatatcaaaatag

SEQ ID NO: 956 - DNA, 846 bp, Proteus mirabilis
gtaattgatgcaaaattaataattataaagtatctgttggacagacagatcagtgaagtttggggcagccgttccctgccccattttttcaccggaggtgaaatcatgtcgattgattgggattgggggatattcttccaagaagccccttttggaaataccacttacttaggttggcttatttcaggctttcaagttactgtcgctttatctctttgtgcttggatcattgcttttattgtcggctctttttttggtattttacgaaccgtacctaatcgcttgctctctagtttaggggctatctatgttgaactatttcgtaacgtccccctgattgtacaattcttcacatggtatttagtgatccctgaactcttaccacaagctattggtgattggttcaaaatggacttaacgccgaatatccaattctttgtctcttcagcactctgtttaggtttgtttaccgcagcgcgcatgtgtgaacaggtgcgggcggcaatcaattcattaccaagaggacaaaaagcagcaggcttagcactaggcttaacactgccacaaacctaccgctatgttttattacctaatgcttatcgcgtcattattccgccaatgacctctgaaatgctgaacttagtcaaaaactctgcaatcgcctcaacgattggcctgattgatatggctgcgcaagcgaataaattattagattattcagctaaagcttatgaatcctttaccgctatcacgctagcctatgtctttattaacgtcattattatgttgattatgcactggttagaaaaacgggtgcgtttacctggcacagcaggaggtcaataa

SEQ ID NO: 957 - DNA, 300 bp, Proteus mirabilis
aacaacatcgcctgttgtcttaaggattacattatgatgaaaacaaaattaaacgaactattagagttcccttgctcatttacttacaaagtcatgggtcatgctaaacccgaattagttgaccaagtcgttgaagtgatccagcgtcatgcacccggtgattatacaccttcagtaaaaccaagtagcaaaggtaactatcactcagtctctgtgactatcaacgcaacgcatattgaacaagtagaaaccctctataaagagttaggtgaattagagcttgttcgcatggtgttataa

SEQ ID NO: 958 - DNA, 240 bp, Proteus mirabilis
ccgaggatcgccctaacatcaacactctgtttttgcggatccattcctaaaattttgatctcaccagcatcaggttttagtaatcctgctagcatgcgaattagggttgtttttcccgcaccatcagggccgacaagacctgtgactgaaccaccggtaatggtggcggtgagtgaagcaaccgccggtttttcaagcccaacaaagcgtttttcaacaccgcttaaattgatggtgtaa

SEQ ID NO: 959 - DNA, 1029 bp, Proteus mirabilis
aaaatgaccgctaagaatatttccctcgaccgctataaacagcgtttctttggcgactttctggagcttcccggtctgacggagatcgccgtcaaccgtccaagtgagctgtataccaaaatcaacggcgtatgggagcagcacgccgttcctttgtcctatgaggattgctacaactttgcccggtgcctggcaaagcaccacggcgacaatatcgaagatattaagccggggctgtcagccacgctggaatctggcgaacggtgccaggtaattgttccccccgcctgtgagcgcgatacggtgtctatcaccatccgtaagccatcaaaggtacaaatcccgcatcagtcgtatatcaatgcgggattttataaccgggtaacaggcgaggaaaaaacggagacgcacgacgaggaattaattgcattgtacaatacaaaaaatattcctctgtttatggagaaatgcgtcgggtacggtaaaactctggcggtcgccggggaaaccagcaccgggaaaactacctatatgaaaatgttgataggttatattccggtacatcttcggatatcaacaattgaggacaacccggaaatcacgttctttatccataaaaactacgtccatctcttttatccgtcagaatcatcagatgaaaaaggttctgtcgttaccccggcgagccttttacgctggaattaccgtatgaaccctgaccgtattctgttaacagaagtccgcggcgcggaagcctgggattttctcaaaataacaggttccggccatgaagggagtatgacctccattcatgcaggatcagcgaaagaagctatagacgggtttattacccgttgctacgagaatccacaatgtgcccagctcccctatacatttatgttacgtaaggttctggacagtctggacgtgattgtgagcatcgatttggacggaaatgtccgccgcatgaatgacatttatttccgtccaatccatcgaaatcaatattttgaggaaatgaaagcatga

SEQ ID NO: 960 - DNA, 198 bp, Proteus mirabilis
gaagaagacgctccccagataaatgcagcgcttatcactgttattgctatctgttttcctgtcattttcttaattaccgattttttaagtgattctaaaaaaccaccaatgtttatctcaattatggatgagccttcatcaatagttataaccaactctatcgattctaactcttttttcgataaacgcttgttttga

SEQ ID NO: 961 - DNA, 306 bp, Proteus mirabilis
caaccggacgccattcctcgatggggtctggttgttttgttaactaatgaggatgttatggtaacaattcgtttagctcgtggcggcgcaaaaaagcgtccgttttaccaagtagtcgtgaccgatagccgcaatgcgcgtgatggtcgttttattgaacgtgtaggtttttataacccactggcaaccggtaatgcagaagaattacgtttagacgtagaccgtgttgaacattgggttgctcaaggcgcaactgtttcagaacgtgttgctggcctgatcaaatcagcgaagaaaagcgcttaa

SEQ ID NO: 962 - DNA, 585 bp, Proteus mirabilis
gaccgaggcgctcgcagaaagtttcatgttctcttaaaaatatttaaaaattttcttaggaggttttttatgccgttattggatagctttactgttgaccatacacgtatgtctgcacctgcggtacgcgttgctaaaacgatgaaaacaccctctggtgatactattaccgtttttgacttacgctttactgtcccaaataaaaaagccatgcctgagaaaggaattcatacgttagagcacttatttgcaggtttcatgcgtaatcacttaaatggtgaaggtgttgagatcatcgatatttcgccaatgggatgtcgtacaggcttttatatgagcttaattggtcagcctgatgagcaacgtgttgctaatgcatggaaggcagctatggaagatgtattgaaggttaaagatcaaaaccatattcctgagcttaatgtctaccaatgtgggacttatgaaatgcactcgttagctgaagctcaagatattgcacgagatattttatctcacactattggcattaatcataatgatgaattagcactaccagaagacaaactcaaagagttacaaatctag

SEQ ID NO: 963 - DNA, 321 bp, Proteus mirabilis
gtgaatttagctagtgcatccatagattcaattcctatgcctacattcctcatcacagctctcctaataattgtgtttacccgttacttcaacgtgttacttaacgattacgtcagcaaggaaaagcttatgagtaaattattccgccatatagtactatatgcatcttgttttattgaaaccgtatgggcagggatgataagtgtggtagtgggtctgatgactgccggtgtccaaattactttggcactagctaaattttctcgattttttatttttcacctaaagcaaccacacccaaaatattatccaatatactaa

SEQ ID NO: 964 - DNA, 564 bp, Proteus mirabilis
tactgggtagcaatgaaaaagatagaaattgatgacgaactttaccgctatatcgctagcgaaactagacatatcggtgaaagcgcttcacatattttaaggcgtctattgaagcttgatgccaaacagcccgtacagccagtcgttgtcactgagtcagtacaagcgcctgtcgttaaacaggatgctgatcttaagcctgtcgcaccagcaaaaaatccggtccgtgaaatgcgtgaactgctgttatctgatagttatgcagagaaaacaaaatcagttgatcgttttttacagatcctgtctacattatatagcttagatagtgctacttttactcaatctgctgaaacagtacatggacgcacgcgaatttattttgccggtgatgaaaaaacattgctcgacagtggacgtcatacaaaacctcgccatattcccggtacgccattttgggttattaccaactcaaatactgagcgtaaaagaactatggtacaaagcatcatgcaggatatgcaattccctgccaatgagattgataaagtgtgtggaactatctaa

SEQ ID NO: 965 - DNA, 1122 bp, Proteus mirabilis
gaaggatatttcatggcttttttcctaactaaaaagcaagggaagattatagctgctattttgatttttattgccataggcttattttttttctggccgaaagagcatttacctagttatcaaacacaaaaaattactcgtggggagctttccaaagaagtcacagcaacgggcaaattagatgcggtacgtaaagtcgatgttggtgcgcaggtgagtggtcagctacaaaccttatatgtaaaagaaggggatgtagtaaaaaaaggcgatctgctggcgattattgatccgaaaaaagcacaaaatgaggtcgcggaatctcaagaaacgaataatgaactgacggctaatttacagcaagctaaagccgaattacgtttggcgcaattgacttatcaacgtcaattaaagctgattggcacacatgttatagcccaagaagagcttgatcgcactaaaacagacgttgaagtcaaaaaagcgcgagtggcgacttatgaagcacaaattagaaaaaatcaggcaacactggataccgcaagaactaatttgcaatatacccgtattactgcgccgatggatggtgtggtcacttttatcaaaacccttgaagggcagacagtcattgcagctcaagaagcaccaaccatattaacattagctgatttagataccatgttagtaaaagccgaagtttctgaggcagatgttatctatttaaaacctgatctcaaagcctcttttactgtattaggagcaccagacaaagccttcaatggtaagttaaaagatattttacctacacctgaaaaaatcaatgatgcgattttttactatgcacgttttgaagtccccaatgaacaacatttgttgcgtttacaaatgacagcacaagttaaaattctccttgagcataaaaaagatattctcttagtgccattgtcagcattaggggaagatgtaggcataaatgaatatcaagtagaggttctcgtcaatgggcagcctgaaaaacgcgtagttaaaatcggtattcgtacagatgtttatgcagaagtcattagtggattaaatgaaaatgatgacgtgatcctcggtgagattgcaggagagtcataa

SEQ ID NO: 966 - DNA, 792 bp, Proteus mirabilis
gcaatgaaagcgagactaaaaaatgcgcttgcactactagaatgtcatgatgtagagacgctagctgttcaatttctaaaatatagcttttttcgtagctcactgagtgggttaattatttcgttaatgaataaagctgaaaataaattggaaagttggaatatcgacttaacacttcaagtgcaaagccattttttagataccgatattaccgatgcagatcaccctttaattcaactgctatttaagggtgaacctgtattttggcaaaacttacaacaaggtagttatattaataatgctgctatgcgcggttttatttcacagcttccggtgaacacaggattgtatagtttgcctatctatgatgttaaccataaagcatgtggcacgattattcttttagggcaagctgaagagctagaaaatatcgagcaaggtattttccctatttattgtgaactatttaatcatcaattaaagcatctttttgaattatcaaatatgcaacaaaaaatctcttacttgcaatatatcaatcaattacaaagggaaaaagaaaccacgcttaatgaaacgttagataaattaaccgcatctgtagcgactattgcacttcctaccatacaaatcaaaggagttaatgatttagaagttgctatagaaaattatgaaaaagaaattttattagataaacagcaagaattgaaaggagatattaacgccatggcagaacagcttagtatttctaaacgagcgttaatatataaattgaagaaatacggagtataa

SEQ ID NO: 967 - DNA, 360 bp, Proteus mirabilis
agccacagagcaccgttgtcactggatacaatggcacgttggctcaatctcaggctacgtgggttgttgtactatggacgcttttgtcaatcagtaatggattatgtagccagacatatcgatctgtaccttgctaaatgggttgcccgtaaatacaagaggggacacggtagtctggttcaggcgtatgaatggttagacaggatccggaatgttaaacccagtttgtttgcacactggactatttgtacgcgatgttaccagtcaactacaagagccagatggcgggatactgccacgtccggctccgtgggagtgcagggggaaagttcccctgcacgacgcggtaaccccatgtaa

SEQ ID NO: 968 - DNA, 768 bp, Proteus mirabilis
tctgtgagagctgaaatgcttattcataacgttgcagaaaggaaagaagccgcaaacagaaaaatgcttgcattgctgacattccttaaagaagaaacatactccgattttaaaacgctgaaaaaagttgttgggttcaaaggtaaaagtcaccgcccaacgtatgcgctactgaataaagcggttgcattgggatttctgataaaacatgaatacccggtaatagccggaaaaaaatcactatgggggatcaccatgcaagggctggcgatggtggttaaacctgatgataaagtattccccggttattttgagccggggaaactcaaataccggacgctggaacaccggctcctgaatcatcgggtcagaattgcactggaagaaaaaggcgggcaaggctggcttaatggtgatcggggggagtttatagcacgttatcctggcattcgccatcgtcctgacgggattatcacgttagatagcggcgcaatcgttgctgtcgaaacggagcgctcaatgaaaacccgcgcacgctatatcaacatcattaacagccatctggcggccagcgatgccggacgctggcactacgcaatgtatgtcatgccggatgacaaaaccaaaacatcgttaatccggctgtttgactccatcaaaacggtaatgaggaacaacgttccggtgccgttcgacgcgaagaacagcgaaatgtttcttttccgcacgatagctgaactggaacaggccccctgcagtcacaactaa

SEQ ID NO: 969 - DNA, 750 bp, Proteus mirabilis
caaaatatggctggtaccaatatagaaggccatatggcatatcgtattaatagtaatttggtaatgaccattgatactcaaatgttgaattgggtaaatataagaggatctgtttgtgaacaggctacaccaacattaactgctcatgccagtgaatttactgtacaatttccaatcagtgtgacattttatataaatgatatggttattgattctcagctacctatacctgaaatggatctaggaggttatgttcgtgcatttacacgatcaggaacgagtcctcctcaaaattcttgggcattgaatgatgtcactgttcctatgcgattagcagcatcacaattaaacgtaacttcttcttgtaaaacagtaacaagtacaggacaagtaagtactttaaatttaaagcatgggcaactcaatacattaaattatgacagcttagttacagaaagtgtaacttataattgtgttttttcaaaagcaacaaaagtgagattacgtctcgattatataactgataacgatcctcaaaaaagattaccgatggtgagtacccaaaacagcaataataaaatttatagtgaattgaccatgacagatgaaataaccgggcaaaaaggtaaagattttaaaattgacattaatgatttgagaacaattaagataaccagccatcttcaaggaacaaatgcgatagctggagattataaaggttcagcttggctaatcgctacgtttgattga

SEQ ID NO: 970 - DNA, 1383 bp, Proteus mirabilis
attagggaggcgaatattatggttagcgtttttgatatttttaaaatcggtattggaccttcaagctcacacacggtaggcccaatgaaagcaggtaaagaatttgtcgatttacttgctgagaaaaaccttctctcctctgtttcccgcgtagtcgttgatgtgtatggctctttatctctaacaggtaaaggtcacgcaacagatatcgcgattattatgggattagccggtaatttacctgatacggttgatattgacgctatcgcaccttttattaaacaagtcgaaaataccggacgtttgatgttagctaatggtgctcaagaggttgatttccccgcggttggaggcatgaattttcataaaagtaatttacctcttcatgaaaatggtatgactatcagcgcctataatggcgaacaacttctgttgaaaaaaacctattactccattggtggcggctttattgttgatgaagagcattttggtcagcccgaagagaataaagttgaagtaccttatccttatcaatatgctgctgatttacgacgtcactgtaaggaaaccggtctctctctttctgcactggtgatgcaaaatgagcttgcattacgcagtaaagaagagatctcagcccattttgctgccgtttgggaggtaatgaaatcaggtatcgagcgcggtgttaataccgaaggcttattaccgggaccattacgtgttcctcgtcgcgcgtctgcattacgtcgtatgttagtgactgaagataaaaccaccaccgatcctatgacagtggttgattggatcaatatgtttgcattagccgtaaacgaagaaaatgccgccggtggacgtgttgtaacagcacccactaatggcgcatgcggtattattcctgccgtactctcctattacgataaatttattcgcccagtcaacgaaaactcttatacacgctttttcttagtagccggtgttattgggtcgctgtacaaaatgaatgcctctatttccggtgctgaagtgggttgtcaaggtgaagtcggtgtagcctgctcaatggctgcaggggctttaactgaactgctagggggtagtcctgagcaagtctgtattgcggctgaaatcgcaatggagcataacttaggtcttacttgtgatccggttgcaggacaagtacaagtgccttgtatcgagcgtaatgctattgctgccgtacaagcggtaaactcagcacggatggcgcttcgtcgtgtcagtgatccacgtatctgtttagataaagtcatcgagaccatgtatgaaacaggtaaagatattaattctaaatatcgtgaaacatcacaaggtggcttagccattaaagtctcttgcgattaa

SEQ ID NO: 971 - DNA, 231 bp, Proteus mirabilis
tccgcacgggcgatttattatacgcacagcagtttaagtggcttaccggaagcgttgaccaacagtgagggtgaaatagtttggcaagggcaatacagtgcttgggggcatttacagcgtcaaacccgacccacaagcacgtttaaccgtgaacagaacctgcgttttcaagggcagtatttcgacaaagacaaatttgtcgggaacaaatttgaacagcgcttgcgctag

SEQ ID NO: 972 - DNA, 222 bp, Proteus mirabilis
tattttcatttctataccttaattatgagttatttatggcggaggattgtcattggtacagtacttgagctaatgttttcatggaccaatccttcttttgatgcctccttaattacttgttcaattccaaaagtataccaatctctttctatattaaaatttcgtatgactttatcgtcttctatgattttaaaattcatattccaacgaataacttcttga

SEQ ID NO: 973 - DNA, 321 bp, Proteus mirabilis
gtattcaatttggcaatcaatggagtgtatatggcaattaacacaataacggcaagtggaaacttaggtaaagattgcgaacagcgatggacgccaaatggtaaagcggttgcatcttttagtttgccagtgaaacaaggttacggagaacacgaaaaagtatcttgggttatctgtaagatgtttggctctaaagctgaaaagttacctccgcacctaaccaaaggaataaaggttacggttagtggtgagttcatcatggaagaatggacaagccagagtggtgagaaaaaatcagctccagtaattattgttaactaa

SEQ ID NO: 974 - DNA, 198 bp, Proteus mirabilis
ttcataaattttttgaatgataacataaaaaaatcactaggtgcttatctatttacaataagttataaaaatcaatttatcccttatttacttatgaataatagtctatttaggaaaaaatggatcgatttctacgataaaacacgtaataaatttattttacactataatgattctattgttaataataccacttag

SEQ ID NO: 975 - DNA, 1305 bp, Proteus mirabilis
cggagcttttacctgtttatggaatcgttgacattacaacccatcgtacatattgaaggcactatcaatttacccggatcaaaaagtgtctctaaccgtgcacttttattggcggccttagccaagggaaaaacgcgtttaactaatttattagatagtgatgatattcgttatatgctcaatgcattaactgctttaggggtacaatatcaattatcaaataataatacggtatgtgatattgaagggttagcaggttcttttcatccccagcagccacttgagctttttttaggcaatgcaggaacagcgatgcgcccattggcggcagctttaagcctcggagagcacgatattgttcttacgggtgagcctcgtatgaaagagcgtcctattggtcatttagtggatgcgttacgtcaagggggggcaaagattgattaccttgaacaaacggattatccgccgctacgtgtttgtgggggattttcggggggaagcgttgatgttgatggctccgtttccagccaatttctgaccgcattactaatgatggcgcctttagctcagcaagataccactattaccattaaaggtgaattagtctctaaaccttatattgatatcacgttagccttgattaacacttttggtggagaaattgaaaatcaaaactatcagcgttttatgattaaaggtggtcaacaatatcaatctccgggtaaatatttggttgaaggcgatgcatcttctgcctcttattttttggcggcagccgccattaaaggagggatcgtgcgagtaaccggcattggtaaaaatagcttacaaggtgatatccattttgcgtctgtgcttgaaaaaatgggggctacaatacgttggggtgacgattatatagagtgtgaacgtggcaagttaaaagggatagatatggatatgaatactattcctgatgcggcaatgacgattgctacgacagcgctttttgctgagggtgaaacgactatccgtaatatctataactggcgggtaaaagaaaccgaccgtctatctgccatggcgacagaattacgtaaagttggtgcgatggttgacgaaggtcgcgactacttaactgtgataccgcctaaacagttaacgacggctgaaataaaaacctataatgatcaccggatagctatgtgtttttcactggtggcattgtctaacacgccgattactattcttgatcctggctgtacggcaaaaacattccctgactattttgaaaaactagcaagtatttctcatgcaaaagtttaa

SEQ ID NO: 976 - DNA, 300 bp, Proteus mirabilis
aagaaattttatgagcgagcggaataccgctacgataatcttaggcgccggattgaaaaacggttattgaaagccagtgcgattgccaacacagtcacctatcaccaacatgagccggatgaagtgtacacctttgggtgggtagggatgcgactggtgtctgagcacagcagcgcagcgccccataccacggtttatcatgcatacaatgaccaaagttatacgcctcttgctcgcattgaatgcacggataacccgcttaatccgcacgggcgatttattatacgcacagcagtttaa

SEQ ID NO: 977 - DNA, 213 bp, Proteus mirabilis
atgtatctttacgattttcccaatgaggttcgcttaaaatatcatacatttcagcagactgagtataataatcttcatagttatccattctgtaattaccttattcaatttcctgctaattatacatattgctcaaaattgtttgatgaaatatttagtttaaggcgtttttttattaatttaatggaaattagtactgcgataaaagtataa

SEQ ID NO: 978 - DNA, 336 bp, Proteus mirabilis
aaatctgtttattgttggagaatgaagttcatgagtacaattaattccattattgcttatagaataaagcaaaaaagaaaagaattagggatgacagggagggaaatagcccattcattggaaataagtcaacagcactattcacgtatagagaatggatataccaaaataacagtagaacatttattctctatcgcgtttattttaggtgtcaaacctaaagaactattgcctaattataatttttcaaatgaaaaagagataattaaagcaaaacaatcattatcagcagaaatcattatgccaataaagaaaaacgacatgtatcctacataa

SEQ ID NO: 979 - DNA, 1572 bp, Proteus mirabilis
ggactcgtttatatgaataacattaaaagggaatgtgttaactatttattaggattaatggcgctatttttattaacgataagtaagataacttttgcagaaataaataataatgtaaataattgcttcttaattaatgaaataaaaatagaaaggaatggtttattaactaataaggcacaaaaagaattaatatctaaatatataaataaatgtttaacattaagtgatatgcaacatatcattaaatcaatgactaatgcgtatattgaaaaaggctatattacttcacaagcttttattgccgatcaagatctctcaaatcatcagttaaccattaacgtaattgaaggaaagataaaatcaatctttattgataatatgacttcccccatggttgatattctatttccttcatatcaagataaacgacttaatttacgtgagttagagcatgggcttgaacaactaaatcgattaacaacatcacaatatagattagatattcaacctagtgacaggataggatactcgactatttttatttataagaaaaacaaaacgcatcctttcagaaatcaacttactattgataattcaggttcaaaagcaacaggtgaaatgttactgacgaataccacaacaatagattcgttatttggatttggagagcagtgggatctctccttaaacagtaatacagatttattacattcacattattatagaggctatacagcgagtataaatattccctatggctattggttttatcaatatcagttatcttataaccgttcttctcattttattaaaagttatagtaataaatatatctataaaagtataaatactaatcagcaagttgatattagtcgtttactttatcgggatagtaagaagaagataatattaaaaggcatattaaagcataaaaaagtaaaaacggaattagccaaacagccgatattaatcaatagcccaacattaacatcactatcattagccccccaatatcattttaatctgacatcaggttatttatctattaatccatcagcagaaattgggttgtctttttttggggcatcacctgattatattgctgaaaactcaccccgaagccactatagaaaattgagtctaaatatacattatcaatatttatttccttactctgtctcctatattacgtctttttatggtcaatatacatctgataatctttatagtgtggaaaaaataaccatagatggattaaatgcggttcgtggtactaaacaaaataagcttagtgccaatagaggactttattggcgtaatgaaattaatacaccatggataaattcatttttaggtcaatggcgttttattacggctgttgattatggcgttatctattctgatcaatatgaaacaaagcagcagtctttattagctggcgctatggggctttcattttatcgttcccctttttcttcacaactattgataaacaaaccattcatttatccaaagtggtcaaatgctaaccaatggtctttatcttggtcaatttcttttgctctttaa

SEQ ID NO: 980 - DNA, 1269 bp, Proteus mirabilis
tatttttcttatcaacttttatttattttccctgaatttccggaacagacaaacagaatgaaacagacacgcccagtgaaattactaagaacacgtctatttagtgcaacctttatattattagctattagccatcatgctattgctgatgacacattaaaaacaatgatacccgctgttcctaatatcgaagccgaatcctatattcttatcgactataattctgggaaagtcctcgcggaaaaaaacgcagatgtccgtcgtgatccagccagtttaaccaaaatgatgaccagttatgttataggtcaagccattcgtgcaggaaaaatatcgaacaacgatattgttcctattggtgaagaagcatgggcaacgggcaaccctgtatttcgcggctcatcattaatgtttttaaaacccggtgataaagtcaccgtttcacaattaacacgcggtatcaatctacaatcaggtaatgatgcctgtgtagcaatggcctcttatgttgcgggaagccaagatacctttgtcactatgatgaatgactatgttaagcgtctaggtttacaaaacacacaatttcaaactgtacatggtttagatgcacctgggcaatacagtagtgcacgagatatggcattgattggcgccgcattaattcgtgatgttccagaagaatatgccatttataaagaaaaagagtttacctacaataatatccgtcaaactaaccgtaatggtttactttgggatactagcctcaatgttgatggtattaaaacaggtcatactgaagctgcgggttataatcttgttgcctctgcaacagaaggaaatatgcgcttgatttctgctgtgatggggggacactcatctaaaggccgtgatgctgaaagtaaaaaactacttacttggggttttcgcttctttgaaacggtaaaaccgctgcaagtgggtaaagaatttgccgctgaacctatctggtatggtgatactgataaagtgcaattaggggttgataaagatgtttatctcacgatcccccgtggccgactcaaagatctaaaggccagttatgtattagataatgttgaattacatgcgccagtcagtaaaaaccaagtggttggcaccattaatttccaacttgatgggcaagtcattgaacaacgtccacttgttgttatgaatgaagtgaaagaaggtggcattttcagccgcttgattgattacatcaaattattattttcacgttggtttggttaa

SEQ ID NO: 981 - DNA, 699 bp, Proteus mirabilis
gaaagatttctcatggctaaaacatggtttttaacaggaacagataccgaagtcggtaaaaccgtcgtaagtagtgcattattacaatgtgctacacaacaaggatatcaaacggcgggttataaacctgtcgcatctggtagcgaatggttacctgaaggtttacgtaatagtgatgcattaacgttgcaacagtttagtagcgtccctttggcttatcagcaagtgaatccctattgctttgaaacccccacatcacctcatattgtgagcgaagaaacaaaacaacctattgattttcaggttatgtcgaaggggttatcttatctgcaacaacgcgcagattgggtattagttgaaggtgctgggggatggtttacgccactatcagcaaaccaattctttgcagattgggtgattgaagaaaaattacccgttattttaacggtgggtattaaattaggttgtattaatcatgcattattaacgcaacaagctatttggcaatcagggttgactttagcgggttgggtagcaaatgaagtagagcctgccgggcggtatcaacagcagtatttagctactttaatggcgcatattaaagcaccacttttaggtaaaattccttatttaacacaagacgttaaacaacataattttacctcttatcttgatctctcttatctcaaatcacattga

SEQ ID NO: 982 - DNA, 912 bp, Proteus mirabilis
tatttggcttatgttaattggtattgccctatcaggtatgttctcgggtcgtcgcccaaatttttggttccttttgccgctacacttgctgcacctcatcaacgaggaaaagcggtaggtactattatgagtgggcttttacttggtattttactggcaagaacagcgtcagggctgatggcttcctttactaattggcagggcattttctggctagcaagtgtttttctagctattttagctattacactatggcgctgtttacctacctataaaagccaaacaaatttaaattattttcaactgctcggttctatttttaaattgtttgccacgacccctgtattacgtacccgctcactgattggtgcacttatctttgcccactttggtttactgtggacatcaatggcttttttactcgcttctgatccctttaattattccgatgcagttattggcttgtttggacttgtcggtgctgcgggagcactaatggcaggtaaagcgggtgtatgggttgataaaggcaaaggtaaaaaaacgactacttcaggtttaattcttctcttcatttgttggggacttattgttatcgccccttattatcaatggattggactgattagttttattattggtgtggttttattagatttagccgttcaaggtgttcatgtcactaaccaaagcactatctaccgtattttacctgatgcccgaaatcggcttactgccgcttatatgactagctattttatcgggggtgccctaggctctttattatcgggttacgcttatcaccaatatggctggattggtgtttccagcgccggtgcaatcattggcttattaggtttactggtttggttatttggttataaaaatgatccagtgatccaatctgaataa

SEQ ID NO: 983 - DNA, 747 bp, Proteus mirabilis
cgtcattattatgttgattatgcactggttagaaaaacgggtgcgtttacctggcacagcaggaggtcaataatgtacgagtttgactggagttctgttgttcctagcctaccttttttaatggatggcatggtcattaccttaaaaattaccataacagcaattgttatcggtattttatggggaacaatacttgcagtgatgcgcttatctacttttaagcccatcagttggtttgcagccgcttacgttaatacctttcgttctattcctttagtgatggtattactgtggttctatttaattgtgcctaacatattacaaaatgttctaggcctttcaccaaaaagtgatatccgtttaatttcagcaatggtagcgttctctctatttgaagctgcttattactctgaaatcatcagagcaggtatacaaagtatcagtaaaggccagttttcagcatccttagctttaggaatgacaaaatcacaaacgatgcgtttagtgattttacctcaagcatttcgtgccatgatccctttattgctcacacaaggtatcgttttatttcaagatacctcactcgtgtatgtattaagtctgaccgactttttccgaacagcggcaaatattggtgagcgtgatggcacacaggttgaaatgatcctttttgctggttttgtctactttataattagtttctccgcttcaatgttagtgaactttcttaaaaaaaggactacttag

SEQ ID NO: 984 - DNA, 1446 bp, Proteus mirabilis
ccctactattatgagaatattaatatgtcgatacctcaagacaaccaagccattgaagagttaattactcttgttggaggttcagataatgttattagcgtttcacactgtctaaccagattacgttttgttctgaatgatcccaatcttgctgatatagataaaattaaaaaaatatcttttgttaaaggctgttttaataatgcgggtcaatttcaagttattgttggtatggatgttgatatctactataaattattaattgataagctttcattaaaagctaaatctaaagatgatataaaatctgatgcgaaaaagaatatgggatcctggcaaaagctgattgccaatttagccgaaatttttgttccattattacctatcttaatttgcggcggtttattgttaggattaagaaatgttattggcgaaatgcctatatcagataataaacccctcacttatttttatccttggttaacaccaatatatgattttctctggttaccttgtgaagccatcttccattttctacctgtgagtatttgctggtcgagtgtaaaaaagatgggtggtacacctgcactaggtatcgtactaggtataaccttagtttctccacagctaatgaatgcttacaatttaggttcacaacttcctgaggtttggaattttggtttatttactattgagaaagtaggttatcaagcccaagtgatcccttcgattttagcgggactatttctgggatggtttgagactaaattacgtcgttttatccctgattacctaaaattagttattgtgccgattgtaactcttattgtcgccgtttttgttgcccatgttattttaggccctatcggtagaagcataggtgatggtctcgcccaactgatcaagtttttaatgttaggtgattttgcccctattggttcaactatttttgcctttttctattcccccatggtgatcaccggcttacatcacacaacgttagcgatagatttacaaatgactcaaagttatggcggtacacctatttggccgattatcgctctgtctaatattgctcaagcatctgccgttgtaggcattattatcgttagtcgcaaattaaatgaacaagaaattactattccggcagctatctctgcttatttaggtgtgacagagccagccatgtatggcgtcaacttaaaatatggctttcctatgctgtgcgccatgattggcgctgcgctagcgggtttgatttgtggattaaataatgtgctatctaatggtattggtgtcggcggattacccggtattttatctatccaacctacttattggttagtttatttattagcaatgattgtggctattgtcgtccctattggattaaccattctggtctatcgctataaagaaaaagcaggcaccttgcaagtcgattaa

SEQ ID NO: 985 - DNA, 624 bp, Proteus mirabilis
aataggtattatatgaataatgaattgaagcgattagaaaaaaaatataatagtattatggtttctcctacagaaaaagaaagtcaatattataattctgttatgtctagtttttcatataagaaaattagtaaagggagattgtataatattaaaccttatgaaatacagagagcaggattgaatcctggtaaagaattaaaagaaaatcctaaaaaaataaaaggagtatgtgtatattactttgatactaaagataatattttattaattgaaatatatggacaaaatgaaaatattataaatagacattattattttcatacagttaaccaaataaaatctatttattttaatagtgggtatcaatcaataagaaatattgatctattaaaatgtaagaatggtcaagttatggaagtgttaaactatggtgagatgggtagctctatatctaattatatttatgactcaggaaaacttatagaaatagatataaaacaaaaagaacataataaaaatgaaatagcgaaatataaagtctattttgagtataaggatgacattttaaatagaatagtagataaacatcctaatggatacgaagagcagcgttatccatag

SEQ ID NO: 986 - DNA, 423 bp, Proteus mirabilis
aatagacattattttgcctccgctgctgcaacaacttgtttagcggcatccgttaagctcttagcagcaataatatttaaaccgctatctgctaattttttagtgcctaactctgcattgtttccttcaagacgaacaacaactggtacgttaacaccgacttcttcaactgcaccaataataccgtctgcaataaggtcacaacgtacaatgccaccgaaaatgttgactaatacagcactgacattttcatctgacaaaataatcttaaatgcttctgtaacacgctctttggttgcccctcccccaacatcaaggaagttagcaggttcaccgccatgcagtttaacgatatccatggttcccatagctaaaccagcgccattaaccatacaaccgatattgccatcgagtgctacataa

SEQ ID NO: 987 - DNA, 534 bp, Proteus mirabilis
gttattaattatttagggagaacgattatgagtactgctaaattagtcaaatccacaccttcagccctgctttatacccgtaataatgttgatgacagtgttaaactgcatactatcgaactactgcagcaaatggtgactcagtttatcgatttgtctctcattaccaaacaagcacactggaatatgcgcggtagaaactttattgccgtacacgaaatggtagatggtttccgtgataccatcaatgaacatactgatgagtttgctgagcgtttagtacaattaggtggcacagtccttggtacacctcaaactgtcagtaaaaaaacacctttaaaagcctatccactcgatattcatgatgtgcaagatcaccttaaagcattggctgatcgctatgcggtagtcgctaatgatattcgtaaagcgattgatgaagttgaagatgaagatactgctgatatgtttaccgcagcatcccgtgatctagataaattcttatggtttattgaagcaaatattgaaaactaa

SEQ ID NO: 988 - DNA, 456 bp, Proteus mirabilis
cttgctaattataatagattatataacagtagaggtgataaggagactgaatttatgacttcatctttgcaccctacccgaggtaagttattaaaacgttttgctcaaataggaccttatatccgtgagcaacaatgccaagaaagccagtttttttttgattgtttagctgtttgtgtaaataagaaagtcacaccagaaaaacgagagttttggggctggtggatggaacttgaacgtaatggtgaacagttaatttattattaccaagttggcctattcgataaaaatggcgattgggttaatcaagtaataagtaaaaaagatgtgattgaatcaatacatgaaacacttattcgttttcatgattttctacaagcggcggtaagtgaattagagatgacgctagttccagatgaaaaaatgagcaattttcctcttccccttaagccctaa

SEQ ID NO: 989 - DNA, 1191 bp, Proteus mirabilis
caagacaattattatcactgtattctgtcatcaaagtatcaagctttaggaaaacaaagaatgaacagaaaactctctctatggttagcaattgcgttaatgatgtttccacaaattgcagaaaccatttatagcccagcacttactgatatttcaaatggttttagagtcagtgccaatgaagcagggcaaacactttcgctctacttttttgcttttgcactcggtgtcattatatggggtcgtttatgtgatgtcattggccggcgcccaacaatgttagcagggttatttatttatgccattgcttgtattggtgtctttatgaccgataatttttctgtattactgatattacgtatgctttctgcttttggtgccgcagttggctctgtaggaacacaaactattatgcgtgatgtttatagtggtgaagaattagccaaagtattttccgttatgggagcggcaatcgcattaagtccggctattggtatgttaagtggttctttactggtgagctatgcaggttatcaaggggtatttagtggtcttgctcttctcgccgtcgttttattgctgtggagtactattgcattaccagaaagtcgccctgcaacaataaaaaccgcaccactaggggaaacagcgataaaaatgctgaaagataagcaaattgccaagactatacttttaattgctttttttaatatcagtctatttgcttattaccaactagcaccttttatgtttgataatcaaggttatagtgcaagtacttttggctatagtggtattgtattagcaataggtgtcggtatcggttcttacattaataaagcattattaagccatcattggcaatgtgagaaattagtattacttgcaagtattattgcagtaattagtgctgtaggtgtttatttattacgcaatcacattagttttattattccaatgatgacaagtgtcgttgcctatggcattgctattccaaatatcttagcaacggctttagcgcaatataaagatcgcttaggcacagcgggtgcactattaggtttattctactatttacttattggtggtggtttagcactggctggatggggacaaagtttagcgattaccttgctgatttgtagtataggtgctttgttactctctttctctcgccaaacagcaaaataa

SEQ ID NO: 990 - DNA, 1629 bp, Proteus mirabilis
agtaactgttatctacttattaacattaaccaacgcgggaggtcacctttgatcccggacgtatctaaagcgctttcttggttggaagcccatcctaaagttttatgtggtatccaccgtggtatagagcgagaaaccttaagagttactcctgatggtcatttagcggctacaggacaccctgtcgagctaggtaagtcactcactcacaagtggatcacgacagattttgctgagtctctgttagagtttattactcctgttgacgataatattgatcacaccttacattttttaagtgatttgcatcgctatacggcacgtcatttaaccaatgagcgtatgtggccgatgagtatgccttgctttattgaagccgaagataaaataacattagcgcaatttggtacctctaatgttgggcgttttaagacgttatatcgtgaagggctgaaaaatcgttatggtgcgttaatgcaaactatttctggtgtgcattacaatttttcgttacctatcgaattttggcaagcgtgggcaaatatcaccgatgaagaaacaggtaaagaggcgatttcagacggttatttacgtttgatccgtaattactaccgttttggttggataattccttttttctttggtgcttcgccagctatttgtggttcattcttaaaaggtcgaaaaaccaatttaccctttgaaaatacccctaaaggcgcaaaatacttaccttatgcaacttcgttgcgcttaagtgatttaggctataccaataagtcacagagtgatttagatattacttttaatcatctagagacttatgtgaaaggtttgaaaaaggccattcataaaccgtcagaagaatttgctaaattaggtgtaaagaaagacggtaagtatattcaattaaatactaacgtattacaaattgaaaatgaattatatgcgcctattcgtcctaaacgcgtagtcaaaggggatgaatcaccttctgatgcattattacgtggtggtatcgaatatatcgaggttcgctcattagatatcaatccatttacgcctatcggcgttgatgaaacacaaatccgtttcttagatttattcttgatttggtgtgtattagcggatgcaccagaaatgaatgcagaagaattggcctgctgtcgtgcaaattggaataacgttattctagaagggcgtaagccaggtcaagttattggcatgggttgtggtgaaagaaaagagccattagcacaagtggggaaagcgctttttgctgacttacagcgcgtagctaaggtattagatagctgttctggaactaaatatctagaagtttgccttaagttagaggaaatgtttgataatccgcaattaaccttctctggcagattattagaaaaaattaaagcacagggtattggcggttatggtctatctttagctgaagaatatcatcaacaattagtcaataccgcttatgaagtgttaacagatgatgcttttgaacatgagagaatttcatctattaaacgtcaggcagacttagaaaagagtgataccatttctttcgatgaatatttgaagctccatgctgggccaaataatgatggtgtggcttcttaa

SEQ ID NO: 991 - DNA, 963 bp, Proteus mirabilis
atgagtggttatgtgtatgcagggtttccaagctctgtaggagtcattattggtggttttttcctcgtgatactttttaagtggttacgatttgcattgcaagacaataaattacccactgctacaatgccagcaacaacagagcctgagcccgttttatcgtctccagcaacagaaagcccagtaaatcagttattacccaaagaatggggattatatgtcgcagccccttatgcggtaatgaatgagtgggcatataacgaatataatcaaggtaaagatgatggtgggctatcagcggcttggggagttaatgatcggtgggatttaatctaccaattattttggttgctgactcaaggtcataccaatgacttttaccagttacgtgaccagattttgaatggcaaagaagaagatattcaatcattaaaaaacgatattttattatctgatttaactgaaaatgataaaaatgaacgtttatggcaaatcgatatgatgaacaccaatcgaatgaatatccaaaatgtaaaatatcttatttgggatctttgtcgttttaacaagctttgcttagaaggctgccaacaaggttatattacccagcaagaagcacaaacatggtcattaatgagtgcatcaatgctacgtcgtatttatgatggttgggaagatatgtggcaaaactttattgctactcgttggttatgggcaagtggtgatcaaaattgggcatcatcacatcaaacattttccgatgtcgtacaaaatatactcaaagcagaaaataccttagcgacagaagaaaactgggtaatggagctacccccattagatttaatgtcttttacacgagccgtagctggattaggttttatgaaaaatgatgtgcctatgacactggctgaaatagaagaaatgatcagcgaacgcattactttaaaaacacttaatagctaa

SEQ ID NO: 992 - DNA, 630 bp, Proteus mirabilis
aggaacattctctttttcagccccactatccctatttatctgacgatggcattgctaggaataagtgttcagacagaagtgtttgtgccctattttttgcaaatgatccatggcattactccgttactttccggttatttagctgctttagtcggtgctggttggtctttttcggctattatctcttcatctcaaccaagcaatattgctcagcgtcttatgcgtatcggccctgccattaactttactgccataattgttcttggcttattaatttcaaattatctccttttaccttatgggcaagtgattattatttgtctagccctcttttttacaggtgcaggaattggcatggcttggcctcattatctcactcgtgtattacaggtttctcaaggggaagatgcacaaaaagcagcgacgtcaattaccactattcagctattttcaaccgctgtaggtgctgccatttcaggtactgttgtaaatatggcaggattaaccaaccccggaggtattgctggcgcacaaaatgcagcccattggttaattattggattttctattaccccattgattgcatttattactgcaaaaatcgttgtttccaatataagaaaacattaa

SEQ ID NO: 993 - DNA, 591 bp, Proteus mirabilis
aggtctgttcttccttctatcattattttgagtgtagctatcatggatattgttgattcacatcgtcgtaagtggttaggccttggtatggctgctgttggtttaggtttacttccctcacatgcatttgcatcattagcaactccccgaccgaaaattcttcgctttaataatttaaatactggtgaaactattaaagccgagttttttgatggtaaacgttataataaacaagagcttgctagactaaatcatctttttagagatcaccgtcaaaataaagttaaaactatcgatccagccttatttgatcaaatctatctgttacaggtgatgttaaacaacaataaagccgttgaacttatttcgggttatcgttcactcgcgactaataatcatctacgtcaacacaccagcggtgttgcgaaaaaaagctatcatacccgtggtcaagcaatggatttccgtttagtaggtactgatttatctaaagtacgccaagtagcactaagaatgaaagcgggaggagtgggttattatccacgaagtaattttgttcatatcgatacaggacccgtgcgctcatggtaa

SEQ ID NO: 994 - DNA, 348 bp, Proteus mirabilis
agaggtaactatatgattataaatatcactagcaaacaaatggacattaccccagcactacgtgaacacattgaaagccgtttaactaaacttaacaaatggcaggtaaatttaatcaaccctcatattattctcactaaggatccaaaaggttttagtgttgatgcaagtattcatactccgaatggacaacttgtagcaaacgcacaacatgttgatatgtatgcggcaattaatgatctcttggcaaaattggaacgtcaattaaataaagttcagcataaaaatgagtctcgacgtgcggccaatagcttaaaagaagaaaatttactcgtaaatgaaatataa

SEQ ID NO: 995 - DNA, 264 bp, Proteus mirabilis
atcatgatatacacaacaggcactgttagcacagtgtcagggtctgctattgtctctggcacaggtaccattattttaattaaaaatggtaatgctaattttatttatatggtggacagggttaatagcgatacagaattagtcatttcacaaccggctacatttaccgtaaaaaacactagttacagcattaatctcactgagccgaactcatacagcgacgctaataatcgtatgaccgctattgcatcagatattacgtag

SEQ ID NO: 996 - DNA, 987 bp, Proteus mirabilis
ttttgtccatattatttgctcgatttatgcaacaatgtattcaccaaaacagggtttttctcccatttcatgcaacctattatagaacgcatcaacatgatggagaaaataaagatgaaaaaattacttcctttaacacttgcaactactgcgtttttcgccacttctgttatggcaacagagttaacattagatatctacaaccccggtgatgccagtgtattccctgtttcatctgaaatcatttatggtgataaagatgctgtcttaatcgatgctcaattccaaaaaaatgatgctcaagccttagtcgataaaattaaagcatcagggaaaaatttaacttatatctatatcagccattctgatcccgatttttattttgggttagatgtcattactgaagcatttccaaatgctaaagtgattgcctcagctcccaccgtcaaaatcattaatgaaacccaagcaggaaaacttgcctactgggggcctgtcctcaaagacaatgcccctaaaaaagttatcattcctgaagtcgttactggtgatagtttttctcttgaaggtgaaaaactctatatcaaaggattagatagccaatctccagaaagaacctatgtttatgtgccaaaactgaatgctattatgggtggggtaatactgtctgaaaatattcatgtgtggctagcagatactcaatctaaagcacaacgccaatattggctagaagcgttacaacagattaaaacgttatcacctaaaacggttattccgggacattatgttccaaaaagtaattatgatatgcgttctgttgatttcacaatgaattaccttaaagaggcagaaactaaactcgctgaaactcaaaactcagaacaatttattgcggcgatggaaaaaagttatcctgacttagcagataaatcgagtttagagcttagcgcaaaagtccttaaaggagagatgaaatggcctcagtaa

SEQ ID NO: 997 - DNA, 1215 bp, Proteus mirabilis
gaaaatagatattgcatggcaattaaactcgaagtaaaaaacctatataaaatatttggtgagcaccctaaacgtgcctttgaattattaggatctggtatgaacaaagaccaaatctttgataaaacagggttaaccgttggtgtgcagaatgccaatctggccattgaagaaggcgaaatatttgtcatcatgggattatcaggctctggtaaatctacattagtgcgccttctcaatcgtctgatagatcccactaaaggcgaagtccttattgatggtgaaaacatcaccaccatgtctgataaagatttacgacaagttcgacgtaaaaaaatcagtatggtgtttcaatcattcgctttaatgcctcatatgaatgtactcgataatacagcatttggtatggagcttgcaggcattagcaaagaagagcgctatgaaaaagccatggcagcattagagcaagttaacttaagctctcatgctcaatcttggccggatgagttatccggtgggatgcgacaacgtattgggcttgctcgtgcactggccaatgatcctgatatcttattaatggatgaggcattctccgcacttgacccattaatccgaacagaaatgcaagatgagttattgagcttacaaggtgataaacaacgcaccattgtgtttatttctcatgatctggatgaagccatgcgtattggcgatcgtatcgcgattatgcaaggtggtgtggtggtacaaatcggtacccctgatgaaattcttaataatccagccaatgattatgtacgtaccttcttccgtggcgttgatatcagtcatgtatttagcgctaaagatattgctaaacgtcgcccagaaacactactgcatattgcgccaggttttggtccccgttcagcattaaaagtactggaagatgaagatagaaactttggttatttaattgagcgaggacggaaatttgcaggtattgtttctgtcacttctcttgaagaagcattaaaagcgaagcaacctattggatccgctattttaactgaaccttgtgcgattaatggtgatacaccattaaatgaactgatttctactgttgcgcaatctccctgtgcgatccctgttattgatgaaaaaaaccgttatatcggtttaatttcgaaaggaatgttgttacaagcactggataaggagacaccaaatgagtaa

SEQ ID NO: 998 - DNA, 252 bp, Proteus mirabilis
aaaagaagataccgttatttaataatagcggtttatcttaggctaaaaagcagacaccacaggtcagcatcaattcatgctttgcctgtggtgttttttttcacccgaaatgatgatattgcgggagagaatggattgggatcaacggctacggaagatgatacggcctttgctcaggtcatatggggtcagctcaacggtaaccttgtcgcctgtcaggatacgaatatagtttttacgcatttttcctga

SEQ ID NO: 999 - DNA, 1776 bp, Proteus mirabilis
cataagctgtacatatttttattattttgtaggatctacacttgtcatgtgactaactgccttacaagagtatttttcatggaactggaacacgaaagtaaacgtcctctctatatcccgtatgcaggcccaatcctgcttgaatttcccctgttaaataaaggtagtgcttttagcgaagaagagcgcagcacctttaaccttcatggtttactgcctgaggcagtagaaaccattgaagagcaggtggaacgcgcttaccgtcaatatcttgattttaaaaatgataacgataaacacatctatttaagaaatatccaagataccaatgaaacgctattttatcgtctgttggaatctcaccttactgaaatgatgcccatcatttatacccccacagtaggtgaagcttgtgagcacttctctgatatttaccgccgtgcgcgtggactttttatctcttaccctaaccgcgccaatattgatgatatgctacaaaacgccaccaaacaaaacgtaaaagtgattgtggtcacagatggtgagcgtatccttggtttaggtgaccaaggtatcggtggtatgggtattcctattggtaaactctctttatataccgcttgtggtggaataagccccgcttataccttacccgttgtactggatgttggcaccaataatccacaacgtttaaatgacccactttatatgggctggcgccacccacgtattaccggagatgaatataacgaatttgtcgatgaatttattcaagccgttaaacgtcgttggccaaatgtactgctgcaatttgaagattttgcacaaaaaaatgccatgccgttattaaatcgttatcgtgatgaattatgttgctttaatgatgatattcaaggtactgccgctgtgacattaggtagtctaattgcggcaagccgtgctgcggggcgtcaattaaaagatcaaactgtcgctttcttaggtgcaggctcagccggctgtggtattgcagagcaaattattgcacaaatgaagtctgaaggactaagcgacgaacaagctcgtgcacgtatctttatggttgaccgttttggtttgttaacggataaactgccaaacttactcgatttccaaagtaagcttattcaaaaaagcgaaacgctggccgattggcaaacagaaacggatgcaatttcactgttagaagtggttaaaaatgctaagccaaccattctgattggcgtttctggtcaagcaggacttttcactgaagagattattcgtgaaatgcataagcattgtgaacgtcctaccgtgatgcctctttcgaacccaacgtctcgtgttgaagcgcgtcctgaagatattatcaattggactgatggacaagctcttgttgctacaggaagtccatttgccccagtcacctataaagagaaagtgtatcctattgcacaatgcaataactcatacatcttcccaggtattggccttggcgttattgcaagtggtgcaaagcgtgttactgatgccatgttaatggttgcaagccgtgcgttagccgattgctcgcctatggcaaaagaaggcgatggcccactattacctttattagccgatattcaacaagtttcacgttatattgctaaacaagttgccaaagaagcacaggtgcaaggtgttgcaacggtcacgtctgattctgctttagaagaagcgattgaacgtaactattgggagcctgaataccgtatttacaagagaacgtcattctaa

SEQ ID NO: 1000 - DNA, 654 bp, Proteus mirabilis
gctatgatgtatcacattatacctgtgacaaattatatgcaaaattgcacccttatctggtgtgatgataccaaagaagcggccattgttgatcccggtggtgatgtcgaaacattaattgcagaaattgaacaacgtcaattaaagttgactaaagtgctattaactcatggtcactttgatcacgtagcaggaacggctcaaattgttgagcattttcatgtgcctgtttatgggccacataaagatgataacttccttattgaagatttagaacaacagtgtcgtatgtttaacttccccagtggaaaatcttttacgcctgatcaatggttaaatgaaggggatactgtcactattggtaaaaccattactttgtcggttttacattgtccgggccatacaccgggccatattatttttgttaatcaccaaaataaacttatctcgatgggagatgtattatttcgtgaaagtattggtcgtactgatttccctcgtggtaatcatgccgatctgattgcctctatcaaaaataaagtattaccactaggtgatgattatctatttatccccggccatggccctatgtctaatttaggtcatgagcgtcaatataatccttttttacaagatgaaatgcccatttggtaa

SEQ ID NO: 1001 - DNA, 267 bp, Proteus mirabilis
tggtataagtacagaaggaacaatgggaaaaatggtggtcaccattttatccgcggtggcagaagcagaaagacaaagaattttggaacgaacaatgagggcaggcaagaagctttgctcaaaggggtaaaatttggacgcaagcgttcagtggatcgcgaaagaattattgagctaaaacgaagtgggtggggaggaaccgcaatagccaaagaaatgaaagtagctcgttctacggtttataaaatcttgaatgaagaaatataa

SEQ ID NO: 1002 - DNA, 1257 bp, Proteus mirabilis
attttggagtatacaatgagtcaatgtcaggttagcggtttgttatcccttgatgaggcgctagaaaaattacttgaaaaaccggtggcaatcacagatacccttagtatccctttgcataaggcagcaggttatatcttaagtgagcacatcacttcaccactcaatgtacctcctttcgataattctgccatggatggttacggtgtacgttatacggatctaaacactcaatctcctttacctattgcaggcaaagcgtttgctggagtcccttttgaaggtgaattaccacaaggacaatgtgttcgtatcatgaccggagccatgatacccgcaggtgtcgataccgttattatgcaagaagaaacacaagtgactgacaacggtattctttttccacatccggccaaacttggacaaaatattcgtcgtattggtgaggatataaaacaaaatgatatcgtcttagccgcaggaacaaaactttctacagcacagttacctcttattgcttcactcggtattgccaatattaatgtttaccgcaaattaaaagtggccgtattttcaacgggtgatgagttgcaaactattggccaaccattaaaagcggggcaaatctatgatactaaccgctttgccgtacgcttaatgttggaaaaattagattgtgatgtgcttgatttaggcgttattccagattcgccagaaaaactgcgagaaacttttaaaaccgctgatgcacaagcggatttagtgattagcagtggcggagtttctgtgggtgaagcggactatactaaacaaattttagatgaaataggcgaaattggtttttggaaattagccattaagccaggtaaaccttttgcttttggtcgcttacataatgcttggttctgcggattaccgggtaatcctgtctcagcaacagtgacattctaccaattagtacagcctttaattgcccgtttatctggttttagtcagtggcgatcaccacagcgtttccatgctaaaacctgttcaccattaaaaaaatctgccggtcgtctggatttccaacgcggtatcgccagtattaatgaaaatggtgaatggcaagtaacaacatcgggacatcaaggctctcacgtatatagctcctttagtgtggcaaactgttttatcgtcttagagcgagagcgtggtaaagttgcagcgggtgaaaccgtcactattgagctatttaatcctctgctaaaaagcgaatag

SEQ ID NO: 1003 - DNA, 261 bp, Proteus mirabilis
cggagggagtatgacatggggaaaatgacattcgtagttgagtatgaagatggcaaggagccgtctgtaaatgcaggagtggatattttaggtggtcgattaacagccgtggcatcctatgattaccgtgatgatttgcttactcagggtgaggctcaagctgtaaacaattccattgaatttactgtactgcgagactactgcgaagagtttgaagttgatttcgacgaagttgtcgctaagttagaatcgccactctag

SEQ ID NO: 1004 - DNA, 960 bp, Proteus mirabilis
ttctcagatttttctaaggcattagaaaagtactatcaccaacatgagccggatgaagtgtacacctttggctgggtagggatgcgactggtgtctgagcatagcagcgcagcgccccataccacggtttatcatgcttacaatgaccaaagttatacccctctagcccgcattgaatgcacggataacccgcttaatccgcaacgggcgatttattatacgcacagtagtttaagtggcttaccggaagcgttgaccaacagtgagggtgaaatagtttggcaagggcaatacagtgcttgggggcatttacagcgtcaaacccgccccacaagcgcgtttaatcgtgaacagaacctgcgttttcaagggcagtatttcgacaaagagacgggcctgcattataatacgttcaggtactatgccccggatttaggccgttttacccaacaagacccaatagggttggcaggggggataaacttatatgcttatgcgccaaatccattgacatgggtggatccgtggggttggagttgtggtcctaaattaaaaactgaagtagattataaaaaggctattcaaaatttagaatcgcagcatggtgctttaaatgctcatggattaagaagacatggagcggggacaaccttagagcaacaacaatatagagccagaacaggtaactcacctgataatcattatacaatagttcttgatagaaaaacgttaggaagaagcgcaccttcatccacaagatttctgagttataaagaccaatacgaagtcatgcagcaggttcttaaactaggagggccaggtaaaactattgaaatgaacatgggacatgtggttgccgaaggttatcaaagtggtggaaaagtttatggaatgacatccaatgtaaaagcttattttgatgatgatggaaagttagtcacaatcttcggagtattatga

SEQ ID NO: 1005 - DNA, 840 bp, Proteus mirabilis
ttgtcagatttgtcttttttctatgaggttattatgaggttaatccccctatccacggcacagcaagtgggaaaatggtcggctaattatatcgttgagaaaatcaacgcatttgcgccaagcgccgatcgtccttttgttcttggtttacctactggtggtacgccattagcaacgtacaaagcgctaattgaactacatcgtgcaggtaaagtaagtttccagcatgttgtcaccttcaatatggacgaatatgttggcattccagcagatcacccacaaagttatcgtacttttatgtatgagaacttttttaatcatattgatattaaagatgaaaatatcaatttattaaacggtaatgcaacagatccacaagcagaatgtgcacgttatgaggcgaaaataaagtcttatggcaaaattaatctgtttatgggaggtgttggtaatgatggtcatatcgcttttaatgaacccgcctcatcactcgcttctcgtacacggatgaaaacactgactgaagatactcgtctcgctaattcacgattcttcgacaacgatatcaataaagtgcctaaatatgcgctaactgtcggtgtagggacattattagatgcagaagagttaatgattttagcgactggcatcaataaggctcaagcagtacaggtggcaacagaaggtgctgttaatcatctatggactatctcttgcgtgcaattacaccctaaagcaattttagtctgtgatgatccggcgacaatggaactgcgtgtgaaaacactgcgttattttcaacaaattgaagcgcaagagcgccagcaataccaagattaa

SEQ ID NO: 1006 - DNA, 237 bp, Proteus mirabilis
tatccttatctgaaagcgatttttctaaacaaaaaagagtggcgtataaaatatacgtcactcttttattttagctattacttgataaatccatcgttagcaaaaaaatgcatcgataaccaaactataagatgcggtttttctgcaatagctcttggcgagcagcttctttcgccattctttttttacgagcatcacaaggttcaggacaatcacactctttctcaataccaatag

SEQ ID NO: 1007 - DNA, 1029 bp, Proteus mirabilis
tggcaggatttggcattgttatgtcaattcatacacaccgaaaactattatcaaaaagtttataatgaggtttctatgcgtttgcaatgggttttgatgggtgtcagtgcattgctacttgcaggatgtgttgctgataaacctgtgaataataatcagccaaccacaaggttgccaaatgtacctacacaacccgtattaggtatagagcctcgttatgagccttatcacccgactgcgaatcaagattatcgtaaaaatggggtaatttatcgcatagtcaaagatccggcgaactttagtgaacgaggacaagcgattgtttacgacagcttagcaatgagtcgcttaacaaccataggtgaacgagtcaacccttatgagtttgctgcggcacacccaacattgcctattccaagttatgcgaaaataacaaacttaatcaatggacgcacaatgattgtgcgaattaacgatcgtggtccttacgttgaaggcaaacaaatacaggttacacctgctgtttataacagtttgcagttaatgccaacaacccctattcaaattgaaggtattgtcgttgatcaaaatggccaaataagtggtattggtacccaaggtgcacaaatagagaaaagagccactacattacctgagcgtcctaactttaatactcagccatcgacaatggctccccaaccctctgtaacagcaccgtctcccataactgtgactcaaccagctccagctccagctccagctccagctccagctccacagccagtatcttcatctagcgcaatagcgcaaggctactatgtacaagtaggtgctttaagtaatcaaactaatgcacaaacatggttaactgaattaaccaatgctttaaatacccaaggtgtcattaatacaactgatggactacataaagtgcaattaggcccctactcatcaaaaacgcaagccgaaacaataaaaagtgctttgaaacaaagtaaaaatatcgatgggtttattgttagccaataa

SEQ ID NO: 1008 - DNA, 1086 bp, Proteus mirabilis
ttagaggatttactcatggctggtattttttcgtcagtagagaaaaatttaattggtggaataaccaacgctaccagcggtctaatgatgtcttattcttctatgatgatgggactggcagcagcgtcagtcaccatctacatcatgtggcgaggatatcagacgctggctggtaaactatctacgcctatggaagacacgatgtgggacatcatgcggatggctatcatcctgtcgtttgtggcaaacgtcagtggttatctcgatggagttatagacgcaataaatggattaaaggaggggttttctggaggagaaaatatctggcaaatgttagataatttatggaaaagcgcaagaattttaggaaaaactctacatgacatggataattccacttatgttaaagatgaggggtggacggctcaattttatgtatggcttggcatatttattttaatgcttattacagcctttgtttcaatgatagctgaagtaatgattctattactgagcattacagcccccatcttcatattttgtctgatgtatggtttcctgcgtccgatgttcaataactggctacaaaatatttttgcagcgatattaacgatactattttcagctttatctctacgtattgttataaattttttaacgtcgagaatggcagaagccaccgcacaagctggtaaggcaaatatcgtagaattaggggcacaagtctgtcttgctggtttctgcgccgcaatactggtgtatatctccgctaaagtagctgctgcactggccggggcaagtgccaccgtatcgatgcaagggctggccgctgtaggtatcggtgctgctgcttttggtgccgggaagctggccgggggagcagttaaagaaaccaaacgttccgcccaggacaacattcagggctggaaggatgcgaatgcaggtaagcccggcaagcccggaggtgagttaggctataacgcatctaaagcgcggaagtacgcgattgagcagatgatagcccggaacgaagcgcggaggctggcacagtcgagagaatccgcggttaagaagttcaacagctag

SEQ ID NO: 1009 - DNA, 1818 bp, Proteus mirabilis
cgacgatttcagtatcatgtgcccctaactatcactcgtaaaatattgatgaaacctgccatgtcacaaacatttattcccggcaaagatgccgcactggaagactctatcgctagctttcagcaaaaattaactcagttaggttttaacattgaagaagcttcatggttaaatcctgttcctaacgtttggtctgttcatattcgtgataaagattgtccgttatgttttactaacggcaaaggtgctactaaaaaagcagcattggcttcagcattaggcgaatattttgaacgtctctcaaccaattatttcttttctgatttctggctaggtgctgatattgcagaaggtgagtttgttcattacccaaatgaaaaatggtttccactgacagatgatgatgctgtacctgaaggcttattagatgcacgtttacgtcaattttacgatcctgaaggtgagctatgtggcagtgaactggttgatttacaatcaagtaattcagaacgtggtatttgtgccttaccgtttattcgccaatcagataaaacacctgtatatatacctgttaatatcattgcaaatctttatgcatctaatggtatgtcagcaggaaatacgcaaaatgaagctcgagtgcaagggctttctgaagtgtttgaacgctatgtcaaaaatagaattatcagcgaaagaattagcttgcctaaaatcccccatgaagttttagctcgttatcctgctgttattgaagctattacgacattagaaaaagaaggcttccctatttttagttttgatgcatctttagggggacaattccccgttatttgcgtcgtgctgtttaacccacaaaatgggacttgtttcgcttcttttggtgctcatcccgattttggtgtggcattagagcgtactgttactgagttattgcaaggccgtagccttaaagatctcgatgttttcaatccaccgagttttgatgatgaagaagtcggtgatcacactaatcttgaaacccactttatcgactctagtggtttaattagttgggatctgtttaaaaaagatgcagactatccatttgtggattgggatttcagtggttcaaccgaagaagaattccacacattaatgtcactgtgccagcaatgtgatgcagaagtgtatattatggattataaccatttaggggtttatgcttgccgtattttagtccctggcttatccgatatttatcctgctgaagatctgcaactagccaataacattatgggtgtccattggcgtgacaccattctttctttaccaacaagtcatggcacaaaagaagagtacctctcacttattggccaatttgatgaagatggcttagatgactttactcgtatcagagaaatgattggtattgcaccgggtaaagataatggttggagtcatttacgtgtaggtgaattaaaatcaatgttagcactcgctggtggcgatttagaacaagcattagtttgggttgagtggacacaagatttcaacgcatcattatttacaccagcgcgtcaaaattattatcgttgcctgcataatcttttactcctacgtgaagagcatgagcgtgagcctgcacaatatatggaggctttttctcgtatgtatggcgaggaaacactgcaagctgcattaaatgcaattgaaggtaaacaacctttttatggcttgcaacccatagctccatcattagcgaatttgcctgttcatcaatctttattagccgcgtatgaaaaattacaacaagcaaaacgtcaatcgaataaataa

SEQ ID NO: 1010 - DNA, 4605 bp, Proteus mirabilis
cttgatattcaaacaaaacaaaatagtatcattttaacagttgatggcaaaattacctttaatggcaatattcaatctgagcaagatattaatgttagtagcaaagcgctacaaatgaatagtaatgccagcttaaaagcgcaaagagatattacattagcaactaatacgctaacgaatcatagtgatattatcgcagaaaaggatatgcgtttattcgtagataaattcactaataaaggtgaaaaagcgcttattcaagcaaaagataatttatggatacaaaaaaatgcacagggtgaaccaagtagtttaattgaaaatcaatcagccaccataaaaacagaaaagggtgatttgattattagaaccaagaaattggttaatgaatctattactcctttatttaaagaaataaagcaagagcctgattctacatcgtctataaatataggtactcattttcttcatccttacaatagtcctacgaataatttccttataattattttacttgctgaattaaaagaactctctgataaaaagtggtttgatatattagatttaaaaaataatggaggtgttaatgtagaacgctcattatttgaaaagaataaaaagtatgttcctagtgttatttattctggtaaaaatttatatatacaatctaacgagttttttaatacccaatctgatatttttgcaactaatgatcttatcgcaacgggaaacaatgcaaaagtatactattatcggtttggacaccttaataaatgggatctttattctcatgataatgctcatattttttatcgagatgatgtaaataaatataatattgatgaaactaaatttcaaaaaatagttcattttattccctttactaaaattggaagtcattatgaatttattgtagatagtgcttctgaatatatgataaaagcaggtaataatttagttttagattttaaagatagtatagcgttagaacgtaaatttccatttttagaaaaagaaattaaaaagtatagaagaatatctgattttgaaagtactatattagctaaaaatatactattaaatgctaataatttaaatatctcattaaatttaaaatcaagtaactctttatctgttattgctaataaaaatataaatataagtaattcaaatttattatctggtgatattataaatttaacagcaattgataatgttaattctgaaaatatagatgtaacggcaaagcatttttccatcataactaagaatggagatattaattattcatttagccctatagcctcttatactctgaatagcattaaggcaccatttattgatgtgtctgaaaaaatagacttttattcaggtaaaaacatttacatttcaaatgtaataattaatgaatcaaatgaaaaaagtttatcagcattagagaatattaaaataaaacgcgatgagtctttatttttcaacctaatgccaaattttagagatgaacaatatatttcagcgtttttatttaatatggggctttggaaaagtaagaataatataagcttgatggctggtaaagatattgttagtcagggaataaaatattatagtaacaaagaaataacttttaatgcaggacaagatatttttcttgcctccaaattaataaaagaagccgctccttttttcagtgatattcattacccccaactacaatctaaattattttcagataataaccttattttaaatgccgcgcgtgatattgatttaagttcaacagtattaaattcaaaagataaaatcattgtattagcgggtagaaatataaaactgggtgcaaatgcttattccgccatcgaagatccccacgaagatgcgcaagacattcaatataccaccacatccattatgggaaataaaggtatttctattgcatcatcaggctcactcacaacagaaggaagttcacttaaatcagagggggatattgctatttccagtggtggcaatatccaattgggatcagtaagaacacattttcgtaaagagtcggactcagagttagaagaacttcgtaaacaagtcagtactgaaattaatagcggtaatcatctaacactattatctgagggcagtattttatttcaggcctctcaattggctgctaataaaaagatggatattgctgctaaaggtggatttctttatgcacaggcaatggaagaatccagttactatgaagaagaaaagaaaaaatgtaattggtggacactgtgtgcgactaaaaagaaatataccaaaacatttaataacacaacgaataaagttaccgagtttattgctaatgacgatattaatttaattgctaaagatgatatcactttagaagcaagcaaattagagacagcaaagaatgccaaattaaccagtaaaacaggaggcattaattttaaagcggtgaaagatactgcttttaaacaagttattactcgttcaaaagatatatatatcactcaacgtaatcagggatacaccaagggaacatggctattacctgaactctatattgacggaaagctgactattgatgcgccaaaaggcatatctgcagatattaaagccaaaaaagagcaatctttagagcaggcattaactgccttaagtaacacaccagaatatgcttggcttaatgcgctccaacgtcaagaaaatattaattggaatttagtgaaagacacttattccagttgggatgataaaacccagcagttaaatccagttgttggtgcggttattgccatcgcggtaggggttgcaacttatggtacggcaacagctgcctcaataggaggaatggcaagtaatgcaactattgctgcaggagcctctgcgggggttgcatcaacggcatcagttgcggcacaagccggttttgcttctttagtttcgcaagctgcggtctctttagctgaaaatcaaggcaatatttctaaaacatttggcgccttaagtcgcagtgatacggtgaaatccattgtcaccagtatgaccgttgcaggcgccttgcaaggtcttgaccaatttatgggttgggatcaagcaatacaggggggaacattaccgacaacaggcaagttgcttgcgacggataatgccacatggactcaagttgctcaacgcgttgcctcacagtcagtagtgagttctacactgggcacagccattcaaggtggcagttttattgataattttaaaactgcgctattaagccatatcggcagtcaatttcacgctgaaggtgccaatctcattggtgataacggtgcggtattagggcatgcaggaaaggttttaagccattctgttgttgcaggagtgagtgctgaaattgcaggaggcagtgtaacaggtgcagtagccggcgccttggcagcagaaatagcggcaatatcgctacaaagtaaattatttgagcctagttatttaaatgaaactgacagacaagttgcattaattcaagaggcactacatggcaatgaaggaaaaacacagctcactaaattaattggtgcactgacaggcgctattgtgactcgtaagcctgagggcgtattttctgcggctaattctgcggagttagtttatcgacataattacagcgaacatatgctttcaaagctagcactagaaaataataaggacataattgcagcgtcaaaaggtgatgttgcagcagcagaaagagttgtaaatcgacaaaatgcagggatgattgcgattgctcttggtttaggaggaagtgcgagcattattggtggtcacactgttattgcagcaacaccagaacttattgctattacgcaagctgcatttagtacatgtaaagctaattgggtttattgtgctaatcagctaggtattaatattgctgggatatcagctccagaagctgcaatcgctggtgtcaccgttggtactggttataaagtattagctagttcagaagaaagtgctaaagctttctctagcatgttagctaatagttcaaagtctttaatgacttcaggaaaattaaatataactgctataaaaccgatagtagaacaagaaaaattattaataactaccaacaaaaaagctattgaaataatcaataacggggagtttataatatattcaggagtaactacgaatggatataaagtatctaatggagccaaaaccgtagtttttaaaaatgaattagaacatcctattgttcaatctaggattaatattaaagtgggagatgttgaatcaggttggttgcatgtacaaaaacgtcatttttcaggagcgcaaaatgctagccaatttacgcttagtgaacaggaaattaaagatatattattaagtcctgctgtcattaagattcctattaataaaacgagagaatcatataataaaaacaccaatagtattgatattttgtatgaaagagtgattcagcttgataaaaatataggaattgataaatttagtaaacagccaactaacataattactatgctcacagataaaaatggaaatttaataactactacccctggggaaataaagtga

SEQ ID NO: 1011 - DNA, 564 bp, Proteus mirabilis
aataggaatcttaaatatatgaaaagaaaagttatagcactagctactattctttctgctgcatttgctggctcatctatggcgtatgacggaacaattacatttacaggtaaagttgttgatcaaacatgttctgttgatacccaatcaaaaaatttagctgttattttgccgactgtttcagtcgcaacattaaataatgtagcaacaacagcaggcttaactccatttacaattaagttaactggttgttccacagataaagatggtgctaaaaacgttaaagtatattttgaaccatccgctgatactgatttaactacacataatttaaaaaatacagcaacaggaactaaagcaaataatgttcaagttcaattacttaactcagatgcagcaacaacaatccagttaggtactgattctgcaacacaagatgtccatccagtacaaatcgacaatgctaatgtaaaccttccatattttgctcaatattacgcaaccggacaatctaccgctggagatgtaaaagcaaccgtcaactataccattgcctacgagtaa

SEQ ID NO: 1012 - DNA, 2613 bp, Proteus mirabilis
ccattaattcaccataggattatcggtgccatgcaagaacaatatcgtcccgaagatatagagcaaactatccaggaacactgggaaaagaacaatacatttaaagtgacagaagataataacaaagaaaaatattactgcctgtcaatgctaccttatccttctggtcgactacacatgggacacgtccgtaactacaccattggtgacgtgatttcccgttatcaacgtatgttgggtaaaaacgtcttacaacctattggttgggatgcgtttggtttacccgcagaaggtgctgccgtaaaaaataacaccgcacctgcaccgtggacttatgaaaatatcaattatatgaaaggccagttaaaaaaactgggctttggttatgattgggatcgtgaagtcaccacctgtacaccagaatattatcgttgggaacagtggtttttcactaagctgtatgaaaaaggtttagtgtataaaaaaacctctgctgtaaactggtgcccacacgacttaaccgtactggctaacgaacaagtcatcgatggttgttgctggcgttgcgacacccctgtcgagcgcaaagaaattccacagtggtttattaaaatcaccgattatgctgaagagctgttaaacgacttagatacgttagatgaatggccagaacaagttaaaaccatgcaacgtaactggattggccggtctgaaggtgtagaaattacctttgatgtcgcagatagcgacgataccatgaccgtatataccacacgtccagatacctttatgggggtcacttatgttgctgtggccgccggtcatccattagctcaaaaagccgctcaaaataatcctgaaattcagcacttcattgatgaatgccgtaacatgaagatggcagaagctgaaatggcaaccatggagaaaaaaggtattgctacaggtctgtatgctattcatccattaacccaagagaaagtcgctatttgggtagctaactttgtcttaatggaatacggtacaggtgcggttatggccgttccaggtcacgatgaacgcgactgggaatttgccactaaatatggtttgccgattaaagcggttattgctgatgcagaaggtaaccaacctgacttatcaacaggcgctctgactgagaaaaatagcctgattaactctggtgaattctcaggacttgataaccaagctggttttaatgctattgcagataaacttactgcaatgggtgtgggtgaacgtaaagtgaattaccgtttacgtgactggggggtttctcgtcaacgttattggggtgcgccaattccaatggcaaccttagaagatggtagcgttgttccagttcctgatgaccaattaccggttattttaccagaagatgtgaaaatggacggcattaccagtccaattaaagccgatcctgagtgggctaaaacaacgattaatggtcaaccagcgctacgtgaaacagatacttttgatacctttatggaatcttcttggtattacgcacgttatacctgccctgattacgacaagggaatgttagatccaaaagctgctaactattggttaccggttgactggtacattggtggtattgaacacgctatcatgcacctgatgtatttccgtttcttccataaattgatgcgtgatgctggtttagttaattctgatgaacctgctaaacgcttactgtgccaaggcatggtattagcagatgcattttattataccggtgaagatggcgctcgccattgggtctctcctgcagaagcgattgttgaacgcgatgaaaaaaatcgcatcatcaaagcaactgacagtgcaggccatgaactgacttacgctggtatgagcaaaatgtctaaatcaaaaaataacggcatcgacccacaaaccatggttgagcgttatggtgctgataccgtacgtctatttatgatgtttgctgcaccaccagaattaacacttgagtggcaagaatcaagtgttgaaggtgcgaaccgtttcttacgtcgtttatggcgtttagttcatgagcataccgaaaaaggaacgactcaatcacttgatttggcaacattaaccacagagcagaaagacttacgtcgcgatttacacaaaactatcgccaaagtttctgatgatgtaggtcgccgcttagcattcaatacggctattgctgcgattatggagttaatgaataaattaacacgtgcaccacaagagactgagcaagatcgtgctttaatgcaagaagcattagaagcggtggtacgtatgctttctcctatcattccacatgcttgttttgtcatgtggcaagcgttaggaggtaaagaggatattgatgttgcaccatggcctgttgctgatgaagaagcgatggtcgatgacacgaaacttattattgttcaagttaatggtaaagtacgtggtcgtatcactgttcctgctaattcagaaaaagattatgttcaggaaatggcaacaaaagagtacagtgttgctaaatatttagaaaatgtcaccgtacgtaaagtgatttatgtaccgggcaaattactgaacatcgttgttggctga

SEQ ID NO: 1013 - DNA, 1464 bp, Proteus mirabilis
ctattatctcactgtaaataccggatttatacaatgtcgacgataaaaaaactgtacattaaaacttggggctgccagatgaatgagtacgattcatctaaaatggcagacctactcgaaagcacccacggttatcagttaaccgatgtcgccgaagatgcggacattctactgctaaatacctgttctatccgtgagaaagcacaagaaaaagtctttcatcagttaggacgttggaaaaattttaaagataataaacctgatattatcatcggcgttggtggttgtgttgcctctcaagaaggtgaatacattcgtcaacgtgcgcagtgtgtcgatattatcttcggaccacaaaccttacaccgcttaccagaaatgattaatcaggtaaaaggcaccaaaagcccagtggtcgatatcagtttccctgaaattgaaaaatttgaccgtctacctgaacctcgtgctgaaggcccttctgcatttgtttctatcatggaaggctgtaataaatactgctcattttgtgtagtgccttatacgcgtggtgaagaagtcagccgcccttgtgatgatattctatttgaaatcgcacaactggccgctcaaggggtacgcgaagttaatctattaggtcaaaacgtcaatgcttatcgtggtgaaacctttgacgggcaaatctgtagctttgcagaattactgcgcctagtggcagcgattgatggtattgatcgtattcgttttactaccagccaccctattgagtttactgacgatattattgcggtttatgaagatacccctgaattggttagcttcttacacttaccagtacaaagcggatcagatcgtattttaaccttaatgaagcgtaatcatacagctcttgaatataagagcattattcgtaaattacgcaaagcacgccctgatattctgataagctcagactttatcattggtttcccaggtgaaacgcaagatgatttcgaaaaaaccatgaaattaattgcggatgtaaactttgatatgagctttagctttatctattcagcccgtccaggaacccctgcggctgatttacctgatgatgtgagtgaagaagagaagaaacagcgtttatatctgttacaacagcgcattaatcagcaagcaatgaactacagccgtgccatgcttaacagcgtacaacgtattcttgtagaaggcccttcacgtaaaaatgtgatggaactttcaggtcgtaccgaaaataaccgcgtggttaacttcgaaggtacaccggatatgattggtaaattcgttgatgtcgaaattgttgacgtttacgctaactcattgcgtggtaaagtggtcagaacggaagatcaaatggatttacgtatccatgaatcaccagaatccgttattgcccgtactcgtaaagaagatgaattaggtgtaggtgtttaccaaccttaa

SEQ ID NO: 1014 - DNA, 1437 bp, Proteus mirabilis
ttatttactcagaccagaaacggtactcaaaacaagggagggagcactgtgatgaaccaagttccgaataatttaatggcggaacaaaatgttattggaggactactgcttgacccgcaaagtgataatgcgcaatcaattttttcactgctaaaacctgaagatttttatgcccgacaccatcaaattatttatctcaccctgcgagaaatgtatacccaacgtatgccaatagacatcatgacggtgacggattgtctggagtcaaaaggccgaattaatcaatcaggtggttttgcctatcttgctgagatggcaagagaaacaccgagtattgctaacattatggcttatgcgaaaaaaatccgagagtgttccgcacagcgttttgttatcgaaaagacggttgaaattcaaaagctcatgatggcgccaagtgagttaggttttacagataaaattgaacaagcacaacgcttgcttgatgaagctacttcgtttggaaaaatggggagaaaaacagggttacgccgaattgatgatgtgctggatgatgtttttaccgacatttgtgatcgacaagataacccagagaaacatcgaggattaaaaacgggatttaaagattttgaccgcctattaagcccaaaacagattgtcatcggttcactgttcgtgattggtgctcgtccaaagatggggaaaacaaccgttctcactgaaatggcaaagaatgtttcacaacaaggtaagcctgtattgctgttcagcatggagatgacagataaacagcttgttgaacggacactagcccaacaaacccagattaattcagataaattttaccaaaagttagaggagcatgaatgggataggctttgcagtgccatcggtcgccttaaagatgagcccaatatttgggtggatgatacacccggcatgtccttacaacacattcgttctgaaagtcggagaattaagcgcaaagtcggtgatattgggtttattggtgtcgattacctcactctgatgcaagcgggaaaagctgaccgtaatgatattgcctatggtgaaatcactaaggggctaaagatattggcaaaagagctcaatacggtggttgtgttgcttgtacaattgaatcggggattggaaaacagggcagataaacgccccgtaccaagtgattcaagagacacaggacaaatcgagcaagattgtgattattggttaggcatttatcgtgatgcggtgtaccacgataatgcggatgaaacgctgaccgagatgattttaaggctcaatcgacacggtaaaacaggcaccgtgtatgttgatcaacaaggattgagtattacaccggttgatcaatatatggctgcttatcgcgctcaaccgaaacgagaacccaaaaaatattgtgaaaaatcgttttaa

SEQ ID NO: 1015 - DNA, 1542 bp, Proteus mirabilis
cgaaaaactcaccttcaatatttccggtatttcacaacaaataatccctttaagagcggcttgccactggtagaaatcatgatgaacaatacttcttatgcatggaaacaacagctactgacagcgcttgatgaacagcaagtcagtagtgctatcaatgataatgatgccgactgggaatatattgacagtgaaatgataaagttcggctcactcagtcatggtcaattagatattaaagagatccagcgtcgctgtttacacctatttgaaacgcagactaaagattttcggatcttagtccatttattacgtactttacagcatgctggagagccaaaagaattagtattggcagcacagatcctaactgattttaatcgtcaatattggcaaagttgctacccaaccaatatgaaattgaaatcacgtttagccaatcaagttttgaaacgttttgaaacagcgagtgagagtttttgtcatgcagccaacagtgcgatgcgtgatgatattctaggctcgttcgcctttctagcgcaattttggcatgaacaaagcccagcacttgcagaacaaattgatgatctaagcagagattataatcgtattgaaaataacgatgcgccgattattgttgcttcacctgccgagaaagaagaaaaagtacagactccgccggttagcgagtctatagaaacaccgacaaaaaatagcttaacaccaactattaacgttaaccatcaagatgaaagacaatggaaacaaacattacttcaagtagctgatgttatctgccaacaagcccctgaaagttcagtaggatatcgtatacggcgttatgcaatttggcacgctattacggtcttacctcaagctaatgctcaaggtaaaacgcctttagcccccgtatcaattgaccgtgtaatggattacaaagctcaactgactcaagcgtccattacgctattaaacaatattgaacagagtctctcactctccccttactggttagaaggccatatgttagctgcccaagtagcaactaaattaggttatggggaagtagaaagtggcattattgaagagttacgtatttttttagcgcgtcttcctgaacttgttaacttgcacttttcggatatgacacccttctttcctgaaagtgtacaaccgtggttagagcaatataaccaaactgaaaacggtcaattgccaccatcgaatacaaatactgcaatcctagagcaagaagtcttgcaatgttatgagcaacaaggtcttgaagcagccctgaagcttattgaattaaatcttgctagcagatcagagcctagagatagattttatggacaattattgtctgcacaactatttgaattgtcaggtatggattatatggctacacagttataccaacaacttaatacctctgcctcacattattcacttgcagattgggaacccaacttaatacgacaactcatgcaaaaaatagacaaaaagacagaaataacaatgactatggatagggatcaataa

SEQ ID NO: 1016 - DNA, 828 bp, Proteus mirabilis
cggtatcatcacgtcaatgattgtatcattatacggtgtaatgttgagatagtgactaagagaaacagacgaatgaaagaaaattattattatttggagcaaacttcagaaatagcgagtaacaaaaacgcattgttacaggcagattggcaacgattttgtcaattgttatgctatgaaggcattgaaattaaacaaaataatgatgaaaaacgacaaaataaggcagtgatttgtcgggttaaaatgaaaggggaatattcatcaaccttattcatgcagattttgggggaaggagagttacaattaacccttgaacaattttctcaacctagtggattggaacattttctgacacagttttttgccttaattgattatcaacagcaggtaaatgctaagttgagcaaaaaagcactgatccaatttcatagtcgatataaatatttgttaatggcttattctcaagtcgcttatcgagaattggggcgttatatggccaatatccctaattcgctaccgctgttacaatttgccgagcagtatcaaaaggccttaatgaaagcactgtcaataccagcaactcgagaagggcataccaatgcattaatgcatatggcgggatattttaagcgagcacttagcgcagagcaaaaacagttgttaacacaagagattttatcttatcggcaaggaaaaacgagtctttcggctcctttgtcacggttgaaaaactacttggcgttttatcctgataattatctactttctcaacgctatttttcaccttatccagcggtatttgatgacttaagagcgcaattttaa

SEQ ID NO: 1017 - DNA, 405 bp, Proteus mirabilis
atcatgaatcagtcgacaattaatactgaaatacgaaagctggtggcgagcattggcaaggatttaaatcttaaaatcgcatggcccaatcttccttttaatgatattaacgatccctatcttcaactccatatcatgccagtagaaacggataatattgggttatctcaggatatgcctgtttatcgtggtgttattcaaattaacgtggttggcaaagtagggggtggagactcgcgactctcaacgattgttgatgacgttaaagccagattggagaacggattaacattaggggagggagtctacattaacggagagcctagccagttccctccaatttcagatgaaacaaattataccattcctattcgtgcatcctatcgatgtaacgcaatccgataa

SEQ ID NO: 1018 - DNA, 288 bp, Proteus mirabilis
ttcaattgtcaacacgcatattatctatcaggaaaatggctggggtacctggattcgaaccagggtatgccaggatcaaaacctggtgccttaccgcttggcgataccccacctgataaattgacgacggttaaaatggtgcgggaggcgagacttgaactcgcacaccttgcggcgccagaacctaaatctggtgcgtctaccaatttcgccactcccgcaaaaaaatatggtggctatgacgggattcgaacctgtgaccccaacattatgagtgttgtgctctaa

SEQ ID NO: 1019 - DNA, 252 bp, Proteus mirabilis
aattatcgtcattaccttctcatatcttacaaaattcgcctcgatttggttaaaacgacctatcttgaagtatgttgctactttcagaaaactactagacgatttacaatgtcaactcgaataagtttatcgggggttttacttctgagcgaagaaattctatcttatccctacttatgtattcgttggctaagtagaggtaaaactaaacctcctctaactagatttctaatttctgtttttccagcttga

SEQ ID NO: 1020 - DNA, 1176 bp, Proteus mirabilis
aatacaatccatcaaatggtgggcctgctgatactgatttacctctgggatgaaaaacgcgccaatgaattattggaaaataatttatcgggggttaaacgtctttcttatgatgatgcattagcgagtggttatattcacgagcaagatttaattatgccttatgttaaagcgttaggtgacgttgttgatatgaaggcaattaaaaaagcgggtttgaaattaggtgtcgatccactgggtggttcaggaattgaatactggaaacgcataggtgaatattacgaacttgatcttgagttggtaaacgatcaggtggatcaaactttccgctttatgacattagatcatgatggtgtgatccgtatggattgctcatcaccttgggcaatggaaggtttattgcaactgcgtgataaatttgacttagctttcgccaatgaccctgattacgatcgccatggtattgtcactccttcgggcttgatgaatcctaaccactatttagcggcagcgattaattatctttttcgccaccgtcctcagtggtcaaatgaggtaaaagtgggaaaaacactcgtctctagtgcgatgattgaccgagtcgtggctgatttaggtcgcgaacttgttgaagtacctgtcggctttaaatggtttgtgcaaggtctattcagtggcgagtttggttttggtggtgaagagagtgcgggggcatcattcttacgttttaatggtaaaccgtggtcaacagataaagatggtattatcttatgtttactggctgctgaaataaaagcggtaacaggtaaagatccacaacaacattataatgagttagcgcaacgttttggctctccaagctataatcgtatacaagcatctgcaactcatgagcaaaaagcgttattgtcacgattatcaccagaaatggtcactgcaaataccttagcaggtgatcctattactgcgcgtttaactcacgcatctggtaatggtgctgctattggtggtttaaaagtgatgaccgattatggttggtttgctgctcgtccttctgggacagaagaagcgtacaaaatttattgtgaaagcttccgtggccctgagcatcgcgaattaattgaaaaagaagccattgaaattgttaataatgtttttgccagtaaacaataa

SEQ ID NO: 1021 - DNA, 219 bp, Proteus mirabilis
agccaataccaaacaatgatggcaaataccgcagaaaaggataaccaaaaactagcggataatatggcaagcggatcaagcaataaaatcactgccgcactccaaatcgcccactgccaaggtaaaaaaagtccactacgccaatggagtaaaacccaaatagttaggcctattatcgctctggttgcggggatcccccatcctgataaagccgcataa

SEQ ID NO: 1022 - DNA, 744 bp, Proteus mirabilis
ggccaataccattatcgacatgctaaggaaaaaggcagaagggaaatgattagtaatgacatcattctaagcaaaacaggcatcgatttaaccaaagtagagcaaggaagcgaagaatggatgtctatcaggctcggtgtagtaaccgcctctgaggcatggaaggttatctctaagccaaagtcagggaaaaaatggacagacacaaagaaaacatatttaaacacccttattggtgaagtctgtacaggagtttacaaggaagtatcagcaaggacgctggaatggggtaaaaactacgaattagaagcaaggatgacattcgagttttacaccggattaacggcaaaggaagtgccaataatatttaaagatgagcaactacggatggcttgctcaccagacggcatttgcagtgatggctctggattagagcttaaatgtcctaataacacggacgtatttatagacttagcattgaatggaatcgatgcaatgaaaaaggaatatgtggctcaagttcaatattccatgtgggttacaagtaaggatatctggcattttgcaaattttgacccacgaatgcctgcaggaaaagaaatagcatatttccctgttgagcgtgacgaaaaaatgatgaaagaatttgacgagttagtacctgagttcattgaggtgatggatcagggattaaacaagttaggtattcaatttggcaatcaatggagtgtatatggcaattaa

SEQ ID NO: 1023 - DNA, 264 bp, Proteus mirabilis
aaaatgcaccaatttttactgatcgacgaagcaacatcgagtatcgattgttcatcagaagtattaattcaacaagctttatcattgttatcaaaagataagacaatcattatgattgctcatcgattaaatagcattaaaaatgccgataacattatcgtaatggaaaatggaaaaatagcagaacaaggaaaacatgctgagttacttgcaaaaaatggcttatatgcacatttatggttacaacagaaagcgttatgctaa

SEQ ID NO: 1024 - DNA, 873 bp, Proteus mirabilis
tcaataaaccatttaacaaggtcacctcggtggccttttttattacctaaactcagctcagggctgagttattacaacgcgctaggcgcatctaatcccaaggggaatcacatgttatttatgaatatcgaacgcaaatattattcacaggctgatgatggttcgcaaggtggaggtggtggaacaccggaaatcactccagaaattcaagctattatcgaccagcaggtttcagggctaaaggctaaaaacagtgagttgctaggcaagctcaaagagcaaggcgataacctgaaacgttttgaaggcattgacccagacactgtgaagggcatgcttaaacgctttgagaatgacgaagaagccaagctcattgcagatggcaagattgacgaggttctcaataagcgcactgagcgtttgcgtggtgatttcgacaagaagttaaaagaagcaagctctaaagctgaaaaggcagaggcgtttgcaaataaattccgtgctcgtgtgttaggcgatgaaattcgttctgcagcagggaaagcgggtgcattaaccagcgctcaagaagatttaattttacgtgccaaaggcatttttcagatcaacgatgaaggtcaggccgtagccgttgatgaagatggcaatccaatcatgggcaaagatggtcgcacgccattatcacctattgaatggattgaatccctaaaagaaagtgctcctcacttattccccgcagcctctggtacagatgcagggaaacataaacaaggtggtgcacattttaaacgttctcaaatgtccgccagtgacaaggctgattatattcgccgatacgggcgtgacgcatatttaaaacttccaaaagagtaa

SEQ ID NO: 1025 - DNA, 240 bp, Proteus mirabilis
cgctcaaaccatgttttgactaattcgggctggctcaccgctgtagagccaatcacaacccgacttgctcctgcggctaatagtgacttcacatcttcttcgctacgaataccaccaccaacttgcacaggaacgttaacacaggcaactagctgttttaatagtgggatctgccgtgcaagtggatctttcgcgccagttaagtcgacgagatgcaataattttgctccgtcttgttga

SEQ ID NO: 1026 - DNA, 1290 bp, Proteus mirabilis
acagttttacagaaaacaccggagaataaccttatgactcaaccaattacagcaacagacttttcaattaatgatatgaaaacattaattgaaacaatgcaaatttataaaaaagataaccatgacaaagggataacacgtattgcctatagcgaagaagatgaagcagcccatctctatcttgctagtgtaatgaaagaggcaggccttgaagtctatcgtgacggtattggcacactctacgctcgcttaccggggcaagatagaacattacccgccgtaggaacaggctctcaccttgataccgttccccaagggggcgcttatgatggcgccttaggagttattgctggtttttatgctttgatgcaatacaaaccacaacaactgaaacgtgatctagagttaattgtattccgagcagaagaatcgagccgatttgggttttcatgtatcggaagtaaagtgctaacagggaaaattgaccgtactcgatgggaacaaaatagagatgatgaaggtaataatttctttgatgttttaaaatcccttggttatcagcatgaaaacttagatcaatgtttacttaaatcagaccgttatagtgcatttgttgaattacatattgaacaaggtaaacgtctagaaaacgatcaaaaaacaattggaattgtcaatggtatcgctgcgccaacacgcttttcagtcaccgtaaatggccatgcagaccactctggtgcaacgccaatgtatcaacgtcaagatgcgttagtggcgagtgcgggtattattactgatatcaatcatgctgcctgtacggaagcggtatacggcaccgtaggtaccattggtaaacttaatgtcataccaaactcgatgaacgttattccagggcaagtaaaattctccgtggatattcgtggtattgatacggacagtattcaacgtgttgtacagcgtttaacaaacagtgttgagaaagcagaaaaagattttggtgtaaaaataatagtgcaacctatttcggctgaatcaccagtaaaactggatgactctatttgccaagttattgaaagcatttgtcaaaaacacgatatcaattatatgactatgttaagtggtgccggtcatgactcaatgaatatggcatctttatacccgacagcgatgatttttaccccctctgttgcggggattagtcatcacccagatgaatttacggagtttagtgatattgcaatagctgcagatatcttagcggaaacattaggtgttctagctaatcaataa

SEQ ID NO: 1027 - DNA, 207 bp, Proteus mirabilis
cgagcattacaaggagtttttattatgggtaaaaaacccggtgaaaacacaggtaaagatggcggtatctatcgagaagttggacctcgtggcggtttaaaaaacaattatgccacagtgagagacaacgaaaagctaccaccaacaacgcaatcaggcaacacatgggttcttgaaaaaagaacaccaaacagtaagcgtccttaa

SEQ ID NO: 1028 - DNA, 303 bp, Proteus mirabilis
aataaattacatctattgtggattaagaaaaaaaataaaaacaaagaaagttatatatcagaagaagagttaaaaactcgtttcttcaagtccatgaaaaatattatatacaaagataggttaataagttggatgcatattaatagtgagtttttcacacctgaattaatagctacttggataaaaaccgtttcaaattcatcaaccaatagtattgactatgaaattaatcgtattgaattagaaaaatcaataaaaaaaattaagctcagggcaagctattttcttatatattatgactga

SEQ ID NO: 1029 - DNA, 531 bp, Proteus mirabilis
tccatagcacactttgaaaattggtgtatgataaatacgtcagttgatttaggacacatatctatgaaatctaagcgggtgcagatcacaatctggcactatatacgatcattttttatactttatctttgtctttttgccggtaatcttatttcagccttattacctttcgcggtgccaggcagtattgttggactacttattctatttggtttacttgccttccagcttattccattacgttgggtaaaacccggtggtaatattttactgaaaaatatgtcattactctttattcctatcggggtgggtgtaatgaactattataatttattaagccaacaactctttcctattgttctggcctgtgttgtcagtacctttgcggtgatggcgctagtcgcttactgctcacattacgtgcatcgtgaacgtcctattatcggtgctaaacccgataaagtagaggatgtagaattagcagaacaacaagacgacgacagagcgttaagtgagaagaaaaaatgttaa

SEQ ID NO: 1030 - DNA, 438 bp, Proteus mirabilis
agcaaaaaacaaacttacaggaaacaaatcatgagcattaaaatagacccattaatagaaagtgtgcaagtgttgcataatgagattgaaactgtttttactcaaacccctattgctacacaggcattaaaaaatatagaaatgttacttgccaacacgttttctatgattggtataacaggaaagaaaataaattatgatgatgtaatggcaatgttttctcgtaatgcagggaaaaggccagaattgaggattgaaacagatagttataacattatttaccaatctgaacattgggcaacggtgagctatcgtgaaacgcattatgaaaataagaagattctcacccgtcaatctgtggtggttttgagacgcacgtctctagattgtcaatggcagtggtattacttgcatgaaacacctgtattagataattga

SEQ ID NO: 1031 - DNA, 1032 bp, Proteus mirabilis
gaactgaaacaacagcactcaccgcaatcaccgctttgcaggttcggttcggcgatctgggataaaggagaaataatgattaaattaggtattgtgatggatcctatttcatccatcaaaattaaaaaagataccagctttgccatgttactcgaagcacagcgccgtggttgggaaatccattatatggaaatgaacgatctttatcttaatcaaggcgaagcccgtgcacacacacgtctgttaagtgtggaagaaaaccctgaaaagtggtttgaatttggtcaagagcaagatattgcgttaggctcccttgataccattttaatgcgtaaagatcccccattcgataccgaatttatctatgctacctatattcttgaacgtgctgaagatatggggactttaattgttaataaaccacaaagcttacgtgattgtaatgaaaaactgtttacagcatggttcccttcattaacgccaaatacattagtcactcgagaagccaaacaccttcgcgctttccatgaaaaacatggtgatgtgatttttaaaccacttgacggtatgggtggcgcctctattttccgcctgaaaaaagatgatccaaacgtcggtgttattatcgaaaccttaacagagcacggtcaccgtttctgtatggcacagaatttcttaccagaaattgttgatggtgataaacgtattctggtagttgatggagagccggttccttattgcttagcccgtatccctgccaaaggggaaacccgtggtaacttagctgcaggtggccgtggagaagcgcgcccattaacagaaagcgattgggcaattgcacgccaagtagcacctatcttaaaacaaaaaggccttatttttgttggattagatgttattggtgatcgtttaacggaaattaatgttacaagcccaacttgtgctcgtgagattgaagcagcttatcctgaggtttctattacaggtatgttaatggatgctattgaagctcgccttaacaagaaaaactaa

SEQ ID NO: 1032 - DNA, 1179 bp, Proteus mirabilis
atagtgaaacagaataaacaaacaacattgatacatagtgggcgtcaagcaattaaaacatctggcccaattaaccctcctgttatgagagccagtactattgtttttgattcaataaaaagctggcgtgaaatacgcgatcgtcgtattactgaacgagtattaagctatggtgctcgtggtacagaaacagcgtttgcacttgaagcattagtaactgaattagaaggtggttatcgagcacagctctttcctacagggctagccgcaattgcatttactattatgggctacgcccgaagtggtgggcatgttttatttgctgattctgtctatgaacccgtacgtaaaatagcctctgcttttttagagcctaataatatcacttatagcttttttaaaactgacggttcagatttcgagcaaaaaattcaagaaaacactcaacttattttcgttgaatcaccgggttcattactttatgaaatgctggatctaccagaaatttgccatatcgctcatgaaaaaaatattcctgttggggtggataatacttggggctcggcatggctttataaccctttggaattaggtgctgatgtttctgtaattgctgcaactaaatatttatgcggtcactcagatgtcatgatgggcattatgatcgcaaatgaaaccgcatggaaacaaattggggcattaccagaagctcttggtcaagcaagtagccctgatgatgccgccttagtcctgagaggaatgaggactcttgctcaacgtcttacaaatcatggtaaatcagcactggctatcgctcagtggttagaaacacgccctgaagtggccaaagtttggtttccagagttacccacacatcctcgccatgacttatggaaacgtgattgtaaaggtagtaatggattattaaccattgaatttaaacaaaaatataccattaaacaatctgaacaatttattgatgcattaaccttatttggtattggtgcatcttggggaggatttgaaagtcttgcattacccgccaatgttatgggtgccagaacagcaacagattggcgtgaaggccacggtccttttgtacgtttacatattggtcttgagtctactgatgacttaattgcagatctcacccaagcatttagtgcattaaatcaataa

SEQ ID NO: 1033 - DNA, 2751 bp, Proteus mirabilis
gaggctgaacatatggcaaagctgctcaaggcaatgaaacgcccagcggcgctgtggggggtgccaatggtgcccctgctggctgtcacgggtgtaaccatcatcgttgctgtctggacttccgtcgctctcctgttcttacttcctttgcaatttctggtgatgaagtccctcaccagaaatgaaccgatgcggttcagtctgattgccgtatggctgagagcgaagggaaagccggtagcaaaccgtttatttggcgcaacaacatttatgcccgttgagcatgaggctgttgatatcagggagtttatagacgccatgaaactcaatcagtgtgccaccatcaggaagtacatcccgtactcatcgcacattcatcagcatgtggttcgttcccctaagagcgatctgtactgcacctgggaattgatgggaacgccgttcgactgcgagtctgacgaatcgctccggttcgggacgaaccagttacacgggctaatccgctcattcgaaggtatgcccgttactttctatatccataacgaccgcaatacgtttaccgacaatcttcataaagattccggcaacccgtatgcagatgaagtcagccgtctttactacgcttctgtcggtctgttccggcgcaaccgcctgttcctgacggtctgctatcgcccgtttgtcagccttgaaaaagcagaacgtaaacggatgaaagacagccagaaactaaaggagctggacggtgctttgctggaaatgctggaaataaaaagcacgctcgataccgcgctgtcgcgctatggtgcgcggcctctcggtacgtttaccgaaggaaacgcggtgttttcgtcgcaactggctttctatgaatatctgttaacgcaccagtggcgaaaggtgcgcgtcacccgcaccccggcctatgacgtgatgggagcggcggcgttgttcttttcggctgaatccgggcagataaaccacgccaacggtacgcaatatttccgggggctggaggttaaagagttctccgaagaaaccgccacggggatgatggactcccttctttacgccccctgcgattacgtgatcacgcagtcctatacctgcatgtcacgcgaggaagcgaagaaagccattaagcgtacccgtcgccttttgatgagtgccgacgacgatgctgtttcccagcggctggatctggatgtggcgcttgacctgctgacatcggggaaaatcgcttacggaaagcaccatttttccatcatggtgtattccccgtcgctggaaagcctggttgctgatacgaacgaaatcagtaacgcgctgaacaacatcgggataacgcctgttccggcagaaatatcgctttcagcggcgtatatggcgcaactgccaggcaactacaacctgcggccacgtaaaggggagctgagtagccagaactttgtggagctggccgcgctccataatttctatccgggcaagcgcgataaagccccctggggggatgcgatggctttactgcgcaccccgtcaggcgatggctactatatcaacctgcataacacactggcagataaggacgaattcaacgagaagaacccggccagtacctgcatcctcggtacgaacggttcgggtaaaaccatgttgatgacgttctttgagatcatgcagcagaaatacgggcgcgaggatagtttctccccggatgccaaaaccaaacggctgacaaccgtttacctcgataaagaccggggcgcagagatgaacatccgggcactgggtggccgttactaccgggttatcagtggtgagtctacagggtggaacccgttctcgttgcctgcaaccaaacgcaatatcaatttcatcaagcaactgatgaaaatcctttgtacccgcaacggctcgacgatctccccacgcgatgaacgccgtctgagtgatgcggttaatgctgtgatgaatgacgagccacaatatcgcgtctacggcattacccgaatgctggaaaatttgcctgagccggctacgaaagaagcccaggaaaacggccttagcattcggctgtcacagtgggcgcagggcggtgagttcggctgggtgtttgataacgagtctgacacgttcgatatcagcaactgcgataacttcggcatcgacggaacggagttcctggacgatgcaagcgtatgtgcgccaatctcgttttatctgctgtaccgcattaccagcctgcttgacgggcgacgcctggtcattttcatggatgaattctggaagtggttacgcgacccggtgtttaaggactttgcttataacaagctgaaaaccatccgtaagctgaacgggatgctggtcgtcggcactcaatccccggcagagatcatcaaagatgatatcgccccggcagtgattgagcagtgcgggacacagattctggcggcgaaccccaacgccgaccgcgcacactatgttgacggcatgaagtttgaaccggaagtgttcgacgtggtgaaagggcttgacccgcaagcccgccagtatgttgtggtgaaaaatcagttcaagcgcggcgataccaaacgttttgccgctcgtgtcacgctcgacctgtcgggtatcggcagatacaccaaagtcatgagcggcgatgcccccaacctcgaaatattcgaatcgatttaccgagaaggaatgcagcctcatgaatggctcgatacctacctggctaaagcgctctga

SEQ ID NO: 1034 - DNA, 429 bp, Proteus mirabilis
cttaggagacatattttgcgcctatttggttatgcaagggtatctactagccagcaatctctcgatactcaaaagaaagcattgattgatgccggagtggcaaagcatcgcttatttagcgataaaggatcaggaagtcacattaatcgtgatggattgcagttactcaaaattaaagttgaatgcggtgatattattcttgtgaaaaaactcgaccgtctcggacgagatactgcggatatgattcagttgataaaagaattcgattcaatgggtgtagctgttcgatttttggatgatggtataagtacagaaggaacaatgggaaaaatggtggtcaccattttatccgcggtggcagaagcagaaagacaaagaattttggaacgaacaatgagggcaggcaagaagctttgctcaaaggggtaa

SEQ ID NO: 1035 - DNA, 900 bp, Proteus mirabilis
acaatcatgcaaaatcaaatagaccgaattcgttcttttatcgccgtagtagatacaggctcttttacacaagcagcaaagtatttacgcttaagtaaatcaatggtgagtattcatattaaagcattagaaacggaattaaatgtatctcttcttaatcggaatactcggcgcttcacattaactgaaacgggagaaatcctttatcaagattttcgtcaagttttagttcaactcgaacaaacattagataaggcacggttaggacaacaaaacttacagggaactttacgattaacttcaacggctgaatttggtgaacattatatattgccacttttacatcaatttatgtgtttacaccctcaactaaaagtgcaatatatattcaattcttctattgatgatcttatcaatcataagttagatttggcgatacgccttggcgcattaaaagacagtaattatcgctatcgcaaattagcagattacacaatcaaattagtggtatcaccacatttattgaaaaaatatcctatccaagaaattgcagatttagcggcagttccctatcttgcaaacagcaatttacgccatagcaaactcagccaacaagataaaatcaatcaactattttcacaattgcactcaatggcacttttcgaaacgaatactattagtgcattaaaacagatggcactcaaacaaatgggaatgactatattaccagagtggtacattcaacaagaaataacacagggtgaacttgttagccctattcctgaacttaccttattaaatcaatctattaatgtcatttttccacatggtgaacatatgccaagaaaaacccgtctatttattgattttttaaaagagagaattaattctatgccctaa

SEQ ID NO: 1036 - DNA, 1149 bp, Proteus mirabilis
tgttggatgcacttaagaatgcttaagttaccaccattaagtttgtatattcatattccttggtgtgtacaaaaatgcccttattgtgattttaattctcacaccttaaaaggcgaagttccacatcaggaatatgtgcaacatctgctcaatgatttagatgctgatcttactcatgttggctctcgtgaagtgcaaactatctttattggtggtggcacgccaagcctattaagtgctgaatcaatggctgatttactgtatggcgtaaaagagcgcatagccgttgctcctgatgctgaaattacgatggaagccaatcctggtacggttgaagctgaacgatttgccggttttcaacgggcgggaattaaccgtatatccattggtgtacaaagctttggtaatgataaactgatccgcttaggacgcattcatgatgccgatgaagctaaaaatgccgcgagactagcaaaagagttaggcttacgtagctttaatcttgatttaatgcatggcttacctgaccaatcattatctcaagcactttcagatctacaacaagcaatcgctttatctcccccacatctttcttggtatcaattaactattgaacccaatacgcaatttggctcccgtccgcctaaattacctgatgatgatatgttatgggatattttttctgaaggtgacaaattactcaccgcagcaggatatcaacaatatgaaacatcggcttattgtaagccaggttttcaatgtcaacataacctaaactattggcgttttggggattatttaggtattggctgtggtgctcatggaaaaataagttttgccgatggccgaattatgagaacggtaaaaaccaaacatcctaaaggttttatggcaggacgttatcttcaccagcaaaattgggttgataatgatgaccgtccatttgaattttttatgaaccgctttcggttattagaagcttttcctcggcaagattttagcgactacacggggcttgcacaagagactatccgtaggcaaattgatgaagcactcgcattaggttatatcagtgaaacagaaacccattggcagataacgccccacggtaaactgtttcttaattcattacttgaactctttctttaa

SEQ ID NO: 1037 - DNA, 234 bp, Proteus mirabilis
agagcagtgcaactatcgctgccgtttccggtcttctgcgttgttgcgaggaggtgcattctacgtcttcctcattcagtgtcaagcgctaatttatcaggcttttcactttttattttgttctctcagccagttcgcttagcgccctgtgccgtgacaacgaggacgcattatagggagttttctgaggctggcaatagttttttgaaaaaaaatgttcaacagcatatttaa

SEQ ID NO: 1038 - DNA, 1320 bp, Proteus mirabilis
gtcaacccgcaaagaaaccggatgtcaccattacggtattggaataaagagatggataaatatcagccaacaatttcttttagcatcaaaaatagtgaacagctagaaagtggttatctgccaaatgcgactttaactcaaagtggcggacagattggtagtggcaatcaatgtgactggaaaatccaagataatgaaggtgctattgccgatcggcaatgtacggtgttttggaaagatcaacacttttgcttaaaagtaaattcaggtcctgtttacattaataatgcgattattccattgcatcttgatgccgttagactgacccaaggtgatcagataaaagtgggtaaattagttattgccaccaatattagtcttaccggagagccggtacaaaatatgatggcgatgacgcctcagtctattatcgcaaaagatcataatccgctagattcattatttgatgttgatacaacagtcaaaaatgagcggaaagagcctccgtttgtaccaaccgttcagggtgcattaacaacagatccactacaggctttagaaaacgaaaatctaagcttaatttctaaaaacacacaagctacttcagacgatcctttattgagtgacccccactcgtattcatctgcctttccgacatcagataatcaagagaatactatggtccaagaatttattgatttacctaaaatcacacctaatgaaaacgaacatatgaccgatgtcgatcatgtggcggttaaccctctgatgaagggattaggtatccaccttaatttaacaaatacacagcatgctaatgattttcttgttgaactgggtaaaaccgtcaaagcggctattgaaggtttactgattttgcaacaacaacaagaaagcttacaagataagcaattacgcccaattgaagataatcctctacgtcttaatagtggctatgaagagacaatgaagttgatgtttaccgatgaacgtagccctgtacatctttcagcacctgcggcagtaacagaaagcttgcacaacatccaattgcattatcaagcgaatcaagaagctatttcaaccgcactatcaaccatgttggcagcattctctcctgaacatttattaaaccgcttttctcagtatcgacgagcttcagataacacaccaatgaatgatggctgggcttgggaaatgtacaacaactattacaaagaactctcttcatctcggcaacagggttttgaaaaattattctatgaagtatacagccatgcttatgacagagcgctgagaaaaggaatagaggaagcttaa

SEQ ID NO: 1039 - DNA, 735 bp, Proteus mirabilis
gtatgcgcgcagtttttctggcaactagtgttgtcttattgttgggagccgcttggaattttaaattacatcgtaattcagttatacgctgatgaacttcgttcttcttcacctgtatatttcggagattttatgacaacacaattcaacaataacaataataatatcgataaaaatagtgctctgctggtaatggattttcagacgaccattcttaataatttccttccacaagatcgtgctgaagatgttattcgtaatacatcatcattaatttccgctacgcgtgcagcaggcataccgattatctatgttagtgttgagtttcgtgaggggtatcctgaggttagtcaaaacaacataattttctcatcgattaaagacaatggaatattaatcaccaatagtgaaagttccgctattcatgatgatatttttccgcaggaaaatgaaatcgttattattaaacgtagagtaggggctttttcatttactgagcttgagatggttcttcgtacacaaggtattgaaaccttgatccttgcaggagtcacgaccagtggcgtgattttatctacagttagtcaggcatttgacctagattatcgtctagtgattgcaagtgattgttgtgccgatcctgatcatgacacacatgtttttttactcgagaaaatcttgtctcaacatgctgttgtaaccagttcatctgaaatatcaaaatattgggtataa

SEQ ID NO: 1040 - DNA, 771 bp, Proteus mirabilis
gagatggagcactctatgactgatgatattttactgaatcatgatgatgaagagcgcattacaaagaaaaattaccaactgccgctaagaggaaacaacatcaatccaatgatagatgctgctacacctttattaggcatggtattgcgcatgaaagcgatgtctgaaaccccactttcagaaaagctgtaccaacaagttgtcatggatattacctctattgagcaacaattacagatccaaggttacgagccaggtgccattgtttcatttcgttatgtgctatgtacttttattgatgaaaccgcccttggattaggctgggatcaagataatggttgggtaaaacaatcattactggttcattttcataatgaatcatggggtggtgaaaaagtctttgtcttaattgaaagattattaggtgaacctaagcgttacctcgatctgattgaatttatctacctttgtttatgcctaggataccgcgggcgctacaaagtctctgcgggacaaaatgatgaatttaatcatttattaagacgcttacaaaaacagatccaacagctaagaggtaacgctaagccaatagttctatttgaaaaaggtgataaccaacaaagccgttatcgtttaggtaagcgtttaggggctcgctatattctcataggtacagcggtattcgcgttgattatttatagcatttattcatccagactgaattatcaaacactcagtattgtggaacaacttaatactttacttggctag

SEQ ID NO: 1041 - DNA, 204 bp, Proteus mirabilis
ttgcctaggcatccaccgtgtacgcttattcgcttaacctcacaacccgaaagtgtctctttcaaagactatctgggtggtgatggctgcgcagattacatttcttcgttgggcagtgctcgcaatgctcacatacttaagtatgctgcgcttgctgtgcgctgtccgcctcgaactgtaaattgctcgctcatcccactttga

SEQ ID NO: 1042 - DNA, 975 bp, Proteus mirabilis
tcacaagggcatccaacaggatgcccttgtctgtctagggaatcagctgtgactacaacgttatctaacgcattattgtcagatatattgcaacaaattcgtcctttaattgggcaaggaaaagtagcagattatattcctgctctcgctcaagtacctgctaatcaactggctatggccgtgtatacggttgatggtgagctttatcaagcgggtatggccgataaacgtttctctattcagtctatatcaaaagtacttagcttaacccttgcgttaacacgttatgatgaaagcgagatttggcaacgagtaggcaaagagccttcaggattaccttttaattcgttgatccagttagaaatggaaaaagggctaccacgtaatccttttatcaatgctggagcgatagtgattacggatatgttgcaatcgcgattaagtgcgccaaaacagagaatgttagaagttattcgtgcactgacgaatacagctgatatttgctataacaccgttgtggcaaaatcagagatggaacatttaagtcgtaatgctgccattgcctatctgatgaaatcgtttgataattttgataatgatgttatcaccgtattagaaacctattttcactattgctcgattgaaatgagttgtgtagagcttgttcgttgttttagctacttagcgaatcaaggaatatgtgttggaagtaaaaatcagattattacgccaagacaagcccgacaaataaatgcgttaatgttaacttgtggtatgtatgatggtgcgggagagtttgctttccgtatcggtattcccggtaagtctggggtgggaggcggtattattgctgtggttcctgatgcctttaccgtagcagtatggtcaccagagttggataaatctggtaactcattggcggggtgtgctgcccttgaattattagcaaacaaagtagggcgctcaatattttaa

SEQ ID NO: 1043 - DNA, 210 bp, Proteus mirabilis
ttaccctttaatcatagtgataacgttgaatttaacgataacgtttatttcagtaaagagcccattatggactcattagtgattaattttatcacactaatgttacatttccacgaaataaactgtatagaatgtcaccgtaaaataaatttaagtaaagtgatgttgtctttgatttcgcttgatgaattattcccaacgcttagctga

SEQ ID NO: 1044 - DNA, 291 bp, Proteus mirabilis
atttatttcctcaataaggagtgtcgtatgtttgttgtaatttttggtcgtcctggttgcccatattgtgtccgagctaaacaacttgctgaaaccttgtctgaaaaacgtgatgactttgatttccgctatgtggatattcaagctgaaggtattaccaaagcagacttatcaaaaactgtcggtaaaccagttgaaactgtgccacaaatttttattgatgaaaaacacattggtggctgcacagattttgaagcttatgcgaaagagcatttaggcatctataactaa

SEQ ID NO: 1045 - DNA, 225 bp, Proteus mirabilis
aaacgtcttaaagtgttttatgactacacgaataatttaataaagggaacatacactatatttataatcaaaataaaaaatatttattatatttatacaaacaaccaaccctatacattcataatgaaaatattttatatttattatattgctatttataatatagacttagcgactatattaattataagttctcttattaaaaacaaaacaacaaataattaa

SEQ ID NO: 1046 - DNA, 564 bp, Proteus mirabilis
aggaagcttaatatgcagcttagaactttctcaatattactgttatttagctcttttttaatattgagtggatgtagtaaaccttttgaagccgcgggtaaaatggggaaaatcttattagatccctcaactcctgttgggcaaccgaaagatcagccctctaccgttgcattaaccatccttgcggagccctatattaatcctaatcaggaaggtgaagctgcgccgataaatatccaagttgtttatcttaacgaagattcagtatttggctctgttgatcatgatcagatagatgcaaaagagggtgacttagagaaagttctaaagaaaaattatattgaccatcaagactacaccattttacctggccaatataaacccttccctactatgacgttagacccatctaaccgttacattggcattattgcctattactcagatcctgataaagcagaatggaagaaaatagtcaaagcgcgtggtaaaggacgccactacttcctattagtgcacattagggaaaatgaaatcgaatttagacaagaagaggatgattaa

SEQ ID NO: 1047 - DNA, 600 bp, Proteus mirabilis
ctaataattaaaataataaacaggtattcttatctctactatactcataatattcaatttatagagcgagtatatataatgattgatttgtttaagttaacgaaaaaaagttctaggcatattggtatagcaatatatgttggtattatagcgggtatcttttcagctttagttaaatctggttttgaagacctaattcccccgagaacacttgaaacgacacccccgccagtcgtcttactcgaaaagcttggattaaatatagatactatgacttatcattggatgggatatagtattaattggggcggtaatggtgttcatatattattctcaatagttatcgctgtgacatattgtgttattgctgaattcttgccaaaggttaaattattacacggtatttgttttggtattggcgtttctgtttttgctcatggtttagtcgtacctctactaggattgtctggctggctttggacagcaggttatcaagcattaatttctgagtttgttggaaccgctttttggatctggtcaattgaagcgattagacaaaatttgcgttattgtttaactaaagaaaatgatgctgagtag

SEQ ID NO: 1048 - DNA, 2193 bp, Proteus mirabilis
agaaaaattaaaaatttaaagggatcaacagtgtctaaaaaaattattgctaccaacctattacttgctctccccttcagtctgttatcgttacaaattcatgccgcaatgacacaaaattcacctgataaaatcattgttaccgcatccccctcacaagatccgcaaggaccaatttcaggtttagtggcaacaaaaacactatcaacaaataaaatacttagtgatatagataagacaccacaatcaatcagtgtcattacacgtgaccagatggatgcgcaagatgtcagttctgtctctcaagcattgcggtatacacctggcgttttcactgaatatcgcggcagttcaaaccgaaatgatgaaatttttattcgtgggtatagctatgcccctcgctttcttgatggacttagttatggtatgggagcctcatcttctacaggagctattgacccttggctattagagagagttgagctgatccgtggcccgtcttctgttctatatggtcaattaaatccaggtggtcttgtggcaatgaccagcaaaagacccacttcaataaccattaatcatattcaagcacgtgtaggaaatgataaattagcagagacagcttttgattttgcaggctcattaagtgatgataatcgtattctctatcgccttaatggattagcaaaaacacaacatactcaaattaaagactataaagaagaacgatttgcccttgcccctgccatcacttttttgccaaatgagcagacacgtttaacgttattaagttttattcaacaagagcccgaagcgggataccgtaattttttgccagcttatggtacggtcaaaaaaacacccgaaggcaccattccatttgatttcaatgtaaataatgctgattatcaccaatcatggcgtcaacaatatggcgttggttatgaatttgaacatgaatttaatgatagattaaaattgatccaaaatgcccgttatagccatatcaaacaaaaatataaatatcttgtttttggttcattaagaaaagataacccttatattctggaacgccgagctcaacaggaaaaacgagaaacagatacatttggtattgatactcgactacaagctgattttgatactgaaaaattagcgcatacagtaattataggtatggattatcaatggagtaaaaataaagacaatttattgcaagcgatgggcccagaatatgatctggattggcgaaatcctaattatcattatcctattgatatcagtttacaaaaaccggtgacaaatcaattacaaaaacacgaccagttagggatctatttgcaagatcagatccaatggaaaaactggatcttattagggggattacgccaagattgggcgcaagttcgtacctatgatcacatcaaaaacagcaaagaccaacaagacgatcagaagctaaccggtcgagtgggtctactctatgcctttgataatggtatttcaccttatattagttatagcacctcttttgaacctaatttacagacacgaagagctccgggtagtgcaccatttgagccaagtgaaggacgtcaattagaagcaggaataaaatacctcaccccaaatgaacagacattagcaacactctctatttaccaattacaacaacgtaatgtgactaactataacgctgaaaaagcctattttgagccagtaggtgaaattagaagccgtggtattgaagcgcaaattaatagccaattaactgaaaatatatcatttattagtagctatgcttataccgatactgaagtgagaaaaaccatcaccgcaggtacacaaggaaaagaattaccacgggttcctaaacatatggcatcattttgggggcagtatgatgaaacatcagggctatttaatggtgctaaagcgggctttggtgtgagatatatcggtgtatctcaaggtgacactaaaaatacgattagtgtacctgcagtcactttgtacgatgccatggtaggttattctttaggcgaattatcctcctctttaaaaggggctgaagttcaactaaatatgaataatattgccaacaaacactatgttgcctcttgtgcgggtgaaactgcctgtttttatggcattggcagaaccatgacagcaacgataaattaccgctggtga

SEQ ID NO: 1049 - DNA, 228 bp, Proteus mirabilis
aacatgattaaaagcacaaatatcatgataataaatggtcaccctgcatctgttgtttatggatcagaaataagtgcattccgaggacaatttttagatgtcaatgggtattgtgactttgttgctgatagtattgaagggttgcaaaaagaaggtgcaatttccttagctgaatttggtgagacttgtattgaagaagagatcgcaccttttaaaagtagaagataa

SEQ ID NO: 1050 - DNA, 429 bp, Proteus mirabilis
attaccgttaagatagcaggtcaacaaatgaggaaatctatgcataattggcggtcaggtcgctggctagtgttgataacagtattgctgatcttatgttgtattgttcagcgctctatgggggctcatgtgattagtgagcgcttagcatctgctgtttcgcaaacacagtcctcattctcgacgccaattgcagagcaacaaaatgcaagtgaagggaaatattcactttcaacctgcgaattaagtgctaaatcactcttatcgattcctcctttagcgattgaaccgcttttttatacttgggcggtattacttttatttggtatggctgccatttatgtttctcgtcaacgtagccagaaaaaacaacatcacccacctccacgaataaggcttcaccttcattactgtattctaagggattag

SEQ ID NO: 1051 - DNA, 615 bp, Proteus mirabilis
cactttactaaggaagataatatgcaaaaagtggttcttgctactggaaaccccggtaaagtaacagagttagcctcattactcgctgattttggtttagatattgtcgcacaaactgagctaggtgttggctcagttgaagaaacaggtcttacttttgtagaaaacgcactaattaaggcgcgtcatgctgccaaagtaacaggcttaccggctatagctgatgattcagggatctcggttgatgcattaggtggtgctccgggcatttactctgctcgttatgctggtattgaggcaaccgatcagcaaaatgtagataaattactcgaagcaatgaaagatgttcccgcagagaaacgtcaagctcagtttaactgtgtgttagtttatctacgccatgaaaacgatcccactccgctaattttccatggtatttggcaaggtgtgttaactcaagaaatgcaaggtgatggtggatttggttatgatcctattttctttatccctgagctaaattgcactgcggcacagttaaccagagagcaaaaaaatcaatactctcaccgtggtaaagcactaaaactaatgttggatgcacttaagaatgcttaa

SEQ ID NO: 1052 - DNA, 555 bp, Proteus mirabilis
atgtttactaaaatctatcagtatttttcaactaaagaaaatattggtattaatctttgccgtatatcaatagctattgttttcatgtggatagggattttaaagtttattccttatgaagctgatagtattgttccttttgtagcaaatagtccattcatgtcatttttatataatgatcctgaaaattatgctcaatatatgaatcatgaaggtgtattaaatgaagttaacagggcttggcatcatgcaaataatacctatggttactcaaatgggttaggtgttgttgaggttttattctcattattaatacttgctcattatttatctcctaaaataggcttttggggcgctgccttagcgtttcttacgccatttgtcacattaacatttttggtgtttacacctgaaacctgggtacatggagcagatgctcatactgggtttccttatctttccggtgcgggaaggttagttctgaaagatactatgatgatagcagcaggatttgttgcaatggtacattctgcaaggtgtatcactaaaaagtag

SEQ ID NO: 1053 - DNA, 795 bp, Proteus mirabilis
tcctctgctaaaaagcgaatagtgtttatgagtatagaattaaccgatgaagaaacgctgcgttataatcgccaaattgtgttaagaggctttgattttgacggtcaagaagcactgaaaagtgcttctgtattgattgtcggtgttgggggattaggctgtagtgtatcgcaatatctcactgcagcaggtgttggcaaactgacactattagattttgataccgtttcactgtccaatcttcaacgccagatcctgcatcgcgatagcaccattggtcagccgaaagttttatcagctaaaacaacattaaacgcgattaatccccatgtacagatagatacggttgatgcactacttgaagataaagcactggctgaattaatcagccaacatcatctggtaatggattgcacagataatgtcactatccgcgaacaactaaatcgactgtgttttgtgcagaaaaaacccttagtatctggtgcagcaattcgtatggaaggccaaattagcgtctttacctatcaagatgatgaaccttgctatcgctgtttaagtcatctttttggtgataatgcactcacttgtgttgaagcgggtattatggcccctgttgtgggtactattggcactttacaggccattgaagccatcaaattactcactggttatggtgaaactttacatggcaaagtattaatatttgacgctatgcggatgcaatttcgtgaatttaagttacctaaaaatccacactgtgatgtatgtgcggctaatttgcccgataattga

SEQ ID NO: 1054 - DNA, 477 bp, Proteus mirabilis
ataatggctaattcaatatatttaaagataatagggaaatctcaaggtgatatatctaaagggtgctctactttaggatctataggcaataaatatcagcacggacatgaagatcagatatttgtgtattcatttgattatgatttaactcgagcacaaaatttaaatcattctcctgtggtaatttcaaaacctatagataaatcttcacccttacttggggttgcaataacaaataatgaattattagagtgcgagctagaattctatagaacaagttcaaacggcaatcaagaaaagttttataccattaagctaacaaaagccagcattaccaatatatcagcacattaccctaattcactgacgcatgcagatgcccagccttatgaagatattactattcgatatgaaagtatctcttggaaccatatttgtgcaggaacatcaggttatagtatcagcaaaaatatttaa

SEQ ID NO: 1055 - DNA, 474 bp, Proteus mirabilis
cagggggctaagatgagtacattgacccgtatatcagtccaaaacgaacattttaatgttggtgatgaatatcaatggttgtcagagtgtgaaagtgatggtgcggtcgtcacttttacaggaaaagtgcgtaatcataatttaggtgatgaagttaatacgctaactctagagcattatcctggtatgacagaaaaggcgttaaatgacattgttgagcaagcacgcgcgcgttggcctttacaaagagtcagcgttatccaccgtgttggccaattaaatattggtgaagagatcgtgtttgttggtgtgaccagcgcacatcgccatagtgcttttgaatccgcagaatttattatggattttttaaaaacgcgcgcgcctttttggaaaaaagaggggctatcagctaaccaagatagatgggttgatgctcgccaaagtgactatgattcagctaagcgttgggaataa

SEQ ID NO: 1056 - DNA, 1314 bp, Proteus mirabilis
tctatcaataagcacaggataagcatgctcgatccaaatctactgcgtaatgagctagacgcggtcgccgaaaaactggctcgcagggggtttaccctcgatgtggaaaaaattcgtcaacaagaagaacgccgtaaggtgttacaggttgaaacagaatccctgcaagcagaacgtaattcccgatcgaagtctattggtgctgctaaagcgcgtggtgaagatattgagccacttcgtcaggaagttaaccaattaggtgaaaaacttgaagcggcaaaagcggaattagataaactgcaagccgacattcgtgactatgcgttaactttaccgaatctgcctcatgactctgtgcctaatggtaaagatgacagcgagaacgttgaagtatttcgctggggtgaaccaaagacttatgactttgaattaaaagatcacgttactctaggtgaactcacagatggtttagatttcccatctgccgtgaaaatcaccggttcacgttttgttgtgatgaaaggtcaaattgcacgtttacatcgcgcgatcgcccagttcatgctgaacttgcatacagaacaacatggctatcaagaaatgtatgtgccttatttagttaaccatgccactttatatggcacaggacagttacctaaattcagtggtgatttattccataccaaaccacttgaagaagagtctgaaagccaatatgcgctgatcccaacagcagaagtacctgttaccaatatggttagagacgttattctcgaagaagacgaactaccattgcgaatgactgcacatacgccatgtttccgctcagaagcgggctcttatggtcgtgatacacgtggtctgatccgtatgcaccaatttgataaagtagagttagtacaaattgtacatcctgaaaaatcaatggatgcattagaagagctaactggccatgcagagaaagtgttgcaattgctcaatctgccttaccgtaaagtggtactttgtacaggtgatatgggctttggtgcacgtaaaacctatgacttagaagtgtgggtaccggcacaaaatacctaccgtgaaatttcttcatgctctaactgctgggatttccaagcacgccgtatgcaagcacgtttccgtgctaaaggtgacaagaaaactcaacttgtgcacactttaaatggttcaggtttagctgtagggcgtactttagtcgccattatggaaaactatcaaactgctgatggtcgtattgaaattccagaagttttacgtccttatatgaatggccttgagtatattggttaa

SEQ ID NO: 1057 - DNA, 324 bp, Proteus mirabilis
ttaatgaataaatacaccgaactatctgacttcgagattaataaaaaggtctatgaattgatattcattagcgatgagtacgaagtggaatccagcctattcgggcatgtaactgtcaatgatgaaatatacgacccatgcaataacccatcagacgcaatgccgattattattgaaaataaaatagggttatcaccaatgtaccattctaataaatggacagctgactgccttgattatgacttcatgtcagtaaataaaaacccataccgtggcgctatggaagtttttttaatgatgaaggatacggagaataatcaatga

SEQ ID NO: 1058 - DNA, 1371 bp, Proteus mirabilis
tgggggaataaaaggatgttgagtgcgatgaaatcagaaagtttagtgattaaaattgggggatctccacttgatacccctgaatttattgccctgaaaaccgaatttaataaattgagccaccctgctcgaccagaaataagttggacacttattgagtcactttgcttatccctatttaaaaatcatggtatcgacctacaaagcggtgcttactataccattgcaagattacaacagcatggtttaagcggttttactgaaggatgtgagttattagcaaatgttattgtgacttattgggatagcctgtggccggaaaagccaaaccaacgtacagaagtattaaactggtttaataccaaagccagcgctttattaagacaacaatcctatcaagcaaaagatctacgattaatctatcgttcagagcgcgcgttacagttaataatcgataaactggctaaaacaacttgggaaaaactgcctaaaattgaaaacttactgtggtttttccaaaacttagccaaacaaattgaaaaacaagaaaaacagacgcaacaagatagtgccgaccccgttagcgtaccgccattagtctgtattcaacaaccgtcgaaaacaacggacaaagcagcccccacttttgtgattgaaacacctcaacccgcctcttctttcactgtagtagcaaaaaaaatgagtgcgacccgaggttttatatggggctgcgtgctcagttgcatactgtttttagctgtcggatttggtgtacatctctatttaaaacaagagatgaatgcgattacttcaatacctgaaggtgcggctgccaaatggttgtttaaaccacagttaaatagctacgagtatcatttagcattattagaaaaacgttctcccctttctaatttacggctaattgatacgatgcaagaaaaagccaaaaacgcttggcctacagatgcagagcaaatttattttacacgtaattggcaaaatctttatcaaacgcgcttagagaatatgccaattaatgatagctggtctgaaaccgcgacattattacaacaactttctaataaaatagttcagcaagaacgaaatagaggcagttttacactctcttatctaaaaacggcaatttatgatattcaaaagcagcacaataaagttgagccaatcgaagaaaaactgcgacagctcgctgtacaaattgaaacagggcaacctatttctcctgcaactcttaataatattgataataaaattaatgggttattagctcgttattatgatttacaaaaacaagctgaacaacaaggtttaaaaccaggctcatattcatcttttggattagatcatgagtga

SEQ ID NO: 1059 - DNA, 1284 bp, Proteus mirabilis
atggctgataacaaagctaagttaacgattggtgaaacttctgtggacttggacgttctctcccctacactcggttccaaagtcattgatattcgtactctcggctccaaaggttattacacctatgatccaggctttacctcaacggcatcttgtgaatcgaaaattacctatatcgacggtaataacgggattttactgcaccgcggtttcccaattgggcaattggctactgagtcaacctacttagaagtatgttatatcctgctttatggcgaagcaccgacccaagagcaatacgataaatttaaaacaaccgtcactcgccataccatgatccatgagcaaatcacccgcctgttccatggtttccgtcgtgactcacacccgatggctgtactttgtggtgtgacaggagctttagctgccttttaccatgatgcgcttgatgtctctaatccagttcaccgtgatatcacagcatatcgtttactgtctaagatgcctactgtagccgcaatgtgttacaagtactccataggacaaccttttgtttatccaagaaacgatctgtcttatgcaggtaacttcctacatatgatgtttgccacaccttgtgaagagtacgtggttaacccagttcttgaacgtgcgatggataggatctttattcttcatgccgaccatgaacaaaatgcttcaacatctactgtacgtactgcaggctcttcaggtgcaaatccatttgcctgtattgctgcgggtattgcttcactatggggacctgctcatggtggtgctaacgaagcttgtttacgtatgttggaagagatcaaaaccgttgaacatattcctgaatttattaaacgcgcaaaagacaagaatgactctttccgtttaatgggctttggtcaccgtgtatataaaaactacgatccgcgtgcaacagtcatgcgcgaaacttgtcacgaagtattaaaagaactgaatctcaatgacagtttacttgaagtggcaatggaattagaacgcatcgccttaaatgacccgtattttattgagaaaaaactctatcctaacgtcgatttctactcaggtattattctaaaagcgctaggtattccatcaaatatgtttacggtcattttcgctattgcacgtactatcggttggattgctcactggaatgaaatgcatgaagatggactgaaaattgcacgtcctcgtcagttatatactggctataacgagcgtaaattccatagtgaacttaaaaataaataa

SEQ ID NO: 1060 - DNA, 216 bp, Proteus mirabilis
ggacattgtaatgccatccaaaaatacctacttgtatatgaagcattcgacaatacaaatgtattcttattaaaaggaaacgctgctataaaaatagaatccggaaaaggtattgaggaaatattgaatacctttactgaagttgcctgctctgaagctagaaaaattgataaatatgctagacgagtggcgatagtaagcgtaatagaactttaa

SEQ ID NO: 1061 - DNA, 1290 bp, Proteus mirabilis
ctggaaagtaaaatgacacccgatgatattgcttttgatttacgccatatttggcacccttatacctcgatgagtaacccattaccggcttatccaatcgtaagtgcaaaaggagttgaactcactttagcgaatggcaaacaattaattgatggtatgtcttcatggtgggctgcgatccacggctataaccaccctgaactcaatacggcggtaacagaacaactagcagcaatgtcccatgtgatgtttggtggtatcacccatccctcagcggttgctctatgtcgaaaactattggctatcactcccgcaccactagagtgtattttcctcgctgattcaggctctgtagcggttgaagtggcgataaaaatggcattgcaatattggcaggcaaaaggtgaaaaacgccagcgcattgtggcattaaaacgcggttatcatggtgatacttttggcgcgatgtcggtgtgtgatcctgacaattcgatgcatagtctctacaaaggctacctgccgaatcatctgtttgtcgaagcgccaaaaaccggattttatcaaccgtgggacgctactgatatagacgatttacgcaccacattagcgcaacatcatcaacatattgccgctgtgatgctagagccaatcgtccaaggggctggtggtatgcgcatataccacccagagtatttaacacaagctcgagcgttatgtgatgaatttaatgtgttattaattgccgatgaaatcgccactggatttggcagaaccggtaaattatttgcttgtgaacacgcggggatctcccccgatattatgtgtgtaggtaaagcattaacaggtggttatatgacgctatccgccacgttaactacacgccatattgccgatactatcagccaaggtgatgcaggttgctttatgcatggccctacctatatggggaatcctcttgcctgtgcggtggcgaatgctagtttatcactattagagcaaggtcactgggttaatcaagtcgctcaaattgaagatcaacttaaaaccgaattgttacccttaaagcaagcaaaaagcgttaaagatgtgcgggtacttggtgctattggtgtcgtagaaatggttgagccagtcaatatggctaaactacagaaatactttgtcgatgaaggggtttggatacgaccttttggtcaactgatttatattatgcctccttatattatatcacctgaaaagctcactaaactcactcaagcaattgagaaagcagttaatcttaccaattaa

SEQ ID NO: 1062 - DNA, 255 bp, Proteus mirabilis
atttgtggtaatgaattggggattggtactgataggaacatcttgttggcaccgagatcacaaaaaatgcctagaactaaaacaggtgtgcttaccttaatgcgacagaaccctaaaacatgcatcttcaagttaattgtgcatgattataaaaaaagaggcacccatagggtacctcacttactttatctcttattaaatcagaatatattaaaaatcaattttgacatttaccccataatttcgacccggtaa

SEQ ID NO: 1063 - DNA, 783 bp, Proteus mirabilis
gtggaactcaacatgaaaaaattatcaggtaagttactggctggtgcgattatctcttttgctttagtgagccaaagcatggcatcggaaaaaataacggtatttgcggcggcttctctcactaatgcgcttaatgaaatttcggcacaatataaacaggaaaaacaagcggatgtcgttgcttcttatgcatcctcttcaacacttgctcgccaaattgagcaaggagcacctgcaaatctatttatttctgccgatcagcagtggatggattatgttattaataagaatttaatggtgactgattcacgacatacattattaggtaacgacttagtgttaattgctcctaaagatagcaaattaaacaatgttgttattaataaggatactaaatggaaatccttacttaatggtggaaaattagctgtgggtgatccagatcatgtacctgttggtatctatgctaaagagtcattagaatatttaggtgcatgggatgtggtgagtccggaaatggcacgcactaataatgttcgcagcggcatggcattagttgaacgagatgaagcaccattaggtattgtctatggctctgatgctgttgccagtgacaaagtgaaagtggttggggtattcccaactgatagtcacaaacctgttgagtatccaatggcagttgtaaaaggacaggataataaagctgttcgtgatttttatgactatctaaaaacacctcaagccgcagaaatatttaagaaatacggctttagcccactttag

SEQ ID NO: 1064 - DNA, 2067 bp, Proteus mirabilis
gggttatccaagggggagtgtgtgaatattttaagttatctgcaaaagataggacgggcattgatggtgcccgttgcgacattgcctgctgcagcaattctgatgggaataggctactggattgatccggtaggctggggaaacgataatgcgctagctgctttactgatcaaatcaggtgctgccattatcgataatatgtcagtattgtttgcgataggtgttgcttatggtatgtcaaaagacaaagacggggcggcggccttaactggctttgtcggctttttagtggtgactacactttgttcacctgctgcggtatcgatgatcaaaggtctaccacttgcagaagtgcctgtggcttttggtaaaataaacaaccagtttgtcggtattctggttggggtactttcagctgagctgtataaccgctttagcagtgtcgaattacctcgtgcattatcattttttagtggtcgtcgcttagtgccgatcctcacgtcattcttgatgattatcgtcgcctttattctaatgtatatctggccggtaatttacggcggcttagtgagctttggtgaaagcattaaagatatgggggctttgggcgccggtatttatgctttctttaaccgcctattaattcctgttggtttacaccatgcgctgaactctgtgttctggtttgatgtggcgggtattaatgatattcctaacttccttgctggtcagcaagcgattgatgcgggcttggcaacggtcggtgtgacaggacgttatcaagcaggtttcttcccagttatgatgtttggtttaccaggggcagcactggctatttatcattgtgcgcgcaaagagcataaagcaaaagttgccggtatcatgatggctggggcatttgcggcattctttacggggatcactgaaccgcttgaattctcctttatgtttgttgctccagtgctttatgttattcacgcattcttaatggcgatttctgtttatattgccgcaagtatggagtggatttcaggctttggctttagtgcgggccttgtggatatgttcttatcttcacgcaaccctctggcggttaaatggtatatgttgattgtgcaaggtatcgcattcttcttcatttactatggtattttccgtttcactattactaaatttaacctgaaaacaccgggtcgtgaagatgaagtggcgggggatgaaaccgcagacggctatgatgaagatatcaaagccgtccccactaatagcaaagaagcagtgcaacaagaagcacgtcaatatatcgctgcagttggtggctcagataacttaactggtattgatgcttgtattactcgtttacgtttaaatgtaaaagatgccagtgtagtcaacgatgcttacgcaaaacacctaggtgcttcaggggttattcgcttaaataaacagagtgttcaagtgattgtgggcacacgggctgaaattgttgcaagtgccatgcgtgatgtattagcacaaggcccagttgccgcttatgctggtagacatacagataacgcggtatcgacagaaaaaacatcagaaaaacagactaataatgatgccaaagtcattcttgaaatggtcgcgccatttgatggtgaagtggttgcattaaaagatgtgcctgatgaagctttctcaagcggtgtcgtgggagatggtcttgctattaaacccacatcaaatattgtgatggcacctgctgccggtacggtagtaaaaatctttgatactaaccacgcattttgcattgaaacggataacggtgttgagattatcgtccatatggggattgatacggtcgcattaggaggaaaaggctttaaacgtctggttgaagaaggtacagaggttaaactcggccagcctatcttagagctagatcttgagtatttaaacactaatgctaaatcaatgataagtccggttatcatcagtaatatcgatgactttgataaagtgagtgatattgcatccggccaagtgacggcaaataacaccataatctataaagtattaaaataa

SEQ ID NO: 1065 - DNA, 567 bp, Proteus mirabilis
cagagagtccttatgaacaaacctatttcctttataatctgtttcactaccttatttataaaggcttgtactccgaaagaaaaacttcagcaacttgaaactgaacctcgctcgatcattctcaataaaaacattcaaatagcacagcccgatctctatctaacaacaccaaaagttgtgcgttatgatcgctatctattgataaatacatctccaacgttggctcaaagtgacccgatcgaacaaataattgatgttcatatcccaacttctcaacaatcctctgttagtgatgcaatgcgttatattttacaaccgtcgggatattctttatgtaagacaacgtcgtctaatcaagtactctataaccaaaaacttcctgttgtacatcatcaattagggcctatgcgcttaaagcaggctttgcaagtattggcaggtgttgcatggcaacttgagattgatgcagtacaacgaataatttgtcattcattgcgagaaggttaccaattaccgacagaaatactcacaaactcaacattatcagcggataggatgttgcaatga

SEQ ID NO: 1066 - DNA, 1275 bp, Proteus mirabilis
ataatatacaagggtaaacatatgaaattaagaaatgcaataataattggcgtaatatacacaccatcaatatgccaggccgtagaacaaactagctataaatatatttctattaatcaagactcttcaacaatagttaaacctaatgaaattaatcctaaacaagcagaaatattaatagcaccaaaaaatcccaaaggcatttctcataataaatatgatacatttgatgtaactgatgctggcattattttaaataataaagaggttgccgctgagactattattaatgaagtggttaatggagcaacgtcattcttagcggggaatatcgcggtagctggcaatgcagctcatgttgttatagccaacccaaatggtattgaatgccataattgtagtttttcgaatacattacaagaaacgttaacaacagggaaacctgttatcaataataataatgatgaattaatcggctaccgcttagaaaaagctatcgctcctataaataaaggatataggggtggaaaatcaattgaacatattggaaaaattgtattcagtaacaaaaatgaccgtagttctagtcattcttttaataaacttaatatcatatctaataacattaagttagaaaacggctttatatcttctaaaggagatataagtatttactcaggtaaaagagatataataattaaagaaggtgaaagtatcttaaaacaagaatacgctatgcgctcaaatataaaaagaaataatctacctaatcagataatattaggtgataaaaatagtaattctaaagaacaaggtataatttcttctaaaaatatcattatcaatgcttctgatactactatttataattatggtagtttagaaagtagtaaccgtagtaaaaatgccatacaacttaatctaaataaaacaatatttaataaccatggatatattctcgctagaaacggatatttagatctgcaaaataagtctttcttccacaatatggaaagtggaactattggcatgcaatattggcttaatactggtaaaaataacaataactatagcgagacatacatagggttaatacccaaaaatactattagccaaatgaaaaacttaactttagatattagtgaggatagtaatctgataaatgatggtattatcatgacagaacggttacacacacgcgataagaatataagcaatattcaaaataatagagaagatatcaaaatttatactaagttacgcaaaattaaataa

SEQ ID NO: 1067 - DNA, 399 bp, Proteus mirabilis
aaaaggcacaatgcgtatcagaatggggatatggtaatgggcatgggtttagaaatatatgatgagaaagggcgactcattattggagaagacactattataccgcgccacttggggcaatttgaccttcctttgtcccaatatggatctcttactattcctgagatttccttaggaggtgaggttgtttgccatttctggctacggtatcgctctcgatggagtggtgaatttcatgtagataagcctaatgagagaacagaatactccatatctggaaatacgttaaactaccgcgttgattacaatatctatcgctgggagaacaatggctctggtggcgggcagacacgagcgaatgactcattctcaagtcatgttgtcgtatgggtggtgtga

SEQ ID NO: 1068 - DNA, 1944 bp, Proteus mirabilis
gcgggtaacaatatgaaaaggtttttgacaacactcgccattttgcttgtagtgattttggcaggcttaacgacattagttttgctcattaaccctaatgattttcgtggttatcttgttgaacgcgttgaaaaacaaagtggctataaattaaccttacaagatgatatgcgttggcacgtctggccaaaactcagcattattagtggtaaaatgtcattaacagcccccggtgctgagcaaccattgatcactgctgataatatgcgtcttgatgtggaattatggccattactttcccaccagttggaagtaaaagaagtgatgctaaaaggcgcagtggttagacaaacgcctgagagtaaagcaatacctaaaataaccccgccttctgttgccaatgaagacagtactcgtccgattattgaaccaaaaacaaatcgttggcaattaaatattgctaaggtgaggatctccgatagtttgattatttggcaaaccaaagggggagagcaacttaatttacgcgatatcaatttattattaaaaacggacgacaaaaaacaaattaaccttgagatgagcaccaaaattaatcgtgatcgtcgcgagttaatgttaaatgttgttgctaatgctgatatgagtggctacccatatcaaatcagtggcaatatcgctcaattagattatgcattatcgggaataggacttccggctcaagggatctccggaaatttaacctcagatttcaatattaaaaatgacagtgtaaatgttattgccttaaataatttaaatatgacggcaaatgagagtcagctacaaggtagcatcacggctgaattggctaaaaagaaccgctatcaagtggaattaactggggacactttaaatttaaataccctattacctgagttagcacagcctaattcatctgaaacagcatcgttaaccttggcaaataccccgtcgagatcattctcattctttagccatgctcaggctgcaccatcacccaatgcaactattatagctcgtccggttattacctccgcgacaattgaaaacaaagcgtatgatttaacccactggggtgatattgaatttagcttaaacttagcgctcaataagttattgtataaagaattagaaataaacaatgttaaattaaccgcattaaataaccccaaatcattaaatattgataggttagaagggcagatcctaaacggaaatttctcactgcctacggtgatttctaccagcattgtgccagcgcatattagtatgaatgtcacaatgaataatatccctttgcaacctttactccgtgtctttgatcagccagaaaatttcagcggtttaatttctgcaaaagggcatctagaaggtgccggatataatcgcaacgcgtttcttaatagctggcagggcacactggatacctcattaagcgaatttaaaatgctaggattaaatattccacaagtgatccagcaatctattgcacaaacaaccgatcaagtggtttatcctgaagatattgagaactataccaaagccgatagtgtgattgcccagtttaaactagcacctaaaggccgagtgacgttaaatcagttagatgctcaagcaagtgcttatcagatcagcgggcaaggtcgattagatctacaacgtcataatctagatgtgatgctgatggttaatatcaaaaaaggttggggcaaagagaatgaatttattcgccaactggccaaaatagatattccattaagattgtatggtaattggaatgctatccaatatgagtttaacgttgaaaaattactacgtgatcaattacagcaaaaagcaaaacaggccatagataattggttaaataagcaagatgatagccccgaagttaaagcgcttaatcaattattgaaaaaaatataa

SEQ ID NO: 1069 - DNA, 1389 bp, Proteus mirabilis
cctaggaacaaccttctgatgagtacaacaaatgtagatttcactcgaccggagtataaaacggctgctcctcagtgggagctagttcgcgctgtttgccgaggcggtgaagatataaaaaattatcttcctgagcttgaagagcaagatggcgagcgtaaaaagaagcgcaataaagattatcaagaccgtgcggtgttctatccaataacaggcaatactcgcaacggaatgatagggatggcatttaaaaaagatcccttagttgctgtcgtcgaaaagctgtcgtgtttaaaagacgatgctgacggggcgggttcaagtatctatcaattggctcagtcttcacttgagtcagtattggaagtcggtcggcatggtctgtatgttgattacaacagtgattcgaaactcccgtacatattccaatatcgtgctgaagacatcattaactggcgtacagctcgtattaatgggcgcacgatgttaacgctggtggtattgcgtgaaacggtggaagaagaggacgggtttggttttaaggatgaggttcaataccgtgtattgtcgatagaagaaggtaagtttgtctgtcgtgtctatcgcaagcccagtggaagtagcgtttttgaaatttcttctgagtatatacctgcgcgtgctggtaacggtgtgtggaatgaaattccatttacatttattggtgcacagaataatgatcacactattgatgaagccccacttctaggattggcaaaaatcaacctagggcattatcgaaactctgctgattatgaagattctgttttcttctgtgggcaaatacaaccttatctaggtgggctaggaacagaatggcgtgactatctagaaaagaaaggcgttatggttggttctcgctcgccaattatgttgccagaaaaaggtttctttggttacgctcaggctcaacctaacatgctggcaaaagaagcaatggacagtaaacgcgattatatggttgcgctcggtgctcaattggtttctgctgatagcaaagttaaaacggttattcagtctgtcggtgaacagaacgcacaaacctctatcctgagcatctgttgctctaatgtttccgatgcatgcagtaaatcgctaatatggtgtgctgaatacttaggtttagatactgcaggcatttcgtttgagattaacaaagacctcgttaatcacattgccgatagttcgatgatccgtgaaatcgtcgcagcatggcaatctggcgcaacgcgtaaatctgacttagtgagaagtttgcagaaatatgatgttatcgaccccgctgatgatgttgatgtggtggtggatgagcttaataatcaagagccgacaatggtaggtgagacatga

SEQ ID NO: 1070 - DNA, 372 bp, Proteus mirabilis
tacatttgcaatgaggtagccatgaacatttatcaacgtgggcagagtacagcattaaggatgttgaaaaaatatggcgtttcctatcaggctaagcgtgatggtaagcattgggttgatgatgaggggcaggaacactttgagccagaaacgttattttctgttgtcggggtaaaaacgcaatataaaccttacgaaatcgatggcacgcttattctctctacggatattaaaatgatacttcctccagatattgatattcagaaaggggataaggtgcttgtcgatggcgtttggttgcgcgttcatgaaccgaaccctgttaaacccgctgatattattatctgctatcagtctcaactgagggcgtga

SEQ ID NO: 1071 - DNA, 810 bp, Proteus mirabilis
gtgtcgcgcaagctgaacttgcaggattgccagcaaaatgggcagaaattaacgaatatggagctaaggtacaagcgcatgtcatcgatacatactgaacaatttataccagctaaattagcacaggcattagcgaattcactttttcctgaactggatagtcagctacgtgcaggtcgacatattggtatagactcactagataaccatgcttttttgatggactttcaagatgagttaacagatttttatgcgcgttataatgtcgaattaattcgagcacctgaaggctttttttacttacgcccccgttcaacgacgcttattcctcgttcagtgctttctgaaatggatatgttggtcggcaaaattctttgttatctctaccttagccctgagcgattagctaatcaggggatcttcactgtacaagaattatttgatgaattacgtacactggccgatgaaagcaaattgttacgcttagttaatcaacgctcaacaggatcggatttagacctacaaaaactgcaagagaaaatgagaacgtcacttaaccgactacgtcgtttagggatgatttcgtttttacccaatgatacgcaacgtttttcaattactgaatcggtgtttcgctttggtgctgatgtgcgtagtggtgactctcctcttgaagcgcaaatgcgtatgatccgcgatggtgaagctatgccactagagcaagatagcgagccaagtgatgacgatgaacaggaagatgagcaattagagtccagtgaagatgatgatgcagaggaagaaaataaatga

SEQ ID NO: 1072 - DNA, 972 bp, Proteus mirabilis
attagcggcaaatttttaaaagtgagtaagacaattatgcgaaatcgcacgctaagtgatttagatcgtgttgtagcccttggtggaggtcatggccttggacgtgtgctttcagcactctcctatttaggaactcgccttacggggattgtcacaacaacagataatggtggctccacgggacgtattcgtaaagacgaaggcggtatcgcgtggggagatatgcgcaattgtattaatcaattaatcacagagccttccgttgcttctgcgatgtttgaataccgtttctcaggcacaggagagcttgctggacacaacttaggtaatcttatgctaaaggccttagataacttaagcgttcgtccattagaagcaattaatcttatccgcggtctacttagagtcaatgctcatcttattcctatgtcagaacaagcggttgatttaatggccattgatgatgaaggaaatgaaatctatggcgaggtcaatgtagataatttaccgaggatgcctcgtcaattaaaactctatccagacgtcaccaccacacgagaagccattgaagccattgagcaagctgatttaattttaattggcccgggcagtttttttaccagtttgatgcctttattgttgctacctgatttagctaaagcattacgtcgtagcagtgccactactatttatattggtaatttaggtaaagagcttagccctgcggctgcaagtatgacgatgtcagataaaatcgccatgatggaaacctatattggcttacaaactattgatgctgtgattattagtccagaaacacaatatgaatcaatgaaaggacgattaattattcaagcgcaattagaggcgaaagatattccttaccgtcatgataggcacctattaagtaaagctattgaattaacacttcagcaattaggtcaacgtaataccgcttgtacagcgagttaa

SEQ ID NO: 1073 - DNA, 726 bp, Proteus mirabilis
atgatttccctaaaagatgtatccaaatggtatggtcagtttcaagtactgacagattgttccactgaagtgaaaaagggggaagttgttgttgtctgtggaccttcaggatcaggtaaatcgacgcttatcaaaaccgttaatggtttagagcctatacaacaaggtgaaatcctagtaaatgatataaaagtcaatgataaacgaactgatttagctaagttacgagccaaagttggtatggtgtttcaacactttgaattatttcctcacctttccattattgaaaatcttacactagcgcaagtgaaagtccttaatagagagaaaggtgcagcaaaagagaaagggctaaaattattagagcgcgtaggcttagccaaccacgctaataaataccctgctcaactttctggtggtcaacaacaacgcgttgctattgctcgtgctttatgtatggatcctattgcgatgctatttgatgaacccacctccgcacttgatcctgaaatgattaatgaagttcttgatgttatggttgagttggctaatgaaggcatgaccatgatggtggttacacacgaaatgggctttgctaaaaaagttgctgaccgtattatttttatggatgaaggtcgtattgtcgaagatagcccgaaaaatgacttctttgataatcctaaatcagaaagggctaaagatttcctagctaaaatcttacattaa

SEQ ID NO: 1074 - DNA, 591 bp, Proteus mirabilis
agagaattaaaaatgaataaaataaagtctattgccgtgtattgtggttcaagtttaggtgcttcaccaatttataaacaacaagcgattctttttgctaaagagctggttaaacgtaatatcactttagtttatggtggtgccagtgtaggaattatgggcacgctcgcggataccgttttacaggaagggggtaaagttattggtgtgatcccaacgctattagaagggcgtgaaatctcacataaaaatctgacagaactccatgtcgttgaaactatgcaccaacgtaaaagtaaaatgattgaactcgcggacggctttgtggcactgccggggggttttggcacattagaagagttcagtgaagtgtttacttggagccaaataggccttcatcaaaagccattaggtatatttaatattaatgatttttatcagccattactggctatgatagataaaatggtagatgaaaaattcttacatgaaaaatatcgtcatatggcgattgttgagcaatcacctattcagttattagataaatttgaaagttatattgccccttcgattaaaacctacgataaataa

SEQ ID NO: 1075 - DNA, 933 bp, Proteus mirabilis
agatgcctaaaatcttacaatagcagaagattaatgggagacacctatatgcatactcgttttcaggcaatttggtcagatttatcccctcaattacaacaagcacttacgccttatcttgagcaggatgaatttccggcaatgttcactgcagaacaagttaatgcgttaaaaacacagttacaatgtaatgatgatgagttagccctcgcattactgcctgttgcagccgcttgtgctgtgacacctatctctcattttaatgtgggtgccattgctagtggtgaaagcggtcacttctattttggggcaaatatggagtttgctggcgccccattacaacaaacggtacacgcagagcaaagtgcggttacacatgcttggttacgcggtgagtctcgtttagttgccatcacagttaactataccccttgtggtcattgtcgtcagtttatgaacgaactaaatagcggcactcatattgcaatccatctcccaggccgaaaagtggcaaccttaggtgactacttacctgatagctttggccctaaagatctcaatatcactaccctactgatggataaagttaatcacggttatcaaatagataacactagccaactggcacaacaggcactacaagcaataaatcgtagtcatgccccttacagccattctcacagtggtattgctgtacagatgaaaagcggtaagatctttcaaggcagttatgctgaaaatgccgcattcaatcctagtatgccaccattacaagcggcacttattgcattaaatatggcgggtgaaaatgttatggatattgagtctgcaatattaattgaaaaagcagacagcctattaactcagtgggatgccacacaagcaacattaacagctttaggttgccgccaaatacagcgtgtcactttgtaa

SEQ ID NO: 1076 - DNA, 330 bp, Proteus mirabilis
atcatgataaattggaaagaataccgcaagaagttgtttggtcgtatcggagagctgggtaaattaactccagacacagtagctggttatcagactctctctaatgccggtaaaaaaacagctcatctggatgacaaaactcgtgaattgatctcactggcagttgcagtaacaacacgttgcgatggatgtattgctgttcatgcggaagcagctttaaaacttggtctcagtcgagaagaaattgcagaagctttaggcgttgcagttgcaatgaatgctggagccgcgatggtttattcagccagagttttagattcaattgaataa

SEQ ID NO: 1077 - DNA, 336 bp, Proteus mirabilis
aaaatgataaataaagaaatattaaagaacctaaagtattttgaaaaaacaccattgattcatcatattaattattccctaactgaagatgctaaaaaaaatatactaaacggctggttacctgcatgtatggaagataaatggctttcatatagtatagaaaactgtgtctatgttcatcgcagttggagtggccatttaatgtataaattcactattgataataacaccattgattttatagaaattgcaatggacgattttgttgatatgacaaatgaaagaaaaatagaagtattcttctctttgttgccttacttatctcaacctcattga

SEQ ID NO: 1078 - DNA, 942 bp, Proteus mirabilis
tataggataaaatttatgaaaactccatttagttggcgacatattgaaatttttcatgcagtgatgaccacacaaaacctaaccgaagcggcagatttactgaaaacgtctcaacccacagtcagtcgcgaactatcacgtcttgaacagctattgtcatttaagctatttgatagaattaaaggtcgcctacaacctaccacggaaggattaagattttttgaagaggtacagcgctcttattatggacttgatcgcattattaccgcagccaatagtattcgccattttcatcaagcggaattaaatatcacctgtttaccggcatttgctcaatcactattaccctcaatttgccaacaatttctcagccaatatcccgaggttaatttaacgatagtgccacaggagtctcctttattagaggagtggttatctgcacaacattatgacttagggctaacagagcacacacaaacacctgccggaacccaacaagaaacactgctaacgttaaatgaagtcgctattttgccaaagtctcatgtgttaagtaaaaaagcattactgcagccacaagactttcatcaaactcgttttatcagcttatctgctaatgatagttatcgacaacttattgatgctatgtttattaaacaggggatcactcgacaattgatcatggaaacacaaagtgcggcctcaatttgtgccatggtgagtaaaggcattggtgtttctatcgttaaccctattactgcccttgattatcaatatagtgatctctgtatacggccactgagttttaccattccatttacggtgagtttgatcacaccatctcatcgcccctcatcacaacttgtgcgctattttattgatgtgatgaaaaccactttagccaattatccaaaacaattaactcacgcgttcacccgataa

SEQ ID NO: 1079 - DNA, 1176 bp, Proteus mirabilis
atgagtgtaaatgaggaaaaaaatccacctcaggctcccattcgcaataaaaaacgaactcgccgaaatgttttattgctactgacttttatctttattctcgcggggctcgcttataccgcttactggtttatggttcttagacatcatgaaaccacagataatgcctacgttacaggcaatcaaattatggttatgccacaaatttcaggctcggtaacgactgtctatgtggacaatacagactacgtaaaagcaggtgaacctctagtccaattagatgatagcgatgaaatacttgcattagataaagcaaaaaccgctttagccaatagtgtccgtcaaatgcatcagcaaatcatcaatggtcgtcaattaaaagcgaatattgttttacgtgaaactgaattggcaaaattgcaaaatgatctgcgtcgtagagaagtattaggcgagcgaaatgtcattggaaaagaagaactccaacatgcaagagaagctgttgccacggcaaaagcggcattagatgtagcaaaagagcaatataatgctaatcaagccattatcttaaccacgcctattgcacaacaaccttctgtattacaagctacaacagaagtgcgtaatgcatggctagctttacaacgaacaaaaatactaagtcctgctgaaggttatgtctcacgtcgtagcgttcaagttggtgcacaagttgcaccgggtaaaccgttaatggccgtcgtacctgtcacaggtatgtggatagacgctaactttaaagagacgcaactggccaatatgcgtatcggacagcccgcgaaaataaccactgatttttatggtaaaaaagttatttaccatggtcgtgtacagggattagatatgggaacaggcagtgcattctcactattaccggcacaaaatgccagtggtaactggataaaagtagttcagcgcttgccggtacgtatttcccttgatgaaaaagaagttgcagaaaaaccgctacgtatcggtttatccactgaagtgactgtggataccgttaatcttgatggaaaagtattatcacagagcgaacgtcaagcaccggcttatcatactgatgcactcactattgatatgtcagaaatcaattcattgattaatgaaatcattgaacaaaatgcaggatga

SEQ ID NO: 1080 - DNA, 987 bp, Proteus mirabilis
attaaggtaaatattgtagttatgaaattgatcatagaaggtctttctcttacaacccagttattaggcacacatttatctgtggctacactgactgcacatacaatccgtactacaaagatgggaattgatttttcatcactggttgaatatctgaaaagtgaaggatttgaaaatacattatcacaacgattattagatgatattccctctctagctatgccagtattattattattaaaaaatgaagagagtgctgttttaaccgaagtttcatttgatgaaactggacaacgtaaatataaaattcagcaagtagatggtttatctatatggttaacacaatctgaattaagtgaaaaatatttaggttattgctggttcattaagccacgtattacagaagatgttcgttcagaattgcctgaatatacgatgcctaaagcatggttttttaaagttatatggcgctttaaaaagtattactatcaaatcattctcgctacttttgttattaattttttggcacttgttagttcattatatgtcatgaatgtttatgacagagtaatacctaataagtcatatcaaacactctgggttttaagtatcggggtaattattgcaatattatttgaatttacagctaaaatgctccgaggccggttaactgatattgctggtaagaaagctgatttaattatcagttctgctttatttagaaaggtcacaaatcttaagttacaagaaaaacctatatcatctggctcctatgttaataatttacgagattttgaatctgtccgtgattttatgacgagcgcgagtttattaacattagttgatatgccttttttaattttatttgtatctgtaattgcgcttgttggaggctatttagcttttgtgccacttacgataattccattggttattattgtcggacttttagctcagatccctttatccaaatatattaatgaatga

SEQ ID NO: 1081 - DNA, 1185 bp, Proteus mirabilis
ctcagatccctttatccaaatatattaatgaatgaatcgatgaaggaatcatctcaaaggcaaggattagctgtagaagcgattgaaggcatagaaacattaaaaacgaataatgccatgaattgggcgcaaaagcgttgggattattacacagcaaaaacagcatcttcatcaatgaaagttaaaaacatcagtaattttgttatttattttgcagtaatgatgcaacagttaaatacgatatttttagttattattggtacttatttgattcatagcgatgatcctgcaagtaaaattacaatgggggcgttaatcgcaacggttattttatctggtagagcgttatcaccattaggacagattgcggggttagccgtgcgctttcaacaggcttgggtcgcattaaaaggtgttaatggcattgttgagcgaccatcagaacgtgaaccatctaggaaatatattacgttaaaacaaataaatggaaatataaaattccaaaatgtttcatttgcttataaccaagatagtagcagtgtagtgaaaaatttatcatttgaaataaagccaggtgaaaaagttggaatacttgggcgtattggcagtggtaaatcaacgactttaaaattagcagctgggttatatcctgcagagcaagggagtatcacactagatgatgtcgatattcgccaaatagatcctcattatttgcgtaatcaggttttgttattagaacaagagccaaggttatttttaggtagtttaagagaaaatcttgatttagcccgtatggatggcttctctagtgatcaagatttgattgtggcactgaagcggtttggtttggataaagttattaaaaagcatcctaggggattagatatgtccttgggagaaaatgggttaggtctttctggtggacaaaaacaaattgttgctttggctagaatgacgttgagaaatcccaaaattgttttacttgatgaaccaacaacggggcttgatcaatattcagaaattcaggcattaaatgccatttcagcatggtgtcgctcaaagacattattggttgttactcatcgacctcaggtactgagtattgtcaatcgaataattgttgttgataacggccaaattgtgatggatggtcccagagatgccgttttacagcaattaacttaa

SEQ ID NO: 1082 - DNA, 438 bp, Proteus mirabilis
aattcgtcaaatagcgcgctaaaggagcaacttatgcaatcgactgcccctttaatttatttctctagtcgctcagaaaattgtcaccgcttcgtacaaaaacttaatctacaagcgacaaggataaaagaggatgaaccactacaagccacacaaccttttgtgttgctctgcccaacttatggtggcggtggcgttaaaggcgcagtgcctaaagcggtgatccagtttttaaatattcctgaaaatcgccaattaatacgcggtgttattgcttcaggaaataccaattttggctctgcttacggcttagcaggtgacattattgcacaaaaatgccaagtcccttttctctatcgttttgagttacttggtacgcctgaagatgttaaacgtgtaaaaaccggattaagcacattttggtcagctagcaaataa

SEQ ID NO: 1083 - DNA, 1356 bp, Proteus mirabilis
acttgtgcaaatcttatgattaaaattaaaaaaggactcgacctcccaattgcaggagcgcctgcccaagtgatagaagacggacccgcgattcgacacgtagctttgctaggtgaagaatatgtcggaatgcgtccttctatgatggtttcggaaggtgagcatgttaaaaaagggcaggttctttttgaagataaaaagaaccccggtgtaatattcacaagccctgcgtgtggtaaagttgttgccattaaccgcggtgagcgccgtgtacttcaatccgttgttattgaagttgacggcgatgaagaagtcactttcgacagttatgatagctcatcactttcagaattgacccgtgaacaggtagaaacaaacctagtaaattcaggtttatggacagcgttaagaacacgtccatacagtcgttcccctaaattaggaaccacgccggtggcaatttttgtcactgcgatggatactaatccattagcggcagatcctactgtgatcattgaacaaaacgagcaggcttttaacgatggtctgattgttttaagtaaattaacagagggtaaggtgcatgtttgtcatggtgaaaaagcaccggctaaactcaatgatggacaaattagctataaccaatttgttggccctcatcctgcgggattagtgggtactcatatccattttttagagccagtcagcgcgaaaaaaatggtatggcatcttaactaccaagatgttattgcgatggggtatctctttactaccggctctttatataccgagcgtgttgttgcattagcgggacctcaagttaaagcccctcgattattacgtacctgtttaggtgctgatctttatgaattaacgaaagatcaattagtcgatggtgataatcgtattatttctggctctattttatggggttggaaatcggacgaagcgcatcactatttaggccgttttcataaccaagtctctgtattacgcgaaggtcgtgaaaaagagttatttggttggggttatccaggtactaataaattctccattacacgtaccacaattggtcacttcttaaagaacaaacgttttgcatttacaaccacaatgaatggtggtgaacgttcaatggtgccaattggtaactatgagcgtgttatgccattagacattatggcaacacatttgttacgtgatttgattgtcggtgatactgacagtgctcaagcattaggttgtttggaattggacgaagaagatttgggactatgcacttatgtttgtccaagcaaatatgagtatggcccagcactgcgccaagtattgaccaaaattgagcaggaagggtaa

SEQ ID NO: 1084 - DNA, 966 bp, Proteus mirabilis
cattatcaaaacaaattaaaacaaaaaagtaacacaaagcaacacatcaatatcaccacgacaggagttattatgcgcatgcgtaaactagcattatcattaatgattttaggggctgcaggagctgtgcaagcagaagaactcactggtaccttaaaaaaaatcaacgataacgatattattattgttggtcatcgtgaatcctctgttcctttttcatactacgataatcaacaaaaagtggtcggatactctcaagactattccaacctgattgttgaggcagtaaaagaaaaattaggcaaacctaacctacaagttcgtcttatccctatcacttctcagaatcgaattccactattacaaaatggtacatttgactttgagtgtggctcaacgaccaataatctcgctcgccaacaacaagctgatttctcgaatactatttttattgttggtacacgtttacttgcgaaaaaagacagtggaattaaagattttgctgatcttgcgggcaaaaatgtggttgttacgtcaggcaccacatctgaaatgttactcaacaagctcaatgatgagaaaaaaatgaatatgcgcattattagcgcaaaagatcatggcgactcattccgtacacttgaatcagggcgtgccgttgcttttatgatggatgacgccttattagcgggtgaacgtgctaaagcgaaaaaacctgcgttatgggagattgtgggaacacctcaatcagaagaagcttatggctgtatgttacgcaaaggtgatacacaatttaagtcgttaattgatgaaaccattgctaatgcgcaaaaatctggcgcagcagaaaaatcgttcaaccgttggtttaatgccccaattccaccgaaaaacctcaatttagaattcactatctcggatgaaatgaaagcactctttgcatcaccaaatgataaagcattgaactaa

SEQ ID NO: 1085 - DNA, 1149 bp, Proteus mirabilis
cggtcacaaaatcttatgcaatgcgcacgctccagtgcgggtgattgccactcttgtgggtggctttctcttgcttattccgaacaaattaatcaaaaacaacataatctattagacttattgcccaaaaactacgcgtttactcaattagcgccggtagaaagccaacaagttaaatttcgtaataaagcgaaaatggtagtaagtggtagtgtcgaaaaaccgattttagggttacgtaaaccagagggggaaggtgttgatttatgccaatgcccactctatcccgcttcttttgaaccggtttttccaatattaaaaacctttattgccaaagcaggattagtgccttataacgtggaacgtcgtcgaggcgagctaaagtttattttattaacagaaagtcgccacaatcacagcatgatgctacgttttgtgctgcgctcagaaaaaaaactggcgcaacttcgccaagcattaccatggttacaggctcaattaccccaattagccgttatttcggtgaatatccaacctgtccatatggcgatattggaaggtgagcaagaaattgtattaacagagaaaacctttttagatgaatattttaatgagattccgttacatattcgcccgaaaggtttttttcaaaccaatcccgatgttgccgcgtcactgtatgcaacggcagggcattgggtcaaagagttgcagataaaccggttatgggatctcttttgtggctcaggggggtttggcttacattgcgcacaaaaaaacacggaattaacaggcattgagattagtccagaagcgattgaatgtgcacgtttatccgccaatgaattagggttagagcatgtagaatttcaagcgctggactctactggttttgctttagcaaaagagtctgttcctgaattagtactggttaatccgccacgacgaggtattggcgaaacgttatgcgactatttaaatagtatgaagcctcgttttatcctctattccagttgtaatgctcaaacgatggcaaaagatatacaacaactttctcattatcgtatcgatagagtgcaactgtttgatatgttccctcatactgctcattatgaagtgttgacgctcttggttttacaacaaagttaa

SEQ ID NO: 1086 - DNA, 486 bp, Proteus mirabilis
tcaatgcaaaataattatgtgttacgcagtgtgcgttatatgttagatcttagcgatggacatattgttgatataatgaaactggcagatttcaccgcgactaaagagcaagttaatcagtggttaaaaaaagacgatgatcctgcctttgttgagtgtgatgatatggccttgggacattttttaaatgggcttatcttttatcgtcgtggtaaagatgaaaaatatcctactccagaagtcgaaaaacggataaccaacaatattattttaaagaaattacgtgttgcctttgaattaaaagacatggatatgattaacatttatgaactagcggattttcgcgtttctaagcctgaacttagcgcgatatttcgtaagccaggacataaaaactaccgtaactgtggcgatcaactggtgagatactttctgaaagggttaactgaaaccttacgtggcaaaggcaaagcggtgaagaaataa

SEQ ID NO: 1087 - DNA, 687 bp, Proteus mirabilis
ttaatgtgtttatcggagagtccaatgtcatcaacattaagtaaagaggcgcaatgggtacatgccgcgttagtggagcgtggtttggaaacgcctcttcgtgagccaaaactttcacccagtgagagtaaacaacaaattaaacatcacatgacggaagtgatgaaattgttaaacctagatttgagtgatgacagtttagcggaaacgccacatcgcattgcgaaaatgtatgttgatgaaattttttcaggcttggattatcacaactttcctaaaatcaccctgattgaaaataaaatgcaggttgatgaaatggtcactgttcgtgacatcacattaaccagtacttgtgagcaccattttgtcactattgatggtaaagcaacggttgcttatattcctaaagataaagtgattggtttatcaaaaattaaccgtattgtgcagttcttcgcacaacgccctcaagtgcaagagcgtttaacgcaacaaatattgattgccttacaaacgctattggggacgaaaaacgttgctgtctctattgatgccgttcactattgtgtaaaagcaagaggcattcgtgatgcaaccagtgcaaccaccacaacctcattaggtggactatttaaatctagccaaaatactcgccaagagtttttgcgtgctgtacgccatctttga

SEQ ID NO: 1088 - DNA, 1431 bp, Proteus mirabilis
atgcaaaaaaatgatgataaaaacaaaaagcttcattttataaataactatcgtagacaggaactatacatgattgaaattcttatcggcgccctcgtcgctgtgggtgttgggcgttacattgttaagggatattcgccaacaggtgtgctacttactggtgggctattattgcttatcatcagtgtgattatgggcaaatcagtattaccagccagtgtcacaagtaccggttatcgcttaatcgatattgttgagtatgtaaaaaatctacttatgagccgtggtggtgatctggggatgatgatcatggtgctatgtggatttgcttcttatatgactcatattggtgccaatgacgtggtcgtgaaacttgcctcacgcccattaaaaatgatcaactcaccttatcttttaatggtagcggcttatattgttgcatgtttaatgtcattagctgtttcatccgcaacaggtcttggtgtgttattgatggcgaccttattcccagtgatggtcaatatgggaattagtcgtggtgcggcggcagctatctgtgcttcacctgcatcaattattttagcgccaacctctggtgacgtgattttagcggcacaagcttctgaaatgccacttattgattttgcgtttaaaacaacactgcctatctctattgccgcaattcttgggatgtgtattgctcactttttctggcaacgttatcttgatcgtaaagagcatatcgaaacagagatgttagatgtgaacgaaatcaaaactcacgcccctaatttctatgcgattttacctttcacacctattattggtgtattagtttttgatggtaaatggttaccagagcttcatattgttgccattattattctttgcatgatgttatctgcggttattgaatttatccgtagctttagtgctaaagaagtttttgccggtttagaagttgcttaccgtggtatggctgatgcatttgcccaagtggtaatgttattagttgccgcaggggtttttgcgcaaggtttaacaacggttggctttattcacgcgttaattgatggtgcacaatcattaggatcaggggcaattgttatgatgattgcattagtcttaattaccatgctcgcggcaatgacaaccggctcagggaatgcgcctttctatgctttcgttgaattaattccgcgcttagcaagtaatatgggtgtgaatcctgcttacttaactattccgatgttacaagcatcaaacttaggacggactttatcacctgtatcgggtgtggtagttgctgtatcaggaatggcaaaaatttcaccttttgaagtgatgaaacgcgtttctgtaccagtattggtcgggcttgtgattgtgattgttgcaacggaaatactggtacccagcacattaggttga

SEQ ID NO: 1089 - DNA, 321 bp, Proteus mirabilis
ccgcgaaaaaaactcctaacggtcgccgaggcgatgtatggcggaatgagttcaaaagaatcggctgagttcgagcgcgcttttggctttccgcctgatattgatgatgttgaggtgtggcctgatgtttgggattcgtatcaagtattttcagctatgaatacacagtggcgtgtaggcatgaatggtatcacaggcttggattacaacccattaaaccaaataatggacttactcaacatcaaagatagagcgaccgtttttagcgatatccgcattatggaggctaaggcgttagaggtgatgcataagagaccatag

SEQ ID NO: 1090 - DNA, 1074 bp, Proteus mirabilis
accatgaaaaaaatccttctcttgctgattatcgcccctctactcatctcatgtagtagtaaacccactaaaacttttgagcctgattacagcaaagacaccaatgccttcgatatattaatgggacaatttgccaataatatcgagatgatttggggaatgcaggaagtattaatcgcaggccctaaagactacgtaaaatatacggacgcttatagaactcgtagccatattaattttgaagcgggtactatcactattgaaaccctagggggtgacgcgcctcaattccaattacataaagcgattgtcacgacattgcttatgggagaagatcccggctctatcgacctctactctgatgtaaataatattccccacagtacagagccttttttattaggacaagtacttgataatacagggcagcctatacgctgggagtggcgagcaaataaatttgcagattatctaattgccaataaattacaaaaacgtcaatcagggctgaacactatttggtatgtcactattaacttagtacctaaccacttagataaacgtgcacataaatacttaccttatgtacaacaagccgcggccaagtatggtgttgaaccttccctgatccttgccattatgcaaattgaatccagcttcaacccctatgcggtaagtagctcagatgcactaggcttaatgcaaattatgccagcaacagccggacgagatgtatttcgtatgcaaggtaaatcaggacagccaagtcgcagttacttatttgatccggcgaataatatcgatgttggtacagcgtatatctcgatattacaaaatagctacttaggtgacattaaagatcccgtttctcgtcgctatgcggtgatacaggcttacaatggcggtgcgggtagtgtgttacgcatcttccatagtgataagaaaaaagcagccgcgatgattaataacttagcgccgacggaagtttatacgacattgcgcaataaacatccggccgaccaatcacggcgttatcttgaaaaggtaagcaccgcgcaacgtaactatcgttaa

SEQ ID NO: 1091 - DNA, 909 bp, Proteus mirabilis
atgatgaaaaagttaacgtttaccgcactggcactgatgatgtgcggcgcggcatggggtgcggccataccgcaggcaagccgctatgactcccgcgtgcagcaggttatctataatccgcagaacgtcaccgtcgttaacaccaaacccggctttatgacaacgctggtctttgataacgatgaggcggtcataagcgccaaacccggctttgatgaggcgtgggaagccacgccggatgcaaaccgggtcaacgttcgcccggtcgcgctcacgcagggagcgcccggagaggatggcaacacaacgcaggtcgtgatccccccgaacagccgggactggcataccaatatgctggttgtcaccagtaagcgcctgtacaacgtcgagctgaacgtcattgatgataaatcgacgcagcaacccgctttccaggtgagctatcgctatccgggcgaagaacgggacaaagcgagccgggaggcgacggccagacagcgcgagtgggagcagaaacagcaacaggccagcgtccagaaagcgctgaactcggcgcagacgccccgcaactggagttacaccaaatatccgggcaaaggcagtttcaacattgttcccgattttgcttacgacgatggccgctttacgttcgtgggcttctccccgtccaagtccattccttccgtcaccaaagagctgaacggcaaagagcatgtggttaacagcagtatccagaagaaagacgacttcaccgtactggtgattcaggaggtgacgccccgcctggtactgcgttccggtaatgccgttgtgggtctggaaaatagcggatttgacaaggtacacgccgccgatggttccaccgtatcccggcaggtggaaagagtggaaaaaccggaatccaattaa

SEQ ID NO: 1092 - DNA, 381 bp, Proteus mirabilis
attgtgaaaaaacaaagacctgtcaatctggatttacagacgatacagtttccactccctgctatcgcatcgatcttgcatcgtgtctcaggggttatcatgttagtcgcagttggtattttactgtggttacttggcacctctctctcatctcccgaaggttttcagcaagccgctgatatcatgactggcttcttcgcgaagtttattttatggggcatcctaacagcattggcataccacatttgtggtggtattcgtcatatgttaatggacttcggctttattgatgaaacattggttgttggtcgtcgttctgcggcaatttcaatgattattaccgttattttatcaatattggcgggggtattagtatggtaa

SEQ ID NO: 1093 - DNA, 714 bp, Proteus mirabilis
atatggaaaaacagtgcccatgaaaaggagaaactcatggcggttatcgtccctgtaattactgttgatgggcctagcggagcaggtaaaggaacattgtgtcaagcattagcaaaagcctttggttggcatttacttgattccggtgctatttaccgtgtattagcattagcagcattacatcatcatgtggacattacatcagaagatgcattagtgcctttagcggcgaatttggatgtgcgctttattcctaatgacaatggtttaagtgttattcttgaaggtgaagatgtttcaaccgaaattcgtactgaaaccgttggcaacacagcgtcacaagcagcaacgtttcctcgcgtaagagaagcattattacgccgtcagcgtgcatttcgtactgcaccgggattaattgctgatggccgagatatgggcacaatcgtttttcctgatgcgcaagtaaaaatatttcttgatgccagtgcgcaagagcgtgcacgtcgtcgcatgttacagttgcaggagaaaggctttaatgttaactttgaacgccttttatccgagataaaagagcgtgattatcgtgatagaaatcgtgcagtagcgcctttggttgcggcaaaagatgcattaattctcgattcaacaagcttatctattgatgaagttattgaaaaatcgttagcttatgcgaaaaaaatctgcaattaa

SEQ ID NO: 1094 - DNA, 780 bp, Proteus mirabilis
aagaggaaaaataacctaatgtttacggtcattatcccaggtcgatatgcgtcgactcggttacccggtaagccacttgctgatattcatggcaaaccgatgattgttcgtgttatggaacaagcaaagcgttcaggtgctaaacgtgtcattgttgcaactgataacttagatgtggttcgcgctgttgaacaagcgggtggagaagcgtgtatgacccgtgaagaccaccattcaggtacagagcgtttagctgaggttatcgaaaaatatcaattcgcagatgatgagataatcgttaatgtacaaggcgatgaaccactcattccacccgcaattattacgcaagtggcagaaaatttagctaattgtggtgcaggtatggcaactcttgctgtgcctatcgtcgattcaaaagaagcctttaatcctaacgctgtaaaagtggttatggatgcgaaaggttttgcactgtacttttctcgagccactattccttgggaaagagatcgttttaatctctctcatgatgaaataggcgagcattacttacgtcatatcggtatttacgcttatcgtgcaggctttattcgtcgttatattacttgggagccaagcccattggagtctatcgaaatgttagagcagctgcgtgtattgtggtatggcgagaaaatccatgtagcaaaagcgcttgaagtaccgggtgtcggggttgatactcaagatgacttaattgccgcgagagccgcttttcgggcactaaaccaagagttctaa

SEQ ID NO: 1095 - DNA, 1134 bp, Proteus mirabilis
tctgcgcccctattgcagttggagagactaatgaacgattcttatgaaggtaaaaacggcaaagtaaaagtaatgtatgtccgcagtgaggacagtgccgataataaacctaaaaaaccatcccgccgccctaataatgctcgtggtgatactgaccgtagtcatcgtcgtgatgataaacgcggtgataacaaattttctcgtcgtgatgaacgtggtgcaggtaagtcttcaggacgtaatccatcacgcagtggatcaagctccttacgtgataacgatagtgaaggtggtaattattctccatggaaaacgatttctcgtccgggagatgagccattaaaagagcatgatggaattactggtaaaagccaaatagatcccgaacagcttcgccgtcagcgtttagaagagacgcgtatctatggtgaaaatgcttgtcaggctatgtttaaaaaccgtccagaagccattgttcgagcttggttcttacaagaagtaacacctcgttttcgtgaagcgttaaaatggatggcggcaaatcgtaaagcttaccatgttgttgaagaagaagagatggttaaagcggcgcgtactgatcatcatggtggcgtttgtttcttaatcaaaaaacgtgttggtcatgatgcacaaacctatttaaaagatgcaccaacaaaagattgtgtcttagcgcttgaagatgtgggtaatccacataatgtcggtgctattatgcgtagctgtgctcattttggtgtgaaaggtgtcatttctcccgactcatcagtgttagaatctggtgcagcagtgcgtaccgcagaaggtggtgccgagtatattcaaggaattgatgctgataattttgctcagacattagagcagtttaaacaggctggctataccttagtgacaacctcaagtcacaaaggaagtgtgccgctagcaaaagctcaattacctgaaaaaatggtattaatcttaggtcaagagaaggatggcttaagtgatagcacgttaaaacaaggggatatgagcatttacattggtggtacaggccatattgaaagcttaaatgtctctgtggcttctggcgtgttattggctgaatggtggcgtcaacatcacggctaa

SEQ ID NO: 1096 - DNA, 552 bp, Proteus mirabilis
tcagttagaaattattgtgaaagaacaactggcgaaagtgaaaaaataatggcaaatcgtttacgaaaatggggtaaagaattaattattctcgcccttatttttgtggctatttcatttgctatggactggtggcgtcaaccaacgccaccagaacttactgatttatctacgctttatacagttgatgataaaccagtctcattgattgcccttagccaagagaaaccattactgatctatttttgggcgagttggtgtggcatttgtaagttaactacaccgacggtaaatgatttagcacaacagggttataatgttacgtctgtagttatccgctctggtgatgatgccaaaataatacgtggcattaactccaagcaactagtttttccggttattaatgatgatagaggggctatttctcaacgttgggggataagtgctacaccttcttttgttattctctataaaggtgaaatggtgcactttacaagtggctggacatcctcttggggattaaaacttaggttatggtgggcttcaatttaa

SEQ ID NO: 1097 - DNA, 861 bp, Proteus mirabilis
tttgtcagaaactacggagtaaccgacatgactagtgtatcaacaattaacgtacctttccacggtaacaacctgtatgtagtaaatttcaacggcgaaccatatgtaccaatgaagccaatagttgaaggcatggggttaacttggcaatctcaatttgaaaagctaaaacaaaggtttagtaaagggatcacggaaatcgtgataccttcaaaaggcggtgagcaatcaatgctttgcctagctctccgtaaacttgcaggctggcttcacactatcagccctaacaaagtcaaaccagagatccgcgataaagtaatcaagtatcaagaagagtgtgacgacgtactttatgaatattggactactggtgaagttaagaaaaaacacaaatcaactgttcaagaacgcaacccattaaagaatgctgttaatctactggttagtaagaaaggcattatgtacccagaagcctattctcttgttcaccagaaatttaatgttagtagcattgaagagctaacagcagatcagatacccgatgcggttgagtatattcacaagttcgttcttgaaggtgaatacattcctaaacaggaagaaaatatactttttgagccaaatcaaaactcaatcactgtaaccatacccaaagaaggcagatggttagtttcttataaaaatggaaagcaacaagtagttagcgttgatggtcataacgttgtcagtgttgaatacattcaaaaattacaacgtgactctaatgctcttattgagttactgcaaaacttccgcttacgcacccaagttatgcaaggtgagaaaagcggagatattttaaatactccgttaattgcataa

SEQ ID NO: 1098 - DNA, 261 bp, Proteus mirabilis
ccccgaagaaacgttggggggttatcactgtacagtgaagatggagcacgggtctttaatacggactatctgccttttacccgaggacaatcaatggcattgttattacggaaggggagtgtagagactccatatagcttgcctttagtctgtgcaaccagtcagtttgtgaatgcgtcttatcaggatgaccacattgattgggccaagcgcaatacggggatatggggattcgttttcggggaaaacagatttttgtga

SEQ ID NO: 1099 - DNA, 1695 bp, Proteus mirabilis
atttacttgaagatcattaacatgacagaatcttttgctcaactctttgaagaatccctaaaaacaatcgaaactcgtccaggtgcaatcgttcgtggcgttgttgttgctatcgataaagacgttgttctggttgatgcaggtctgaaatcagaatctgcgattcctgtagaacaattcaaaaacgcgcaaggcgaattagaaatccaagtgggtgacgaaattgacgttgctctggacgcggttgaagatggcttcggtgaaaccgttctgtctcgtgagaaagctaaacgtcacgaagcgtggctgatgctggaaaaagcttacgaagaaaacgaaactgttgttggtatcatcaacggtaaagttaaaggtggtttcactgttgaactgaacggcattcgtgcgttcttaccgggttcactggtagacgttcgcccagttcgcgatacaactcatctggaaaacaaagagcttgagttcaaagtcatcaaattagaccaaaaacgtaacaacgttgttgtgtctcgtcgtgcggttatcgaatctgagaacagcgcagaacgtgatcaactgttagaaaacctgcaagaaggcatggaagttaaaggtatcgttaagaaccttactgactacggtgcattcgttgatctgggcggtgttgacggcttactgcacatcactgatatggcttggaaacgtgttaaacacccaagcgaaattgtcaatgttggcgacgaaatcactgttaaagtcctgaaattcgaccgtgagcgtactcgcgtatcattaggtctgaaacaactgggcgaagatccatgggtagctatcgctaaacgttatccagaaggtactaaactgactggtcgtgtaactaacctgactgactatggttgcttcgtagaaatcgaagaaggcgttgaaggtctggtacacgtttctgaaatggattggactaacaaaaacattcacccatctaaagttgttaacgttggtgatgttgttgaagttatggttcttgacatcgatgaagaacgtcgtcgtatttcactgggtctgaaacagtgtaaagcaaatccatggcagcaattcgcagaaactcacaacaaaaacgaccgtgttgaaggtaaaatcaagtctatcactgacttcggtatcttcatcggcttagacggtggtattgacggtctggttcacttatctgacatttcttggaatgttgcaggtgaagaagctgttcgtgagtacaaaaaaggcgacgaaatcgctgcagtagtactgcaagttgacgctgagcgtgagcgtatctctctgggcgttaaacaattatcagaagatccattcaataattacctgtctgctcacaaaaaaggtgctattgtttctggtaaagtaactgctgttgatgctaaaggcgcaactgtagaattagctgatggcgttgaaggttacctacgtgcttcagaagcttcacgtgaccgcgttgaagatgcaactctggttctgaatgttggcgatgctgtagaagctaaatacactggtgttgaccgtaaaaaccgcgttatcaacctgtctgttcgtgctaaagacgaagcagatgagaaagacgctatcgcttctgtaaacaacaaagaagaagctggtttttcaaacaacgctatggctgaagctttcaaagcagctaaaggcgaataa

SEQ ID NO: 1100 - DNA, 1089 bp, Proteus mirabilis
ctagctatgaacacgccctttgatattaccctattagccagaaaaaatgttcgccagttaaccccttatcaatcagcgagacgtttaggtggaaatggctcggtttggttaaatgccaatgaataccctaccgctcctgactttacgtttaatgaaaaaaatttaaaccgctaccctgagtgtcagccggttaacgtaattaatcgctatgcagcatatgcaggcgtccaacctgagcaagtgttagttagccgaggtgccgatgaagcgatagaactactgatccgtgctttttgtgagcctggtaaagatgctgttctctattgtccacccacttatggtatgtacagcgtcagtgcggaaacctttggtgtagaacagcgtgttgtccctgctcttgctgattgggagcctgatgtcaaagccattgcatcacaacttgataatgtaaaacttatctacctatgtagtcccaataacccaacaggcaatatcgttgatccttcactgatccgcgaagtattagcattagcaaaagataaagccattgtggctattgacgaagcttatattgagttttgtcctcaagcatcactagtcacttggttaaaagagtatccgaatttagtcattttgcgaactctctctaaagcttttgcattagcgggactgcgttgtggctttgcacttgccaattcacctgttattgaattattacttaaggtgatcgccccttacccactttctaccccggttgctgatattgcggcacaagcattaactgaccaaggtatagaagcgatgaaacaacgggtaacggaaattgtacgcaatagaacatatttagcggatgcactaaaaaatttacccaatgttgaacaggtttattgtagtgaaaccaactatattttagtgaaattcactgatgctgattgtgttttccgcagtttatgggagcaagggattattttacgcgatcaacagcgtcaatatgggctggcaggttgtttacgcatctctatcggtacgcgtcaagagtgtgatagcgtgataaccgctataaaaaataggcaaacggcaaacgtataa

SEQ ID NO: 1101 - DNA, 1173 bp, Proteus mirabilis
aacatcatgaatttacacgagtatcaggcaaaacagcttttctcacggtatggattaccagcacctgctggtttcgcctgctccacgccgcgcgaggcagaagaagctgcatcaaaaattggccaaggcccttgggttgttaaatgtcaagttcacgcgggtggacgtggtaaagcgggtggcgtaaaagtcgtcaactcaaaagaagagatccgcgcatttgctgaacaatggttaggcaaacgtttagtaacttatcaaacagatgctaatggccaaccagtaacacaaatcttggttgaagcggcaacagatattgctaaagaactttatcttggtgctgttgttgaccgtggtacccgtcgtgttgtctttatggcttccactgaaggtggcgttgaaattgaaaaagtggcggaagaaacgccagagcttattcatcgtgccattattgatccgctgacaggacctatgccttatcagggacgagaattagccttcaaactcggtttaaaaggcaaacaagttagtcaatttgctaaaatatttatgggattagcgacgatcttcttagagcgtgatttagcgcttattgagatcaacccattagtgatcaccaaagatgatgatttgatttgtcttgatggtaaattaggtgtggacagtaatgcgttattccgtcaaccggaaatgcgtgaaatgcatgatccatcacaagaagatccacgtgaagcgcaagcggcacaatgggaattaaattatgtagcactcgatggcaatatcggttgtatggttaatggcgctggtttagctatgggaaccatggatatcgttaaactgcatggcggtgaacctgctaacttccttgatgttgggggaggggcaaccaaagagcgtgttacagaagcatttaagattattttgtcagatgaaaatgtcagtgctgtattagtcaacattttcggtggcattgtacgttgtgaccttattgcagacggtattattggtgcagttgaagaagtcggtgttaacgtaccagttgttgttcgtcttgaaggaaacaatgcagagttaggcactaaaaaattagcagatagcggtttaaatattattgctgctaagagcttaacggatgccgctaaacaagttgttgcagcagcggaggcaaaataa

SEQ ID NO: 1102 - DNA, 705 bp, Proteus mirabilis
gttgccatgaatactattaaacagaatctcgtcaatgtcaggtctcacattgacaccgcagcgcaaaaatgcggacgttctccagacgaaataactctacttgcagttagtaaaactaagcctgtgagcgatatcgaaaaagcaattgcatgtggacaaactgaatttggtgaaaactatgtgcaggaaggtgtagataaaatcagctattttgctgaaaacaaaaatttagtttggcactttattggcccattgcagtccaataaaacacgtcttgttgctgaacattttgcctggtgccataccatagatagattaaaaatagcgcaaagattaagtgatcaacgtccaactacgttaccgccactcaatgttttgatccaaataaatattagtgatgaaaacagtaaatcagggatctctcttaccgagcttgatggccttgctgcacaaatatccattctgccagggatcaaactgcgcggactaatggctattcctgccccagaaaatgactataacaagcaagtcgaggtactagaaaaaatgcatcaggcatttaaacagttacaaaaccagtaccccgatattgatacattgtcgatgggaatgactggtgatatggaagcagcaattgcctgtggctcaacactggtacgcattggaacggccatttttggcgctcgtgattacgccaataaataa

SEQ ID NO: 1103 - DNA, 1209 bp, Proteus mirabilis
tcggtaatgaaaacaaatcttccatccgtattggctaaggttaccgcgggaatgggtttactgctaattatttctagtcctacttttgcggtgaataatcctgtgccgcctcaaattgaggctaaatcttacgtattaatggattataacagtggaaaaatacttgcttcagagaagcctgaagagcgcctagatcctgccagtctaaccaaaataatgagtagttatgtggtaggacaagcgataaaagagggacgtatgtcgcccgatgatattgttattgttgggcgcaatgcttgggcgacgggtaatcctgttttaaagggctcatccttgatgtttttaaaaccaggcgatcgagttaaagtgatcgacttaaatcgaggtatggtgatccaatctggtaatgatgccagtattgcgttggcagaacatgttgccggtagccaagaaacctttgttgatcttatgaatacctatgccgcgaatttaggtttaaaaaacactcactttaaaacagtacacggtctagattctgaagggcagtacaccacagcacaagatatggcgttattaacagctgccatgatccgcgatgtaccttcagaatatgatattcataaagaaaaagaatttaccttcaacaatattcgccagccaaatcgtaaccgtctattgtggaataaaaatatgaatgtcgacggtgtaaaaaccgggcataccaatggggctggctataaccttgtctcttcggcaaccgaaggaaatatgcgtctgattgcagtggttttaggggcgccatcagataaagtgcgttttgctgaaagtgaaagattactcggctggggtttccgcttttttgaaaccgtgacacctgtaaaagagaacgtgcccctgactacgcaaaaagtatggtatggcgataaaggtgaagtggctttaggtgttgctaaagatgcatcaatcaccattcctaaaggagagctaaagaacttaaaagcctcttttacattgactaaccccgaattagaagcaccattaacacaaaatcaagtagtaggaacagtgaatttcttactaaacgatgaagtgattgagcagcgcccattagtggtaaaagaagcggttgaagaaggtggtttctttagtcgtatctgggactttgtggttaaaacagtctctggttggtttaatgcgctttttggttaa

SEQ ID NO: 1104 - DNA, 546 bp, Proteus mirabilis
agaggaatgaatatgaaagttgaacaatctcaagttactaagttagtaataacgggtgtagaacgtcacgaccctattcatgtttatcttgaggactacggcgataatcaaaatggtcgtgtcacaattagcgaaagcggttgttcatggtcttgcttttggggttctatgggtagcccgctaattgagtttattcagcgcatcaataatcactactggataggtaagttagattctaatttaatctctgagatagacgctgataacgatgcaaatgctgaatacgctaaaaagcaagttatcgaactgcgcaaagatgatgaaatagataaatacgaagcaagggaatattgggatttaatcgaagcatcagatagtgttaaagatgagtgctgtaatagttttttaggtggtaagttgcttagtttgtttggtgatgatgcttggtataacgattggcccactactcctaaccctcaatatctcagaatggaatcacgattaaacgctgttcgtgaggcattaaaacaaataaaggtgagttaa

SEQ ID NO: 1105 - DNA, 1305 bp, Proteus mirabilis
tgtgagcagaattttgagcctcattatacgatacacactgatttgaagagtgatatggcaaataatacaaatctttctgaaacgttatttaaacctcgtgctaaacatgcggaaacctcaacgttaatacagtacacacaccctaaatctaatattgattcgtactctgtacttaatgggatgagccagcaaaattggtatcgcacaattcaacgtctacagtggatctggcgaggtatttcccccatagagatcgaagaagtattaagtcgcattgctatttttgatgcgccacgcagtgatgataaatttattgatacagtcgttggttatcgacgtggcaactggtcatttgaatggtctcatcaagcaatgatttggcaacaaaaagcgttacgagagacctcagaggaagcagccgctgattgttggttacgagcggcaaacctttatagcattgctgcttatccatttattaatggcgattttcttgctgatcaagcggtagtattggcgatgaaagcttttgaaaatgccatgaaattctcttcatttgaagtaaaaaaactgacgtttaaattaacaggtaaaggaactaccagtggatttttacatctacctaaagggtgtaaaggaccttatccaacagtcattttttgtggtgggttagatagtttacaaagtgattatgttaacttttttaggcgctacttatcaccaaaaggtatcgcgatgttaaccgtagatatgccatctattggttattctgttaagcagaaactcagcgaaaatacctgtcaattgcatggtgatattttacagcagttgggagatattccatggattgatcacactcgagtgggcgtaatgggatttcggtttggtgccaatattgcggtgcgtttagcctatctttatccaaaattgattaaaggtgttgtggcattagggccattaattcatgccttttttactcaagcggaattacagaagaaaatccccattatgtatctcgatgtactggcgagccgcttaggattattaaatatagatgaaaacaatctcagactatcgttaagtagttattcactgaaaaaccaagggttgattggtcgtcgtatgccagtgccgatgatgagtgtttattggaaaggggatgaaattagtcctaaagaggattcgcagctcattgctcgctcttctatggatggcgatatagtagaaataaaagaaaaaccactttataaagggcttgaacaggcattaactaaaagcgcagattggatctatgctaaattaatataa

SEQ ID NO: 1106 - DNA, 501 bp, Proteus mirabilis
atgagtaagaaaaatctcggtagtgttgcccctaaagaaaggattaatattaaatatacgccaaatactggcggagctcaggctgaagtcgaacttccattgaatatgttgattgttggggatatgaaaggtaaaacggaagagacccccattgaagatcgcaaagcgatttcagtcaatcaaaacaacttcaattctgttatggaaagtgctggcattaatttaaatattaatgttcgcaataccttagaagaaagcagtgattcagagcttaatgttaatcttgatgtgaaatctttacaggatttctctcctgatagtatcgctcgccaagtgcccgaattaaataaacttctcgaattgcgtgaagctttagttgcattaaaaggtcctctaggcaatgtcccagcttttagaaagcgtcttcaagaactacttgaaaatcaagaaactcgcgaacagcttctaaaagagctcgatattgctgctaatcaaaaataa

SEQ ID NO: 1107 - DNA, 1122 bp, Proteus mirabilis
ttaggaaagaatatggctaaaaaagcacccaaagaacaacaagcaattagggaaagtgccgaggttcgatttgctgaagaattagaacgcttaacaaaagcggatgctaataatccgaagccccaaggatggcttcgctctcctcgagctgtgcgccaatttattttaggtgatgatactttaggtatcacacctaagtttttcggtgatgatgccttagttgatcgtgcaattgttacattattaggcaaacagggcttaatgctggttggtgagccaggtacagcaaaatcaatgctctcagaactttttgcggctgctatcagtggtgattcaggattaaccatccaaggtactgcagggacgacagaagatcatatcaaatactcatggaactatgcgttactattagcagaaggcccaacagaacgagcattagtcggctcaccgatttatcaaggcatgttacaaggtaaaattgttcgttttgaagagataactcgctgtcctcctgaaattcaagatgtactggtttctttaatgtccgaaaagcagttaatgatccctgaaatgggcgacggtgcgcgtattagtgcaaaacccggatttaacttgattggtaccgcaaacttgcgtgaccgaggtgtacatgagatgtctgccgcattaaagcgacgttttaattttgaaacagtaaaacctattcgtgatccagcttttgaaatcagtttgatccaatcacagcttgaaaatgagttaggtactttagcgacagaaatcaccgttcctatggatgtagtggaattactggttaccacattccaagaattacgttcaggtaatacgcaagatggtggcaatatcaaaacacctgatgcggttatgtcaacagcagaagccgtaaatatcgcttatgcttgtgcgttagaagcgcattatttaggtgatggcgtgatgaatgccggtgcgattgcacgtcaattaatcggcgttgtattaaaaaataatcctgatgatattaagcgtattcgttattacatggacaacgtcgccagagaaagggccagaaatagtaaagagtggaaagcgttctttgatgcatcaaaaaacttttggcaataa

SEQ ID NO: 1108 - DNA, 786 bp, Proteus mirabilis
tggacggagaaaataatgagaaaacaatctcccgaatatattactcctttaaatgagcaaaatgtaaataaagacaatgcgaacctattggtttgcccatttgctggtgccagtaatagtgcatttaactcgtggagatctaccgatatttcagggttaaattgtcaattagttaattactctggccatggttgcagatttaaagaaccagcctttaatgatattggattattagccaatgaattaataacaataataaagaaattttatccaccacggcataattcattattactttgtggtcacagtatgggggcccaagttgcctttgaaactgctattcaattagaaaaaaatggctgggaattatctggactaatattatcaggctgccaagctcctcatattcaagcaaggagattactgagtgatttaaatgatgatgactttattcaacaattaattgccattggtggatgtgatgctgaattaatcaagcagccacagttgttaaaacagtttatgccattattacgtgctgatttccttgctaccgagcgttatttttttcaaaaaagcactaaacggctttttcatacccctgttttattaatgtatggtagtcatgatagtgaagctgataaaagcgaagttgaggcatggcaagattggatagataagcattgcactattaattgcatcgctggagatcacttttatccaattacacgtccaaatactttttgtcgttttattattgatttttatcaccaaatttatcaatga

SEQ ID NO: 1109 - DNA, 228 bp, Proteus mirabilis
gttaggtggaataagatgttaaataataaagcttctggtgactggaatttatttaaaggaaaagtgaaagaaaaatggggaaaactcacccatgatgaactggatattattgaaggaaccagagagcaactgatagggaaactccaagagcattatggctattcttatgatgaagcgaaaaaagaagtattagagtgggaaggcagtaacccttatccttggaagtag

SEQ ID NO: 1110 - DNA, 864 bp, Proteus mirabilis
ttggagcggaattcacctagcgctatactaagcaattatgtaccctattatgtaagcgaaactatgcccgttatatcaatctctatcgttgctgtctgcgcttatttactcagtctggtgtttattctccccagtttgctgagaaaagagcaaaatggataccgtggattagcgctgctttttgcggtggtcgcccttgtgacccatgctatctcattaaaatttttgattttccgtccacatagcgggcaaaatctgtcactcaccaatttaggggcggtggtcagtttaatggtctgcgttatcatgaccattgttgcttcccgtggtagagcttggtttttgctgcctattgtttattgcttttccatagtcaatctcattattgccgccttgatgccaggtgagtttgtcacccaccttgaaagtagcacatcgctctttattcatattgggcttgctttattaagttacgccactttgttaattgctgctttatatgcgttacaactcagctggctcgactatcaactaaaaaataagaaactaaaattttcaccacaaatgccaccattaatgtcaattgaacgtaaaatgtttcatattacccaagtgggggtagtattactgacattaaccttgtgtaccggcctgttatatatggataatatctttggtaaagaaaatatccataaatcaatattttctattattgcgtggtttgtctacatcattttattatggggacacttccgtgagggttggcgtgggaaaaaagtggttatttttaacctgatcggtgccattattttgacattagctttttttggtaatcgtttattgcaagagttaatgcttaattaa

SEQ ID NO: 1111 - DNA, 627 bp, Proteus mirabilis
aggaaataccttacccagttcaaaaggtgtgctgtgatgaaagtcgtcattcttgatacaggttgtgctaatttagcctcggttgcgtacgccgtacaaaggctaggttacgatccaattatttcttatgaaaaaaatatcgtgttatctgctgataaactgtttctccccggggtgggaacagccagtgccgctatggaacaactaaaagcccgtgaacttatccctttaattaaagcgttaacccagcccgtattaggcatttgcttagggatgcaaattttggcctctctgagtgaagaaggtcacaatatccctctattaggattagttgacggtaatatcaataaacttgataccaaaggattacccttaccgcatatgggttgggatcaggtattagcaaaacccgctcaccctctatttcgcaatattgacagcgacgcttggttctattttgttcacagctatggtttagggctcaatgactcaaccatagccgaaacagaatatggttcacgctttagcagtgccattcagaaagataatttctatggggtgcaatttcaccctgaacgctcaggaaaagcgggtgctcaactgattaagaattttttggagatgtaa

SEQ ID NO: 1112 - DNA, 828 bp, Proteus mirabilis
ataagtcgtttatccattaaggagagtgatcatatcttgactgctaggaacagactagaagtggcttggcagtgtatcgctaagctgcgaactctacgcatttcattctgtgcattcaccgcgcaattaaaaacactcacagaaccttacagaaagtcgaacctgagaaaaaccgttaatggtgttttctgtggggcggttatttctggtgaacaggttcgcttttctataaggatttacaccatgagcaaatcattagttttcaaaggtaatgaaattactccatttgataatggtgataataagatttggtttaccagctctcagatggctaagctactcgaatacaaaaatgagaagtcagtaaccaatctatataacgccaacaaagacgagttttctgatgatatgacaatggtcactgaaacaatgaccaatggaataaacaacaacttacgtaagaaaaaggtcaggatcttctctgttagaggtgcacatctaatcggaatgttagctaatacagatgtagcgaaatccttgcgtcgatggttacttgatctagctgaaaaagagtcaaaaccacaaacagggttagcaaaccttgacatgaatgagcttaaaaccctgactatcaatgagatgcaaaatagattagtagcagccgataactggtcgttcgagaactttggcaggaaaggtagtgacttaatgaatttacgcaagcgtcacttaaagaaaatacgcaaagcgaagaaggcaattaaagaactatcacaattaaccttgcctgatatgggcgaatttccagatggagaagagccagcatga

SEQ ID NO: 1113 - DNA, 1005 bp, Proteus mirabilis
ttgactattgacattataagaacaaaaaataatgatgaaataatagaaagaatcaactttaggagaaaaaatctcatggatacactgagccgtttactccatctttcgcagggagagctgattttagacgttttttgtagattatctggtgattttttacttcctcatcctccctcttcagaaaaagaaacgatttttcatcttgttttatccggtgaatgccaggttcagatagaaaattcagaaccgctagctttgtccgaaggagcatttttaatgcttaatcgtggtcaatcgcatacgatttggcgtggggaagatatcggctcaacagttcaactgttggataatgatgttttacctgttaaatgctccgtagcagcaacggatgggcaatctgcagacattctttgtggccggatggtttatgccgaagggagtggacaattattacttaacggtttcccagactttgttcttgcggatttatctgcgttaccaggaatcgaggttcttgaaatatttacacgattaataaaagaagaagctcttgataggaaatcaggtgcttctgcaatgctgaatggacttgttcaggtattatttatttttgcattgcgatgctatgaaagatcgggtgaattgaattatcattggttaaccttgcaggaagaccccagattatcgaaggcgcttaatgcgatgattagtgaacctcacagagattggacagtaatctcattagccaatttgtcattaatgtctcgagctacctttgctcgccgattcaaagcttgtgctggtgtgccaccaggagatgtgcttcaatctattcgtatgatgaaagcgctctcattattgaaagaaaagaaaaatacactttcctatatagctacttccgtaggatatcagtcagaagctgcattcagtcaggctttcaaacgcattttaggttgtagacccggagagtggcggaagtaccaaggaaggcataatgatatatga

SEQ ID NO: 1114 - DNA, 690 bp, Proteus mirabilis
gtagtggctgacatgaatgttatcgatctctttctaaaagcggggcttttagttaagttgatcatgttgttattaatcggattttctattgcctcatgggcgatcattattcaacgtacgaaagtattgaatgcagcagatcgtgaagcggcagattttgaagataaattctggtcaggcactgatttggctcgtctatataaagaaagccaagctcgtcgtgacgagttatcaggggcagaacaaatttttcattctggttttaaagagtttgcacgactacatcaagcgaatgttcatgcacccgatgccgttgttaatggggcttcccgtgcaatgcgtgtttcatttaatcgtgaattagagtccttagaaacgcatattccttttttaggtacggtggggtcaattagtccttatattggcttattcggtacggtatgggggattatgcatgcatttatcgctttaggtagcgttaaacaggcaactttacagatggtggcacccggtattgctgaagcgttgattgcaacagccattggtttatttgcggccatccccgcagttatggcttataaccgctttacgcaacgtgtaaataagttggaacaaagttacgataactttatggaagagttcctgacgattttacatcgccaagcttttgtctccgcagaaaagaaatag

SEQ ID NO: 1115 - DNA, 861 bp, Proteus mirabilis
aaaatgcatgataaaataattaacgatatccttgattggatagaagataatctgactaaaccaatttcaacaatagatgtaataaaaaaatctggttatagtcaaagatattttcaagatctatttctgcataaaacaaaatcaactattgctaaatatattttgtctagaaagttatctatgtcagctattttgcttaaattaactcggtattctatatcagaaatatctaatgattactcttttacttcccagcagagtttttcaagagcttttaaacgatattttaaggtaacgcctgaattttatagaaagagtaaattttgggattttagatattatcgacctcaacataaagtatttgattttaaaaaaataaattgtcagttaatttatttatcaaaagatagattgcttgataataattctgatgattttaagttttttgatatttctattccttttgactttaagtcaaatattgcaatagaggggctaggctataaaaataaaaaacagattgaaataataaaaagtcttgttgattcatcaaatgataatttgtgtgtatcttataattatttccttagtagtaaagttaaaaataaaatcactgtaaaatataatataaaatatattcatgattataatttttcctttaataaggaaggtctaaagtattatctgttttcatttttaggctcttgggaagattatatgattttatccaatattatctatatgagagaattaccgctattgcaagccaagagaagagatggctatgatatagaaatatttacttcaggtaaattagataaaaacatttgttctttaaattatcttatccctataatttag

SEQ ID NO: 1116 - DNA, 186 bp, Proteus mirabilis
gaaggtaatgacgataatttcacaataaaactattaaataattttttcgtcatttttagtttattatcaatagcattttgctcatttgctcgcaacagctatcctaaatctgtattatcaaaaaaagccaatattcccattacatatttaatttttctgaataaaaatcccgccagaatcatttaa

SEQ ID NO: 1117 - DNA, 285 bp, Proteus mirabilis
tatcacaatgactttactggtggttgtatgtcacaaaaaaatacgagaataagagatataacgccttatagccttagaatgcctgatactctgaaggaaaagttaatgcaaagggcaagtaagaatgggcgatctcttaatgctgaaatggttatgattcttcagtctgcagtggatgaggatagcacccataaaaacttaaatgagttgtcacagcttgatcctgaaaagttcaaagaactgttcatggaaactatcaagaaaatgaatgagggtaagtcatga

SEQ ID NO: 1118 - DNA, 1389 bp, Proteus mirabilis
aaaggcaatgactcactttatttttcattatttttttaccgcgttatttcggagagtattatggatacaaccaaagctggttctatcgcacagggtaatacccaaagtgattacaaaacatggcgtaagtcagacacagtatggatgctcggtttgtatggtacagctatcggtgctggcgttctgtttttacctatcaatgccgggattggtggcttaattcctctgttgattatgttagtacttgcttttcctatgaccttttttgcacaccgtggtatgtgtcgctttgtgctatcaggtaaaaatccaggtgaagatattactgaagtggttgaagaacactttggtaaaacagcaggtgtattaatcactctgctctatttctttgctatttatcctgtcttgttggtttacagtgtcgctatcactaatacggtagaaagctttattgttcaccaaatgcatatgacagcaccacctcgtgcgattttatcactggtactgattgtcggtattatgtgtatcattcgctttggtgaacaagctattgttaaagcaatgagtgtcttagtattcccattcgttgccatcttgatggtacttgctttatacctcattcctgaatggaatggtgccattcttgatacgctctcttttgatcacgcctcaacttctggtatgagccaaggcttgttagtaaccttatggttagctatccctgtgatggtgttctcttttaaccactcaccaatcatctctgcttttgctgtggcaaaacgcgaagagtacggtgacaatgcagagaaaaaatgttcacgcatcttagcttatgctcatatcatgatggtgatcactgttatgttcttcgtgtttagctgcgtatttagcttaacaccagaaaatttagcagaagcaaaagagcaaaacatcagtattctgtcttatcttgctaaccactttgaagcacccgttatcgcttacattgcacctttcattgcctttgttgcgattactaaatctttcttaggtcactatttaggggctcgtgaaggtttcaatggcttaattatcaaagggatgcgcggaattggtaagaatgtcgaaaaagatcgtttaaacaaaatcacagctctgtttatgttggttacaacgtggatcgttgcaacattaaacccaagtatccttggtatgattgaaacattgggtggcccaatcatcgcaatgttactgttcttaatgcctatgtatgctatccgtaaagtaccagcgatgaaaaaatatcaaggccatattagcaacgtatttgttgttatcatgggtctgattgcaatctcagcggttttctacaccttaggtaatactttcattaattatttctttaactaa

SEQ ID NO: 1119 - DNA, 2148 bp, Proteus mirabilis
aaagtgaatgagataaaaaatatgacccactctatagaacaactcgattatcacgccttaaatgccatgctcaatctctatgatgagcaaggcaatatccagtttgataaagacaaattagccacccaccatttttttcgtcaacacgttaatcaaaatacggtgttttttcatgatctaaaagaaaagctcgattttctggtgcaacaacactactacgaagcacaagtattagagcagtatgatttcccgtttatcaaacagctttttaagcatgcctatagcaaaaaatttcgctttcaatcgttcctaggtgcatttaaatactacaccagttacaccttaaaaacctttgatggtgagcgttatctcgaacgctatgaagatcgtgtttgtatggttgccttaaccctagcacaggggaataccaaactcgccactcaccttgtcgatgagataattagtggccgtttccagcctgcaacccctactttcttaaattgtggaaaaaaacagcgtggcgaattggtctcttgttttttattacgtatcgaagacaacatggagtccattggccgagcagtcaattctgcgttgcaattgtcgaaacgtggcggaggtgttgctttcttactgactaatttacgagaagcaggagcccccataaaacgcattgaaaaccaatcgtctggcgtagtaccggtaatgaaaatgcttgaagatgccttctcatatgccaatcaattaggcgcaagacaaggtgctggagcggtttatctccatgctcatcatcctgatatctatcattttctagatacaaaacgagaaaatgctgatgaaaaaatacgtattaagacgctttcattaggtgtcgttattcccgacattacctttgaattagctaaacgcaacgaagatatgtatctattttcaccttatgatgtagaacgagtatatggcgttcctatgtcagaaatcagtattagcgaaaaatatactgaaatggtcaacaatgcagagatacgtaagaaaaaaattaaagcacgggcattttttcaaactttagctgaaattcaatttgaatcaggttatccctatattatgtttgaagataccgtcaatcgcgcaaatccgattgcgggccgaattaatatgagcaatttatgctcagaaatcttacaagtaaatagtgccagtgaatacaatcctgatttaagttatcgacaaattggtcatgatattagctgtaatctcggatcaatgaatatcgccatggcgatggactcaccagattttgcgcataccgtaaatgttgccatcagagcactgacgagtgtggcacaaatgactaaaatagaatcagtaccttctattgaaaaaggcaaccaagcatctcatgccattggcttagggcaaatgaacttacatggttatttagcccgtgaagggatttattatggttcagaagaaggacttgattttaccaatatctatttctataccgtaacatactatgcccttttagcctctaaccaattagcgatagagactaaacagcgctttaaagggtttgaacagtcaaaatatgccactggggagtattttgataaatatttatcaaaacagtggttacctaaaacccaaaaagtccaccagctatttagccaatccaatattcatattccaacccaagaagattggcaaaaacttaagctctcgattatgactcacggtatttataatcaaaacttacaagcaataccaccaacaggatcaatctcttatatcaatcactctacatcgagtattcaccccattgtggcaccgattgaaataagaaaagaaggtaaaatcggtcgggtttattaccccgccccttttatgaccaatgaaaaccgtcatttttatcaagatgcttatgaaattggcgcagaaaaaattatcgatacctatgcccaagcatcacaacatatcgaccaaggattgtcgctaacattattcttttctgatgaagcaaccacaagggatgttaataaagcacaaatttatgcatggcgtaaaggtataaagaccttgtattacattcgtattagacaaacagcattagccggcacagaaataaaaggctgtgtttcatgcgccctttaa

SEQ ID NO: 1120 - DNA, 210 bp, Proteus mirabilis
tttattgatgatcaacctaatgtgctgggtaccagtatttccgttgcaacaatcacaatcacaagcccgaccaatactggtacagaaacgcgtttcatcacttcaaaaggtgaaatttttgccattcctgatacagcaactaccacacccgatacaggtgataaagtccgtcctaagtttgatgcttgtaacatcggaatagttaagtaa

SEQ ID NO: 1121 - DNA, 678 bp, Proteus mirabilis
aggagagatgaaatggcctcagtaagccatgtgaaccaagaaaatagcaccaaaaagctgcactatatttacgatccactttgtgggtggtgctacggcattgccccacttattgaagtagtgagtcacgaatacccacatgtactaacactacatggtgggggattatttaccccgacaagaaaagtgacagggggcgatgcatggaaagagcatgttacccctatcgatgaacgtattagccagttatcgggacaaatttttagccagcaataccgtgataacctcgccaatacagagatgacattaaactcactgatgccaattgcagcgatattggtagcaagaaaaatgggcgatagagatgtcatgttattaaaagcgttacaagatgcctattatcttgatggattaaatattagtgataaagatgtgctattttttatcgtacaaaaactcgggtttgatatcacccttttttcgacgctatttacgcaagtaaatgagtatgaaataactcaacatatacagcaaactcaacaattaatgcatcaagtaaatggtcgtggtttcccaacgctatgtattgaagataaccaaacctaccagttgatcccggtagagaattattttggcgatacaaaaagttggacctcttttctaaagcaaacgctgtaa

SEQ ID NO: 1122 - DNA, 1281 bp, Proteus mirabilis
tatgattgtgagctagggagtataaatatgttagaacaaatgggaaaagcggcgcgagaagcttcttggcacttagctcagctatcaaccgaacaaaaaaatcaggcactgttagtcatcgctgatttattagaacagcaagaagccattattcttgctgctaatgaaaaagatatggtggcggcacgagagtctaatattaatgctgcaatgcttgatcgtttattactcacatcagaacgtttaaaagcgatcgctgatgatgttcgccaagtttgtcatctagaagatcctgtaggtcaagtgatagatggtcgtttattagacagtggcttacgtttagaacgccgccgagtccctttaggggttgttggcgttatttacgaagctcgtccaaatgtgactatagatgtagcatctttatgcctaaaaacagggaatgcggctattctccgtggcggaaaagagactcaccatactaaccaagccgttgtcgcggtgatccagcaagcactagaaacatgtgctattcctgcggctgctattcaagctatcgataagccagatcgcgaattagtcgcaaaaatgctaaaaatggatgagtatattgatatgcttattcctcgaggtggtgcaggattacataagttatgtcgtgaacaatccactattcctgtgatcacgggggggattggtgtttgtcacacctttgttgacgaaagtgctgatttagaccaagcattaaatgttattattaatgctaaagttcagcgtccaagcgcatgtaattcgttagaaacgctattggtacatgaagctattgcggagagtttcttgcctcaattaagtgatgcgatggcagcacaaaaggttactttgcatgccagtcaacgcgctataactgcattgaaaaagggacgtgcgacggtcgtcgatgtgacagaagcagattattgtgatgaatggctatcactggatctgaatgttgaagtcgttaatgatttaacggcggcaattgctcatattcgccaatatggtaccgcgcactcagatgctattttaacgcaatctatcagtcatgctgatcgctttgtacgccaagttgattctgctgcggtatatgtgaatgctagcacacgttttacagatggtggacagtttggcttaggtgctgaagtagcggtgagtacacaaaagctacatgcacgaggccctatgggattagatgctctaaccacctataaatggattggttacggcgacaatacattacgtcgctaa

SEQ ID NO: 1123 - DNA, 522 bp, Proteus mirabilis
agaccaagtgagtttagaaaagcgctgtcagattgcactctcatatcatcggtactaatcatgaaatacggaaaactctatgccgtcattgcgatggtaggcattatcgtgggtagttattgggtgattaactggcaagctaataggattaattcactgacagatatcaacaaaaaactggccgtggctctcgaagaacagaagtctattaatactgactatcaagcacgcataatgcgattaaatcagttggatattcaatatacgcaggagctagcgaatgctaagaatgaaattagtcacttgcgtgatattagtgagcgtcatccagagcgggtgtacatcaaagccgagtgccccaaagtcaaaaccactccctccaccagcttggcttatgcaaccaccgcccgacctactgacaccgctatccgaaattattggttactcagagagcgaattgcagagtcagaacagatgattaaagggttgcaggattatatcaaacaagaatgcatggaataa

SEQ ID NO: 1124 - DNA, 1740 bp, Proteus mirabilis
atcatgagtgaaattaaatatattaaagaaaagcagtacttacaaaaactgttcagtgagtatgcagataaagcgccacatttagcgagcgtacttgatcctcaagatccacaaacaagttatctcttagaaggctttgcttttttatctgctcgtttacaagataaaattgatgatgcttttcctgagatcacattacccctactgcaacgactaaattcccaagccattaaagggctaccatccacaacaattatccaaattgaccaaagtgaaattctcccctatcccatggagattaatgaaaaacatctggtgattggcgacaacggagcacaatttagtttctgccataatttcaccatcatgccttatagcattttagatagaaaaattactcagcatccaaaccactcttgtatctctcttgaaatattatatcgtggtgatgtggaattaactcaaacaaatgcacttaatgtttttttaggggaaaataaaaccacctcagacattttattactcgcatttagtcaatactttgaaaaaattgaggtggtacataacggtgaacgttatgaaggcgatcctcttaattatgcttttgaacccaaaattggcaatgactataaaatcttcccacagaaaaataactcattttctgcgccacaacgtttattagaaggtctttatttaccccatgttcaccattttattgagttagatataccacaaatagtgactcaattagattggaaacaacagcagcggtttgttgtgaatatctatttcagtcagcaacttcctttaactcaagaagagtgtaatcagagcttttttttaaactgtgctccagcgattgatagtgaagcaaaacatacacttttaattgattttaaaaagaataaatcaagttatttactccctattccaacccatcactatttggccgatcttgataaaattgagttatcactagagcctcatgagctagcgcgtggcatatactgtcatttttatcctacgacagaattaaccgccgcctctcgtttaatgccccaatttcataaagccattttctattcattaacaatggagaaaaatattactgggcatacactttattatttgaatttctttgataataaaggtgatcctatggtcacaccgcctagtttacattttgcatgtgtttatattggctttgaacaatataaaagaaatgagttaggtctattaaataaacacagcgaaaaaatgcctgatgcagtaaaaacaggaaatatcacattattatcatcttgttatccacctattgtaaataatcaccatttttggaaattgttatctcattacagtgctaatggttcaatgttaatgtcattagatactattaaacatatgatttctgattatattctttaccgagatactgataggcagatcactcgaaaatgtgagcgattattaaatggactcgttgaactaaaaacacatttatatgactatattttaaaaggtaaaccctatcgttgtttatctttatcgctattcattgacgaaacacaatatgaaaatagaggtgaagcttttgtctttactacacatctttaccattttttcccgttctgtttatctgaaaatatgttattggaaatgtcagttacactcaatgatcagaaaaacaccacttggtatttatctccctcaccactaaggggctataaatcaatgatttaa

SEQ ID NO: 1125 - DNA, 501 bp, Proteus mirabilis
attaatggtgaaagcgccaaaggatatttaatgtctctcaaacagaaaatagcggtgataacaacagcaggagccacagccatcgcgttagtagtaatagcccattttgaaggtgtacgttatgaaccttatcgtgatgtggcaggtgttctaactgtttgttatggacatacaggcaaagacattattcaaggcaagagatacacacaacaagaatgtgatgcgttattacaaatcgattttattaagacacaacagcaagtcgatgcattaatcaaagtatcactcgatgactacaccaaagctgctttatattcctttgcttttaatgtgggtacaaccgcatttgctcgctcaacattactcaagaagctaaacgctggtgatagagcgggtgcctgtgaagaaatgaaacgttggatatatgcaggcggaaaggtctggcgagggcttgtcagtcgtcgagaggcggagtcagcactatgtcatggaaaactttaa

SEQ ID NO: 1126 - DNA, 1848 bp, Proteus mirabilis
tttaagtgcctattgttgaaaagattttataaaactttacaaatattagtttattcctataaaactctttgtctaactcatctaatattttacgatagcaaaataataacaagggatgaggcactgaggactatggcgcaacaagcaattaaaagagcaataacgtattcggtcgtaataggtacacttctctcagggcataatgttattgcctcagaaagtgaaacgccaccgctattcacatcagaaacacctgcattagtacccgcattcacagaagacgtggcaacacaagatacattaaattcaccatcagtgagtaagcaggaagttagcactaaactacaatcttggttaccaagcgaatataaaccactttactttaagcaactcgtggatgtttatcaaagcaatgacttagcactgatttggcaagatgaacaaattacaaaacaactagagcagcaactggcagaggttgccttaactggaattcaaccacaatttggacgttggttaacgctattagaaacagcacaattaacgccagaagcacgagatattattttatctgacgcttttttaggttatatcagctttgttgaacagattaatcaatcaggaacaacactgttatatcgcgctgcgatacaagcattaccggcaccgactgtgcaagctgtcgagcatttccaactcaatctacaacaaaataccttagggcgctttgtcgtctcctttgcaccctcacacccttactatccattaatgaaagaggaagtgcgcaaacagcttcatcaagaggttatttggcccgtcatggaagggaaaaattcattaaagccaaaccaatcggcagaagaagttattgcattaagacaaatattgcgtaacttaaatttactgcctcaattggctgaaaatgagcaagaagtagcaacaacgatttatgatgagcctttaattgctgctgtaaaatcgtttcaagcggcccatggattagaaactgacggtattattggtagacagacgcgtaattggttaaatatgacaccaatacagcgtgctggaattatggcattaaatatacagcggttacgtttaaccccacctattggtgacactggaatttgggtcaatattcctgattactccctctatttttatgctaataatcaactgattttagattcaaaagtgattgttggtcgaccagatagaaaaacccccattatgagtagtgcgcttaataatgttgtggttaatccgccttggaatgtacctacgagtatgacgcgtaaagatatagttccaaaaggaaaggctgatcctagttattttagccgtaaaggttatacgatttattcagggtgggggaatgacgcttatccaatcaatccttatgatatagattgggaaaacatctctgcggctaattttccatatcgcatttggcaagcccctgggccaactaactccctaggccgatataaatttaatatgccaaactctgaagcgatttatctgcatgacacaccaaaccacaatttatttactaaaaatatgcgagcaattagttcaggttgtattcgtgtgaataaagcggcgcaattagcgacgatattattaggtgatgcaggatggaaacaagatagaattgatgcagccttaaaacgaggttcaacacaatatgcaccaattccagaacgtatccctgtctatttatattatcaaacagcttgggtagcagaagaaaatgcccctcaatatcgagcagatatttataattatgaccaaagcattaataatgcaacctcttttttagagaatattaagaaatatttgtaa

SEQ ID NO: 1127 - DNA, 684 bp, Proteus mirabilis
acggagtgcctcataatgtgggattatattgttgatattttaccaggcttaccgaccagtttatcactgacttttgttgcgctcttagtcgcctttacgttatcggtattaatgacttttattttggcattaaaagtccctgttatttcacctatcgtaaaagtctatattacattgtttactggcacacctttgttggtacaatttttcttaatctattatggaccaggacaattcccctcattaaaagaatatcctctgttgtgggaattattatccacaccttggttttgcgccatggtgacattagcattaaatagtgcggcttattcaacactccttttccacggtgcagtcagggcgatacctgctggacaatggcaatcctgccaagctttaggtatgtcaccgctacaaacagcgaatgtcatcttaccttatgctttcaaacgcgccctttcttcttattccaatgaagtggtgctgattttcaagagtacttctcttgctagcactatcactttacttgagctaaccggctatagccgacaagtctttgggcaaaattatgatgtgatggtatttgttgctgcaggcattatttatttagctatcaatggaatactgacactgttaatgagattaattgagaagaaagccttagcttttgaacatcgtgattag

SEQ ID NO: 1128 - DNA, 603 bp, Proteus mirabilis
ggaaggtacgaaatcatgattccgtctctgaattacgccgtattaacagatgccctgcgtgcgctgaaagaagacaatattcgccattgtgaatctctgggattcaccttcgacgaaatgaataccctcagtcaactatcgcttgatgagctgtttattatcagccgggcgtcggcaccctttgtttctgtctgtgtccgccatgatgttttgcattatttactgacacaagcccgccgggaataccagcggcaacaacagattaaccgggcgatccggctgggtggttcgatagctctgcttaatcagtattttggcctcacttccaacgaagtctgtcttcgccgccggttgctgggtgtcagcgtgccttatggccggacgcctgaaccggacgaagagacagattcggctatctggaagcaatggcaaaagtgccgggtggaaaatctggcctccccggaagcactgagggccatgatgcaggtcactgaaacactgctatcgcagacagaagagctgccactcaccactgtctggaagcgtattgcgcagtgtgagcgtgaaactgctgttcacaggagggcaccacatgccggatga

SEQ ID NO: 1129 - DNA, 273 bp, Proteus mirabilis
tttatgagcgatactataatgcaatcaacatggcaaactaaggagttgggtatggtaaccagaaaaggaaaatctgttacgcctgagtcttcgtttttccaaacgccacacattattcagactcgagaagatggaagtactgttagtactgtttgtagtcgtagtggaaaagaagtgacctttgttactccaaaaggaaaaaggatcagagcatcacagaatgaagtttttaatactttattgaaatctataaaatcagtaaatcattcataa

SEQ ID NO: 1130 - DNA, 234 bp, Proteus mirabilis
tttattttagatgaattttcaggaatagaaaatttatcaaatatactgtatgaaacggctattatcttactaaatagtggaactttacctgagaataaatttttattatcattggcgatatcacaaggtaattttgataccaattgtgtctttcctacaccattattaccaatcaatgcatatactctattttttaaaatagacttatcattaaagttaaaagttaaaagttaa

SEQ ID NO: 1131 - DNA, 1083 bp, Proteus mirabilis
ataataatagagtggaacacgggaatgaattaccagaatgatgatcttaaaataacacaaatcaatgaacttttaccgccagtggcattattggaaaagtttccagccactgacaatgcggcgtttacagttcgtcatgcccgtgaagctattcatcaaatccttgctggaaaagatggtcgcctattagtggtgattgggccttgctctattcatgatcctaacgcggcactggaatatgctcagcgtttaaatttattaagagaagagctgaaagataaacttgaaattgtgatgcgagtttattttgaaaaaccacgtaccacagtcggttggaaagggctgataaatgatccacatatggactgtacctttgatattaatgaaggattacgcattgctcgtcgtttgctattaaccatcaatgatagtggattaccaacggctggcgagtttttagatatgataaccccacaatatgtcgctgatttgatgagttggggagctattggtgctcgaacaacagaatctcaagtgcatagagaattatcctccggactatcttgtcctgttggttttaaaaatggcacagatggcacaattaaagtggcgattgatgccatcaatgctgcaggctctccacactgtttcttatcagtaactaaatggggtcactcagcgatagttcgtactgcagggaataaagattgccatattattttacggggcggtaaagagcctaattacagtgcagaacatgttgctgccgtaaaagaaggtctgaaaaaagcaggattaccccaaaatgttatggttgattttagccacgccaatagctgtaaacaatttaagaagcaaatggaggttggtgccgatatttgccaacaaattagcgcaggagaaaaagctttaattggtgtaatggttgaaagtcatttagaagagggcaatcaatcattagaaagtggtgaacctttggtatacggtaaaagtgtcacagatgcttgtattgggtgggatgatacagaaacgttattacgccaattagccgatgcagtcgctactcgtcgtaataaatcataa

SEQ ID NO: 1132 - DNA, 591 bp, Proteus mirabilis
aaacaatcagagaacagtattactattatgaatttactcaaccattttcttattgctatgccatcattaagcgatccgctctttcaacgctcggtcgtctatgtttgcgaacataatgaaaacggtgcaatgggtttagttattaataagccgattgaagatatctctattgaaagtgtcttagagcagttggagatattctcagcagatagagatagtgcgattagcttacaaaaaccggttatgtctggtggccctgtagcggaagagcatggttttatcttacacacccctgtttctggttttagctcaagtattaaaatcagcgatagcaccatgatcaccacgtcaaaagatgtgttagaaacattaggtacagcaagacagcctgaaaaaaccttagtctcattaggatattccagttgggaaaaaggccagctcgagagagaaattttagaaaatagttggcttaccgttgaagcaaccccacaaatcatttttgataccccaattgcagagcgttggcataaagccgccgaactaattggtatcgatatccacacaatttcaccaacggctggtcatgcataa

SEQ ID NO: 1133 - DNA, 1206 bp, Proteus mirabilis
ttaatgtcagagaatataagtcagcccccattactgagtaagggcatgaaagcagtattattatcacagtttctttctgcatttgcggataatgctttgttatttgccatactcgctcaatttaaatcagcactttatccagaatggagccagcctattttacaaatggtgtttgtgctggcttatattctcttagctccttttgttggacaagttgccgatcgccagcctaaaggtagggtgatgcttactggtaatgcgttaaaatttgccggtgcttttcttatttgtattggaaccgatccattcttaggttacgccttagtggggatcggcgccgccatttattcgcctgctaaatatggtattttaggtgagttaaccgatggcgagcgtttagtcaaagcaaatggcttaatggaagcatcaactattgcggcaattttattaggctctgtgattggtgggcttctttccgattggagcattatcttagcattagctgtctgtgcgacaatgtatgctttggctgtattggttaactttagcattcccaagttatcacctgctcaaataggtcgaggctggaatattaaaaaaatattcaatcaattcttagctgcttgtggctctttatggcgagataaagagagccgtttttctctggtaggaacaagtatgttttggggggccggcgtcacattgcgttttctattagtgcaatgggtgcctatagctttgggaatgactgataatacaacaccaacaatattaaatgcgatggtggcgattggtattgtgattggcgctggtttagccgctaagtttgtcacattaaaaacggtccgtcgttgtatgcctgccggggttttaattggcttaggtgttgtttacttctcattacaaaccaccattattccagcctattttatcttagttgttattggcatttttggtggcttctttgttgtaccattaaatgctttgctacaagataaaggaaagcatagtgtgggagcgggtaatgccattgctgtacaaaatttaggtgagaataccgcaatgttactgatgctaggtttgttctcactagtcaccagtatgggtgtttccgttattacaattggtattggctttggtgctatctttgcgctagcaattggtggattatggttatgggattgcaccagaaagagagctgaataa

SEQ ID NO: 1134 - DNA, 216 bp, Proteus mirabilis
ccacttccagaattcatccatgaaaatgaccaggcgtcgcccgtcaagcaggctggtaatgcggtacagcagataaaacgagattggcgcacatacgcttgcatcgtccaggaactccgttccgtcgatgccgaagttatcgcagttgctgatatcgaacgtgtcagactcgttatcaaacacccagccgaactcaccgccctgcgcccactgtga

SEQ ID NO: 1135 - DNA, 1062 bp, Proteus mirabilis
agcgaaacagataatctcaccagccaaatgatccgcctttatccagaacaacttaatgcgcaactccaagaggggttgcgccaaagttacctactttggggtaatgaaccgctattactccaagaatctcaagatgccattcaaacggtggcaaaatcacaaggctttacggaacattatcaatttacccttgataacagcactgattggaatgaaatatattcactctgtcagtcactgagtcttttttcacaaaagcaatctatcttactccatcttcctgaaaatggtcctaatgcggcaatgtcagaaaagctcttacgcttatctcacgaattgcatgaagatctcttgttaattttacgtggacataaattaactaaggcacaggaaaatagcgaatggtttaaaacactcagccagcaaggtatttatgtgacttgcttaacccctgagttagataaattaccaaattgggtagcgagacgcgccaagcaaaaaggccttgagcttgatgaacaaggtaatcaattactgtgttactgctatgaaggaaatttactcgctttagctcaagcaattgaacgcctctgtttgctctatcctgatggtaaattaaccctgccaagagttgaagcggctgtcaatgatgcctctcattttactgcttatcattggattgatgcattattagcaggcaaaacccaacgggcatggcatatcttgcagcaactaaaaagagaggatattgaacccgttattctacttagaacattgcaacgcgaattaatgcaattaattaccttacatcgtagcgctaaaacggcctccttaaaatccgttttcgatcaacatcggatatggcaaaaccgacgtccgatatttaccgccgcgttacaacgtttgtcagagcatcaattactcactgccatgcgattacttacccagattgaaataacccttaaacaggatcacggacaaaacgtttggcctgaacttcatgcccttggcttattattatgtggaaaagcattaccggaaggatttattcgccatggctag

SEQ ID NO: 1136 - DNA, 219 bp, Proteus mirabilis
atggccaaagaagacaacattgaaatgcaaggcactgtactggatactctgccaaacacgatgttccgtgtagaattagaaaacggacacgtcgttaccgctcatatttcaggaaaaatgcgtaaaaactatattcgtatcctgacaggcgacaaggttaccgttgagctgaccccatatgacctgagcaaaggccgtatcatcttccgtagccgttga

SEQ ID NO: 1137 - DNA, 810 bp, Proteus mirabilis
gaagcaaaagaatttaatatgaatgcctatatagataatactttaaaatttaaaaacattattttctctaaccacattcttttgttaattagaaaagattgtgaaatatccataacaaaagataatgttaaatatcaaatagataacgacagtatcgtttttataaaaaaaaattcagcattagatattatcttaggaaaaaataaaatgcctgaatttatatttttatctcatgaagttatgatggaagtattaaaaattactattaacaataaaaaagaggaagttactcaagataataataaagatagctttataaaacaagcaaatcatgaagatattctatttttcaatagattaaaaaataaatttaatgatgaagtcattacaaataacaaaacttcgcttagtcagatactaaaaatcgcatatttactgttaaactttgatatacctaaccttatattaaaatcaaaaccagaattaacatcagtaaaagtaaaagatattattattagtgacttacaacatagctggtctctaaaagagattagtagtaaattatttattagtgagtcttcattacgaaaaaaacttgaagcagaaaaaactaattttatgactttattaacaacggtaagaatggcacacgcaatgaatcttctggctacaacaaatttaacaataggacagatatcttcattgtctggatataaaaatacttcctattttattaaaaaattcaagaagtattataaaagctccccgaaaaaacttaaatgtctaaattatagggataagataatttaa

SEQ ID NO: 1138 - DNA, 1125 bp, Proteus mirabilis
atggctgaagaattacaaaatttgcgagagcaaattgatcaggtggataaaacattgctttctttactcgccaaaagaatgcaattggtagcagaagtgggagaagttaaaaatcgccacgggttacctatctatgcaccagatagagaagccgcaatgcttgcttctcgacgtaatgaagcagaaaaaatgggtatttctgctgatttaattgaagatgttttacgtcgagtaatgagagagtcatatagcaaagaaaatgataaaggctttaaaacacttaatccccaattaggcaaaattgtcattgtgggggggaacggaaaaatggggagacttttttctcgtctctttacactttctggctatcaagtggaaagtcttgaagcggatgagtggcaaagtaaatctccggctatttttgcggatgctggtatggtgataatcagtgtcccaatccatttaacggttgatgttattgagcaattaccgcccttgccagaaaattgtttattggtagatttagcctcaatcaagcaagcgcctttagaggcgatgttaaaagcacataatggccctgttttaggactacatccaatgtttggtccagatgtgccaagtttagcaaaacaagttatcgcttattgtgaagggcgagatttatcacattttgagtggttgcttgagcaacttatggtgtggggagcaagagtagaggctattactgcacaagagcacgataaaaatatgagttttatccaagcattgcgacattttactacttttgcatatgggcaacatttggtgaaagagaatgtcgatttagccagtttattaagattatcttctcccatctatcgtttagagctagcgatgattggtaggctctttgctcaagatccacaattatatgccgatattattttatcttcacaagaaaacattaacttgatccgtagatatcatcattcattaggtgaagctatagccttattagatataaacacaaaagatgaatttattggctcatttaataatgtaagtgattggttcggtgattatgcttcacaatttatgaaagagagtggtgcgttattacaaaaagccaatgatagccggatttag

SEQ ID NO: 1139 - DNA, 345 bp, Proteus mirabilis
ccaatggaagagtttaaatggcgaacacaaatacaagattcgccaagcggtgagttcaagcatcgcattaaagaagttgaatttggagatggttacaaacaagttgctggtgatggtattaatccagaatctcaaacgtggccatttgcttatatgggactaaaagatgaggtgatgcctatttttaaattcattcggcgacacacagcaaaatcatttatttggacgcctccatttggtgaaaaagggctttatcgtgttaaagctgattcaataacgatgctccccatctctgatggagtaatgaaattgacagctacgtttgaacaggcatttagcgcatga

SEQ ID NO: 1140 - DNA, 594 bp, Proteus mirabilis
ggagatagagagaaaatgaaaaacaatatttttgatccagaaaagtacactatttcaattaaaaaaattctggatgacggagaagaaatctatgtagcaagcgttgctgagctaccagatattcaagaatatgcagactctgcggattttgctagagatatggctcttgactccataactactgcatatgaaatgtttaaagaaaatggaatggcattcccattaccaatcgacacaactgaaactgataacgtaagtggtagagtgacgcttaggttaccaaaatcactacatgcaaagtgcattaaagcagcagagagtgatggcgttagtttaaatacctatctaacaacatgcgtagttcattattctgctcaaaatgaaatgatgaataatataaatacgcagttcactgaagtgaagcattggattaaagcacaatctaaaccaaactttcatacatatagaaatgctaataaaactggtagctactggtcttcttcgtggaactctaagcttgtcagtgatggtgatttatctgaaagagatagtgagattgaattatccactaagtattcggagtgttttcaatga

SEQ ID NO: 1141 - DNA, 534 bp, Proteus mirabilis
cacagcggagagagtgcatttatggaaagtacaatttaccttataggacctagaggtgcaggaaaaacaacagtaggtaaagcgctttctctatctttagattatcaatttattgatacagataattggataacagataaatatcaacaaactatttcttctatggttgaagcggaaggttgggatgtctttcgccaacttgaatcagatgcgcttattcaagttagccaacctaaccaagttatttcaacggggggagggatagtgttggcagaaaaaaatcgtgtttatatgaaaaattcaggtgtaattgtttatttacaagcttcacttgaaactttagttgagcgtttatctcaagatcctaatgaggcacaaagacctagcttgacgggaaaaacattagtttcagaaatacacgatgttttaattaagcgtgagcctttatatatgcaatgcgcagatattattgttgatgctggattatctattaatgatattattgaggtcattctcgcaaaactcgctaaataa

SEQ ID NO: 1142 - DNA, 825 bp, Proteus mirabilis
attagtatggaacatcgcaatatcgcttttattggtgccggaaatatggcacacgctattattgcaggactggttaatggtggttatcccgcaaaaaatattacggtaagttcaccttctgaggttcgacgtgagcctttagaaaaagagtttgccatacagagtacttgcgacaacatcaatgcagttgaaaatgccgatgtcatcgtattagccgtcaaaccgcaaatgatggctgaagtttgtaagccattacaacatatcgattttagtcaaaaattagtactaaccattgccgcgggtattccagcttctcgttataatgattatttagccacttcgctacgactgatccgcatcatgccaaataccccagcactggttggcaaagggttaagcggtatgtttgctcaaaacactattacccctgaagataaacaatttgctgatgcgttaatgaaaagtgtcggtatgacggtttgggtagagcaagaatcagctatcaatgatattatcgccgttgcgggtagtgcgcctgcttatttcttcttgtttatggaatctatgcaacaagaagccgagcgcttaggtttttcagccgacgtagcaagagctattgtacaacaagcagccagtggctctactgcattagctgaaaaacaaaatagcttacctttttcaacattacgtgaacaagtaacgtcaaaaggtggcacaacagctgcagcattggcacaattctatgcaggtaaattacctgagaatgttgctttagcgatgcaagcggcgattaaacgagcgcaagaaatggaaaaacagttttaa

SEQ ID NO: 1143 - DNA, 1044 bp, Proteus mirabilis
aatatgatggatgcacagcagttctcgcaagtcgtactcgactggtatcacaaatacgggcgcaaaacattaccttggcaacaagaaaaaacgccttatcacgtttggttatctgaggtgatgttacaacaaacgcaagttgccacggtgatcccttattttgagcgttttattgcgcgttttccgaatgttagcgcattagcgaaagcgccacttgatgaggtgctacatttatggacgggtttaggttattacgcccgcgccagaaacttacataaggcggcacaacacattgtagataagcatcaaggacagtttcctgatacctttgaggacgtttgtgctttaccgggtgtgggacgctctacagcaggggctattttatcgctatcactaaaaaagccttaccctattcttgatggcaatgtaaaacgtgttttagcgcgttgttatgctgtagaaggttggccgggtaaaaaagaagttgaaaataaattatgggaaatcagtgaacaagtcaccccaaccaaaggggttgaatattttaatcaagcaatgatggatttaggggcaatggtttgtacgcgaacaaaaccaaaatgcgaactttgccctttaaatacaggttgtattgcttatgctcaccatagttgggcggattatccggggaaaaaacctaaaaaggctattccggaaaaaacaacttattttcttattttacaatatgataatctggtctggttagataaaagaccaccagcaggaatatggggaggactgttcgcctttcctcagtttgaaacaaaaatgcttttagaacagtggctagctgaacatggtcttgaaaatagcaaaactgagcaattaatttcatttagacatacttttagccattttcatttagatatagtaccaatttgcgtaaaactctccacgtttacctctctgatggaggcgcaacaaggactttggtataacttacaaaccccggcaagcgtagggcttgcggcacctgtagagaatttacttagacaattagcctaa

SEQ ID NO: 1144 - DNA, 585 bp, Proteus mirabilis
gatgcgatggagttgctgatgcctgagttaacaatacgagagtgtggtgaggaggcaattagattaactaatgagttatttcaacagtctgagcaatcttttatggcatatttattaaatgaatcagacttagcatggtgtattgcaagtactagaaattttccgccagagaggcaacttccttgggatcacgcaggacaaacatttcaaaatgataatggatttagcttttgttttaagtttttagatatgcaaaataggcctgctggagcctgcatttgtgaatattgctctgataatgtattgaatattgaaatgattcagaactttcaaattaaaccatctattcttgatggaaatacgcttaagtttatgctttataccatagtgttttttctgttactgacacaagggacgggtgtacggctcatgtttcctataaatgaaaatgttgcaacatactatgttgaaaaacatggttttcaggatttaactggtgatggttcaaaagaaatactttaccgctcagcagaagatttattaaattggtttgagcaaaataaccgctcagttgatagtgagtga

SEQ ID NO: 1145 - DNA, 669 bp, Proteus mirabilis
agaaatacggagtataaaatgaacgtattgaaaatctttttctgcacattactccctttactcttcacttcaccgggaaaggccgaaaataatcttaatcagaaaatgattgaggaattaactcaatgccgtttggaatcatctcagctaattcgtttagattgttatgacaaaattgcgctttcttcaacatcttcctccaatgcactgcctgatgttactcaaatgggtaaaacatggcgccaagcaacagagcatgaaatgaaacgaacgggaaacagtgcaggttttctcgtctcagtaccagaaaccggtgattatcccgtattaatgaccattccagcgattggctttcaaccgcctcgccccatcttaatgctgagctgtattgataacattactcggatgcaaattatcctgccaacaaaacaagatgctggcagtgtgatggtttcaacggataaaacacaatttactgcagaatggtttttacgtgaaaacggttatgtattggaatcaagccgcggtataccgggcatagatgaaattaaacgcttgttaaatgctgaaagattgacattgaaattatctaataacgaaaaactcaccttcaatatttccggtatttcacaacaaataatccctttaagagcggcttgccactggtag

SEQ ID NO: 1146 - DNA, 300 bp, Proteus mirabilis
tcatcaacggacactcctctgggggtgactatgcgtatggaaaaattaaccaatgtaacttatggaacagcaggcctaacggccttttttgccagtctttcgttatatgaatggggatttgttatcgggatggcgttcagcatggttctcggtttagccacttactttatgactcgtcgagaacaacgaaaacgcactcaattatttgaaaagcttgttcgtcatgttgacccacaaaacccgaccgaaaccttaaaaaagcttgctgaattaatggtgaaagcgccaaaggatatttaa

SEQ ID NO: 1147 - DNA, 1176 bp, Proteus mirabilis
gtaacacaggagtccactatgtttgattatgaagtattgcggtttgtttggtggctactgattggtatcttactgatcggctttgcggtcaccgatggttttgatatgggtgttggtgtgttattgcgcgtcattgcaaaagatgacacagaacgccgtattttaattaactctgttgcacctcactgggatggtaaccaagtttggttaatcactgccggtggtgcattattcgctgcatggccaatggtatatgctgcggcattttctggtttctattttggtatgatcttcgtactggcggcattattcttccgtccagtaggttttgactaccgttctaaattagaatcaccaaaatggcgtggtatgtgggattggggtatctttattggtagctttgttccaccattagttatcggtgttgcttttggtaacctgttacaaggtgttccattagaagtcgatagcatgcaacgtgtatcttataatggtacaactaacgcactaattaacctgttaagcctattaaacccatatggtctattagctggtgttattagcttaatgatgattgtggcacagggtgctagctatcttcaaatgcgtactaccggtgagctgcatgagcgtactcgtaaagcaacttacattacctctttaatcacttttattgcttttgcattagcaggcgtgtggttaatctacggtattgatggctttattatcactagtgcggttgatactgcgggtccttcttctccgttgttgaaaacagtttctcacgaagctggcgcttggatgacgaactacaacaactatcctattttatggatcttaccggcattaggtctgttaagtcctttattagcggttgttgcaactaaagcaaacaaaggagcttgggcattcctgttcacttcactgactattgcttgtgttatcctaacgtttggtgtaaccctgttcccattcattatgccatcaagcacattccctgatgtaagcttgacaatttgggatgcaacttcaagcctgttcactttacaagtgatgacagtagtcgcgattatctttgtacctatcgttctcctctacactatctggtgttactggaaaatgcatggtcgcctcgataagaaatttatcgaaggcaataatcatactctttactaa

SEQ ID NO: 1148 - DNA, 261 bp, Proteus mirabilis
caatataaggagtaccatgtttatgttgttcatcagggtattcatgattgtgatcatgatgatgatggccgattaaaggaggtcgaattggggcgtgatggtggtgatcatcttcatgatcatgaaaatgcgtatgaccaggcagcccatatcgacgatgttgttcaccatagccaatccctatataaccgtcatcgaagagccaggatacaccaatatttgccgattggttatcttgataagatcctgctaaacggctag

SEQ ID NO: 1149 - DNA, 207 bp, Proteus mirabilis
attttcaaggagcaaagaatgcttattctaactcgtcgagttggtgaaacgcttatgataggcgatgatgtaaccgtaaccgttttaggggttaaaggtaatcaggtacgtattggcgtaaatgcccccaaagaagtatctgtccatcgtgaagagatctatcaacgaattcaggccgagaaaactcagcccacagataactactaa

SEQ ID NO: 1150 - DNA, 1275 bp, Proteus mirabilis
tttcgaaaggaatgttgttacaagcactggataaggagacaccaaatgagtaagacaaataaccaagccaatccttgggaaacggacactcaagaagcggcaacagaaaacgccaatacaacacaaaattcagcgcaagaaacgcataacaacacagatacagacaatgatccttgggcaaccacggatagcaacactactgataccgccccttggagtagtagcgctggcggtgataccggtggagctgatgctgatccttggggtacagggagtggcactgacggcagtgatctctcttctggtactgattggctagatgccatgccaacagaaagtacacctgatcactttaatattatggatccatttaatcatacgctgatcccactagattcttgggtaacggatggtattgactggattgtgctgcattttcgtcctattttccaagggatacgcgttccagtcgatttagtattaggtggctttgaaaactttcttacctcaatgcctgcacctgttgcgattattttattttcactgattgcatggcaactttcaggtaaggtgatgggaataagcgcttttatttcactgatcttaatcggtgctattggtgcatggtctgaagcgatgataacccttgcattagtgctgacctcattactattctgcctgattattggtctccccttagggatatggcttgcacatagtgacagagcatcaaaaattgtcagaccacttttagatgccatgcaaacaacccccgctttcgtttacttagtacctatcgtgatgttattcgggattggtaacgtacccggtgtagttgtcacgattattttcgccttaccaccgatagtgcgattaactattttaggtatcaaacaagtaccggaagatctcattgaagcggctcaatcatttggggcaaatcctcgacaaatgttgtttaaagtacaattaccgctggcaatgccaacgattatggcaggggtaaaccaaaccttaatgttagcactgtcaatggttgttatcgcatcaatgatagccgttggtggtttaggtcaaatggtattacgtggtattggtcgcctagatatgggattagcggctgtaggtggtgccggtattgtgatcctcgcgattattcttgaccgcttaactcaatctttaggccaaaatagtcgcctgaaaggtaatagacgctggtatatgacaggcccgattggtttgatctgccgcctgtttggtaaaaaagccgcataa

SEQ ID NO: 1151 - DNA, 267 bp, Proteus mirabilis
cggtcgagggaaatattcttagcggtcatttttcaacctcagtgtatagatgttggaaaaatcaatatcctcgcctgtgatcaggttgatgatctcgccctgattcttatagagcgttgggggaatattgatgctgttctccagcgtagtacgcgccatatctgccatagcctggcggctgttttccgtatagtccgtattgcggtcttttttacccgcactgttggatgcccatgcgccaatatcggggatcatgccgaccattaa

SEQ ID NO: 1152 - DNA, 741 bp, Proteus mirabilis
acctttggggatcatggtaatattcattcctttatttatgattgtggtctttctgttatgcatgacaatgcggtttctcgacttcgtcaatatcgagtttctatctctacacgcccatataaagccagaggctttcgtgttaaacgatgcactttttgtttattacctgaaaaacagtgtctgtgtgacaccatcattcatcaaaccgcgaaaagtcgtttttgtttaatgatgtacgatacagaagtgatgaaaccaagtaatacaggaaaattaattgccgatgttttacccgatacacttgcctttttatggtcacgtaccgagcctgaaaaagccttacttgatgcaattaatgatccgcatcgacaagcttatgtcgtcttcccagacagctatgcttctccttcgcgaaaagtttatcaccagttacctgcaaacagtaagccaccgctatttatcttactagacggcacttggacagaggcgagaaaaatgtttcgtaaaagcccctaccttgatgcattaccactgttttcaattaatgaagccagtaaatgtgactacatgctccgtcaagcagcaagagaagagcaacattgtaccgctgaagttgccgcttctattttagccaatgtcggcgatgatttagcgtcacaacagcttttttctcattttagttactttcgtcaacaatatttaattggaaaaccagacagacgtcaggcaaaagaagagtaa

SEQ ID NO: 1153 - DNA, 1200 bp, Proteus mirabilis
tttcttggtttgaggcgaagaaaacagagaaaggagaccatactcatggagaagcatgatgatgatatgcctaaagataaaatacaacaagccaaacgttggcgcttgattttaggccaatacgctgatgatgctttagggcaagccacgtttaatgctgatgatcttaaaattgaacgtacactcgattttctttatcgccgtgaatatcagcgccgaggattacgccaagagcgcggtcgccatggctctctcgatgcatcgcaacttactgccgtaaactggctaaatcaagctcgcaaactttttcccaatagcacatttgaacgtatgcaatcacaagcgattgaacgttatcaaatcagtagctttcttaaagatcccaatacgctaaaagccatggagccgactaaagcgttagctaaaacactattaagcttacgcggacgaatgagcgaagaaacgcgagatgcagtaaaaaccattattcgtaaagtggttgaagatattttgcgtcaaattcgtaataactttcgccaatcattaaccggtcgtcgtaatcgctttagacgctcgttagtaccaaatagtcgtaactttgattggcgtgccactattgccgccaatttaaaacattacgatacccaaaatcgtcgtttattgattgaaactccttactttaattcacgaatgcaacagcattttccatgggatgtcattctctgtgttgaccaaagtgcatcaatgtctagttccattatgtatgcagctgtgtgtgcgagtattttagcttcattacctgctgttaatgtctccttaatcgtgtttgatactcaagttgtcgatttatcacacttagccgacgatcccgttgaagtgttaatgacagtccaattgggaggaggtacggatattgctagtgccatgcaatattgcgaaagcttagttaacaaccctaagcgtactgttatttcgcttatcagtgactttgaagaagggggatcattaacccgattattagattgcacacaacgtctcaatagccaacaagttaaattattaggactggcagcactagatgatgaggctcaaccggtttatgactcaactatcgcacaaaaactcgccgatagaggtatgcaagttgcagctttaaccccagaacatttcgcacagtggctagcagaggtaatgcaatga

SEQ ID NO: 1154 - DNA, 204 bp, Proteus mirabilis
tttaactcactgacgaacaaaagaaatatggtgcccggactcgggatcattcagctatctattaagttgaaagttagaataaattttatgcatacctcttgtcaagacccttgtcttgacccgtatacttattgcattctaattaaaaaagtgcatacaaattgctctgctttctcaccgtatacattgaatgtttctttgtaa

SEQ ID NO: 1155 - DNA, 528 bp, Proteus mirabilis
gtggagtcacttacaaaaagccttgaatcaaaataccgcaataaaaggtataacaggaaaaggttgttaattatgataaatttatcaatggatataatagatataattaataaaggatcaatattcaattctatcacttctaatgatgaaagaatacgcttgctatcatattcacatgaagagtttttcagaaacgctaagatttatactattaatattaatggtttttatattgaaatctgtattgctaaactatctaatagaagttatgaaagtatttgtttgaatcaagatgtaaatgtttcagatgttgatataaatatatcagataagtttagaataatgacgcaaacaaaagaacaactattaaaacaaaaaaatataccattacccgattattctatatttatagattctaaaatagaacaagtagaattacattatcataatgggtgtaagcttatttatgaaaacaaacactcatttccatcagttttgattaatcctttatttataatgagtaactaa

SEQ ID NO: 1156 - DNA, 318 bp, Proteus mirabilis
tgcaggtcactgaaacactgctatcgcagacagaagagctgccactcaccactgtctggaagcgtattgcgcagtgtgagcgtgaaactgctgttcacaggagggcaccacatgccggatgaaatcgatcgcgaccaggaatttaatgagcaacaactggaagagatgattgaacaaagccgtttcaggccgggtgaaacatcctcgctgttccactgtcgtttctgcggcaaccccattccggaaaaacgacggcagacattgccgggtatcacaacctgtacggagtgccaggaaaaaattgaacgcagacgttaa

SEQ ID NO: 1157 - DNA, 4761 bp, Proteus mirabilis
  unsure (4726): Identity of nucleotide at the above locations are unknown.
ccatacccactgacgatttattgtttattttataaggatagagatatgggaaatgaatttttcgcagccaagcaaggcgataaattaatgcactcgtcaatcttcgccgatatcgtgtgtggtgtggttaaaggggcggtttatgccgcgatagggacggccgctgtggcgctgaccattgggacaggcggtatggcaacggccgccggtgcggccatttttgccggtgcagggctggcggcgggctttactattggtggattgattgatgatgccgctgattgggtcgcggatgggatcgatagcttattcgggctaagtaaccctgatggtgaaatcgatacaggctcgaaaaatgtacgtgtcaaaggcaagggagccgctcgcgcagcgggaaaattaccgtcacccgtactattagcctcaattgcggcagataataccccaccgaaagaagaaaaaggcaccgagattgccttacgcgtattgaaaaataccgccatgatgacgactggggcattttctttattggcgggtaaggtgctagggagccaaaccaacaatgcggcacccatagcgctcgatccctccgagtttcccgaatacccttctccagagcaaggcttttttgacagtattctttccccagtaaaagctgcgaaacacccgaatgctgaacctatgcctttggataccatcacgtgcgataaatggcattgtgctagcgccccttactttttagccgaagggtcgaaaaaagtccaaattaatagccaaccggcgtgtcgtaacggtgatagaagcacttgtgaagccaaaatcagtgatacgcaagaaaaagggattgtgcgtattggcggtggcagtgtggtagtacgcgatattatgagtgggcgtaacccctttgccgaaatgtttggtgaaatcctcggtggccttgctgttggcgcggcgtctaccctgtttcgcagagggggactcaaggcgattaaacagtgtttgaatagtgtaggctgtactttggtgagtgaaatcgccagtaccgcagtgggcagtatggtagtcgcctcggtgacccaagcctttaatagtgtgcgtcaccccgtgcatgcggctacgggggcgaaagtcctaaatggagaggatgacaccgattttattattgatggtgtgtacccgttagtctggtcgcgtatttaccaaagtcgtaatacgggtgaaaatcgtttaggacgcggttgggcgatgccatttgatgtctttttgacaattgacgacacgggtaaagggcttgagaatgaaaatatttattatcatgacatgtcggggaggcgtttagcgttaggaaaaatcgcccttggtcagaaagtgttctatcaagatgaaggctttaccgtctatcgcacgacaaacaatcttttccttgttgaatcggcggaaggtgattatcaacttttcgaagccaatccacataaaatcaatacactgcgtttaatgaaaagtgctgatcgtcataataacgctttacactaccgctatgctaatgacggtgaattggtacaaattcatgatgatgcgtatctgaccgatatccggttacattatgatgaaatcacccaacgcttacagtcggtgacccgccaccaaggacaagaagaaaaaacgctggtcacttatacttatgatgcacaacagcgtttagtgcaagtcactaatgcggataagcgagtgactcgtcgttttggctgggatgatgaatcgggtttaatggccatgcaccaatatgccacaggggtcagtagtcattatcgttggcaacgttttgatgcctttaccattgaagacaatgaacctgaatggcgagtggttgagcactggcttaaagacggtaaacgctgtttagagcataccgaactgacgtatgatttagctcaacgaaccctcaccaccgtggaaacggggggcgaaaccaccttccgtcgctggaatgaacaacagcaaattatcgaatacactaatgcattgaatgaaacgtggtggtttgaatgggataccagccgcttattaaagaaagcaatagccccagatggcagtgaatgggggtatacctatgatgagcgcggtaatttaacccaatggaccgatccggaacaacaatcgacttgctatgattgggacaaagattttgcgtttcccacggcacaaaccttgccaaatggggcggcttggcattgggagtacaatgagcacggcgatattcgtcgtgtgattgacccgcttggccatatcacgcgcttggcgtgggatgaccaaggcctgtgtctggggcaagtggatgctaagggtaatgaaacccactatcgctataatgcccgcggtcagttaatcgagcaacgggactgttcgggttatcccaccaccttgacctacgatgattggggacaacttcgctcgttgaccaatgcacagaatgaaaccacgacttacacctttagtgaagcggggttgttgttaacagagtgcttaccggatgggacagaaaaccgttatgactatgatgccaccgggcaattagtgggaataacggatgccggagagcgccatattctgttgcgccgtaaccgtcgtgggcaagtgatagcccgacgcgatccggcagggcattggttgcattttcactatgatactttcgggcgtatgcaggcgctggagaatgaacagggcgagcagtaccgctttgagtatgatgccttgcatcgtttaaccgatgaacatgatcttatcggacaacaaaagcactatcagtacgatgtgatggggaatgtcacccaaataaaaaccaccccggggccttccattgatacgccgatacccttatccccgcaggtgaccaccttcggttacgataaagtgggacggttgctgtttcgagaaaacgccgattatcgcacggaatacctttatcaacctttgagtgtgacgttacgccgagtccccatggcggtatggcatgaagccgaacgcaccggcaccaccgcccgcgtagagtatcaagacgccctgacctttacctacgataaagtggggcagttggttcgagaagccagtgctcgcggtgattatcagcatcactatgatgtgctgggtaatatcactcgcaccgagttgccccatcaaagggcatttgaatacctgtattacggctctgggcatttacaacaaacgcaatggcgagataatgagcaactgacggtattggcggaatatcaacgagaccgtttacaccgagaaacgttgcgcaccagtggcgccttagacaatgaaacgggctatgactgtcggggacgtattacgcaccaagtggcgcgccaaatgaatgcctcacagtttgtgaccccggtgatagaccgtcgttatcgttgggataaacgcaatcaacttatcgagcgcagtgtcagttatggtcaaacgggcgaggtttttaccgccggacattggtactaccacagttatcagtacgacccgctggggcaattgacggcgcatttagggtcggtgcaaaccgaacactttctgtatgatgcagcagccaatttactgactcgtccgcacaccgaagcaccgcataaccaagtacaaggcagtgataaatttgattatcgctacgacggttttggtcgcatggtatcgcgctatgaaaaaggcagtagctcggggcaacgttatcactatgacagtgaccaccgcattatcgcggtggatatcgaccaagggcccttagggtatcagcgagcggaataccgctacgatatcttagggcgccggattgaaaaacggttatggaaagccagtgcgattgccaatacggtgacctatcatcaacatgagccggatgaagtgtacacttttggctgggtagggatgcgactggtgtctgagcacagcagcgcagcgccccataccacggtttatcatgcttacaatgaccaaagttatacgcctcttgctcgcattgaatgcacggataacccgcttaatccgcaacgggcgatttattatacgcacagcagtttaagtggcttaccggaagcgctgaccaacagtgagggtgaaatagtctggcaagggcaatacagtgcttgggggcatttacagcgtcaaacccgccccacaagcacgtttaatcgtgaacagaacctgcgttttcaagggcagtatttcgacaaagagacgggcctgcattataatacgttcaggtactatgccccagatttaggccgttttacccaacaagacccaatagggttggcaggggggataaacttatatgcttatgcgccaaatccattgacatgggtggatccgtggggttggagttgtggttcagatgcaaagattttaagagaaaatatgattgagcgaggcatcattacacctaactataaaaattcggctcatcatataattatgtctaatgctaaagatgtacgcatgcgttggttaagacgtaaaatgaatcgtttggggattgatataaatgatgctataaatggagtctacttaccaacatcttctaaaataaaaattgatgtaggtacatccactatagctcattcaaaaatacatactgcattatataaacagaatgtatttgatagacttaaaaatataaaagatgcaacggagtttagacaggagttgaataaaattgcagaagaaatattanatggtacatttagctattattttttctataaataa

SEQ ID NO: 1158 - DNA, 1011 bp, Proteus mirabilis
gggatgggtttgaaagaagatactataaccatcaattcggaagatgatgttttcagattggttgcgcagtacgctgaaggtcatgagattccagaaaacgtaacatttgaaggctggccaaacttaacctttagacttacgggtaataagttcaataaaagtattacaccatccgtaatgaaaggttttattgacatgcaggcgcatatcaataaagcatacgccgctttcaaatatggtgatcaaaacaagcgtttatcgaaaaaagagttagaatcgatagagttggttataactattgatgaaggctcatccataattgagataaacattggtggttttttagaatcacttaaaaaatcggtaattaagaaaatgacaggaaaacagatagcaataacagtgataagcgctgcatttatctggggagcgtcttcttcttataagtattacctagataccatgcgagaaataaaacttgctgaaataagcaaagaaggcgaaaagcagacgctagagtcgattaggtttatgtctgagcaagagactaaacgaatggaacttgttacaggtgttatcgagtccatacctcaacttaagcagcaaaatgaaatagccactgagtctaaaggtaatttattaaagaacttgaataaagctgacactatcgagttcgatggtgttgttttggatgctgagttaactaaagagctaacttctacaaaacgtaaaacttacgccgaaagaagaattgatggcatatataaggttgttaaggttgagccaggcgatcctgcgccattcaaggttacagtgaaaaatgtaaccactggtgagctagttagttgtgtagttcaggatgtgtttttagatgaaaaagaaaataaagagattattcagcaaggtgagtgggacagggagccaatcaaactaaccataaacgctaaagtactgggcgatgaaattaagtcagcaatcattattaaagccgaaaaactcccccaagaataa

SEQ ID NO: 1159 - DNA, 294 bp, Proteus mirabilis
atgtataaactttctaaattagcagaagaagatatttaccaaattgctcgttatactattcaacaatttggagtaactcaggcaaaaaaatatcataatgatttaaaacagacatttgagctactagctaaagcaccttggattggacgagaatgtaattgggtgtgtaatggtatgagacgatttgagtttaaaaaacattcaatttattatctaccaaaaaatgataccttatttattactcgtcttattcatcattcaatagatgttgattttgttgattttcctaaataa

SEQ ID NO: 1160 - DNA, 720 bp, Proteus mirabilis
attatgaaacttgaattttcaatttatcgttataatcccgacgttgataatgcgccgcgtatgcaagattacacgcttgaagtacccgaagggcgtgacatgatgttgctagatgcattaattcaattaaaggaaaaagatcctacattatcattccgtcgttcttgccgtgaaggtgtatgtggctccgatggagtgaacatgaatggtaaaaatggtttggcatgtatcacacctatttcatctttacagaaaggaagtaagaaaattgtgatcagaccgttaccaggtctaccggttattcgtgatttaatagtggatatgactcaattctatacgcagtacgagaagatccgtccatatgtgattaacgacgacaaaaatcctccggctcgtgagaatctacagtcaccagaacaacgtgaaaaacttgacggactttatgagtgtattctttgtgcttgttgttcaacatcttgcccgtcattctggtggaatccagataagtttatcggacctgctggactgttagcagcgtatcgtttcttgattgatagtcgtgatactgaaacagaatctcgtcttgatgatttaagtgatgcgtttagtgtattccgttgtcacggtattatgaactgtgtcagcgtatgtccaaaagggttaaatccgactaaagcaattggtcatattaaatcaatgttgctaaaacatagtgcataa

SEQ ID NO: 1161 - DNA, 555 bp, Proteus mirabilis
ttatcgaaactaacaaggtgtctaaaaatggaaagctcatttacgccaacagaagaactactaaacactcgcgctacacaacagaaatcgcttaacaaagatattccttaccaagaaattttgttaactcgcctgtctatgcacgtccagagcaaacttcttgaaagtcgtaataatatgttaaagtctcagggcattaacgagacattatttatggcacttatgattttagatacaacggaaaatcgtagtattcaaccatcagaattgagtgcggcgttaggctcatcaagaacaaatgccactcgtattgcagatgaattagaaaaacaaggatggattgagcgtcgtgaaagtcataatgaccgtcgctgtctacatcttcatttaactgatgctggagaagagtttttaaatagcttattaccaccacagcacgaatgtttaaagaaaatttggtcggtattagatgaaggtgaacaaaaacagctagaaaccctaatgcgtaaattattattacaacttgatacattagcggataatcagcaggaataa

SEQ ID NO: 1162 - DNA, 2748 bp, Proteus mirabilis
tactttacttggctaggacgcattatgatccaaattgatctctctactctcgttaatcgattacacccaatagctaagcatgccttagaaagtgcagccgcttactgtgtaagccaccagcaacctgaaattacgattgctcagtttctacaaaaactgatagaaacgccattaactgacattcgtatgatcagtcaaaaaagcgcattagatattaatgcgttatcagagttattagatatcgacattccgccacatcaagttattacacaaagttatcctagtttttcacccttattagtcgaatggatgaaagatagctggctattagcgtcaactgagctaaatcacagtgaacttcgctctggtgcattgtttttaactttactacaaatgcctttgcgttatcttgcgaaacctgttgccgatatgcttgcgcagattaaccgcgaccaattaaaactcaattttgatcaatggactgaaggctctgctgaatcgccttttaacgaaaaaacagtatcagaaaaaggtaaccttgccgctgattcattgttagcgaaatttactcataacatgactgaacaagcgcgaaatggtgagttagatccggtcttatgtcgcgataatgaaatcgacttaatgattgatattctgtgccgtcgccgtaaaaacaatcctgtagtagtcggagagcccggtgtgggtaaaagtgcgttaattgaaggactagcactacgtattattgccggagatattcctgataaattaagaggttgtgaacttcttactcttgatttaggcgcattacaagcaggtgctgcagtcaaaggcgaatttgaaaaacgctttaaaggcattatgcaagaagtcactcaatctcctcaccctatcattctatttattgatgaagcacacaccctcattggtgcaggtaaccagcaaggtggcttagatgtttctaatttattaaaaccggctttggcgcgtggagaactacgaactatcgcagcaacgacttggagcgaatacaaaaaatattttgaaaaagatgccgcgttagcgcgccgtttccaattagtgcaagtcaaagagccatcatctgcagaagccattatcattatgcgtggcttacgtagtatctatgaaaaatcccaccatgtctttattgatgatgaagcactacgagccagtgctgaattaagtgaacgttatatctctggacgtcaattaccagacaaagccattgatgtattagatacagcctgtgcaagagccgcgattaatctatcttcgccaccaaaggcattatcctctttgaaaacagaactccaccaaatcaatatggaaatggatgtattacaaagagaacactatttaggtttagatgatcattctgagcgtcttgaaacgttagcctcacaagcaagtgctattgagcaacaagcaactgatttacagcaagcatgggagcaacaaaaagagcttgtatctcaaattattaccttacgagcaacattacttaataatgctaccgaagcgactaatgacgatgtcgcaaatgatgttgcaaataatgaagtggtaagtgatataagaacttatagtgaagcagaagatgctgaagataatgctgaagataatgatgaaaaaatagcgacacagcccccctgctcatctgaagaattaaagcaacagttacaacaattagataaacaacttgctcagctacacgacacgcatttactggtttcacctcacgtcgataaaaaacaaattgcggcggtaattgctgaatggacaggcgtaccattaaatcgattatcacaagatgcattatcaattgtcactgagttaccgacctacttggaagagagtatcaaaggccaatcattagccattcaatgtttacacaaacatttacttacagcgcgggctgatttacgtcgaccgggtcgaccgctgggggcattcttattagcaggtcctagtggcgtgggtaaaacagaaacggttatccaaattgcccaattaatgttcggtggcacacaatatctcacgactattaatatgtctgagtttcaagaaaaacatactgtttctcgccttattggttcacctcccggttatgtgggatatggtgaaggagggatcttaacagaagctattcgtaaaagaccttactcagttgttttactcgacgaagtagagaaagcgcatcctgatgtgctaaatctattttatcaagcttttgataaaggagagatagccgatggagaaggacgagtcattgattgtaaaaatatcgcatttttcctcacctctaatttaggtgaccatgtcattactgcttacgcggataaaccggacgaactagaagatgcactctaccctgaactaacaactttctttaaaccggcattacttgctcgaatggaagtgatcccttatttaccgttgcctgcagaggttttacgacaaattgttgatggcaaattagctcgtcttattaacctattaaaacagcgtttcaacgcagaaatcaatgtagaagagagtgttgctacggaaattttacgcagagcttctcgtgctgaaaatggtgcgcgtattttggaatctattattgatggtgcgttattgccgcctctttctttattacttctacaatatagtgcacgtaatgaagctatctctcatattcgcttagcgactgaaaatgatgagtttattgcggaggttaattaa

SEQ ID NO: 1163 - DNA, 204 bp, Proteus mirabilis
gagacagaactgacatcttgcgcatccatctggtcacgtgtaatgacactgattgattgtggtgtcttatctatatcactaagtattttatttgttgatagtgtttttgttgccactaaacctgaaattggtccttgcggatcttgtgagggggatgcggtaacaatgattttatcaggtgaattttgtgtcattgcggcatga

SEQ ID NO: 1164 - DNA, 1062 bp, Proteus mirabilis
agagcctattgtatgataatttctaaacagcagttacaccaattaatcaaaaataagttacataatgcaggactgaatgaaaaccatgcagacattgttgccgatgtattagttcatgctgatatgaaaggaattcattcccatggtgctgtacgtgtggaatattatgctgagcgcattagtaagggaggaacaaatacgcatcctaagtttacttatcaagagacaggaccttgtagtgcgatttttgatggtgataatggtgctggacatgttgctgctaagcaggccatggagcacgcgattaatatggcacaagagaaaggcattgctgttgttggggttagacgtattggtcatagtggggcgttatcctactttgtagaacaagcctctgcatctggaatgattggtatttcactttgccaatcggatcctatggtagtgccatttggtggatctgaagtttattatggcactaatcctatcgctttttcagccccgagtgcagatgataaacctattacctttgatatggcgacgacggtgcaggcatggggtaaaattctcgatgcgcgggctaaacatagtgacattcctgacacatgggcggtagatgaagcgggcaaaccaacctgtgatccctttgcagtaaaaggtttattacctattgcgggaccaaaagggtatggcttgatgatgatggttgatgtattgtctggcattttattaggattaccttttggtaaacatgttagctctatgtatcatgatttgacacaaggtcgtgaattaggtcagctccacattgtgattaatccagcctttttcactgatgctgatttatttaaaaaacacatttctcaagtaatggctgagttaaagagtattaagcctgcaatcggttttgaacgggtattatatcctggggaaaatagtcagcttgcagcgcaacgaagcgaaaaagaggggatagaaatcgttgacgaaatttatcattacttaaattctgatgtattatttaatcaatcttatgataataaaaacccatttgccagctaa

SEQ ID NO: 1165 - DNA, 1398 bp, Proteus mirabilis
cgatttaattgtattattttttatttctattccgatgcgttttttaaggggttaatgatggattttataatacaactcgccattatattagtttgtttattttatggagcaaggaaagggggaattgcattaggtctattaggcggagtggggctggttattttagtctttatttttaatttacctccgggtaaaccgcctgtcgatgtgatgttagtgattattgctgtcgtctctgcatctgcaacgttacaagcatcgggtggtttagatgttatgttgcaaatagctgaaaaattattaagaaaaaatccgaagtatatttctattgttgcacctctcgttacctgtaccctgactatattatgtggtactggacatgtggtttataccattttgcctattatctatgatgtatcgattaaaaataatattcgtccagaaagaccgatggcagccagtaccattggttcacaaatgggaattatcgcaagtcccgtatctgttgcggtcgtcaccttagtggcaatgttaggtaatgtcacttttaatggtaagcatcttgaatttttagatttattagcgattaccattccatcaacctttattggtattttagccattgggatttttagctggtttagaggtaaagagttagataaagatcagcgcttccaagattttatttccataccagagaatcatgattacgtttatggtgatactgcaacattgttagataaaaaattaccaatgaaaaattgggtagcaatgtggatattcttaggtgcgattgcggttgttgctgtattaggtgcattttctgaattacgtcccgtatttaataataaaccattatctatggtattagttattcaaatgtttatgttattagcgggcgcttctattattattatttgtaaaactaatccctcacttatttctaaaaatgaagtttttcgctccggtatgatagccattgtggcggtctatggtattgcttggatggcagaaaccatgttctctgcacatatgaaagaaatagaagctgcattaggacaattagttcgtgagtatccttgggcttatgccgttgtcttattacttgtttctaagtttgttaattcacaagccgccgcattagccgcaatagtccccttggctttaggtattggtattgatcctgcctatattgttgcttcagcaccggcgtgttatggctattatattcttcctacttaccccagtgatttagccgctatccaatttgaccgttcaggaacaacacgtataggtcgttttgttattaatcatagctttattttaccgggattaattggtgttactgtttcttgtatttttggctgggtatttgctgctatgtatggttttttataa

SEQ ID NO: 1166 - DNA, 222 bp, Proteus mirabilis
ttatctaattgggttattttttatcatattgcattatttttctgtgaggtatttgttactttattttttcctatttattttagagagtttttagatcctccatatatctttatcttttttgggaattttatattaagtaaaaaggttgttttaacatttttggtgtttttttatgttaaagatgttaattgttattatttatcttttgcttttttggtctaa

SEQ ID NO: 1167 - DNA, 690 bp, Proteus mirabilis
ttcatttgttggagcgttatactgcctttcacaattacgctacaaatgaagattttcacggtgcaagataaaacaatcattattcgccaattgggtatgaaaccctatttaccggtttctgattctatgcatcagtttacggaaaaacgggaaagtcatacacctgatgaaatttggctggttcaacatgaacaggtttttacccaaggtcaagcgggtaaagcagaacaccttttaaacacaggctctataccggtgatccaatctgaccgcggtggacaagtgacctaccacggccctggccaacaagtgatgtatgttttgcttgatctaaaacgtaaccatattggcgttcgccaattagtcactgttttagagaatactgtgatcaacacactcgcagaatttaatgtagacgcatatgctcgtgcagatgcaccgggcgtgtatgttaatggtgataaaatttgttctttgggattacgtatacgcaaaggttgctcttttcacggtctagcacttaatgttgatatggacttatctccttttacgcgaataaatccttgtggttatcctgatctaaaaatgacacaactggttgatttggcgcctaatgcaacatcggaacaagtggcatcattattaatcaaccatttttgtacacaactgggattccaaccacagcaataa

SEQ ID NO: 1168 - DNA, 951 bp, Proteus mirabilis
atacattgttgcataaatcgagcaaataatatggacaaaattaaagcatcagaggtttttgtgaccatcgttaagcaaggtagcatgattaaagctgctgattatctaggtatgtctagagcaatggtgacgcgctatcttaatgaaatggaggagtgggctggggtgcgtttgttgcatagaacaacccgtaagcagagtctgacttccgtgggagaattagtttatcaacaaagtttacaactgctagagatggcggagcgtattcccgcgaatattcccaaagagagtcaccaaatcagtgggctggtgcgtattacaacggcacaatcactcgctaattgtgcattatctgtggctataactgaatttatacaactttatcctcttattgcagtcgatttgcaaatatctaatcagacagtcaatcttattgaagagcgtattgatattgcattgcgtattaccaaccatttagagcctaatctgatagcccgccctttagcaaaatgtttttctgtggtttgtgctcataaagattatttagctaaacatggtatccctaacacgccggatgatttgacttatcatcaatgtctcacatatcgcttttttggcagtagcttatgggagtttagtttaggtgatgagcgttattctgttcctgtaggtggtaatttaagtgccaatgagtctgttgtgttattgcaagccactttgcaaggtgccggagtctccttacaaccttactgctcagcaaaaccctatcttgaacggggtgagttagaaattttgttagcggattatcagccacagcctatgggaatttatgccgtgttagcgagccgacaaaatatgcccgcagccgtgcgtgttttactggattttctggttgactggtttgcttcttcgcctcattggttgtcattatcgggtgaacgcgtgagttaa

SEQ ID NO: 1169 - DNA, 903 bp, Proteus mirabilis
acaagttgttgcagcagcggaggcaaaataatgtctattttaatcgataaaaacactaaagttatttgccaaggtttcactggaagccaaggaactttccactccgaacaagctattgcttacggtactcaaatggtgggtggtgttacaccgggtaaaggtggtacaacacatttaggcttaccagtatttaatactgtacgtgaagcagtggaagcaacgggggcgacggcgacggttatttatgtaccagcaccattttgcaaagactctattttagaagctattgatgcaggtattaaactaattattacaattacagaaggtattcctacgctggatatgctgactgtaaaagtaaaattagatgaagctggtgttcgcatgattggccctaactgtccgggtgttattactccaggtgagtgcaaaattggtattatgcctggtcacattcacttacctggcaaagtaggcattgtctctcgttcaggtactttaacttatgaagcagtaaaacaaactactgacgttggtttaggtcaatcaacctgtgttggtatcggtggtgacccaattccgggatcgaactttattgatattctgaagctattccaagaagatccgcaaacagaagcaattgttatgattggtgaaattggtggtacagcagaagaagaagcagctgcttatatcaaagatcacgttaccaaacctgttgtaggctatattgctggtgttacagcacctaaaggtaagcgtatggggcatgctggcgccattattgcgggtggtaaaggtactgctgacgagaaatttgccgcattagaagccgctggcgttaaaacagtacgtagtttagctgatatcggtgatgctgttaaatcgctattaaataagtaa

SEQ ID NO: 1170 - DNA, 426 bp, Proteus mirabilis
aacattggttgttggtcgtcgttctgcggcaatttcaatgattattaccgttattttatcaatattggcgggggtattagtatggtaagtaattcttctactttaggccgtacaggcatacaggattggttattcctacgtgcaactgccatcattattttcttatatgttttatattttgtcggttttgttgcaacaactgatattacctatgaagtttggcgtggattctttagctcctctctaaccaaagtttttaccctattaacgctactttctattctaattcatgcatggattggaatgtggcaagtgttaacggactatattaagccaatagcattacgcttgacgttacaacttattattgtcgttgcgctgttggtttatcttatttatggaacaattgtggtgtggggtgtgtaa

SEQ ID NO: 1171 - DNA, 465 bp, Proteus mirabilis
tggagaggttgtttagtgacagatgatatctgtctccataaatccaatctcaacagtattttcaaagtgctctccgaaatcgtgacaacaggtaaacgctatcgcatcaaaatcaccgagtggcgtgatttaagaaccatacccatgaataaaacatggcgtatgtggatggaaaccacaggcgagtggttacgtgcgcgtggcgttgttatcgatattaaaaatggtgttggtgaaatcgttttatcaaagcccatcactaatgaggaaactcatgaatatttcgttggacattggctagggcgcaatgaaaacggtgagcgtgaaaaaaccagcaagatggataaagcaaggatgctttacatgatggagaaacatgaacaatggtgcattgagaagggaattccgatcatcattcctcgtaattctgaatatatgagtttgaaaagaaagcaagaagaatag

SEQ ID NO: 1172 - DNA, 603 bp, Proteus mirabilis
tcccttttctggagtaaaaatcctatgtaccaagatcttattcgtggcgaattaactgaagcggcagatacactctctcgttttttacaagatgatgcgaatattgaagccattcaaaaagcagctgtattattagcagactcatttaaagcaggcggcaaagttttatcctgtggtaatgggggatcacactgtgatgccatgcattttgcagaagaattaacggggcgctatcgtgaaaatagacccggttatcctgctatcgcaatttctgatgtgagccatatttcttgtgtgagtaacgactttggttatgaatatgttttttcacgttatgtggaagcggtaggtaaagagggtgacgtattactggggatctcaacttccggtaattcaggcaatattattaaagccattagtgccgctcgtgaaaaaggtatgaaagttattactctaacaggtaaagatggcggaaaaatggcagggagtgcagatattgaaattcgtgtccctcattttggttatgccgaccgtattcaagaaatccatatcaaagttattcatattctgatccagctgattgaaaaagaaatggaaaaataa

SEQ ID NO: 1173 - DNA, 219 bp, Proteus mirabilis
ccattattatgtttaaaaataaagcttacccaatcaatttgggtaagcttttttgttatcggtaccctgcttttgttcacttcgctacattttttctttattgctctgcgacaacaaaaatcacttcagtactctttttactcattctgtgaaaaaaagagtcttttattaatcaataagattaaaaaaacagcgattgaacagttttgtgataaataa

SEQ ID NO: 1174 - DNA, 279 bp, Proteus mirabilis
aaagtagaatgcatgtgtatagaagataaaaactatacaaagaacaaaaggagtttatctatcatgacattacaattaagaatgggtcgcgtaaaatggtttgacaataataaaggatatggtcttattgttgcaaaagatcttgaacaagatatttacgtcaataaaaaagcgattgccaatacaaaaaataaagcactaaccgaaggccaagacgttgagttttctgttatcaaaacagcagcaggtctagaagccgctgatgttatcgggttctaa

SEQ ID NO: 1175 - DNA, 1053 bp, Proteus mirabilis
acaggagaatgtattgtgagtacgttaaaacgttggacattaaaagaagctagggcactgtttgatatgccatttttagatttggtttttcaagcgcaacaagtgcatcgtcaacattttgatccttcacaaattcaagtcagcaccttactgtcgataaaaacaggcgcttgtcctgaagattgtaaatattgtgcccaaagtgcgcgctataaaacagggttagaaaaagagcgcttaatggaagtacaacaagtgattgaatcagccaaaaaagcaaaagcagctggttcaacccgtttttgtatgggcgcggcttggcgtaatccacatgagcgtgatatgccttatcttgagcagatggtcaaagaagtgaaagcgctaggtatggaaacctgtatgacattgggtaagcttgatgattcacaagcctcacgcttagcacaagccggactggatttttataaccataatcttgatacatcacctgagttttacggcagcattattaccacccggacatatcaagaccgtttagataccttagataaagtacgtaatgctggcattaaagtgtgctctggaggcattttaggtttaggggaagaggtcaaagatagagccgctatgttagtgcaattagctaacttaccgcaaccgccggaaagtgtacctatcaatatgttagccaaaattaaaggtacgccactggctgataatgaagatgtcgatccctttgattttattcggactattgctgttgctcgtattatgatgcctcgctcttatgtgcgactttcagcagggcgtgaacaaatgagtgaacaaacgcaagcattctgttttatggctggcgcaaactccattttttatggttgcaaattattaacgaccacgaatcccactgaagataaagatcaccaattattccgtaagcttggtttaaatcctgaaagattatctgtctcaatgggcgatcagcaacaagaagacgtgttgctacaagctgttgctgaaaaagacaccgaacaattttataacgcggcactgtaa

SEQ ID NO: 1176 - DNA, 351 bp, Proteus mirabilis
acaatggaatgcgcaaatacacgcaaacaattcaatcaatttatctctaaccacctaatagcttcagcattacaagcattgagaaataaaactcagtctgccgtggctagaaagttaggtgttcatgattcaactatcctacgtcgaactgaaaaatatcctgaaatatgcgaaacgcttgtcgcatcgggaattattgattttgtgatggaaggagaacgaaaaatctcagaagaagagtaccgatttttgtggaaacaaatgggtgaactttctcaaatgaaaataaaagaaaacgcctcgattgcggcaacaaacgaggcgtgttgttcaatggaattcaccatttaa

SEQ ID NO: 1177 - DNA, 1275 bp, Proteus mirabilis
  unsure (62): Identity of nucleotide at the above locations are unknown.
gattgggaatgtgaaatgaatgaactaaataaaaaacacttgatgtcttcaagtcatactanagaggttctttctaataaggacttagcacttctaaatgacttgcatgcagcacttcagaatgaaaaacatcataaaagttttatgatgatcacaatattgctgatctttatggttattttcgttatttgggcatggaatagtaatcttgaagaggtaactcgtggtcaaggcagtattattcctagcagtcgcgagcagataatccaaacattggatgctggcatattaaaaagtatgcaagttaaagaaggggatatagttgaaaaaggtcaagtattattaacgctagatgatactcgaacatcggctatcttaagagaaagtgaagcaaaagttgctaatctagaagcaatacgagcacgacttaaagcggaggcttattctactgagcttagctttccagaaggtttatcaacagaattagtaactcgtgaaacaacagtatacaagatacgtaaagacgcattgaaatcaggaatagacaatttacaacaaagtaaagcattgttagaccgagaaatttctatcactaagccaatagttgcacaaggtgcaatgtctgctgtggaattattaagaatggagaggcaatcagccgatattcaattacaaatagatgaaaagaaaaataaatatttaactgaagctggggctgaattagttaaaacagaagcggaattagctcaagcaagggaaaatatggcagggcgagctgatcctgttgaacgtgctttaatacgtgcaccattaagaggtattgtgaaaaatatccgtattaatacagttggtggagtaatttcagcagggcaggatataatggaaattgttcctttagaagatcagttattagttgaagcttatattagtcctcgagatgtggcctatgtacgtgctggtatgcctgcattagtaaaattgactgcttatgattatgcgatttatggtgggttagaaggcgtcgtgactttggtaagcccagatacattgcatgatcaaaaaagacctagtgatttaaaacttaatcaagatgaagctttttatcgcgtattggtcacaactcaaagtagtcatcttacggataaaaatggaaaagagcttcctgttattccgggtatgatcgccagtgttgatattaaaacaggtgagaaaacggttttccaatatttgattaaacctataacaagaatgaagcaggcattacaagagcggtaa

SEQ ID NO: 1178 - DNA, 279 bp, Proteus mirabilis
acaataggatgttctaattcatttttaaaaactacggttttggctccattagatactttatatccattcgtagttactcctgaatatattataaactccccgttattgattatttcaatagcttttttgttggtagttattaataatttttcttgttctactatcggttttatagcagttatatttaattttcctgaagtcattaaagactttgaactattagctaacatgctagagaaagctttagcactttcttctgaactagctaatactttataa

SEQ ID NO: 1179 - DNA, 300 bp, Proteus mirabilis
tctagactgtggacagcgaatcatcatttttgttttactatagccaacgcaaaacgcttgcgtttattttctattttaaaggtaaacttgatgtctaaattaaaaggtaacgttaagtggtttaacgaaactaaaggttttggttttatcactccagaagatggcagtaaagatgtgttcgtccacttttccgctattgtttcagaaggttttaaaacacttgctgaaggtcaaaaggtagagtttgaagttactgacggcgcgaaagggccatctgctgcaaacgttgtcgctatctaa

SEQ ID NO: 1180 - DNA, 1545 bp, Proteus mirabilis
gtaatgatgtgtaggatattaatgaataatttctctttattaaaccgccagtgggttcgcaccctactggcggtttttttcggtgccagtggcacactcgcgttttctccctttgatttctggcctgcagcgttaatttctttatcaggtttgctactgataataacgcaacgaaccacacgacaaggggcatggcttggttttgcatggggatttggattatttggtagtggtgtaaactgggtatatgtcagcattgctgattttgggggaatgccgttcgctatcaatattttcttagtcatattgttagccctttacttatcgctttataccgccctatttgccggattattaaacaagttctttcctaaacctaccgtttggcgttttgtctttgcggctcccgctgtatggcaactcactgaatttttaagaggctgggtgttatcagggtttccgtggttacaatttggttatagccaaattgatggcccattaaaaggtattgcacctatttttggtgtcaccatgataacctttttgctgaccataattagtggacttattgctgtcgctatctatcgtaaatcactatatagtgcggtgatcggagcaatattattactcttacctatcagctttaaatcttatcaatggtatcaacctttaactgatgaaacacaagaaattgccttagttcaaggcaatatcgcgcaatcattaaaatggcaacccggtactttagaaagtacgttaaacacctatctcaccttaagtcgcccttttatcggtaaagcaaacttaattatttggcctgagtcagctatccctgatgttgaaattcagcaacaaggctttttagctaaattggataaacaattaagagcacaagacacgcatctaatgacaggaattattgatgcgcgtcccaccttagaaggctatcgtttttataatagtgttattacattaggtgaacactatgcttaccaatatccggcaacagatcgctataacaaacatcatcttgtgccttttggtgagtatgtccctttagagtccttattgcgcccattagcgccattttttaatttacctatgtcatcattaagccaaggtgaatacatacaacctcaactgacggtaaatgatgctaaaataaccgccgccatctgttatgaaattattcttggagaacaagttcgcgctaactttaagccggatacacgtttcttattaactatttcaaatgatgcttggtttggtaattcaattggtccatggcaacattttcaaatggctagaatgcgttcattagagttaggacgcccattattacgttcaactaataacggcattaccgcctttattgctgctaatggtgatgttattgcccagcttccacaatttgaagccggtgcattagctgaaaaaatgacgcccacgacaggatcaacaccttattataaaatggggagttatccagtgtggattttagcaggggtatttttaattcttgcttttattaagcgtcgttcttaa

SEQ ID NO: 1181 - DNA, 714 bp, Proteus mirabilis
tcacgctggtgtgattatgaatggtatgctacttcatcacttatatggacaactgagcagactggttccttacagcgattactggcgggatcggacggtaaaaatagtgcggaggaaagagtttgtatgagcctaaaaacaatacgcctatatggcgttcttggcgcaaaatttgggcgtgaacacaaattagatatagattcacctagtgaggcgattaaggcgctctctgtgctttatgatgggtttgagcagtttcttgctaatgcacatctgaaagggctggagtttgctgtatttaaaggtaagcgcaacattgctgaagatgaattacatcttgataccaaagaagagatccgcatagcaccaatcattaaaggaagtaaacgaggcggattctttcaaactatgctgggtattgccatgatcggtgtcgcgacatttgccccttggggggctgctttgtgggcgagcgatttaatcggaacaataggtttaggtgtagcacttggtggtgtttaccagatgctttcacctcaaccgcgaggtctatcaatgaggcaagattcagataacaaaccatcttatgcctttggcggagctgtaaactctactgcgcaaggaaatccagttcctttactttatggattggacaggcgagaggtaggtggggcaatcatttctgcaggtatttatacagaagatcagcaataa

SEQ ID NO: 1182 - DNA, 453 bp, Proteus mirabilis
ctaactcggtgtttcctgttgctcaatgcaatgattgtcattgaggacttaaaggtcagtaacatgtctaaatcggcaaaaggtacgacagaacggcctggacggaacgtaaaagctaaatctggtttaaaccgcgcaatactggagcagggctggtatgaaatgcgccgtcagcttgagtacaagcagctctggcgaggtggtcaggtagtggcaataccaccagcctacaccagtcagaagtgcgcttgctgtggtcatacagcaaaggaaaaccgccagtcacaaagtcaattcgagtgccttgaatgtggatatacagcgaatgctgatatcaacggggcacgtaacattttagcggcaggacatgccgtgcttgcctgtggagggagggggcagtcagaccgcccgtcgaagcaggaacccgccgaggtgattcagacatcagtctga

SEQ ID NO: 1183 - DNA, 1335 bp, Proteus mirabilis
atattaaggtgggttaatagagtgcaaaccaatgacaaaaaacaaaaggatcattgctgctataaatcaatctgttatgagttatcagccaacagaaggatcattatggctataggtggggtttatatcacccaaacccttatatcaatgattatcatgcaatctgtaccaaccttactaagaagtgaaggattttctctctctttaattggattgacttcactttttatgcttccttggacacttaaatttttatggtctccatttattgaacgcctgagattaccttttggaaaaaaatttcgccgttcacgtaacttgattcttattggtcaatcattggttgctcttttagtttttttacttattctaataaaccctaacgataatataagcaaactgaataatctttggatttttggaatatttatcctatgtgcattcttaacatcgactattgacattgcatgtgatggcatggcggtagaacagattaaggcaagtaatagagggtggggaaatattgctcaagttggcggaggagaaataggagcattattaggcactagtggttttttattaatttccagttattttagcttaaatactgcatttgctatatcagctctaaccatcatattacttacaattccaacactctactttaaagaatcagatagactaaccacatctgaaacttaccatataccaaaattatcatatgcatttaatcgaaaagaggtaagaattggtattttattagtagttttattagaaggaggtaacagaatcacagatatgattaccggacctctattaatagatataaatattacattaaataatattgcactattaataggaagcttcaatttttgtgcaagcctatttggaacacttttaggtggtatattaataaaagtatttggtatatggaaatcaattttcattacctatggtttacaaggattaatttttgctttcatatccatggctataggaataaaatatatcccacatgaaatactttttttacttatagggttcaaatatattcttttttctgcaggactagtttctttttacactggtttaatgagcttatcttcattgaaacaagctggtattgatttcactattttccaatgtacaaatgcttttacagcaatcattgctactctattaggcacttggacagcggagaactggtcttatcattttgtttttgcaatatcatctatttatacttttatcgcagtactaatttccattaaattaataaaaaaacgccttaaactaaatatttcatcaaacaattttgagcaatatgtataa

SEQ ID NO: 1184 - DNA, 234 bp, Proteus mirabilis
agaattctgcttggcggccatagcgcggtggtcccacctgatcccatgccgaactcagaagtgaaacgccgtagcgccgatggtagtgtggggtctccccatgtgagagtagggaactgccaagcattaaataagacgagaaagccaacccaatgggttggcttttttgcgtttgatattttttattctcaattttatcctttaactaaggaaaagagttatttcaattgctga

SEQ ID NO: 1185 - DNA, 2607 bp, Proteus mirabilis
attttaaatcgaattttacttggaggtgttatgcgtctggataaattaaccaataaattccagcaagctctcgcagacgcccagtcattggcacttgggaacgataatcaatttatagaacccatacatttactgagtgcgttatttaatcaacaaggtggctctattcgcccactattaacatccacaggtgttaatgcctcacaatttaatgaaagaattaatgatgcattatctcgattaccaaaagtggaaggtgctggtggagaagttcatccttcaaacgatttaattaaacatcttaatttatgcgataagttagctcagaaaaaagatgatgaatttatttcatcagaactttttcttttagctgccatggaaagtggtggtcaggttgctgacatgctaaaagccgccggagctaacaaagccagtttagaattagccattgaaaaaatacgtggtggagaaacagtgaacgatcaaaatgcagaagaccaacgtcaagcattgaaaaaatatactgttgatttaacagaacgagcagaacaaggcaagcttgaccccgttattggacgtgatgaagaaataagaagaacaatccaggtattacaacgtcgtactaaaaataacccagtattaattggtgagcctggtgtaggtaaaaccgcgattgttgaaggtttagctcaacggatcgttaatggagaagttcctgaaggtttaaaaaataaacgtgtgctttcacttgatatgggatctttattagcaggggctaaatatcgtggtgaatttgaagagcgtttaaaagcggtattaaatgatttatctaaacaggaaggtagtgtcattctgtttattgatgaattacatactatggttggtgccggtaaagctgatggtgcgatggatgcagggaatatgttgaaacctgctttggcacgtggcgaattacactgtgtcggcgccactacattagatgagtatcgccaatacattgaaaaagatgcggctttagagcgtcgtttccaaaaagtttatgtggcggagcctacggtagaagataccatcgccattttgcgtggtttaaaagagcgttatgaattgcatcaccatgtacaaattacggatccggcgattgtagcagcagctactttgtctcatcgttatatttctgatcgtatgttgccagataaagcaattgacttaatcgatgaggctggtgcaagtctacgtatgcagatggattcaaaaccagaagcattagatagactggatagaagaattattcagctaaaacttgaacagcaagcactgcaaaaagaatctgatgatgcaagtaaaaaacgtttagctatgttaaatgaagaacttgcagaaaaagagaaagagtattctagcttagaagaagagtggaaagcagaaaaagcagagcttactggtactcagcatataaaagcagaattagagcaagcgcgtattgcactagagcaggctcgccgtagtggtgatttggcaaaaatgtcagagatccaatatggtcaaattcctactttagaaaaacaacttgctgaagccaataaaactgaagataagcatatgaaactgttacgtaacaaagtaacagatgctgaaatcgctgaaatcttagcacgttggacaggtatccctgtgtctagaatgttagaaggggagcgtgaaaaactgttaagaatggaacaggaattacatagacgcgttatcggccaagatgaggcggtaaatgcagtctctaacgcaattcgtcgtagccgtgctggattatcagatccaaatcgcccaattggttcgttcttattcttagggccaaccggggttggtaaaactgaattgtgtaaagcgctcgctgatttcttgtttgatagtgatgatgcgatggtgcgtatcgatatgtctgagtttatggagaaacattctgtttcacgtttagtgggggcgcctccaggatatgtgggctatgaagaggggggttacctaacagaagctgttcgtcgccgtccttattctgtcatcttattagatgaggtagaaaaagcgcatcctgatgtgtttaatattttattacaggtattagacgatggccgcttaacagatggacaaggtagaaccgttgatttccgtaataccgtagtcattatgacatcaaacttaggctcggatttaattcaagagcgcttcggtactcttgattatccggcaatgaaaactattgttatggatgttgttggtcaccactttagacctgaatttattaaccgtattgatgaggtagtggtattccatccattaggtaaagagaatattgccgctattgctcaaattcaattacgtcgtttgtatcagcgtttagaagagcgtggttatcacgtgactattacgggagcagcattagaaaaactgggtgaagttggattcgacccaatctatggtgctcgtccattgaaacgtgctatccagcaagaggttgaaaacccattagcgcaagatatcttgtcgggtaaattagttccgggtaaagaaattatcttggacttagatgacaatcagatcattgcaaaacagtcataa

SEQ ID NO: 1186 - DNA, 660 bp, Proteus mirabilis
ctgtgcctgcttttaaccacgtcaggcgaggtggttctcgtgtacccctacagcgagaaatcggctataatccacttacccctacagaataagagattatcaaccatgccgaattggattgaggcagtgattgcctatttgaaacaaaacacatcattgaggttcaatatgttttggttgttatcttggtttgcgctattaatatttactcccattggatatattgaatttattaactcaaaacttcttcagtgggataatccatatatagtgtcgtcactattttttgttccagtgagttactttatttcatattttgttaagttattcattaagttatgtatttacttaaacagagcgttaacacaagtaagattaaataaaaaaaagaaaaacaatattaataatgtcaccgacaaagaagcttcgattattgcaatctttgccgaaataggtctggatagcgaattgtcttttgattcaatgaatgaaaaaggtgtcatcgaattatttaataaaggaataatcgaaccaattaaaggtgactatattaacgagcctaagtgcagatataggattactagaaattaccttaaagatatagaatacgccctagtaaataacactaaaatacgtaaagcatatgaagaggtaaggtaa

SEQ ID NO: 1187 - DNA, 1362 bp, Proteus mirabilis
ataagcatgctccgtcagccggagagtaaaacgatgagtacttcaaaaaataaaatgagtgtattgcaactcactatattaactgcggtgaatatgatgggttccggtattattatgctaccgaccaaactagccgaagtaggaaccatttctattttatcttggattgtcactgcagtcggctctatggctctggcctatgcatttgctaaatgcggtatgtttagccgtcgtagcggaggaatgggagggtatgccgagtatgcctttggcaaatcggggaattttatggccaattatacctatggtatttccctgttaattgccaatgtcgctatcgcaatttctgctgtgggttatggtgccgaactgatggatgcgacaatgactccgttaggtatttgtattgcaacgattgttgtattgtggatctgtacaatagcaaattttggtggtgcgcggatcaccggacaaataagcagcatcactgtctggggggtgatcatccctgttgtgggtatttcaattattggctggtggtggttcaatcttgaacaatacattaactcttggaatccacataattttccattctttgaagccgtaggctcttctattgccatgaccttatgggcatttttaggtatggaatcagcttgtgccaatagtgaagcggttgaaaatcctgaaaagaatgttcctattgctgtattaggtggtacattaggtgcagccgttatttatatcgtatcaacaaatgttatcgcaggtattgtgccaaatatggatctggcaaactctaccgcgccatttggcttagccttctcccaaatgtttaccccaagtgttgggaaaatcattatggcgctaatgattatgtcttgttgtggatctttacttggctggcagttcaccatcgcacaagtatttaaggcgtcatcggattctggttattttccaaaaatattttctgcagttagcaaagctgatgccccggtaaaaggaatgttagttattgttgttattcaatctgcactgtcactgatgaccatcagcccatcattaaataaacagtttaatgtactcgtcaatctagcagttgtgactaatattattccttacatcctttctatggcggcaatgattattttacaaaaagtcgccaaagtggaacctcataaagcgagaaccagtaatatcatcgcattcattggggcgatttatagtttctatgctctgtattcatctggtgaagacgccgtaatgtggggggcattagccacattcttgggatggacactatatggttttgtctctccacgatttgaaatgaaacaaaaccaagacctaatgacaaaataa

SEQ ID NO: 1188 - DNA, 204 bp, Proteus mirabilis
tgcaaggtccgaagagcccctgctttggtccgtagacattatgcggtattagccaccgtttccagtagttatccccctctatcgggcagatccccatacattactcacccgtccgccgctcgtcagcaagaaagcaagctttctcctgttaccgctcgacttgcatgtgttaggcctgccgccagcgttcaatctgagccatga

SEQ ID NO: 1189 - DNA, 312 bp, Proteus mirabilis
actgactgccgaagagggaaagtaaccctgtcagcggataaaacgtccgctatcgctgacagtacagatacagtaacgatcactcttaattacaccaagggcagctctccagtcgaaggagctaccgttaattggtctacaacaggtggcaaattaagcgttacttcatctaagacgggcaaagctggtggtgcgacagtgaaattaacttctgattcacagggtgaatttattgtcacagccactgttgatggtgttgcacaaaatactgatgcaattacattcacagaaaaaacttctccagacgagtaa

SEQ ID NO: 1190 - DNA, 660 bp, Proteus mirabilis
atggagacacgcaaaatgactaaaggtcttatttttgatctggatggcgtaattgttgataccgccaattaccactatattgcgtggaaaaaactatctaatgaaataggaattgattttgacaaagagtttaaccatttattaaaaggaataagccgaattgagtcattagagcttattttatctcatggtaataaaagtgatgtttattctgcggatgaaaaaaaatcattcacagaaacaaaaaataaatattatcttgagttattaaataatattactccaaaagatattttacctggtgttttagatctaatagaacaagcaaacaataatcacattccttgtgctattgcatcagcttcagaaaatgccccaaccatattagaaaaattaggcattaagcattattttaaggcaattgttgatcctaaaacactcaaaaaaggcaagcccgatcctgaaatatttttgcgtgcggctgagtttattcacattccaccacatttatgtatcggatttgaagactcgattgctggaatacaatcgattaaacaagcgggcatgtatgcaattggcgttactgctgacggccccttaccagaagcagatttagctgttcactcattaactgaaatagatattcattcacttttttaa

SEQ ID NO: 1191 - DNA, 309 bp, Proteus mirabilis
acagctcaacgtttgagatacgaccatctttctgaagctcatttagaatattccggtctattctatcaagatctttacccggacgttttttattatcaatcatctctatactctctttctctttttctcttactttattttcctatacccatacctgtacaccttcagcatcatattgagacctcggtatcaaacggtcagagcaaactaccaatctatttttatttaatgccagataaaacaatcattttatccaaattcttatctattcatcttgcaaaagcactatcctataccctgtctgtctaa

SEQ ID NO: 1192 - DNA, 273 bp, Proteus mirabilis
atgaaaaaacgaacaaaccgagtttatactcttgagtttaagcaagaagcggtcgcattagtctcaaaacaaggttatagcgtctcaaaagcggcagcttctttagggatcaccgataaattactttataactggaaagcaaaattcgacgctgagcaatccggtagtagcttgaattccgatgagagagctgaactattaaggtttcgaaaagaaaataaagaacttaggatggagaaagaaatcctaaaaaaagcagcgccctccagctaa

SEQ ID NO: 1193 - DNA, 249 bp, Proteus mirabilis
tcaatgaaacgaattacattatcagaatggaataataaatatttcgccaaacctagaagtccacggcaattatctcgctatataaaggaaggtaggttataccctgctccagaaaaggttggtagagaatatgagttagagccgtggacaattctaacaaatgacaaaatggtaagggaaccgcaatatttaatggagaaaattaatgggcagaagcagaagtgcaaagaacaaggggctaccgcctaa

SEQ ID NO: 1194 - DNA, 825 bp, Proteus mirabilis
aaaatgaaacggatcacgatagtcggattaggttggttaggattaccacttgccaatgccttgcgtgaagcggggtatcaagtaaaaggaacaaaaaccacagaagatggtgtagaagcagcacgaatgagtggtgttgattgttgtctaatgaatttaacaccggctattgagtgtgatagagatgattttgattacttaatggaaactgacgtactgattattacattacctcccagtgcggcggggggaggatatgattatgttgaagggatacaaacattagtggatagcgccatgtctcggcatgtgacaagagtgatttatattagctctacttcagtatatggcaatcaaagtggtgttattacagaagaagttgatattaggccggaaacgcaatccgctaagatgatagcggaagttgaaaattggttacatcgcttaccacttacgaccgtcgatattttacgtttggcggggttagttgggcctggtcgtcatgcaggacgctttttatccggtaaaaaacaggtcaaaggtgcacatcagagtgtcaatttagtgcatttagacgatgttatttttgcgatagagcaactgcttgctcaaaatgaaggaggccgtttatataatttatgtgcccctattcatcctaaaaagaaagatttttacagccgtgttgctgcacagttagatcttactccccctgaatttgctctagaagataaaccgccagcacgagagatcgacggtcaggagatttgccgagatctcggattccattatcactatcctgatcccgacaaaatgccaatgagttaa

SEQ ID NO: 1195 - DNA, 4458 bp, Proteus mirabilis
atgattgaacgaggaaaatttcgctcattaacattgatcaactggaatgggttttttgctcgtacttttgatttagatgaattagtcacgactttatccggtggtaacggagcgggtaaatccaccaccatggcggcttttattaccgcgatgatccccgatctgactttacttcattttagaaataccactgaagccggttcaaccagtggctctcgtgataaaggattatatgggaaattacgcccgggagtttgttacgctgttttagatgtgattaattcccgccatttacgagctgtcgttggcgtacgcttacaacaagttgccggacgagataaaaaggttgatatcaaaccttttatgatccaagggctacctattgctgaaaatccaacagaaattttgacgcaagctgtcgatggacgccaagcacgtgttctaccacttaatgaattaaaagaaaaagtagaagcgatagaaggcgttgtttttagacaatttaactcgattactgatttccactctgtactctttgatttaggggttattccgaaacgtttacgctcagcaagcgatcgggcaaaattctatcgtcttattgaagcttcattatatggtggtatttcaagtgccatcactcgctctttacgcgactatttattacctgaaaatagcggagtaagaaaagccttccaagatatggaaggggcattacgtgaaaaccgcatgaccttagaagctattcgggtcactcaatccgatcgtgatctgtttaaacatttagtcaccgaagcgacctcttatgttgcagcggactatatgcgtcatgctaatgaaagacgagtacaccttgatcaggctctatctttacgtaaagagttgtgggatcagcgtaaagcgattaacaatgaagcttatcgctttattgaaatgggcaaagagttagaagagcaacaagcgttatcggctgatttggaaacagattatcaagccgccagtgatagacttaatcttgtacaaaatgcggtgcgccaacaagaaaaaatcgatcgctatgttgcggatgttgaagaaatcacattccgtttagaagagcaaagtgaagttgttgaagaagcaacatcaaaaaaagaagagttggaagcgcgagttggatctgcggaagaagaagttgatgaactgaaaagtcaattggcagattatcaacaagcgttagatgttcaacaaacccgagctattcaatatcgtcaggcggtacaagcattagagcgtgcgaaagcacaatgtggcattgatgatttagatgaaaccaatgccgagctatgggctgaacgtattcaagcaaaaattcaatccatcacgcattcattactttctatggagcagaaactcggtgtttctgatgcggccaaaacgcaatttgatcaagcctataaattgatcacctcgattgttggggaagttgagcgtcaaaatgcgtggagtgtggctaaaagcgcattacgtgaatggtcatcacatcgccatcaagccgatcgtgttcaccctattcggatgcaattagctgaattagagcaacgtttacagcaaagaaataatgctgaacgtcaacttgcagagtttaataaacagtatggcaaaaatgttgagcctgatgatctatttactctacaagaagagctagaagcaaagattgaagagctgagcgattatgttagtgattctggcgaacagcgtatgcaaatgcgccaagagcttgatcaactaaaacaacaaattgaaaaattaagaaaacaagcgccagtttggtttgctgcacaagatgctttaacgcaactgtgtgaacaaacgcatcaatcttttgaaacaagcaatcaagttactgaatatatgcaacagttacttgagaaagagcgtgaagccacggttttgcgtgatgaaaccgctgctcgcaaacagcaaattgaagctcaaattgaacgattaagtcagcctagtggggctgaagatggccgattaattactttagcagaacgctttaacggggttttattatcggagatttacgatgatatcaccttagatgatgcgccttatttctcagcattatatggacctgcgcgccatgcgattgtagtacaagatctcagtgcgatcgaagagcagttagcttctttagaagattgcccggaagatctctattttattgaaggtgatccacaatcctttgatgatagcgtatttaatgcccaagagatggaaaaagcggtacttattaaaagttcagataggcagtggcgctattcacgttatccagaaattccattatttggccgtgcggcacgagaaaaccagctagaaatattatcccgtcaacgagatgagctgtcagagctgtatgctacacaggcctttgatgtgcagaaaattcaacgtgcacaccatgcatttagccaatttgttgggcaacatatttcagtggcatttgatgccgatcctgaagaagatattcgccaattaaatcaacgtcgtaatgaattagagcgcgagttatcacaatatgaagagggcactcagcaacaacgtcagcattatgcgcaagccaaagagtcgctcaatttattaaataaactcattcctcaagtcaatttattattggacgaaacattaattgatcgtgttgaagagctacgtgaagagctttataacgcagaagagtcaatgcgttatttacagcgtcatgagaaagcattaactgcgttagagcctatagcctcgattttacaaagcgatccacaagagcatgatcaattaacacaagattatcaatacgcaaaagaagagcagcaacgttatcaacaacaagcatttttgctggtggaagtggttcagcgtcgtccacattttagttatagcgatgcggttgaaattgtcagtgaaaataacgatcttaatgaaaaattacgtcgtcgtttagaaatggctgaaacagagcgagcgacagcgagagagttatatcgtcaacagcaggcacaatgtgatcagtttaatcaagtactagcctcactaaaaagttcttttgataccaaatcagaactattaagagagcttgagcaagagatgaaagagactggcttgcaaattgatgcgggtgcagaagcgcgagccaaagagttacgtgatcaacgttatgctgcggtgagtgctaaccgtacgcgtattagccaacttgagcgtgatattgcgcttagtgaagctgaacgtgaaaatatggcgaagaaaattcgcaaattagaacgtgattatggccaaatgcgtgaacacgtcgtcagcgctaaagccagttggtgtgctgttatgcgcttagtgaaagaaaatggtatggagcgccgtttacatcgtcgtgactttgcctatctttcagcggatgagctacgttcaatgtcggataaggcgctaggtgcgttacgtcaggctgtggcggataatgaatatttacgggatgcattacgtcgctctgaagatgcaaaataccctgatcgcaaagtccaattctttattgcggtttaccaacatttaagagaacgtattcgacaagatattatcaaaaccgatgatccggttgatgctatcgaacagatggaaattgaattagcgcgcttaaccgaagagctaaccagtcgtgaacaaaaactggcgatcagctctcgcagtgtggcaaatattattcgtaaaactatccaacgtgaacaaaatcgcattcgtatgctaaatcagggcttacaagcggtttcctttggtcaggttcgtggtgtacggttaaacgttaatattcgtgaaagccatcaaatcttactggatgtattatcggaagaagaagatagccaatatcaagatctatttaaaaaccaaaacctaaccttctctgaagcgatggcaaaactgtatcaacgcttaaatccacaggctgattttggtcagcgtatgccacaaacggtgggtgaagagctacttgattaccgtaactatcttgagatggaagttgaagttaatcgtgggccagaaggttggttaaaagcagaaagtggtgcgctatcaacgggtgaagccattggtacaggtatgtctatcttagtgatggtggttcaaagttgggaagaagaatcacgacgcttaagaggaaaagatatttcgccttgtcgtttgctcttccttgatgaagccgcacgtttagatgcgaaatctatcgcaaccctgtttgaactgtgtgaacgacttgatatgcaacttatcattgctgcaccagaaaatattagtccagaaaaaggcacaacttataaattagtgcgtaaagtctttaatggaagcgagcatgttcatgtggtcggattaaaaggctttgggcaacaaagtgaaaaagataacattttatccgaaaatgttgcagatagttga

SEQ ID NO: 1196 - DNA, 1782 bp, Proteus mirabilis
aatagcccgctatttattaaaagtttggtaatatatatgaatgatatagacctatcaacgtggcaaacattccgacgcttatggccgatgattcggatctttaaagcggggttgtttgctgcagcaggcgcattaatcataaatgcgggtgttgatgcatttatgatctctttattgaaacctctgcttgatgaaggcttcggtaaagcaagtaatgatgtattaaaatggatgcctttagccgttattggcctgatagttctgcgtggtatatctaactttatttctagttactgcctttcttgggtatcaggaaaagtcgtgatgaatatgcgccgtcggctgttttctcatattatgggaatgccggtgagcttttttgatcagcaatctacaggtacgttattatcacgtattacctatgattcagaacaggtcgcttcatcttcatcaggggctttgatcactgttgtccgtgaaggggcttatatcatcggcttatttggcttgatgttctactatagctggcagttatcacttatcttgattgtgatcgcacctattgtggcggtggtgatcagaatggtatcaacacgctttagaaccatcagtaagcgtatccaaaatagtatggggcaggtgacaacaagtgctgaacaaatgcttaaaggccataaagaagtcttaatttttaatggtcaagaagttgagaataagcgctttaatcatgttagtaaccatattcgtcgccaaggtatgcgtatggtggtggcatcttctatatcagatcccattatccagcttattgcttcttttgctttagcctttgttttatatgcagccagttttcctgagattatggataccctgactgcagggacaattacggtggttttttcttcaatggtcgctttaatgcgcccattaaaatcattaactaacgttaatgctcaattccaacgaggcatggctgcttgccaaacattatttgctatccttgatatggaacaagagaaagataccggcacccttgagctgaaaaaaccaacaggtgatattgagttccgtaatgtcactttccaatatatcaccaaagatacacctgctttgaaaaatctgtccttcactattcctgaagggaaaacagtggcactagtagggcgttcaggctcaggtaaatctactattgcaaacctcctcactcgtttttatgacgttaacgaaggggagattttgatcaatggtcacgatattcgtgattacacattaagatcactacgtaatcaggttgcgttagtttcacaaaatgtgcatctgtttaatgaaacggtagcaaacaatattgtttatgcttgtgaagaccaatatacccgtgaggatatcgagaaagcggctaaaatggctcatgctatggactttatccaaaaattagataatggtctcgatactgaaattggtgaaaatggcgtgttgttatcaggtggtcagcgtcaacgtattgccattgcaagggcactattgcgtgatgcgcctattcttatcttagatgaggcaacttcagcattagatactgaatcagagcgggcaattcaagctgcacttgatgaactgcaaaaaaatagaacatcattagtgattgctcatcgtctatcaaccattgaaaaagcagatgaaattttagtgattgaagatggggaaattgttgaacgtggtgctcatcttgatttaattgagcgaaaaggcgtttatgctcagctacacaggatgcaatttggcaaatga

SEQ ID NO: 1197 - DNA, 1299 bp, Proteus mirabilis
ttttatatttttataaaaggaaacgtgcatatgaacgacgaaaacaaagtgcctgtgccggatgaagcgcaggcatccccggcacacgctgaggatgatattgccacgcttgagcgggaagcccgcgctaaaagggaggccgagcttctcaatgcgcaggacgacgaagagaaagacccggtacaacccgccgttaacaagctgaaaaagcgcaaacggggcaaagcaaccgcctttcttgccattgtcgcggttgcgcttatcttcctggcatggggggggaactgggtttatcgcaatatcctgtggcaacccacggaagaaaagaaacaggacacagccccgcagacgaacaaaaccgattaccggcagcgtaacgatctcggtatgtccaccgatacagccgaagaagagccggagcaacaggacaacggccagaacagcgcagcgggaacagggcaggcggctccggccgccccgccagaactaaacaaagccagcttccttattcgccgtgatggttcggccaccacacagaaccaggtaaaaacccggcagcaggaaatgacgctgacatcggcaacgaccaccggacaacaggacagcagcgcggccacaccacccggtcagccgcaaaatgccgcaacaccgtcgcagggacaaagccccgcaccagtacggcgcataccctataaccctgacctgtatatcccggaaaacacctcgatcccctgctcactggatcgccgctttgtatctgaccgggcggggaaacttcgctgcacggtcactacggacatctggagcgccagcggcaacacgaagctgatagagaaaggcaccacagcatcattactttaccgcgccatagcggaagaaggtatgaagcacgggcaagggcgggcattcatcattgcgacgaagctacgcacccgccagccgccttatctcgatatcccgttggttgataccagcgcggctggcgagctgggcgaggctggcgttgatggctggatagattcgcacttccaggaacggttcggcggcgcgttaatggtcggcatgatccccgatattggcgcatgggcatccaacagtgcgggtaaaaaagaccgcaatacggactatacggaaaacagccgccaggctatggcagatatggcgcgtactacgctggagaacagcatcaatattcccccaacgctctataagaatcagggcgagatcatcaacctgatcacaggcgaggatattgatttttccaacatctatacactgaggttgaaaaatgaccgctaa

SEQ ID NO: 1198 - DNA, 198 bp, Proteus mirabilis
aaaaagcagcgccctccagctaaaggaaaccaagtaacgtttaaaacgattaagcaattaccttctcagtttcccgtgcagaagctctgtaagttaatgaaaataagtcgttctgcctactacgcttggcttaaacgcccagcaaaattgatcaccgcagaaccaaagctatctttgaacagagtcgaaatagcttag

SEQ ID NO: 1199 - DNA, 198 bp, Proteus mirabilis
cgtagtaagcgccttcaaccgattgttggaatgcctcagacggtattgacgggtattcccgtttcatatcgtcgccaagcgttttctctttggcgtaataccatgctttctggcgctcgtttaattgaacaccatgtttgctggctatctcatcaaagtaatcaactaaccgctggggtaatggctcaacagggttaa

SEQ ID NO: 1200 - DNA, 1224 bp, Proteus mirabilis
tttatcgagcgcagtgtcagttatggtcaaacgggcgaggtttttaccgccggacattggtactaccacagttatcagtacgacccgctgggacaattgacagcgcatttagggtcggtgcaaaccgaacactttctgtatgatgcggcggccaatttactgccccgtccgcacagcgaagcaccgcataaccaagtacaaggcagtgataagtatgattatcgctacgacggttttggtcgcatggtctcccgctatgaaaaaggcagtagctcgggacaacgctatcactatgacagtgaccaccgcattatcgcggtggatatcgaccaagggcccttagggtatcagcgagcggaatactgctacgatatcttagggcgccggattgaaaaacggttatggaaagccagtgcgattgccaatacggtgacctatcaccaacatgagccggatgaagtgtacacctttggctggatagggatgcgactggtgtctgagcacagcagcgcagcgccccataccacggtttatcatgcttacaatgaccaaagttatacccctctagcccgcattgaatgcacggataacccgcttaatccgcaacgggcgatttattatacgcacagtagtttaagtggcttaccggaagcgttgaccaacagtgagggtgaaatagtttggcaagggcaatacagtgcttgggggcatttacagcgtcaaacccgccccacaagcgcgtttaatcgtgaacagaacctgcgttttcaagggcagtatttcgacaaagagacgggcctgcattataatacgttcaggtactatgccccggatttaggccgttttacccaacaagacccaatagggttggcaggggggataaacttatatgcttatgcgccaaatccattgacatgggtggatccgtggggttggagttgtggtcctaaattaaaaactgaagtagattataaaaaggctattcaaaatttagaatcgcagcatggtgctttaaatgctcatggattaagaagacatggagcggggacaaccttagagcaacaacaatatagagccagaacaggtaactcacctgataatcattatacaatagttcttgatagaaaaacgttaggaagaagcgcaccttcatccacaagatttctgagttataaagaccaatgtcttcaccacggggctggaaggatccgcgactggcgcatt

SEQ ID NO: 1201 - DNA, 1047 bp, Proteus mirabilis
gcgaaaaggcgtttatgctcagctacacaggatgcaatttggcaaatgattgagcggatttggtctggtaaatcgtggtgttaccttcttttattgcctttttcatggctctatggggcgatcagcctttttaggcgttttgcctataaacaaggctggttatcctcatggaaatcccccgtacctgttgttgttgtgggtaacttaacggcgggaggtaatggtaaaacaccagtggtgatttggcttgttgagcaattaaaagcacaaggctttaaacctgcggttgtttctcgtggttatggcgggaaatcagaccaatatcctttattattgtcgccagaaacacagccggccgtcgcaggagatgaaccggttttaatttatcatcgcactggcgtacctgttgccgttgctccttctcgcagtgatgcggtcaaagcgctattagcgcaatatgatcttgatattattattactgatgatggattacagcattatgccctacagcgagattatgaaattgtcgttattgatggacaacggcgttttggtaatggctggtggttgcccgcagggccgatgagagagcgcgctcatcgtcttgattctgttaatgcggttattgtcaatggtggtgattgtcaagcgaatgaaatagcgatgagtttagagggagaaatcgcggtaaatctaaagacaggtgagaaaaaagctattactgagttgggtaatgcagttgctatggcagggattggtcatcctcctcgtttctttaattccttgcaagataaaggggttaagttaattgcgactaaagcctttaatgatcatagtgaatataccctacaagagttacaaatactgacgcctcaccaagagcctctgattatgacagaaaaagacgcagttaaatgccagcattttgcgcaaaacaactggtggtatttgcctgtcagtgcggtattgaaagatctatctgtgctaaatcaagtcagccaattagtgacaacgcgaaaaaaacttgtatatgatctgaaacaatga

SEQ ID NO: 1202 - DNA, 765 bp, Proteus mirabilis
cagtggattagtcacatggatgtgagtatgattccaatatttataatggtatccacgatgatagaactatcttcaaagcttaaaaatattattttttgggtgtcaacagcttcaatatctttaattgtttttggtgtttttgttattgatatatttgtcaccgatgctcatggaaaagataaactcagcattattttttcttatctatcaactatctttgcattcttatcttcgctagccttatttgccaccataggtgtttattggcggcaaaaaaaggactcagaaaactcagaaaaaaaaagacaaaaagaaatatccattagctatctaaatatatttactaaatattctgatgagttaaaaacaatagtaagtcaactggttaaactacataaattattagacgaaaacaacaattcatttgtagaatatattggtggtcatgatatacatgcatttatcttaaaagacgtaaatgggaaagaattaggcaatgctcgaatgtttaaatttgatagctcatccttgtcttatatatattcaaactccgcatcagttaatataaacatctcagagaagtatcaatttttatacaagcgcagcattaaaataaatacatatattgaaaatttaattttaaaaattcattatgataatagtaaagaaaatatacttaattattttagtactttaagattaagtaaatctatagataaaattgatttatgtgtaaaagatttcgaagattactgtgaaagttaa

SEQ ID NO: 1203 - DNA, 867 bp, Proteus mirabilis
gagagtgttagtatgaaagctgacagcccttttaatttattatcacctgctgatatggcaaaagttgccgatgatgcatgttgttataaagcaaacaaacatatcccaacaacttacttatctgcttttactgcgggaatgtttatttcaattgcgtttgttttttatattacagcgactacaggcaccgcatctgttccatttggtctcgctaaactcgttggaggaatttgtttctctttaggcttaatgctcgtggttgtttgtggtgcagacttattcacttcaactgtactcaccattattcctaaagcgacaggacgtatttcttgggctaagatgttcgctaattggataaatgtctatattggtaactttattggcgccctgttctttgttgccttaatgtggtttgcaggtcaatatgcagcagctaatgggttatggggtctgaatgtattacaaactgcacagcataaagttgagcacacctttattgaagcagtttgtttaggtattttagctaatttaatggtttgtcttgcagtttggatgagttatgcaggtcgaactttaattgataaactctttgcacttattttacctatcggtatgtttgtggcgagtggctttgagcacagtatcgctaacatgtttcttattcctttaggtattgtaattaagaattttgcaccggcagaattctggactacagtaggtgcatcaccagaacaattttcaaatctaacagtatcaaatttcctcgttgataatttattgccagtcactatcggtaatattatcggcggagcagtcctagtcggtctggtatactggttaatgcatctgcgcggcgataaacattaa

SEQ ID NO: 1204 - DNA, 444 bp, Proteus mirabilis
tggaaagttagtcacaatcttcggagtattatgatgaaattgattaccattagtgcgggttatattgatagcttttgggctccaatatgtgaaggaagaatcatccctaatgaatttataggattaaatctgaataattatgagagtgcacaaaaattaattgaagaatatttaattccaaaagcgatgaaattcaaatcaaaatcatggcattattattttaaagaaacattaagatatgcaattaacttttggagtaatgagcgattgtataatatttatatgggggtattaccagaaatacctccacctcaaagtaagtatattaaaatgaaagatttttatttgttaatttggacagtaatgtaccctaatgaagaatgtgttgtatatacccctgaactttataaagaagttccttccgtagaaataggctcattctag

SEQ ID NO: 1205 - DNA, 1212 bp, Proteus mirabilis
aaaatgagtagtgtagatattctagtaccggatctccctgaatcagttgctgacgcgacagtcgcaacttggcataaaaaacctggtgatagcattcaacgcgatgaagtgctggttgaaattgaaacagataaagttgtgttagaagtaccggcgagtgaagctggggtgctggatagcattcttgaagaagaaggcgctacggtaggttcacgtcaattattaggacgtattcgtcttggtgatagcactggtattcctgcggatgtgaaacctgcacaagatacgacgcctgcgcaacgtcaaagtgcagatattgttgcgaaagaaagcaatgatgctcttagcccgacagcacgtcgtttagtcgctgaacatgatattaatccagcagatgtaaaaggcagtggtgttggtggacgtttaactcgtcaagatattgaaagccatgttgctaataataaatcagcaacagcagccaccgctgaagtttctcaagctccattatcgcatcgtagtgagaaacgtgtaccaatgacgcgtttacgcaaacgtgttgcagagcgtttattagaagcgaaaaatactaccgctatgttgacaacgtttaacgaaatcaacatgcagcctattaaaaatttacgtgcgcaatatggtgaagcattcgaaaaacgccacggtgtacgtttaggctttatgtctttctacattaaagcggtagttgaagcgttaaaacgttatccagaagtcaatgcgtctattgatggtactgatgtggtttaccacaactattttgatatcagtattgcagtatcaacaccgcgtggtctggtaacaccggtattacgtgatgcagatgcgatgagcatggcggatattgagaaaaatatcaaagcattagcagtgaaaggtcgtgatggtaaattaaccgttgaagatttaacgggcggtaattttactattactaacggtggtgtttttggctcattaatgtcaacaccgattatcaacccaccacaaagtgctattttgggtatgcatgcgattaaagatcgcccaatggcagttgatggtcaggttgttattctacctatgatgtatctagcactttcttatgatcatcgtttaattgatggccgtgagtctgtcggtttcttagtgaccgttaaagaaatgctagaagatcctgcccgtttattactggatgtgtag

SEQ ID NO: 1206 - DNA, 414 bp, Proteus mirabilis
ccaattatcaggcttgagatattttatagtaaaggtaggaatatgaacaaaatcctaaggcagtatcgacatatgaaggtgcctttatttgaatctggatatattatctattgtggctcttgggatgattggcgctctctacatgaaaaactaggcattgatggtggggatagttttgttaacggtgcaagtcatactgttactaacactcagtgtgtactccatattattggtgtgtttaacggtaaattatctactctagctcacgaatgcgcacatatagcgttcgacatttgttaccgcgtcggtgtgagcgttgaaacaggagccgcgaatgaaacattttgtcatcttattagtaggatggtggatttctgtgttaaacccaaaaaagccgacgtaggccggctttaa

SEQ ID NO: 1207 - DNA, 297 bp, Proteus mirabilis
  unsure (160): Identity of nucleotide at the above locations are unknown.
tttgtgatcagtattatggaaaacacagcaccacaaacctctcttagtaaaggccttattttacttatggccgttgccactggcatggttgtcgcaagtaactattatgcacaaccgctacttgattcaattgcaaattattttcatatctctgccactntagctggctttattgttactacagcacaattaagttatgccttaagtttaatgctattggttcctcttggcgatatttttgaacgtcgttcactgattgttatcatgacgcttattttcaagcgagcggcttattaa

SEQ ID NO: 1208 - DNA, 1461 bp, Proteus mirabilis
caaattgtcagtacattgagactggcaggtttatattcagacgggagttatttcatgtcaaaacagcaaatcggcgtggttggtatggcagtgatgggacgtaaccttgcgctaaacattgaaagccgtggttacactgtatctatctacaaccgctcgagcgataaaaccaatgaagtgatcgctgaaaatccaggtaaaaaactggttccgaattactctattgaggaatttgttgattcattagaaaaaccgcgtcgtattttgttaatggttaaagcgggtgaagcaacagataaaaccatcgcagccctgacaccacatttagataagggcgatatccttattgatggcggaaatactttctttaaagatactattcgtcgtaatcgtgagctatcggctcaaggttttaactttattggtacgggtgtttctggtggtgaagaaggggcattaaaaggaccttctattatgcctggtggtcaaaaagaagcctatgagttagttgctcctattcttgagaaaattgccgcggtggcagatggcgagccttgtgtcacttatattggtgcagatggtgcaggtcactatgtgaaaatggtacacaatggtattgaatatggtgatatgcaactgatagcagaagcttattcagtattaaaacactcactaggtttaactaacgaagagttagctgacacttttaccgagtggaataaaggcgaattaagtagctaccttattgaaattactgctgatattttccgtaagaaagatgaagaaggtaactaccttgttgatgttattcttgatgaagcggcaaataaaggcaccggtaaatggactagccaaagctctttagacttaggtgttcctgttacgttgattacagaatctgtttttgcacgttatatttcttcactgaaagatcaacgtgtggcggcatctaaagtattatcaggcccagcaccaaaagcatttactggtgataaaaaagcctttatcgagaatgttcgtcgtgcactatatttaggtaaaattgtctcttatgcgcaaggcttccaacaattgaaagctgcatcagatgaatataactgggatctaaattacggtgaaattgcgaaaattttccgtgcaggttgtatcattcgtgctcaattcttacaaaaaatcactgatgcctataatgacgatgcgaatatcgctaatttattattagcaccttactttaaaaatatcgctgatgagtatcaacaagcattgcgtgatgttgtttgttatggtgttcaagcaggtattcctacgccaacattctctgcggctatctcttattatgatagctaccgtgcgcaagtgttaccagcaaacttaattcaagcacaacgtgactattttggtgcgcatacttataaacgtactgataaagaaggcgtattccatactgagtggatggagtaa

SEQ ID NO: 1209 - DNA, 750 bp, Proteus mirabilis
ggtaattacagaatggataactatgaagattattatactcagtctgctgaaatgtatgatattttaagcgaacctcattgggaaaatcgtaaagatacatttataaaatccttgaagtttatgggaataaaaacaggcaactggttaaatataggttccggcactggccaagaattaagtataattgcgcaaatgtttccagacatacatatttttgcaattgaaccgtctgcatctatgcgtattggcctaatgacaagaattatgatgttgcctgaaatacaacaccaagtaactgtgattgctgatacatttcaaaataccattctaccaaaatcattttctgccgctattatatgtggctgtataggatattttaatcagaatgatagaaaaatattatggaataagcttgcaaatgggctagaaaaaaaaggtgctattttggtagatacaatgccgtttaatacgccttgtaacatttctaagatactactaaatagcaaaaaaatagggaaccatatctatgaaatttatttaagtggcaaacctatagatcaagaagttattcgttggaatatgaattttaaaatcatagaagacgataaagtcatacgaaattttaatatagaaagagattggtatacttttggaattgaacaagtaattaaggaggcatcaaaagaaggattggtccatgaaaacattagctcaagtactgtaccaatgacaatcctccgccataaataa

SEQ ID NO: 1210 - DNA, 879 bp, Proteus mirabilis
gttttatacagaatattttgtaatagaaaagaaaccatagtagatttaaatttacaaattgattgcttcattgcaatctacaatctagtttatcaacaaattttaagccttttttttgataaaaccatgaccagtcacgcaaaacaattaatcatatttttaacaataatattaacctcattatttgttaacgctgaaaatagttcaaaatttcttatcaaacctgttaaaaaaagtacaggagagcccatctatattcaaatatttaaagaagaaaacttactagaactgtatatagaaaaacaggatggacaattagagaaaatacgtacttatcccatttgtagctattcgggaggattaggtccgaagaaatatcaaggtgatttaaaaagtcccgaaggcttttatcaagttaatcaaactcagcttaacccaaatagtcggttttatcgagcaattaacctaggatttcctaatcaatacgatcaagagcaaggttataccggtgatttcttgatgatccacggtgcttgtaaatcagtgggttgctacgcaatgaccgatactgtgatggatgaaatctaccaatatgccgaacttgcgctgaaaaatggccaacagagcattaatattcatattttcccttttaaaatgacagccgaaaatatgaaaaaattccaatactctgcgaatatggatttttggcaacagttagcacctgcttaccaatatgtggaagaatacaaaaagatcccatcgattagtgtaaaaaacggtcgctatttggtgaataatcgtgaggctatttctacattaaatttagctaaaagtatcgatagtaaatggttacaaaattcgcaacccacgatcaaataa

SEQ ID NO: 1211 - DNA, 768 bp, Proteus mirabilis
cccttaaacaggatcacggacaaaacgtttggcctgaacttcatgcccttggcttattattatgtggaaaagcattaccggaaggatttattcgccatggctagcaccaataataacccccctttaattcatcaagccattgctctatatggtggtacttttgatccgatccattatgggcatttacgtcctgtagaagccctttctggcttgatagggctaaaagaagtgatttggttgcctaataatattccccctcatcgcccccaaccagaagcctcttcacaacagcgattagccatggtgcggctcgcattacaaccttttagtgctttcaaagtcgacactcgagagttagagaaaccgactccctcttataccattgagacattaaaagcgtttagacaagaaattggtgagaaacagccattagcctttattattggacaagattcattactttcaattgatacttggcataaatgggaagagttgttagatgtgtgtcacttattggtttgcgctcgcccgggttaccaaaccacatttacatcaccacaaatgcaaacctggcttgaacaacatcaaaccaaacagcaagcagatattcactgtttacccgccgggaaaatttttcttgctgatactcctttatacaatatttcagctaccgatattagggctagacataaagcaggattagattgtcatgatcttctgcctgagtctgttgaaaactatatcaaacagcatcagttgtatcgataa

SEQ ID NO: 1212 - DNA, 552 bp, Proteus mirabilis
cgtcaatgcagaaaagcactcttatttttagcgcgtaaaggttatttaatggacgctgttgttactatcgatctggatcagctgaaatcttggctggatgaattacagattgctttctatgaatgtgactcttgtcaggcgttacatttacctcatcttcaatatatcaatggtatttttgatgctaaaattgatgtgcttgatgatgtgcttgtttttaccgctattgctgaattaaaaccatcagcgatagtgcctgttatggcaaatcttagtcaaattaatgcaagttccctatttattaagacgttcctagaaattagcgatgaaaacttaccgaaattagttttgagccaatctttacctattgctgtgggactatcatttaatcagttcgagctgtttttacataaggctgaagagcagtcagcagaagtgatcagtgagatctttaataatgattttctgtatggcgaaagacaagaaaatgaagaagatgaagatctagacataacatcatcatcaacagactcttcatatactgtacattaa

SEQ ID NO: 1213 - DNA, 1551 bp, Proteus mirabilis
acaaaatgcaggatgataaagcgaggtgtaaaggtgattaaagaacccttacaaggaggaaaacttgctataatgaccatcgcacttgcgctggccacttttatgcaagttctcgattcaacaatcgctaacgtagccatcccgacaatagcgggtaacttaggtgcatcaaattctcaaggcacttgggttattacctcatttggtgttgcaaatgctatctcaattcctattactggctggctggcaaaacgtattggtgaagtacgcctctttatgtggtcaacagcactatttgccttaacatcatggctgtgtggtatttctcaaagtttagaaatgctgatctttttccgtgtacttcaaggtttagtcgcaggccccttaattccattatcacaaagtttgctattgaataactatccaccagcaaaacgcaatatggcgttagcgttatggtcggttaccattgtcgttgcacctattttaggccctattttaggtggctatatcagtgataattaccattggggatggatcttctttattaacgtaccttttggtgtgttaattattatgtgcatctcaaatacattagcgggtcgcgaaaccaaaacggaaattaaaccaatagataccattggtctcgtactattggtggttggtgttggtgcactacagatcatgcttgatcaaggtaaagagctggattggtttaattcaactgaaattattgtacttactattattgctgtagtggcgttaagtttcttaattgtgtgggagttaactgacgaacaccctgttattgatctttctctgtttaaaagtcgcaatttcactattggctgtttaacccttagtctcgcttatatgatctattttggtactattgtgttgctccctctcctgttgcaagaagtctttggttataccgcaacatgggcgggtttagctgcagcctctgttggtttattaccgctgatcattacaccaatcatcggaaaatttggtggaaaagtcgacttacgctatatcattagctttagctttattatgtttgcggtatgtttttattggcgagcttatacttttgaacccggaatggattttgccacagttgcttggccacaattctggcaaggtttaggtgtagcatgtttctttatgccattaaccacgatgaccttatcgggattacctccggagaaaatggcctcggcatccagtttatctaattttttaagaaccttagcgggtgcaattggcgcatcattaacgacaacaatttggacacaaagggagtcattacatcatgaaacctttgttgaaaaaattaatccactcgatcccgatgcacaattggcttttcaacagatgagagaattggggctttctgatgaacaaacctcggcttatttagctaaaacaatcactgaacaaggtctgattatttcagcgaatgaaattttctggctagcggcaggaatattcattttaatgctggtggttgtttggtttgctaaaccgccattctcaccgggtaaataa

SEQ ID NO: 1214 - DNA, 492 bp, Proteus mirabilis
aaaaaattaagctcagggcaagctattttcttatatattatgactgaaattattgctaatataagatatgactcattaataatttttgatgaaccagaaacacacttacaccctaatgccatatctcagttaattaatagcattcactctcttgctgatcaatttaaatcttactgtataatagcaccccattctccaattattgttcaagggattttatctaaaaatatttttgtcataaaaaatgaaaataaagtattaagtgtaacacatccatcgctggaaacatttggtgaaaacttgtcaaaaattactgatgatattttcggtgcgagagatacaccacaatattttagaaaaaaaatagaagatcaaattaaaattggatatagtattgatgatattagaaaatccattcaatctgatggagttcctcttagtttaaatctttccattttattacaaaacatggagatcaaaaataatgattaa

SEQ ID NO: 1215 - DNA, 201 bp, Proteus mirabilis
cgaatgctaagaatgaaattagtcacttgcgtgatattagtgagcgtcatccagagcgggtgtacatcaaagccgagtgccccaaagtcaaaaccactccctccaccagcttggcttatgcaaccaccgcccgacctactgacaccgctatccgaaattattggttactcagagagcgaattgcagagtcagaacagatga

SEQ ID NO: 1216 - DNA, 222 bp, Proteus mirabilis
gagaagctaagtatggagacaggtacagttaagtggtttaacaacgctaagggttttggtttcattacccctgccgcaggtggcgaagatatttttgcccattattcatcaataagaatggaaggctaccgcacactgaaagcgggtcagaaagttaattatagcacaataaaaggacctaaaggggatcatgctgatcttatcattcctattatcgaataa

SEQ ID NO: 1217 - DNA, 252 bp, Proteus mirabilis
gtattcataagatcaacaaaggtttcttggctaccggcaacatgttctgccaacgcaatactggcatcattaccagattggatcaccatacctcgatttaagtcgatcactttaactcgatcgcctggttttaaaaacatcaaggatgagccctttaaaacaggattacccgtcgcccaagcattgcgcccaacaataacaatatcatcgggcgacatacgtccctcttttatcgcttgtcctaccacataa

SEQ ID NO: 1218 - DNA, 1086 bp, Proteus mirabilis
gctgaaataagtttggataatagcgtgggaaagaagacgaaaccaatccgaagtaaattgagcggttcagttatcttgtctactgtcttgcatttactgatcatcgctttgcttatctggggatcgttaactcagaaatggaatttaggcggtggcggtggatctgatgggcaagttattgatgctattatggttgaccctaatgcggtagtacaagagtataatcagcaaaaggcgcaacaagctaatgtccaaaaagcagaacaagaacgtaaagcgcgggcgcagcaacaagaagaagagctacgccaacaacaaattaaagaacaagaacgtttaaaagcgttagaagtggaacgtttgcaagcaaaagaggctgcagaagctcaacgtcgtgaagcagccaccgccgctgctaaagcgaaagaagagcaaaagcaggctgaagaagctgccgcacaagctaaagctgaacgcgatcgtattttaaaagagcaagctgatgcgaaagccaaagcagaggcagaagcgaagaaacaagcagaattagcagcaaaacagaaagcagaagaagcgaaggcaaaagcagaagctgaggcaaaagcgaaggctgaagccgatgctaaagcgaaagcagaggctgatgcaaaagcgaaggcagccgcagaagctaaagccaaagcagcagcggaagctaaagccgctgcacagcaacaaagtaaagcggttgatagtctactcgatggattagttgctcaaggcgataaacaatcgggggcttctgcagcaggtcaaggtggtggtaatcgctctggggcaaatgctgcgggcattgatcgctatactgggcaagtaaaagttgccatcgaacagaagttttttgattctgatttatataaaggtcgtaaatgtgaccttaaaataagtattgcaccagacggtatgttagtaagtgcaaaagcggtaggtggtgatccggctttatgccaagttgcattacaagcggctaaaatggcaacattgcctaagccaccgaaagatatttacgaacaagtaaaatcaccaacaattgagtttaagccataa

SEQ ID NO: 1219 - DNA, 1041 bp, Proteus mirabilis
aaaatgataagaaaaacattgttagccagcttattaaccgtaattagtggtaccgtttttgctttacctaatgtgacaatcctcgcaactgggggaaccatcgcagggggtggtgactctgccacttcttcaagctacaccgcaggaaaattaggcattgatacattgattaatgccgtacctgaggcaaaaaaagtggctaacttaacaggcgagcaagtggttaatattggttcgcaagatatgaacgaccaagtgtggttaaaactggcgaataaaattaatacggattgtgataaaacagacggctttgtgataacccatggtacagatacgatggaagagaccgcctattttcttgacttaaccacagcatgtaaaaaaccggtggtgatggtaggggcaatgcgcccagcaacagcattaggtgctgatggtccattaaacctctataatgccgtggtggtggcaagtgataaagcatctgaaaatcgtggtgtattagttaccatgaataattcagtgatcagtggtaaagatgttgtcaaaatgaatacgacagaagtgcaagcattccagccgattaatgcaggtgctcaaggttatgttcatgatggtaaagtacactattacactgctgcaacaccgcgcgctgagaaagttgcctttgatgtcagcaaattaaccgaattaccaaaagtaggtattgtttataactatgctaatgcatctgatttaccggctaaagcgtttatagataaccactttaaaggtattgttagtgcaggtgtcggcaatggtaacttatattctgacatcttaaatactttagctgatggtgtaaaaaaaggtgttgttgtggttcgttcaagtcgtgttccggttggatttaccacacaaaatggtgaagtagatgatgcaaaatatggctttattgcttcagaacgtttaaatccacagaaagcaagagtgttattacagttatctttgacagaaacacaagatcccgccacgatccaagaaaactttgaaaaatattaa

SEQ ID NO: 1220 - DNA, 2139 bp, Proteus mirabilis
aggtatgcaagttgcagctttaaccccagaacatttcgcacagtggctagcagaggtaatgcaatgagttggcagaccgtttattttcattatgatgaagatgcgcttaccgtctttgctaatgccggattattaagacgcgcaagaaaagatgttgataacgaaaaagtctctgttactgatgcaaatacagggcaatttagcagtgatgggcaaaaagtcgttttacatgaagcaggcattcagcaagccagttgtgattgttccgcagcaggttgttgcaaacatattttagccgctattttatggttacaagccaacaacaattcgactgatgatattaatactgataatcccattgaaacatcagcagaaaaaattatagcgcctgttgaaacaccgcctttattaccctctttatttacgcttgatcccgagttactcatcaaaaaagcaggtaaacccgcctgtcggactgcgattaacttaattgaacaatgggaagataaaactttagttctagaagacacaggaacccagctaaaaatccaactccctgatgttgatgaaccggtcattttcttacaagcaagtggttacgatggcatgttatcccctttttctagctctcagaaaaaagcttttcatcttgctattgtcgcgaaaatatttgagcaaaatacacagccttggacgtggcctgaagatttaattcccttaaaatcttcacaacgcccactaaatgatgaagaaattgcccttattaatactattgaacaatttattgatgatctattacgtcaagggctatcacacattagtttaagtagcgcaacgcaattacatttacttaatatgtctgctcgtgccgagggtttacctcgtttagcctcttatttacgaacattaagtactcaagtcaagcggttagcagaaagacatttcactatggatgaaagcaatgtcttacgtctattagctcatatctcagcctatcttttccagctatcttatgcgacacctgaacaattaaaaacattacgaggacaacttcgccgtcaatatgatgataaaaaaaccagtctcgcgcttattcctattgatgcacattggtggacagcacaaagtggcgcattaggcacaacttttactttctgggataaagaagcaaaacaatttttacaagcgacacaagctcgccctaatcaacttgataccctatttaatcgctatagtgtttggcatagtttatcgttatggaaacaaactgcagataagctcatgcgccgacctttcttattacaagcgcctcgtatttctgatgaagggaaactagctactattggcgatagctttgcgcaaaatcaaaccgattttcttgatgtcacagattatcatcaactacaaacagaattaggtattcataactggcaagatttacccaattattttacggatcaaccagaaggatttctttcccctctggttttacatatcaaaagctataatcccttaatttggcatgaagtagagcagtgtgttatttgggaagtggtagataataatggaaattcggcctttttgcgcctttattgggaaggcgaaacgcaaaataatttagaagaattacgttttctcactaaacgagaattagaaatcgttgcgatcaccgtgcaacctgttcgacgtgatttcaatatcgatttattacccaccaccatttggatcaaaacagagcaaggcattgaaatgttttatctcgattttgaccaatttccacgtaagaaaaaacagtctggttttattagtcatattcaagaatatatggctaaacgtaagcgacaaacggcaatgcatcacagtgaacctacccttgcacaaaaattttgtcgccccattttatccgtattggaagcccaagcatgtacagggcgagaacaactttctgcaatgcaaaaagagcaattagagagaagcaaacaaattgctgacgatttaggtatgacattaatagctaaccaattaactcgttatctcgctttaactgctcgtgactctcaagctttattacagttaatttggctatgtgataatctgcaacaattacaaagcccgctacccattcaacttaatgaataa

SEQ ID NO: 1221 - DNA, 210 bp, Proteus mirabilis
tttaaacaaaggatatatttgcaaggatgcaaacaggagatagatatgactattgaacagttacaagaagaaaatgcgaagttgaaacaagcgattattgacatctacagtaattgcgaggaatgcgaataccaaggttatggaacattctacgctgtagagcaagaccatgttaattcagcatacgaactaacgcaaacaacggattaa

SEQ ID NO: 1222 - DNA, 1152 bp, Proteus mirabilis
atggaacaaagttcacgtcaacgcatcgacgctttagatgcgttgagaggaatagcgatccttggcatcttattactcaatatctcaggttttgccttattaagagttgcctcatttaatcctatgcattcaggagaggcgacttttgcggacaaacttacttggatggggctaaatttatttacccaaggaaagtttctgtttatttttgcgctgttatttggcggaacactttatttattatcacaacgctctgttgcttggaacgtctctcgcctaattattctggcattaatcggtattattcataccctattactatgggaaggggatatcttatttccttatagtatttgcggattatttgttctcttttttattaaagcattacctattaagcggcaatttatccttgggctggtgctctatttatttggcgcgattattttagcttttttattttattactatcgtgattttgttgaaatagtttggtatagctctgactattccgccatgatagagactaattggaaaaccggaagctatataaatagtatctactggcgattagatgaactgagtgattttatttttaatttagttcgtcaatatagttggtttttaattggcgccatgttaatgggggcggcgttaatggcatccggttggttacaacgacgctattcacagtctcattatggtttgatagcggtttgttttttagtcataagtttacttttccaagggacgcttgttattaccgattattatttagattggcattatatgtggtctgcggtagtggctcagcctatcaccatggtgatccaaattattcaaagcttaggttatattgctttactctattgggcatggccttatattcaacacagttttatcgcctatgctttacgttgtgtggggaaaatggcgcttaccacctatttactacagagtattattggcacgacgcttttccagcggatggggttatttaaccaatttaccttattgcagcttatgctatttgtgatggctatttgggtgataaatattatctttgccgtaacgtggttacgctatttttctcaaggaccaatcgagtggctgtggcgccactcgtcaacagggttagcaaaacgcttttaa

SEQ ID NO: 1223 - DNA, 519 bp, Proteus mirabilis
tttaaggggctttgtgcccctcttttttttgaggtgagcatgattgatcctgataagaactctccaatatttaatagctacgcaagtgtggatgatttgaagaaatacgctgaggatagaaatatcactttggcagatagtggattagaggcattactaattacggcgatggattatcttgaatcgcaaaaatggttaggtaaacgaactaacctaaatcaacctttatctttccctcgctcagggctatctcgcgacggtgttgccatcccaagcgatcagataccaaagcaattaatccaagctcaatgccgtttagcgattgaatcagtagaaaatgacctacagcccacgttaggcgctgaaatcacctcagagcgaattgagggcgctattactgtgcaatatgccgaaggcactaatactggcgcaccaaactttccttggttaaaaggtttattgtctggcttgattgatgtctcggatggatttgccattaatacatttgcaatgaggtag

SEQ ID NO: 1224 - DNA, 1173 bp, Proteus mirabilis
attactaaaaggaagtcaataatggccagttcaacattttatatcccttcagtaaacaaattaggcgcaggttgtcttgcagacgcgataaactcaatgaaagactttggctttcataaagcactgattgttactgatagtgttttaaatcaattaggtgttgtaaataaagtgagtgaattactggcgaaatcaggtattgctagcgttacttatgatggtacagcgccaaaccctaccgttgaaaatgttgaagcggggttagccttattaaaagagcatcaatgtgactgtgttatctctttaggtggtggctctcctcatgactgtgctaaaggtatcgcactagtcgctgccaatggtggtaagattgccgattatgaaggggttgatcgctctgagcatccgcaattaccactgattgcaattaatacaaccgctggtactgcttctgaaatgacacgtttttgtatcatcacggatactgcgcgtcatattaaaatggctattgttgataaaaatgtaacaccaatcttatctgtaaatgattcagagttaatgattggtatgccaaaaggtttaaccgcagctacgggtatggatgcgttaacccatgctgttgaagcttatgtctctactgccgctaatcctattactgatgcatgtgcgttaaaagcagtgacgatgatcagtgagtctttacgtaaagtcgttgaaaacggtggtgatacagcagcacgtgaaaatatggcttatgcacaatttttagcgggtatggcatttaataatgcttctttaggttatgtgcatgctatggctcaccaattaggtggtttttataacttacctcatggtgtatgtaatgcagtattactgcctcatgttcaagcttataacatccaagcagcagcaggtcgtttaaaagatatagcgcaagctatgggtgttgatgtttcggcaatgaatgatgagcagggtgcgcaagcttgtattgaagagatccgcaaaatcgccaaagatgtcggtattccagcaggcctgaaagaattaggcgtgaaagaagaagatttcaaaacattagctgaaaatgcattaaaagatgcatgtgccatcactaaccctgttcaaggtagtgaaagtgatgttatcgagatattccgccaagcaatgtaa

SEQ ID NO: 1225 - DNA, 1296 bp, Proteus mirabilis
ggtagcaaaaggaactcaattttggagcatgtgtcgacaacaacgctcattatcatacttatcggtatgatctttgcctcagcctatttttcaggcactgaaactagcatgatgactatcaatcgttatcggctacgccacgcggccaagcaaggtaatcgctcagccaaaagagtagaaaaactattacagcgtcccgatagattgattagcttagtattaattggtaataacctgattaatattgtcgcctccgctctcgccactattgtaggaatgcgtttatatggtgatgcaggagtagctattgcaacaggtgtattaacctttgtcattcttatttttgctgaggtactaccaaaatctatcgcagcgctttatccagaacgtttcgcttatccaagtagcgttcttttgtcacctttacagaaaatcatgttgcccgttgtgtggttttttaaccaaattactttggtgtttatgcgcattttcggtattaaatcccccgtaatacagggtaatgcggtatcaaaagaagaactacgcaccattgtgaatgaatcaaaatcgaaactgtcacagcgtaaccaaaatatgctgatttctattttggatttagaaaaagtgactattggcgatattatggtgccgagaaatgaaatttttggtattgatgtcaatgatgagtggaaatccattgtcagacagttaactcactcccctcatgggcgtattgtcctttatcgtgataccctcgatgacgtcattggtatgctacgagtacgcgaagcttaccgtcttatgacagagaagaaagaatttactaaacaaattttgattaaagcggctgataaaatctattttatcccagaaagtacaccacttagcttacaactagttaattttcaacgtaataatgaaaaagccggtattgtcgtcgatgaatatggtgaaattcaaggattagtcactgttgaagatatcctagaagagattgtcggtgattttactacctcaatgtctccttctttagcagaagaagtgatcccacaaaaggatggttcactattagtggatggcacaaccaatatccgagatatcaataaagcctttgcttgccatttaccagaaaatgaagcacgaacaattaatggggttattattgaagagttgggtgatttacccgtagtaggtgccaaaataacgattgatggttatgaatttgaagtgttggaagtgcaagacaatgtgattaagaaagccttgatccgccatcttacgccctctcgtcactag

SEQ ID NO: 1226 - DNA, 960 bp, Proteus mirabilis
attataaaaagttatatttataaacaattaattatttttaaggcagagaaaaaaatggaacaagataatagttcatcgcttacggagccagaagaggtgtttacgccagttcctctacaaagaggtgcttcaggggcaaccgagtggttaggtattggctgggatttagttaaagagcgcttttttatgtgggtaggcgctgtaattatttactttcttgttaacttaattatctcatctatccttggatttatcccacttattgggccgattatctccccgtttatttcagctgtattagttgccgggcttatgatgatagcccatcagcaatatgagactggtcagctaaatctggataatttattttctggtttccagaacaaacgctaccttagcatcatgggtgcttatggtattagtgtgcttattatcttagcaggctttattttagcactattaatcagtggttcattattgatggaagttgctcaagccgctcttaatgatgcaccaacctactatattcaaggcttattggctgataacctgacaccaattacgttttcttctatcattattatcatttttagcttaatcagtactgcctcttattggtttgcccctgccttaattttagtaaatgactataaagctatccctgccgttaaagccagttttatggcggttaaaaacaacttatttggtggctttctattctttgtgctgttaagcatcattattggcttgagtattatcccatttggattaggcttatttatcactattccactctcttttactgcaatgtatggatcatatcgccatattttctatcagaaaaatatgggtaatatgactaataaccatactgataacaatgacaataatggtgatggtgggaataaagtttctttaaataaaaccgcagaatcgaatatcggtaaattagtcagttaa

SEQ ID NO: 1227 - DNA, 2412 bp, Proteus mirabilis
atcaaaaaaagctatgtaatgataataattatcattaacatgattgtgttgttaaatgtatttttagctatttatttgcgtattaataaccatataaaagatactattatgaactttttgttaattaagcatgagcctcattttcagggaatgggggccgtttcattttcatctcatgcgatttttttattactcactacacttgcttcgtttaatagcgttgcttcacaaagcacagaaaaagcatcacaaactcaacaatctgaaactgtggtgcttgatcctatttatgtttccggaaaattaaattcgagtgttgaagcaggaagcacggctttgacattaaaagatatcaatagaattcagccaaataatatcgctgaattggtagataaattaccagggatttcttcatctggctcgccaagacctggcgggcaaactttaaatatttggggaatgggcaatccggaagatgtgaaaatcactcttgatggtacaccgaagacgtttgaaaaatatcgtcaaggttccatatttatcgatcctgaattaattaaacgccttgatgtcgataaagggccacataatatcacccaaggaaatggaggatttggtggctccgtacggattgaaacgaaagatccggatgacttactgttacctgatcagcatattggtatgtttttaaaatatggacatcataccaatgataggcaaaatcgttatagtggtgcgatatatggcaagctaatggatggaacggctgacggtctattttattttaatcgtcgtaaaagcgatgatttacgtcgtcctgatggcactaaatttggttattcacaatcagatcaagattcgtttttaattaaaaccaatgtctatttaacagacgcacaaacattaactttatcagcatcaagatctgtcagtgatggctggacgccttgggctgcgaagcgagatgaactggcaaaaccgagccaatatgatgttgataaatatggttttgatggagcgatgaaacgtaagttagtttatcgtgaccaaaaagatgacactgtgagtgtgaaatggaatattcagccaattgattctgacctgattaatttcacattgacttacggttattcaaataccaaacagaatgataaacgccctgataatgcgagttcttatctaagtagtagtatgggtaaccaaagttgggttaactataaaaatcatcaaattgaagtgaaaaatgaaagtaccgtgatgcaaggagctaccgaacatgtgattttagtaggagcgcgttggcaccgtaatgatcgtaatgtgttaatgtttacgcgggataaagcgaaaaatccaaattataattatggctattatgcaccaccttatatgccagaagggacgcaaacaaccacgagtttttatcttcaagattcaattagttatcgaacactaaccctcacgcctggtgtgcgttatgatatagtgaaaaatcaaggagtagggagtcgagcgaaggtttatcaagatcctaatccctattacggtcatgattatagtgatgtaacttatcgtggcattacacctcatttgggtattttatggaaagcgacccccaatattagattttttggtgatataactcatacatggcgtgcgccgttaattgatgaacaatatgaagtgcaagccagtatctctagtttgacaggcacgagtcgccatttagataaagagaccgttaccgcaacacggattggcgccattgttgattttgaaaatgttttccaacaagaagatcagctgcaacttcgaagcacattttttgatactcgtgggaaagatgagatattccgtcgtcgcggtgtctattgtgaaagcggaaaagtaaccggaaacaatggaagttgtcctccttcccttggaaattatcgcaatttacctggctaccatattcaaggtatggaaatagaggcattttatgacagtgctaatctctttggtcgcttagcgtattcgacaatgaaaggtaaacgcgatcaatctcctcgtgatccgtggtttggacaaaaaacatggattgcagaaattcaaccggatgcattacatgccacccttggaatgaaaatcccacaaataaatatggttgcagggtggacaggggactttattggcgctcaacgtcgttcaccgatggatgctgatccggctgctacttattggtcattaccaaaaagtaaaggctatgccattcatggactattcgctaattggaaacctgcttttatcgataataccgagatacgttttactgtcgccaatttatttaaccgtgattattacccttatttaggtgagtcggtatctggtactgggcgagattatcgctttactgtggttaaaagtttttaa

SEQ ID NO: 1228 - DNA, 411 bp, Proteus mirabilis
ggaaatgaaagcatgataaaaaaacttaaagtaatcatgttagcggcaatagttaccagatgttcatcgccaccacctcccgttcctgtaaagtgggataaaaccgctgccccattaaatacccgtttacctcaatggagtgacaataacgttatagtcccttccccgagagttaacggtaaatggacatcatcaatcagcgcacaaagtttctacgatacaatatggactccggcagtattttacgcagtcgcccattcaacacaaattgtcgtcactgcacaatccggcactgatttctttaatgccaaaaactggcttcgccagaatggcgcaaaaggtgttattgaataccagcctgtctttaattgcctgacatgcaaagaaaccactatttatttctctcgttaa

SEQ ID NO: 1229 - DNA, 2298 bp, Proteus mirabilis
aaaggtagaagtatcatgtctgatttaaatgaaaaatttgctgaagcatggaaaggtttttctgaaggtgaatggcagaacaatgttaatgttcgtgactttattcaaaaaaactatactccatatgaaggcgacgaatctttcctagcaggttccactaaagcaactgatacactttgggaacaagttatggaaggcatcaaaattgaaaaccgcactcatgcgccggttgattttgatacttctgttgcttcaactatcacttcacacgatgcgggttatatcgaaaaagatttagaacaaatcgtcggtttacagactgatgcacctctaaaacgtgcaatcatcccattcggtgggatccgtatggttgaaagttcttgccacgcttataaccgtgagctagatccagagctgaaaaaaatctttactgaatatcgtaaaacacacaaccaaggtgtattcgatgtttatactccagacatcttaaaatgccgtaaatcaggtatcttaactggtctgccagatgcttatggtcgtggccgtatcatcggtgactaccgtcgtgttgcactgtacggtatcgagttcctacgtaaagacaaattcgctcaattcacctctttacaagaaaaactggaaaaaggtgaagatctggaaatgactatccaactgcgtgaagaaatcgcagagcagcacgctgcattaggtcaaatccaagaaatggctgcgaaatatggttgtgatatttctcgcccagctcaaaatgcgaaagaagcagtacaatggacttacttcggttacttagccgctgttaaatctcaaaacggcgcagcaatgtccttcggtcgtgtatctactttcttagatatctatatccaacgtgatctcgatgcaggtctgttgactgaagaacaagctcaggaattaattgaccacttagtcatgaaattacgtatggttcgtttcttacgtactcctgagtatgatgaattattctctggtgacccaatctgggcaacagaatcattaggtggtatgggtttagatggtcgtactttggtaactaagaatactttccgtttcttaaataccctgtacaccatgggtccttcaccagaaccaaacatgactatcctatggtcagaacaactgcctattaatttcaaaaaatatgcagctaaagtctcaatcgatacttcttcaatccagtacgaaaatgatgacttaatgcgtcctgacttcaacagtgatgactatgcaattgcatgttgtgttagcccaatggttgtgggtaaacaaatgcagttcttcggtgctcgtgcaaacttagctaaaaccttactgtataccatcaatggtggtgtggatgagaaactgaaaatccaagtaggtccaaaacacgcacctatcatggacgaagtgttagactttgatactgtgatgaaccgtatggatcaatttatggattggttagcaactcagtatgttactgcactgaatgttatccactacatgcacgataaatacagctatgaagcagcactgatggcacttcatgaccgtgatgtataccgtactatggcttgtggtatcgcaggtctatctgttgcggctgactcactgtctgctatcaaatatgcaaaagtttcaccaatccgtgatgaaaacggtttagccgtagacttcaacattgaaggtgaatacccacaatttggtaacaacgactctcgtgttgatgatatcgcttgtgacttagttgaacgtttcatgaagaaaattcagaaactgcacacttaccgtaacgcagtgccaactcagtcaattctgaccatcacttcaaacgttgtgtatggtaagaaaacaggtaacactccagacggtcgtcgtgctggcgcaccattcggaccaggtgctaacccaatgcatggccgtgaccaaaaaggtgcagttgcttcattaacttcagttgctaaactgccatttgcttacgcgaaagatggtatttcttataccttctctatcgtacctaacgcgttaggtaaagatgatgatgttcgtaaagcaaaccttgcaggtctgatggatggttacttccatcatgaagcggatatcgaaggtggccaacatctgaatgttaacgtaatgaatcgtgaaatgctgttagaagcaatggaagatcctgagaaatatcctcaattaactatccgtgtttctggttatgcagtccgtttcaactcattaactaaagagcagcaacaagacgttatcactcgtacattcactcaaacaatgtaa

SEQ ID NO: 1230 - DNA, 534 bp, Proteus mirabilis
aataggagaagatttgtggcaatccattcaagagctgggcaacatactcgtcaaagcgatctgattaatgtagcgcaattaaccgcacaatattattcactaaaaccgcaagcaaatcagaatgctcatcgtgtgaaatttggtacatcgggtcaccgaggcagtgccaaacgtcatagctttaatgaagcacatattctagcaattgctcaagctattgctgaagtccgagctaataatggtgtaacggggccttgctatgtaggtaaagatacccatgcattatctgagcctgcttttatttcggttttagaagtgcttgctgcaaataaagttaacgtgattattcaagagaataatggttataccccaacgcctagcgtttccttctctattttaacttacaatcaagggcaccaagacattgctgatggtatcgtcattacaccatcacataatcctcctgaagatggggggataaaatacaatccatcaaatggtgggcctgctgatactgatttacctctgggatga

SEQ ID NO: 1231 - DNA, 2052 bp, Proteus mirabilis
tttaatggaagtaagatccttactatgtctcacgtcgcgaataaattattggtaacctgcgcgttaccttatgctaacggttcaattcatctcggtcatatccttgaacacattcaggctgatatctgggtccgttaccaacgaatgcgcggcaaagaagttcatttcatctgcgctgatgatgctcacggcacgcctattatgctgaaagctcaacaattgggtattaccccagaagccatgattgaagagatgagcaaagagcatcaacaggattttgccggttttaatatcagctacgataactatcactccacacacagtgaagaaaatcgtcaattatcgacgaaaatttatctagccctgaaaaaaaatggtcatattaaaagtaaaacgatttctcaactttatgatgaagaaaaaggcatgttcttgcctgatcgttttgttaaagggacttgccctaagtgtaaagcgcccgatcaatatggtgataactgtgaagtatgtgggtcaacttatagcccaacagaattaattaatcctcgctctgtggtatcgggctcaacgccggtaatgcgtgaaaccgaacactatttctttgatctcccagcctttagcaatatgttgcaagagtggatccgctccggtgcattgcaagagcaagtagccaataagatgcaagagtggtttgacagcggtctgcaacagtgggatatcacccgtgacgccccttatttcggttttgaaatccctgatgcgccgggtaaatatttctatgtttggttagacgcccctattggttatatgggctcattcttaaacctatgtgaaaaacgtggtgatttaagctttgatgagttctggaacaaagagagcaaaactgacttataccattttatcggtaaagatatcgtttatttccacagcttattctggccggcagtgttagaaggtagtgaataccgtaaaccaaccaacctatttgtgcatggctatgtcaccgtcaatggtgcgaagatgtcaaaatctcgcggtacctttattacggcacgtgcctatcttgatcactttgatgctgattgcctacgctattactatgcagcaaaactttcatcacgtattgatgatattgacctaaacttagaagactttgtacagcgtgtaaacagcgatatcgtcaacaaggtggttaacctcgcgtcccgtactgcgggttttatcagtaaacgctttgatggcaaattagcggcaagccttgatgatgcgaagttatatcaacatttcgtcgatatgcaagaaagcatcgcacaatgttttgaaaaccgtgaatttggtaaagccattcgtgaaattatggcattagcagacgaagctaaccgctatattgatgaaaaagcgccttgggtggttgctaaacaagaaggtaaagaggctgagttgcaagctatttgtactatgggaattaacttattccgtgtactgatgacttatttaaaaccaattctaccttctttaacagaacgttcagaagccttcttacaaactgaattaacttggaatgctctgtcgcaaccgctgttaaaccatgaaattactaaatttaaagcattgtttaatcgtattgaaatggataaagccaatgcaatggtagaagcttcaaaaagtaccattgcgccagtcaaagaaatcacgggtccattagcagacgcgcctattcaagaaaccattaaatttgatgattttgccaaaattgatatgcgcattgctgaaattaaacaggctgatttcgttgacggctcagataagttgctaaaattaatactggacttagggggagaaacacgccaagtattctccggcattcgttctgcataccctgatccgaaagtattagaaggtcgcttaactgttatggttgcaaacctagcacctcgcaaaatgcgttttggaatttcagaaggtatggtgatggccgcaggccctggtggtgaagatattttcttacttagcccagatagtggggctaaaccgggtcaccaagtgaaataa

SEQ ID NO: 1232 - DNA, 471 bp, Proteus mirabilis
gtaatgggaagtaatatgagtataaatttagacgaaaatattatacctggtaagtctattggtagtatttcattaggtgataatgttaatgatattattaaatgcattgaggcggaatattgtataaatgttatagaatttgaaaactttggtgttaaatatctgtgttataaaataaatgatggagctatatcttttactgttaatgatactgggcatatagtttcgttgtggtgtgagcctccatataaagggagttttaatggaaagttatatcctggaataacagcaagaaaactaaaagaaatatctagcattcaaacaataataaaaggatatttagttatagataataatccattgatttattatggaatgcctgatgatatagatgattttaactgtttttctgatttggatgatgatgttttttttaatgaattgtatgttggcgacttaaaccaatcatga

SEQ ID NO: 1233 - DNA, 690 bp, Proteus mirabilis
acagtcatgagtgaacagaaattaatagctgaatcccgcacctttgagcagcaaatgattgagcgggataaacgcgccacaaaagccggttttgttgttggcggcgtgggtctgctgattgcggtactggcgctcgtcgccgtggtcgtgatgttgccgctgaaacagacggatgttgagctgtataccgtggataaccatacaggacgggtggaacacgttacccggacatcgaaaaccagcctgaccgcaacagaagcctatcaaaaggcgatggccgcaaactacgtcaaagtgcgtgagcggtatgtctatccctctttgcaggacgactacgagacggtacaggtctacaacgctccccaggtaaacgatgactacctcgcgctttacgccggaaaaaacgccccggacaaggtttataagaacggggcgcacaccgtgaaagtggagatcttgtccaaccagatcacagatgcgacagcccctgatagggtcgccaccatacgctacaagaagattatccgccgtctggctgataacagcacccgcaacgaatattgggatgcccggttcacgttccattctgcccctgacaaggaaatgagcgatgcggaacgcgagatcaactacttcggctttaccgtcaccagttggcagaccgaccgcgaaatccggggaggtgaatga

SEQ ID NO: 1234 - DNA, 888 bp, Proteus mirabilis
aacgccatgagcgacgaccaatcttcgagtaacgataaccctggtcctaaaaaggggtttctcacactgcttaatcagttattccacggtgaacctaaaaatcgtgatgatctgatggagcttatccgcgattctgaacagaaagaattaatcgatcctgatacccgtgatatgttagagggggtaatggatatcgctgaacagcgtgtacgggatattatgatcccccgctcgcaaatcgtcacattaaaacgcaatcaaacccttgatgagtgccttgatgtgattattgattcagcgcactctcgctttcctgtcatcagtgaagacaaagatcatattgaaggcttattaatggcaaaagatttattgccatttatgcgtactggtgctgagccatttagtatagacaaagttttacgttctgctgtcgttgtaccagaaagtaaacgcgttgaccgcttactaaaagagttccgttcgcaacgctatcatatggctattgtcattgatgaatttggtggtgtttctggtttggtcacgattgaagatattcttgaacttatcgtcggcgaaattgaagatgagtatgatgatgaggatgatattgatattcgtccattaagtcgccatacctactcagtgagagcattaacccaaatagaagattttaatgaggcatttggtactcactttagtgatgaagaagtcgatacgattggtggtttagttatgcaagccttcggtcatcttcctgctagaggtgaaactattaccattgataattaccaatttaaagttgttatggctgatagccgtaaaattattcaggtttatgtgcacattcctgacgatgcgcctgtacctgaactaggtaatgatgtgtag

SEQ ID NO: 1235 - DNA, 1233 bp, Proteus mirabilis
atgctgatgagtcacaataacactgaaacgcaaattggcaatatcgatcttgttaagcaacttaacagtgcgattgtatatcggctcattgatcaacacgggccgatttctcgtattcaaatcgccgagcagagccaactcgcccctgccagtgtcactaaaattactcgtcagcttcttgaacgtggcttgattaaagaagttgatcaacaggcttcaaccggaggtcgtcgcgcaatatccattgttgtggaacatcgccgttttaataccgtcagcgtccgattaggacgcaatgatgccactgttgctctttatgatctcagtggtaaagccttagtagagcaacactaccctttagaacaaagcacccaacaagaagttgaaaccttgcttattaatgctattgatgattttattaaacaaaatcaacgtcgtattaatgagcttatttcaatttcaattatcttgcccgggttagttgatcctaataaaggcattgtccactatatgcctcatatgaaggtaaataactgggcactcgttgataacttagaaaaacactttgatctgccttgctatgcgggccatgatattcggagtctcgccttagcagaaaactattttggtgccaccagagattgtgaagattctatcttggttcgtattcatcgtggcgcaggggctggtgttattatcaacaacaaaattttgctcaaccagcgtggtaatcttggtgaaattggtcatatccaaatagatccattaggagagcgttgccactgtggtaactttggttgtttagagaccattgcgtccaatagcgcaatagaagctaaagtccgctaccaacttgaacaaggctatcccagccagcatttatctgcaacacaatgccaaattcaagatatatgcgatgccgcggtaaaaaacgatcccctcgctgttgaaaccattaaacaagtgggtcttcatctaggtaaagccatcgccattgcaattaacctatttaacccacaaaaagtggttttggcaggagaagtgaccgaagcggctgaaatattactaccgtcgatccaaagttgcattaatacccaagtattaaaagagtttagagaagcgcttcctgttgttatctccgaacttgatcatcgctcagccattggtgcatttgcacttaccaagcgagcaatgcttaatggagagttactacaatatttattcgacaaataa

SEQ ID NO: 1236 - DNA, 906 bp, Proteus mirabilis
caactagagagaaatatggagccaatcacccgcttaatcgatcgcatgttatcttttgcattacttgatcctcgaattgaggctgtggtattaacaggctcagtgggtcgtaataagaagatagacagctattctgatattgatatagagcttattggtcacggtgcgactgagctagcaaaaaaccaacattggctatcacaatttggtaaacacctcgtctctttagcaacagaatgtgaagatccgaacggcattcgctggccaatctatttgcacgtattagctcaaggccgaaaaatggatattttgatggcagagcctgaaagaattatcaatatgaaacaaaatggtctaagtccagtttatcaacgaggctatcgtgttttacttgataaaacaggtttatgtgaccaacttccagaaattagcactgtgacacccccagccctttccatagagcaagctgatgccttggctcaagagttttggtttgaagccacacaaatcgctatagctatcttacgtaatgaattttggttcgctgaatatcgtatgagtgatataagggaatggttgatccgtttactagagcaagttgctctgcaaacatcaacacaagatgtctggtatcaaggcaaaaacttacgggagtggttacctaagttttactcattacgttcattagaaagcacactggcgatgagtaccccttatgaagcagcggctgcattaagtattatcatggctttttttattgatgcatcaaagcgttttggtttgtcgatagaaaaggcaacacaagctcaaacacttattagcgattggtttattgataatgaactattaactgaaaatgaatattaccaaataaccacttccattatttgtcattatccaacttaa

SEQ ID NO: 1237 - DNA, 1038 bp, Proteus mirabilis
tcagaagagagatatatgttaaaaagaaagatgatgcatgggatcttgatgctatgtgcactggttttcttatcagcctgtggtgaaaaacagcaggtgttagaaggcgaaacgatgggaacttactattcaattaaatatgttcctagtagtgattcaccttcacaaagcgtcttacaaacagaaatcgatcgtattcttgaagaagtgaacgatcaaatgtcaacgtatcgtcctcaatctgaattaagtcgtttcaatcaaagtcgtgaaattaatacgccattcccagtttcacccgctactgctaaagtcgttagtgaagcgattcgtattaataaaattacggatggggctttagatgttactgttgggcctttagtcaatttatggggatttggccctgaaggacgttttactcatcaaccttcagccgatgaactagctaaacgtaaaaaatggacgggaattgattaccttgcagtggaaggtaatacattaattaaaaaaatacctgagctttatgttgatctctcttctattgctaaaggttacggtgttgatgctgttgccgaatatttgatttctcaaaatattaccaattatatggttgatattggtggtgaggtgagaacacaaggtgttaatggtaatgataaaccttggcgcattgcgattgaaaaacctgctaatgatggcaccacacagagcgtacaattaattattgaaccgggtgataattcgattgcgacatcgggggattatcgtaactattttgaagaagatggcgtccgtttttctcatacgattgatcctacaacaggtcgcccaatcaaacataaccttgcttctattaccgtaattgtacctacttgtatgagtgctgatggtttatcaacagggttaaatgttctggggcctgaaaagggcttagaggtagcaaataaattaaatattcctgtttttatgatagttaaaactgaaaatgggtttgaagagcgttatagtaaggcattcgccccattcttgaaaaagtag

SEQ ID NO: 1238 - DNA, 786 bp, Proteus mirabilis
gttattaggagagcgaaaatgagtatgcttctcatggcaaaagccatgcaattacaggtggggagtacagcacaaaaaatggtgctactgaaacttgctgataatgccaatgataaaggtgagtgttttccttcttatgaaactattgcacgtcattgcgaaattagccgtcaaagtgcgataaaccacattaaaagtttatgtaaaaaagggtttgttcgtaaagttacgcgaaaaactgataaggtgcatacttccaatttatatattctggatttggaggctaaatctcttgatgacggtagtcaaaatacagtaccacctagtcaaaattctgtactagaggtagtcaaagaatttgaccacggtagtcaaacggttggactagggggtagtcaaaaatttttacccagaaccaatcagtcttttaaccagtcaattaaccctaaaaaactatcgtctgacgactcgaaacctgcaaagcagatttcggttaatcgacaaactaaaattccttatcaggaaatcatgcaagccttcaacgaatcggcaggggatagattacccaatgccgaatcactgaatgacaaacgcaaaagagcaatatccaaattcctgaaagagctcaaagagcctacagtcgaatcagctaaaaattattttgattattttatggaaacagcgagtgcttggtatttcggcgaaaataatcggggttggcgagcgaattttgattatttactcagaccagaaacggtactcaaaacaagggagggagcactgtga

SEQ ID NO: 1239 - DNA, 1962 bp, Proteus mirabilis
gattgcaggagagtcataatgtctgcattactagagctcaacaacgtaagccgtttatataccaatggtgaagaagacacggtggtactggatcagatttcactgacgattaatgctggggaaatggtcgcgattattggtgcatcaggctctgggaaatcaacgctaatgaacatattaggttgcctagataagccaagcagcggtgaatataaagtggctgggcaatgtgtggcagatatggaaagtgaccaactggctgcgctacgtcgtgaacattttggctttatttttcaacgctaccatttgatggcgcatttaactgctgagcaaaatgtggagatccccgccatatatgcaggtaaaagtacagagcaaagaaaagagcgcgcccgtgcgctattaactcgccttggtttagcagagcgtattcactatcggccaagtcagctttccggaggtcaacagcaaagagtcagtattgcccgcgcattaatgaatggcggagaagtgatcctcgccgatgagccaacgggggcattagatagccaatcgggtaaagaggtaatggctatcttaaagcaattaaatcaacaagggcatacggtgattattgtcactcacgatccattaattgcccaacaagccgatcgtattattgaaattaaagatggtcaaattattagcgataataataatcaccattctgcaccagtgaaaaaggtaccacctgcgatccaaaccgcctcttattttcatcaagtcattggacgttttacgcaggcattaaacatggcttggcgagcaatggtggtgaataaaattcgtaccttgctgacaatgttggggatcattattggcattgcctctgttgtcaccattattgttattggtgatgctgccaaagatagggtcttagcagatataaaagcgattggcgccaataccattgatatctatccgggtaaggagcttggtagtgattcaccagaagataaacaatccttaaccattcaagatgttgatgcgttaaaacagcaatcttatatacaatcagtgacaccacagatttactttagctctcgattacgtcgtggtaatcaagatgcgccggcaacagtttctggtgttaacgaggattatttttcagtgtatgcgttgaaatttgcacaggggagcacttttacgcctgatatgatccatcgccaagcgcaagtagtcgttattgatgaaaatactcgtcatcgttttttcccgaataagcaagcggtgattggcgagcaaattattattcgtaatatcccttctactatcataggtgtggttgcagagcaaaaatccacttttggtgataataagtcattacgtgtctgggtgccttacagtacgctaagtagtcgaatttataaccgtagttatttagataacatcacggtaaaagtaaaagagggctatgatgcgagtgttgctgagcaacaaattctccgcttattaacgatccgacatggtaaaaaagatatttttacttataacattgatagctttattaaagcggctgaaaaaaccacgcaaactatgcaactgtttttaactttggtggcggttatttcgctggtggtaggggggatcggcgtgatgaatatcatgttggtttctgttacagaaagaacccgagaaattggtattcgtatggcggtaggcgcacgagccagcgatgttatgcaacaatttttaattgagtcagtactggtgtgtttggtgggaggattattaggtattagcctctcatttgcgattgctatgtttgccagcatgatgctacccaattggcattttgtgttccagcccacggcactgataagtgcttttgcttgctctacagcaattggggttatttttggttttttaccagcgagaaatgcggccaaaatgaaccctattgatgccttagcgagagagtaa

SEQ ID NO: 1240 - DNA, 444 bp, Proteus mirabilis
cgcaaaaggagagagctgatggcacgaggtcgcagtagccgccgaggcgtaaaatcagaaattaatatagtacctttgcttgatgtgttattggtgcttttgctgatttttatggcaacagcgccaattatttcacaaagtgttgaggttgatcttccacaagcaacagaaacacagactgtttcaaccagtgataacccgcctgtaattgtcgaagttgctggagtggggcaatataatatccgtgttgaacaagaggttttagagcttttacctcaagaacagattatggctgaagcaaaacgacaattagaaaaaaacccgaaagcggtctttcttattggtggcgctaaagatgttccttatgatgagataattaaagcactcaacatgttacgtcaagcgggtgttaagtctgtcggtttaatgactcagcctctttag

SEQ ID NO: 1241 - DNA, 210 bp, Proteus mirabilis
ttggattttggcggtaacggtggtaatcaggcaggaagccagaaacctcagcagaatcaaggatggggacaacctcagcaaccgcaagcaccaaaacaagcatcgagtaatcaaacaccacaaagtgagccacctcaagattgggatgatcctatacctttcgctcctatcggactcccctacccacgccacgctatttatgtgatttaa

SEQ ID NO: 1242 - DNA, 189 bp, Proteus mirabilis
tgtgtcttttttatcataatatttcggacacttaaaaataatatgaaaagagtgtctatttattcgatattttcaattaatagacacttgttgtctgataatgacttaggagacatattttgcgcctatttggttatgcaagggtatctactagccagcaatctctcgatactcaaaagaaagcattga

SEQ ID NO: 1243 - DNA, 687 bp, Proteus mirabilis
tttaaatttggattagaaaataggaaagctaacatggacacaaagcgagtgggatatactgttgttgatctatcccaatggggacgaaaagaacactttgaagcatttcagtcttttgctcaatgcacctttagccagactgttcaactggatattacttcattattaaaaaccgtaaagcaaaatgggtacaaattctatccgacatttatatacatcattagccaattggtaaataaacatgcagaattccgcatggcaatgaaagacggggaattggtgatatgggatagtgttaaccctgggtacactatctttcatgaacagaccgaaacattttcatctttatggagttattaccacaaagatatcaatcaatttttgaaaacttattcagaagatatagcgcaatacggtgacaatctagcctattttccaaaagaatttatcgaaaatatgttttttgtgtcagcaaatccttgggtaagtttcaccagttttaacttgaatgtggcgaatataaacaatttctttgcccctgtatttacaataggtaaatattatacgcagggagataaagttctgatgccactagcaattcaagtgcatcatgccgtatgtgatggcttccatgtaggcagattactcaatgaaatacagcaatactgcgatgagggatgtaaataa

SEQ ID NO: 1244 - DNA, 2265 bp, Proteus mirabilis
cgagtccttgggggctcgtccttattttgtattgttcccttttctttatccatttttgcatggaggcagattatgcttagcaaagatccgaaatcaacgcccattgacccggcatccgttttaaaagatgaagccatcaatcaagtgaaaaatagggtgcaatccaaagtgaacgaaacgctatcgacacccacgcaaaaggtggccgggatggcctcagcagcggcctcgctcactcaatcagccagcgcatcggccaatcgcgtgactgctcatcccctgatccacggtggcggttttaccggtggacaaacattcgctgaaaaccaagcactccaagcggcccatggggcgttacttgatgcattaggtatggacagcctcgaaagtggtttggtgttcacttgcaccattggtggattgcctgacgacacctttcaagtcaccgaatttaatcttaccgaaggattatcctcgctattttcactgtccatcagtgcggtcagtgccttaccctttatcgatttccagcgccatcttggcttagcctcatcattaacggtcaaacgcgatggggtgttgatccgcaaagtcaacggtatcttagctggggcagtacaaggcaataccgacggagtgaaaacgtggtatcacttcgatattcgccctgaaatgtgggtgatgaccctcaatcaagacagccgtatttttcaacatcaatcggtgccgaccatcttaaaaaccttattggatgaggcccatgttaaagcggattgccaattctaccgtgaagatctacaccctgaacgtctctacaccacccaaaaacgcgaatcggcatttgatttttggtgtcgactggcgtttgaagagggcattaacttctggtttgaagaagaacaactgttttacagcgatgaacatatggggatgacggcgggtattcaccttacctataacccgcaggccgacaccgatatcagcgatagcactgccatgacttggcaatatggcgaatatttgtgtgtggatgaaactatccataaagacaacaactttgtgcgtccttcttatccgttgtctcatgaaaacaaagttgagcaggggggacagcacagtgtgtttgaaagttatggtcgttttcaattagacgatgaaggtcgacctctgacacaggtgcgctttgagcaattacgtaacggcagcaaagtgggacaagcgacaacaaattgttttgcactgatgcccggcaaaatcttcaccttatctcagcatccccatcagccgatgaatgatcgctggcaagtgatcagcgtcagccatcatggtgtacagccactggcggacaatagcgggggcgaaggcacacaactgtcgaatagcgtctcctttattccgggcacgcaagagtggcgccccccttatcgttataaaccgacggcggacggtgatgaagtggcgacggtggtggggccaccaggggaagaaatctacgtcaatgaatatggcgccgtgaaagtgcattttcattgggatcgtcggggaagtgccgatcacagtgcttcatgctgggtgcgggttgccatgggttggagtggaaatggctatggtttttctgcggtaccgcgcatcggcacacaagtgctggtcagttacctgaatggggatatcgacagaccgataattaccggttgtacctatgatggtcgtaacgcaccaccgattaagttcccagagaataagacacaaaccactttccgtagccaaacccacaaaggggaaggttttaatgaattgcgttttgaagatgcgggcggtaagcaagaggtgtttcttcatgcgcagaaggatatgaataccgtagtccaaaacgataaaggaactacggtaggcgccaatcatactgaaaccgttatgcaaaaccaaaagatctcagtacatggtacgcaaactacggcgattcaagcggatcaaaaaaatatcgtgtttggtaaccaacattcaatcgtggatggtgaagtgttgatcgcatcagccaaaggtattcgtttaattagtggcaactcggcacttcaattaaaccctgacgggactatcaccttagtgtgtaacaactttgatttttacggccacggtagcggtcggattggtactggtgagttattagatttgaatatggacggggcaggtcccggaaaccttgagatgaaacccgatactagcactatcgctcaagcgaaagatcagttcttccctaaaaaataa

SEQ ID NO: 1245 - DNA, 231 bp, Proteus mirabilis
gtgctacttggcgtgcaattgcccaatcgctttctgttaatgggcgcgcttctccacggccacctgcagctaagttaccacgggtttcccctttggcagggatacgggctaagcaataaggaaccggctctccatcaactaccagaatacgtttatcaccatcaacaatttctggtaagaaattctgtgccatacagaaacggtgaccgtgctctgttaaggtttcgataa

SEQ ID NO: 1246 - DNA, 183 bp, Proteus mirabilis; identical to SEQ ID NO: 574

SEQ ID NO: 1247 - DNA, 3849 bp, Proteus mirabilis
gtgaaacctggagagccctctttgagccaggaatatacagaagataaaaatattcgttttactaagataagtaaccgccgtcgtatttgggaagcccttcttattttgataggcattggtgctatctttttaatgatttctttactgagcttccatccagccgatccgagttggtcacaaaccacgtggaatgaacctattcaaaacttaggtggcaatattggtgcatggcttgctgatatccttttttcagcatttggcttgctcgcttatgcaatccctattgtggtggtatttggttgctggaatgcattacgtcatcaaaaaaatcgtgaatacacagattttttctcccttgcattacgtacaattggtgccttggctctggttcttacatcttgtgcgttagctgatcttaattttgatgatatctacaattttagctctggtggggtgattggtagcttatttagcaaggcattgctaccttggtttaatatgctaggtgcaacactggcgctactatcagtatgggcgataggctttacgctatttactggctggtcatggctgacgattaccgaaaagattggtgcggttatcttaggtgcggttgcttttattactaatcgtggtcaaaaagatattgactatgatgattatgaagaacccgccgatcctattcaggcagatcccgaggtgctggtggataacaacacccagccagaacatcaactttctgcgcaaatagaaccagatagtgatgatattctcttttctgcaccttccgcccttgagttagcgcgtcagcaagaaatggcgatcacgccacaacatgatgatataactgaaacttcagaagttgctagcggatctgcaaccccaacgatttcagccacagagacagttatcgctgaggcgcacgagagcaaagagcgggcagagcatattgttgataatcaacaaccgacgcatgccacaacccatgatgcagaagtaacaccgccatccattatggctactcatgacgctagcccagtcactgagcctgaacctgaacactatcgctttgaaataccatcggcatttcttaagcaacaagcgcattcctctgattctatggcagacaatagtgtcgtgacagaagaagtaccgacaaccatgccactgacggaaaacaaacctattgagacaaacgaagcgtcaattgtctcgcaaaaaacagcggcggataatagcgaccatagtgcatcattatttacgccatctgctacatcaacagatagcaattcagcttcattaactcaaacagccgccggtgttgccagtgtggcaacagcagcaatagtcagtcacggtgcacaagttaaacaaggattagggcctgaattacctcgaccaaatccggtacgattaccaacgcgtcgagagctttatggtattcgtatcccatcacaacgtgaggcggaattacgccgccgtgaagaagcgcttcaacaagatcatgaagacgatttagcggatatacaagagcaggctaatttcgaacaatcgttacgtcagcaatttcttgagcaacaacgtgagcgctatggtgaggatacatcagcaacacaaaatgttgagccaaccatcacgatgtcatcagcgacatctagctcgcagtcaacctatgacgagtatgacgagtctgataatcaacctttcattgatacccataccttttctgcgcaagaaacagaagaggagagtgatgagtatgaacaacacctcgctgagcagtttaagcaacaactgcaagaacgctacggtgaggatgttttacaggatgaagatgacgaggtattgccatcagtcacgactggagcatccgagacgtcagcctcggcacaagggtatcatccccatattcagcactcttttgcgtctcaatctacccctgttactcaacagactgataacagcactctttatcctaacagtgatgcattcttacaagtatcacctcgtgatgatgaagaagaggaatacacaccgactatcgagttacaagaaaatcttgatgcattaggctcgttatcaccggtggatgatttgttagatgaagagcctgcagagcctgtttttacgccgatggtaacccctgcagagccagtatcttctgtatcttctgtagggcaaacacctattgagcctcaagcacagatggctcaacattttgcacagcaacagcaacagcaacagcaacagcaacagcaacagcaacagcaacagcaacagcaacagcaacagcaacagcaacagcaacagtcattaattcatccgttattaatgcgcaatgataggccgttacaaaaaccgacaacaccaatgccatcacttgacttattaacctctcctcctatggatgatgaacctgttgatatgtttgagcttgagcgtattggtaagttaattgaagcgcgtttaaatgactaccgtgttaaagcaaaagtggttggtatttcaccgggcccggtgatcacccgttttgagctagagctagcgcctggtgtaaaagctgcacgtatttcaaatctatcccgcgacttagcacgttcactttccacgacggcagtgcgtattgttgaagttataccgggcaaaccttatgttgggcttgagttaccaaacaaaaaacgccaaaccgtctatatgcgtgaactattagatagtgatgcattccgtgacagtcgttcaccattaactgtggtattagggaaagatatcggtgggcaacctgtggttgctaacttggctaaaatgcctcacttactggttgcaggtactacaggttcgggtaaatctgttggggtgaatgcgatgatcatcagcattctctataaagcgaagccagaagatgtacgctttattatgattgacccgaaaatgttggaattatctgtttatgaaggtattccgcacctgttaaccgaagtggtgacagatatgaaagatgctgcgagtgctttgcgctggagtgtcgcagaaatggaacgccgttataaattaatgtccgcattaggggtacgtaaccttgcgggctataacgaaaaaattaaagaagcggaagccatggggcgtccaattccagatccactatggaaaccttctgacagcatggcacctgagttgcctatgttagaaaaagagccttatattgtggtcatcgtcgatgagtttgctgatttaatgatgaccgcgggtaaaaaagtggaagaattaattgctcgcttagcacagaaagcacgtgcggcgggaattcacttagtattagccactcagcgcccttcagtggatattattactggtttaattaaagcgaatattccaagtcgcatcgcatttaccgtatcgagtaaaatcgactcgcgcactattttagaccaaggtggcgcggaatccttgttaggtatgggtgatatgctttatgcccctaatggctatatgccagagcgtgtacatggtgcatttgtcagcgatgatgaagtacatgcggttgcaacagactggaaagcacgtggccgacctcaatatattgaagccattaccaaatgtggtgaagaaggcgaaggtggcaatggtggtggttatgatgatggtgaagagcttgatccgctatttgatcaggccgtagaatttgtggttgaaaaacagcgagtctccatttccggtgtacagcgtcaatttagaataggctataaccgtgcagccagaattgttgagcagatggagatgcagggtattgtcagtgcacctaatcacaataatacgcgtgatgtattatcaccaccgccagcagaaatgtaa

SEQ ID NO: 1248 - DNA, 207 bp, Proteus mirabilis
cagaaatatggctggggtaccaggattcgaacctgggaatgccaggatcaaaacctggtgccttaccgcttggcgataccccatccgctaattcaattgtcaacacgcatattatctatcaggaaaatggctggggtacctggattcgaaccagggtatgccaggatcaaaacctggtgccttaccgcttggcgataccccacctga

SEQ ID NO: 1249 - DNA, 1080 bp, Proteus mirabilis
tcgtttcacggcacaaccggtcccgcaagggtgaagtgcacgcatgctgcgcccttgcgggtcagaacgatgccgagaaagcgaaccgtcaggcgatacgaagacgaaaatcacattactgatggagaaaaaactatgatcacttccttgcatactcagacaagcgcccctaacaccgcagcggcgaccagcgtatccccgctggacccgtcaggctcctcaaaaacgaaattttccaaaaccagaaccgatatttatcagatcgtcaccgaccgcatcattaccgcactggaaacaggcgttaaaccctgggtgtgtccgtggcagcgcgtaccgggcatatccggcttgccttccaactacgctactggcacagcttacagcgggatgaatatcatgttgctgtggtgcagtgcatcagaacggggattcagtgattcccgctggatgacatacaaacaggccagggcagaaggtgcacaagttcgtaagggcgagcacggcacgaccgccattttctataccaccctggagaaggaaaacggcaccggagaaattgaccatatcccgatgctgaaaacctttgtcgtgtttaatgtcgaacaaattgatggtctctcactgacggcggataccgttgctccacaagcgacgtttgacccgttgccgcaggctgaaaacctgtttcgcagcagtggcgctaacatcattgagaaaggacaaaacgcctttttcatgccatcaacggatgaggttttgttacctgaacgtcgtttcttttccgatgccgccagcttttatgccacgggtctgcatgagattgttcactggagcggtggcaaaagtcgcctgaaccgcgaaatgaaaggaagatttggcagtgaaaattatgcatttgaggagttgatcgccgagctgggaagcgcgttcctgatggcggatctggggattgtcggagaggttcagcacgaaagttatattgcttcctggctgaaagcactgaaaaacgataagcgctatattttcaaagccgccagcgcagcatcgaaagcgcatcgttatctgatggataaggtctga

SEQ ID NO: 1250 - DNA, 720 bp, Proteus mirabilis
cccactttaggaattatacttttggagatgttaagtgaatacgaatggcaagcgattcttttaagccttaaggtatcgacaattgcagtaataattagtcttccttttggtatattgatggcttggctattagttagggttcgttttcccggtaaatcattgcttgatagcattattcatttacctttagttttacctcccgttgttgttggttatctattattaattagcatggggagacgcggatttattggtgaatggctatataattggtttggatttagttttaccttcagttggcgaggggcggcacttgcctcagctgttgtggcatttccactgatggtaagagcaattagactagcactagaagctgtcgaccaacgtatggaacaagcggcaagaacattaggcgcatcaccattacgtgtcttttttactataacgttaccattatctatgcccggcattattgcggggatcgtattggcctttgctcgctcattaggtgaatttggcgccacaatcactttcgtctccaatattccaggggaaaccagaacgatccctttggctatgtatacgttaattgaaacaccgggggcagaaatggatgccgcccgtttatgtgtcattgcaattattttggcgctcgtctctttaatggcttcagagtggctaactcgttgggggcgtaaaagattggggggcgtatgctag

SEQ ID NO: 1251 - DNA, 1410 bp, Proteus mirabilis
tgcacattagggaaaatgaaatcgaatttagacaagaagaggatgattaatatgtcaactaaaaatagagtgatctggcgtgaagggctatttatcaaacctcaacattttcaacaacaacaacgtcatcaagattatatgacggtgagtattttaaataactttttttcacacttttggggatttagtaccttaaaattgagtgacgatttatatgctttaggtcgtattggtattaaagaagcttctggtgttatgccagacggcaccattttctctataccaaaccaagatttactaccacagcctattgatataacgaatattactgatagtgacagcagtattatttatctagcttttcctttaatgaacgagaatgtcagtgaaatttccactgaacataacggtagtcgtttactttctcgctacagcgaaagcaccgaaaatattcgtgatttacatactgaaaatggtgatatcagtgctattcatgttgcacagctcacaccaatactcaaacaaggtaaacatggtttagatgcctatgttgctttacctatctgtcgtattagagagcgtaatgctaatggtaatttaacgctagataatgattatattcccagcctattaaatatccgtgcctcaacattattgagccaatttctcaccgagcttgaaggaacgctatatgaaagaggaaaacaaattgcctctcgcattggtgccccaggtcagcaaggtgttgcggatgtggcagaatttatgatgttacaagtgcttaatcgcacttatccactctattcgcattatgctcaagagccggtgatccatcctgaaaaactatttcgagatttattagagctttgtggtgaactacaaacattcacgaatacttcacgtttacctgaaaatattgccaaatatcaacatgctaaattaacagaaagttatattccattaatagccagtatccgcgaagcactcagtgttgtcttaacaccaagagcgatcccaatcccgctacaagttcaagagcatggtattcgtgtagcaaccattcatgacaaacaactgctacaacgagctgaatttattattgcggtgaaatcacaaatgccgcaagagcaactacgtcgccaattcccacaacaaactaaggtgacaacaatcaataacattcgcagcttggttagtgtgcaaataccgggtgttcctttatcaccactttcggctgcaccaagacaattaccttatcactcgggatataactatttccattttgatcaacaaggcaatgaatggaaagggatccagcaggatggcaacatcgcattccacgtttcaggaaacttccccgatctcgatattcagttatgggcaataagagatggagcactctatgactga

SEQ ID NO: 1252 - DNA, 699 bp, Proteus mirabilis
aaaaaaataggaaactctctcacagatcgtttatgctatcttgatacacattgtttcattgaaaatataaattataccacactcactcaagataaatatattcattctaaaaaatgggtcattgataccactctgatcgggtatgaattcgtaacaattcaacacttactggcacactcaatcaatataccaccaccaattacaggcaatcaatgtattaattatggcatttcagttttattatcaagaactctatttcaagcgtttgagaaaataacatggaaagaacgaattagccaacaaataatgcaattacctgaagaactaaaatctgaggtttataacaaaattacatcgaatgaaactcataaatccagtgacaaagaatatttccctatttataaattaccacaagattcctgttttgtaattcgcctgactgaactacaaaagctgatgaatgcctatgtaaataataaacacactccaacatcgacacgcatatccaaccctttatctcgtcttttctggctttcatgtaaacataatgaagtcatcagtccattaataggaaaaccttacaagcttttatccattttcgaacaatgggcatctaccgaaggtattactgacaaattcagcggcgatacactgaaaacagcacttgaacgcggttctcccacttcagtgccttattga

SEQ ID NO: 1253 - DNA, 822 bp, Proteus mirabilis
cccaccacaggatacaggctccatcgaaaccatgtagtcccccccttaattctgatcccacagcatgcagtgtcagcaggctctgcatgccacctgtttactgaggtcatcatgctttccaccacagcctttctggcggtagccatgcagtgcgccgccagtattcatccgtccactgcactcgacgtggcacgggtggaatccggttttaacccttatgccatcgctgagattgtcccgaaggccggaccctcttcccgcgataaacacattatttctcacctgccagccagtcggggagatgcagagcatattctccgccgcctggcagcacaggatcgccgttactctgtcgggctgatgcaaatcaccagcaccaatttccgccattatggtgtgtccgccacagagctgcttgatccctgtaccaatctgtccatctttgaacgcattctcagtgactgctaccggcgcggcggcacgctgaaaagagcgctgagttgttattactccggcaatttcagtaccgggcaacagcctgaaacggctttttccggaacgagctatatccagcgaatcggttatgcgccgggatcatcccgctatgctgtccccggaacccgtgaggacaaatcatctgtttccactcctctgaaaatcgcccctgccggtaactcatcccgtcaccacctgatctggcccggagtcgtcgtccgtggcgtccctgcgaaactccgccaggaaaaaatcttcatcgcgcccttctccgcaccgtcagtgcaccggagcctctccctgtcaccccgtaaggaggaagaataa

SEQ ID NO: 1254 - DNA, 357 bp, Proteus mirabilis
ttcgatagagggattttagatatgacaataaaacaactacagaaaaaaattcatcaacaaaacattgaggctggatggtgggatatcccaagggaaaaaggaaccttactttgcttgatccattctgaaattagtgaagcaatggagggagagcgtaaagatctaatggattaccatttaccacatagaaagatggcagaagttgaacttgctgatgctgttattcgtattttggattatgcggaagagttcggttacgacatcgaaagcgctattacagagaaactcgaatacaacaaacatcgagtagatcatcagcgagaaaatagagttaaaaaaggaggtaaacgattttaa

SEQ ID NO: 1255 - DNA, 435 bp, Proteus mirabilis
ttatttatgggattactcaaggagtgtaaggacggaattatgcggtttctttggccagttcgtgtctattacgaagatactgatgccggtggtgtggtctatcatgccagttatttaaaatattttgaacgtgcaagaacagaattactcagagaaaaaggtttttatcagcatgatttacgggagtatgatcatgttgcgtttgttgtgcgtaaattaaccattgactatattgcgccagcacggcttgatgagcttctgaaagtagaaagtgaaattactacattacgtggtgcatcaatgacattttctcaaaagcttatcaatcaagatggtgtggtactgtgtagggcagatgtattagttgtctgcgttgattcattaaaaatgaagcctgtagggcttcctaagtccattatcgcggagtttaagtag

SEQ ID NO: 1256 - DNA, 192 bp, Proteus mirabilis
ccaacggcgggctggagcactttgctgtttcagccatcgaaccaattcattttgtttagttttatccatgagaaaagattcaaatctgcaggtgagatacaaagtatcaaaaacgccaagaataataattactctttaacgaccaagctagtatgttacatggtaaaaggcgctactgaaatagcgccttga

SEQ ID NO: 1257 - DNA, 582 bp, Proteus mirabilis
tttcatcagggccaactaatgaactttttaaatttcgtcattctgactcttattcaactctatatttccgtgctactacttcgtgtatggatgcaatgtgtaagagctgatttttataatccgttttcacaatttgtggttaaaattacccaacctgttgtgcgcccattaagaagaattatcccctctattggctctattgatactgcttcggtcatcttggcatatgttttagtgttattagaaattatcctcccttcttacttatccggagcaggtggtgctattccattttctttagtcctacccttcgcatttattgaattactcaccgcagcaggtaagattattttttggatgattatcatccgtgcaattctcagttgggtcagtcaaggacgtaatcctatcgatcatctgctcttccaattaactgagcctttaatggccccaattcgccgtgttattccggcaatgggaggattagatttctcagccatgattgttatcctgatcctttatgcccttaattatttacgtgtagatgttttacagtggctaatcaccatgacactttactaa

SEQ ID NO: 1258 - DNA, 747 bp, Proteus mirabilis
ttaagtcggggttgtcaaatggatgtcattagttggtttagtatcaataatattttagtcaatattccattaggaaaagaaggctatccactctcatggattgaagctatagggactattgctggattattatgtatatggcttgcgagccaggaaaagatcattaactatttatttgggttaattaatgtcactttattcgccattatttttttccagatccagttatatgccagtctactgctacaaattttcttctttgctgccaatatttatggttggtatgcatggagtagagtgaatgattttgaacaagcagaattgaaaatacgttggttaaagccgggccaacaaatcgtattaatcattgtctccattgctgccattattgcgctaacgtttaatattgataccgtttttggctatttagcagttattgctgttgatatcttaaatgtcttcggggcaaatttagccacacctgctatcgagccagatgcttacccattctgggattcaacaatgacggtactctccattgtggctatgatcttaatgacacgcaaattggtagaaaactggttaatttggtctgttattaatgtcattagtattgttatattttataaacagggtgtttatgccatgtctattgaatatatcatcttattggctatcgctattaatggctctcgtttgtggatcaaatcagcaaagcattcaaataaaaataattatctctcataa

SEQ ID NO: 1259 - DNA, 1080 bp, Proteus mirabilis
aagattggggggcgtatgctagagatgaattttaaacagacactgggctctttgtgtctggaagtgaatactcaattaccaacagaaagtatcacggcggtatttggcttatctggcgcaggtaaaacgtcgctcattaatgtgattggtggtttaaccaaacctgattcaggacatattgtgttaaataatcacacattggtggatattgagaagaaaatttatctgccacccgaaaagcgcaaagtaggctatgtatttcaagatgcacgactatttcctcattataccgtaaaaggaaatttactttacggtatgtcaccaacaatgaaagtacagtttgatagaattatttatctattaggtatcgaacatctactttcgcgttttcctattacgctatctggtggtgaaaaacaacgtgtggctattggacgtgcattattaactgcacccgatattatgctaatggatgaaccattggcctctcttgatttaccccgcaagcgtgaattattaccctatttagaaaaactttcacaagatgtacaaatacctattttgtatgtgagccatagtctagatgagattattcgacttgctgataatgtgattgttatggatgccggaaaaattaaggcaatgggtaagttagaagatgtttgggccagtagcgcattacgcccttggttacaaaaagagacgttaagcagtgttgcaaatgttatggtcgttgaacatcatagccattatgcgatgacggcgaccgcctttggtaatcaagtactgtggttgccacaaatagaggcaaaaataggtcgcgatgtgcgcgttcgtattgatgcttcagatgtatcgttaactaccactcgcccatcaaatagtagtatccgtaatatattacatatgaaagtggtcgaaatgatcaaacatgatgatcaggtagatgtgaaactggttaatgatggcaattatttatgggcgcggatcaccccttgggcgagagatgaactcaatattcaagaagggcagtggctttatgcgcaaataaaaagtatttcactaagtcgccatctttaa

SEQ ID NO: 1260 - DNA, 1353 bp, Proteus mirabilis
tacgtttttatttatcccttcgtatccagaaatttttgggtcagattgtgggtcattcagttcgacaactggagtgaccctcacatgttaactgacagcaagattcgctcagcaaaatctattgcaaaatcatataaactcaccgactcgcaaggcctgtacctgatggtatctgcctgcggtactaagctatggtatttccgctatcgcctcaacggtaaagaaagtcgtctggccctcggcccttaccctcagacttcgctggcggaagcccgtgaaaagcgcgatgcagtgcggaagctactggcgtccggtatcaacccttctcagcttcgcaaggcacataacaataccgttgatgaatcccgcacatttcagtatgccgcgacaacatggcactccagcagacttaaactctggtctgaaacccacgccgataaaattctcacctgcctgaaacgctacgtttttcccactattggcgcgatggatatcacccaaattgaaacccaccatctggcacagttggttaaggtaattgacgataaaggcgtgcatgacgttgccgggagggttcgccagcatctgaagaaaatcatgcgccatgccgtacagcagggagtgatcaaatacaatcctgcttacgatttagatggtatcgtaacccccgtagtgttccaacatcaccccgccttactcctgaaacacctgccagaattgctggaaaagattagtaattacaaaggcaggaaactaacccgcctggcactggagcttaatcttcatgtcttcctgcgctccagtgagctacgcctcgctcgctgggatgagtttaacctgaaagcacatatctggacggtgcctgcaaagcgtgagaccgtaaaaggcgtgagattctcggagcgtggtgcaaaaatgaaggatgaacatctggtgccattatcacgacaggttgcttccctgtttgagcaaattaaggaaatcacaggggagtcaatgtttgtctttgcaggcgcgcattcaatggataagccaatgagtgaaaacactatcaataaagcactgcgcgtaattggctacaacaccaaaaccgatgtctgcggccatggtttccgcacaatggcctgtagtgccctgaatgaatcagggctgtggtcaaaagatgccattgaacggcaaatgagccataaggaacgcaatggcgtaagagctgcttacgtgtataaagcggaacatttagaagcccgcatagaaatgatgcaatggtggtctgattatttagacaccagccgtatagaatatattgcgccatatatttatgcccgacaatataaatccataggtgccgcttga

SEQ ID NO: 1261 - DNA, 852 bp, Proteus mirabilis
gagtattttatgtcggggagtcagtataaaaaggaagatgcgagctggggaatgctacttaaaggacgaaatagtctaaaatcactcgctttagcagggggagtggcattacatgctattaatgtctatatcaccattaccaccctaccttctattgttcgtgatatcggcgggcttaatttatatgcatggaataccaccgtttttattttggcatccattctctcttcggcactgacttctcgtttattaattttgctcgcgccacgtaatagctatttatttgccacactctgctttttagtcggctctattatctgtgctaccgccccttcaatgccaatcttgttggttggccgatttattcaaggtgcgggaggcggaatgttactggctttagcttattcattggttagagtgatgtttccgcaaccattatggtctcgagccatggcgttaatgtccagtatgtggggaatatcaacgctgctgggtcccgcattaggaggaatatttgcagaatataatatttggcggggggctttttggtctattctttgtgtaggcattccttatgctattctattgtttactatccttcctaaggaaaacagtgctgatattgctaacaaaaaaacatcacttccctacctacaacttaccttattaatattagcagtattatctatctcaatcggtagcttgtatcacgttacgctatatcatattttatcttttctattagcaattatttttatcttattattaatttatatcgataagagatctcatgatgggctttttcctaaaggaacattctctttttcagccccactatccctatttatctga

SEQ ID NO: 1262 - DNA, 6948 bp, Proteus mirabilis
agacattttatacgagagttatatatgaatataatcttttttgaaaagaattcaaacgagaaagtacaattacaacctcatgctaagcatactataacggcgaaagcaggggatgtgtatcagttaattgattcagatactcaactttctccattagatattcaagcgcatcgtaaatcggatgatcttattttatctagtaaagaacaaaatatagaagttgttattaaagatttttggcaagaatgccaaccaggggaacaacaatgttacgccactttaaatgttttagattcaaatggtgtaatgggacaagcaactattactcaagatggtcctgttttagaacatttagttgctggtgaaacaggtactctttctgataatgatgatggaattggtctatttttatgggttgctggttcaatcggtagtgcattagcgatctttttagctaatagaaatcatggtggtgacaataataaaggtaatgaggctgatattaccgcgccgagtaagccaggattaactgctgaagatgatggttctgtttctatcgatttaccaaaagatgccaataaaggtgattctgtagatgttacttttgaagatgaggatggtaattcaaatactgtcacattagaaaagggagataatggctggacatcaagtgatcctgaattaattcctgatacagataacaatcaagtcactatccctaatgataagataaaagataatagtgatgttaccgcaagtgcgaaagatccgagtggtaataaaagtgatgatgttactgtaacagccaaacctgatcccgtatcagatatacctgttttaagcattccagaagttgacgatggttatgcgaatgcagaagagctgaaagacggtttacaagcagaagttactttgccagcgggtacggttgaaggggcggaaattaccttaacggtcactcgtccagataatactacagaaacgattacatacactgtaactaaagatgatgttgctgcaggtaagatttcgattgatattcctaaagatgcggtacaaaacggccaaaacagtgtcgatgtcagcataactcaaggcaataatccagccaaaccaggaaacaaagtagattttgctgttgatggacaaatcccgggcgatacagatggtgatggtacggtggataccacaccagtggtgatcattccagaagctgcggacggtgtaaatgctgacgagctaaaagatggcgtacagaccgaagtgactgtaccgggggggagtgcggcaggtgacacactgacactcactattactaaaccagacggctcaaccgacactgttgaacacacactgactgcagatgaagtggcggcaggtaaagccgatgtgactatccccgcagataaagtgacagcagatggtaactattctgttaccgcagaaattactgatccggcgggtaataccagtggtcaaggtaaacctactgactttatggttgatacgcaaattccgggagacacagacggtgatggtacggtggataccacaccggcggtgaccattccagaagctgcggacggtgtaaatgctgacgagctaaaagatggcgtacagaccgaagtgactgtaccgggaggtagtgcggcaggtgatacactgacactcactattactaaaccagacggctcaactgatactgttgaacacacactgactgcagatgaagtgacggctggcaaagctgatgtgactatccccgcagataaagtgacagcagatggtaactattctgttaccgcagaaattactgatccggcgggtaataccagtggtcagggtaaacctacggactttatggttgatacgcaaattccgggtgatacagacggtgatggtacggtggataccacaccggtggtgaccattccggaagctgcggacggtgtaaatgctgacgagctaaaagatggcgtacagaccgaagtgactgtaccgggaggtagtgcggcaggtgacacactgacactcactattaccaaacccgatggatcaactgatactgttgaacacacactgactgcagatgaagtgacggcaggtaaagccgatgtgactatccccgcagataaagtgacagcggatggtaactattctgttaccgcagaaattactgatccggcaggtaataccagtggtcaaggtaaacctactgactttgctgtcgataccgtggcaccgtcggctcctgtattaaaagcagaggacgatggttcggtttcagttgacttaccaacagatgccaataaaggtgatacggtagaaattacctttgaagatgaaaagggtgataagcacacggttaccttagaaaaaggggataacggttggacatctgatacaccggcgttgatcccagacagcaacggcgataaggcgaccattcctgcggataatgtaaaagacaacagtgaagtaacggggattgccaaagatccgagtggcaacgaaagtgacccatcaacggtgacttcgaaaacggacggtgtcgctgatgcgcctgtactgactatcccagaagtggctgacggttatgcgaatgcggatgaactgaaagacggcttacaagcagaagttaccttgccagcgggtacggttgaaggggcggaaatcaccttaacggtcactcgcccagacaaaaccactgaaaccgtaacgcatacagtcactaaagatgaagctgctgcgggtaaagtatctgttgatattcctaaagatgcggtacaaaacggccaaaacagtgtcgatgtcagcttaactcaaggcaataatccagccaaaccaggaaacaaagtagattttgctgttgatggtcaaattccgggcgatacagacggtgatggtacggtggataccacaccggtggtgaccattccggaagctgcggacggtgtaaatgctgacgagctaaaagacggcgtacagacacaagtgactgtaccgggaggtagtgcggcaggtgacacactgacactcactattactaaaccagatggatcaaccgacactgttgaacatacactgactgcagatgaagtgacggcaggtaaagccgatgtgacaatccccgcagataaagtgacagcagatggtaactattctgttaccgcagaaattactgatccggcgggtaataccagtggccaaggtaaacctactgactttgctgtcgatacagtggcaccgtcggctcctgtattaaaagcagaggacgatggttcggtttcagttgacttaccaacagatgccaataaaggtgatacggtagaaattacctttgaagatgaaaagggtgataagcacacggttaccttagaaaaaggggataacggttggacatctgatacaccggcgttgatcccagacagcaacggcgataaggcgaccattcctgcggataatgtaaaagacaacagtgaagtaacggggattgccaaagatccgagtggcaacgaaagtgacccatcaacggtgacctcgaaaacggacggtgtcgctgatgcgcctgtactgactatcccagaagtggctgacggttatgcgaatgcggatgaactgaaagacggcttacaagcggaagttaccttgccagcgggtacgattgaaggggcggaaatcaccttaacggtcactcgcccagacaaaaccactgaaaccgtaacgcatacagtcactaaagatgaagctgctgcgggtaaagtatctgttgatattcctaaagatgcggtacaaaacggccaaaacagtgtcgatgtcagcttaactcaaggcaataatccagccaaaccaggaaacaaagtagattttgctgttgatggacaaattccgggcgatacagatggtgatggtacggtggataccacaccggtggtgaccattccagaagccactgatggagtaaatgctgacgagctaaaagatggcgtacagactgaagtgactgtaccgggaggtagtgcagcaggtgacacactgacactcactattaccaaaccagatggatcaaccgacactgttgaacacacactgactgcagatgaagtgacggcaggtaaagccgatgtgacaatccccgcagataaagtgacagcagatggtaactattctgttaccgcagaaattactgatccggcgggtaataccagtggtcagggtaaacctactgactttatggttgatacgcaaattccgggcgatacagatggtgatggtgtggtggatacaacacctgtagtgaccattccagaagctacggacggggtaaatgctgacgagctaaaagatggcgtacagaccgaagtgactgtaccgggagggagtgcggcaggtgacacactgacactcactattactaaaccagacggctcaaccgacaccgttgaacacacactgactgcagatgaagtgacggcaggtaaagccgatgtgactatccctgcagataaagcaactccggatggtaattattctgttaaagcagaaattacagatcccgcaggtaacacgagtggtgaaggtaaagcaacggacttcactgtagataccgttgccccatctacccctgtattaaatgctgaggataatggctctgtttctgttgaactgccaggggatgccaacaaaggcgatacggtagaaattacctttgaagatgaaaaaggggataaacagactgtaacaatggagaaaggggataatggttggacatctagtgatcctaatttgatcccagacagtcagggcaataacaccgctattccatctgataatgtaaaagataacagtgaagtaaccgcaatagctaaagatccaagcggtaatgaaagtgctccagcaacagcaatgtccaaaacagatgtgttaccgacagtgagtattagtgttgatacaacatcagtaaatgacaatggagataagattagtgctgatgcttctgtttcgggtgaaataacagaagttcctgcaacaatagaggacaaggatgatactaccggattagtatataccgttgctctagattatgttgcagcacaggatgtgaccgtaaccataaccttaacaaatgatgcaggtcatgcaagtgcgccggattattcaacgcttgcaggctctcagcatgatgggaaaatcgccctacatggggacacaggtaaagtaacctatgatggagcttcaactgtaacggttgttattcctgctggatctaagagtgtttcatttatagttgatccaacaatggaagctaaccaaaatgcatttaatgctgaaggtatggagaaagttgttgcaaccattacgggaacatctaataacgctaccgctgtaactgatacagtaaataatgcaggtgcttctgctacgggggttatttatgatggcaaccctatttcattacgtaatctggacggcgattttacactgaagtattcattatcctcatcagtggctgaaaatggggactttggatataccatcggagttgatagcggtaaaaaagatcctaagctaacgacagattacaatgatacgatttatgttggttattatcaggatggtagcgaaacttcatcatacagcaatcttgctaactcgcaggataatggacctgatggcacaaaaacagatggtaatcaaagtattacaactgttgatttaggtgctggtgatgacctgatggtgatccgcggtaatatgttaaccaatacacgagtctatgctggtgaaggtaatgatacctttactatggacggcatgaatacagcgttacgttctatgtatgctggtagttatctctttatggaatctggtaatgataccgttacgattaaacgtacaggggtaaccaatgctggtcaaatctatcttggctcaggtagtgatacctttactcaaggtgatgccaatgatcaaaataataccgaattgtccggtttattagatctgggtagtggtactcaagataagtcaaatatgccaaatgagtatctttctgtttatcaggatggcagtaatttaagtttaggtaatgacaataacattgatgcggtcacagatgttaatactgtcactatttatggttctgtctccggtgaaattttaggtggatatggtagtgataatatcactatcactaaaaatctgactggtaatgtttctgttggtgataatacagacactctaactgctgggtggatttatggtggtgccactgtttctatgggggatggcaatgatacggttactgtcactgaaggtgcgtataacacaactatttcactaggggcaggagatgatgtgtttgatgctactgctggtgttatgggggattctgttagcgcgacattagtgaatggtgaagatggcaatgacaccataaaattaggcacaattggtaaaaatctgacagttgatgcgggtgctggcgatgatactgtgattttgacaaaagattatgatccttcacctataggtaatcagggatatattaatgggggagagggaactgatactttagtcttatcaggtacgattacggtaaatatggccactaagactgatgaaggtattgctaatttcgaaaaagtcgatatgacggttaacagtgagttgaaagtggacaatagctctcagactattaagttaaccgcatctgatgtgttgggaatgaatgcaaattcaacgatttatatttccggtgatgctaatgataaggtggatttaggtgccgatggtgctggaggtttaggtacatttacagctactgccactacaacaaaagcaaccgcattagatggtactgaacatacttacactctttatagcagtgcaagtggtgctaatgtctatattgataataatattatcgataatggaggcgttatttaa

SEQ ID NO: 1263 - DNA, 1104 bp, Proteus mirabilis
cccatctttatgcttcactgcccagagggagataacatggctattgatgaaaacaaacaaaaagcattggccgcagcacttggtcaaattgaaaagcaatttggtaaaggttctatcatgcgtctgggcgaagaccgttccatgaacgtagaaactatctctacaggatctttatcattagacgttgctttaggtgcaggtggattgccacgtggccgtattgttgaaatctatggccctgaatcttctggtaaaacaaccttgactctacaagttattgcctctgctcagcgtgaaggaaaaatttgtgcatttattgatgctgaacatgcattagacccaatttatgctcaaaagctaggtgtcgatatcgataatctactctgctctcaacctgacacaggtgaacaagctctggaaatttgtgatgcattatctcgctctggtgcggtcgatgttattgtcgtggactccgtggcagcattaacaccaaaagctgaaattgaaggtgaaattggtgattcacacgttggtttagccgcacgtatgatgagccaagctatgcgtaaactagcgggtaaccttaaaaactctaatacactgctgattttcattaaccaaattcgtatgaaaatcggtgttatgtttggtaacccagaaaccacgaccggtggtaatgcgcttaaattctatgcttctgttcgtttagacattcgtcgcattggctctgtcaaaaatggtgatgaagtcattggtagtgagactcgcgttaaagttgttaaaaataaagtggctgcaccgtttaaacaagctgaattccaaattatgtacggtgaaggtattaatacctatggcgaactgattgatttaggtgttaaacataagttagtagagaaagcaggtgcttggtatagctacaatggcgaaaaaattggtcaaggtaaagctaacgcaaccaattacttaaaagaacatcctgaaatgtacaatgagttaaacactaaattgcgtgaaatgttgttaaatcatgctggtgaattcacaagtgctgcggattttgcaggtgaagagtcagacagtgatgctgacgacacaaaagagtaa

SEQ ID NO: 1264 - DNA, 630 bp, Proteus mirabilis
gagacctttatgttaaaagtctggggtagaaaaaactcatcgaacgttaaaaaagtcctgtggtgtttaaaagagcttcaagctccttacgaacaaattgatgtcggaggcccttttggtggacttcatgaggccaactatttagcactcaatcccaatgcatctattcctaccttacaagatgatgattttgccttatgggagtcaaataccataattcgttatttatgtaccaaatatgaaaattatcatctctacccaaccgatgtaaagcaacgcgcaaacgttgaaaaatggatggattggtcgaatggtagccttttttctccaatccaacaaatgatgataaatcttgttcgcacaccaaaagagcagcaagatccacagcttgtacagagcctaaaagcgaaattaaaccaactgatcaaaattgccgatgatcaactggctaaaacagcttattttgccggtgactatttttcattagctgatatcgctattgctcctttggtatacccatggctagaggtttgccaagaaggtgcaaattatccacatctacaacgctggtttgcacaattaagtgaaaatcagatcttccgtgatgtcgttttactgccggtaaattaa

SEQ ID NO: 1265 - DNA, 2655 bp, Proteus mirabilis
agtctatttatttatctatcaaaggcagagttaacttactctgctttttcacccaaaaaagggatcaacacggtgacgctaccttcaatatctttaccaacaagaattgaccaagcccgactgaaatggacgtcgttacagcaacaacatctctattttgcccctgtacgccaccatagcccagcttgtgcttatgcagttttatcattaattgattctgtaaaacctgattatatcttaattgaaggtccggatacctttaattcgcttattcctagcctaacggataaagatactctccctcctattgctattatggggcaagccgaatattgtcatcatgatagtggcctagaagagcgtgaaaaatcgctacactctgcctatttcccattttgtgaatattcccctgagtggcaagctttgcgaggtggtttacgcatcaatgcaacaacacgttttatcgatttaccttgggctgctcaagtcaataacgaagagtatagcgatctacaaagccgtagcttacaaaaagaacgttatttagcccatagccaatttattgcacaattagctaaacaatgtcattgccgtgatcatgatgatgtttgggagcatctttttgagttacgcagtattgaggcattagcagattggcaaactctgtttaatgacatttttatttggtgtgcacttgcacgccttgactatgaacctgaagtacttgcatctgaaggctcttcacaacgtgaagcacatatgctcactcatataaaaaccatcaaacagcacgagcctaatgccaaaatattaatcgtcacagggggagcccacacccttgcactaatcgaaggcttagcttcttcacaaccccactctttcgctatttctagctcagaacaaaagcactttactaaaatgcaaaaaatgggcgaaaaagagcaagcttggcttattcgctatagctttgacagattagatgcacttaatggctatgcatctggtatgccatctccggctttttaccaacaagcttggcaaagcttaatgcaacaacatcatgataaattagaaaacaatgaggcggcaaaacagccaacgcaagtttatcgcaataaaatgggcatcgcctttttaagctcagtggctcagactatcagagaacaacaatttgataatccacccagttatttaaccgtaaaactagcagccgagcagagtttacgcctcgctttactaagagagcacactggtatggggcgttatgatttgcttgatgggttacaaagcgcctttattaaaggcagtttagatgacagtcaaaacgaattatgggacgaaatcaaaacctgtttttcaggttatctattaggacaaattccattaggtacagcaacgccccctttagtcaatgaaacctatgaacgcgccaaagcatttcgctttaaacttgatgatacattagcaaaaactacaaaatgtgatgtttatcgtaacccccaacatcgcttaagaagtcgttttttacatttattggcatttttagaaatccattttgcccaccgtgtcaatggacctgattttctttctggtcaccagttagatctattatttgaagaatggcaatatgcatggacccccaatgttgaaggtgaactgatctcattatcagaaaaaggctctcaacttgaaactatcgccttaaataaactgttagcaatggaaaaacagcttgcagaacaaggacaaagccgttcaagccaaagtgcggtcactttgttaattcaagcggcattaattgggctccaccagcgtatccctacgctatttaaactgctagatagctatattcagcaagattttcgccttgagtcattaacacaatgtggacataaattgatccatttatggcgaggtcgtcaatatcttgatattaccgatgagctgacattggaaaataggctacatcaagtgatccctcaagccttcttttgcttagagcaattggctcaaggtgatgagcaacaacaagaaagcaatctgcaagccctactctctttacgtgaactcattgagtttatgccatcactggatcatcaatatgattataaaagtgatttttatcagcaacttaatcgtcttgatggacagttagataccgttcctttattaaaaggtgcggtagatgcattacgttatctaggttcgtatattgacgaaaagaccttagcggccgtgttaaatgcgacctttagtacaggcagcgctcccgaacatgccattggttattttgtcggtataatgcgcaccgcaccagagctagtcattcgcctgccgttgttagtcaatcacttaaatagcttattacagcaatgggatgaagaacgttttattcagattttacctgatttgcgttttgcctttagccaacttaatcccaaacaaaatgcagagcttgcacaatatattgctaatgatattggtttagatacgcaagccttatcactatggcaatcagaatttagtgccaagcaaatgcttgaagccactaaactcaatcaaaaactgcaacagcgcattaagacacaaggcatgatttcttggtttgaggcgaagaaaacagagaaaggagaccatactcatggagaagcatga

SEQ ID NO: 1266 - DNA, 987 bp, Proteus mirabilis
aaactatttatgtctcaacaaatacgacttaatgctacagtcgcagattcacagctgggtcaacgcttagatcaggctttggccgaattgttccctgattattcaagatcacgcataaaagagtggatcttagacaatagagtgcaggttaacgataaaatcatcaataagccaaaagaaaaaatgcttggcggtgaaaaaattgaagtcgatgccttaatcgaagaggatgttcgttgggagcctcagaatattccgttaaatatcgtctatgaagatgatgatattttggtgattaataaaccaagagatcttgttgttcatcccggtgcaggtaatcctgatggcaccgtattaaatgcacttctttatcgttatccagagattgttaatgttccccgcgctggtattgttcatcgtttagataaagatacaacaggtttgatggttgttgcaaaaacagttcctgctcaaactcacttggtagaagcattacagcgtcgcgaaatcacccgtgaatatgaagcggttgcaacaggaaggatgacagcaggagggctggttaatgagccaatttctcgacatcccaccaaacgtacccatatggcagtgcacccaatgggaaaacctgcggtgacacattatcgtgttatggaacatttccgtgcccatacccgcttacgtttgcgtctagaaaccggtcgaactcaccaaattcgtgtccatatggctcatatccatcatccattaattggtgatcaactgtatggtggtagaccgcgtcctttgaaaggggctagtgaagaatttcgtgagacgttacgtcgctttgaccgacaagcactacatgccacaatgttacgcctttatcatcctattaccggaattgaaatggaatggcatgcaccgttgcctgatgatatggtagaacttattcgcgtactaaaagtggacgcagaacagtttaaagatgaaatggactggtaa

SEQ ID NO: 1267 - DNA, 2691 bp, Proteus mirabilis
atacagtttatcataaaattaggagttgatatgagccagcgaggccttgaagcactattacgtcctaaatcaattgcggtgattggcgcctctgacaaagtaggcagagcaggaaccacaatgatgaaaaacttactcagtggtgggtttaatgggccagtctttccagtcaatccgactcgcaattctgtttctggtgtttttacttatccttctattgataaactcccccaagtaccagacttggcaattatctgtactcatcatcgccgcaatcttgaacttcttgagcaattaggtcaatcaggctgtaaagccgtgattgttctttcagcacaatcagaacaatttcaagctattaagacactctgccagcaataccatattcgcttgttaggtccaaatagtttaggtttattagccccttggcaaggcttaaatgccagcttttcaccccttcctgtaaaaaaaggcaaattggcatttatctcacaatcagcagcagtagctaacaccatcctagattgggcgtattaccgcaatattggcttttcctattttattgcattaggtgataaccaagatatccaagttgatgatttactggattttctagcaagagatagtaaaaccagtgcaatattactgcatttagagcatattcatgatgcaaggcgctttatgtctgcctcacgtagtgcatcacgtaataagccaatactagttataaaaagtggtcgaacacaaaaagcccaattactcttaggcgatacgccaagttatgatgtagcttatgatgcagccttccaacgcgcaggactgttacgcgtacaagatactcatgagatgttttcagcggttgaaaccctcagttatatgacgccattaaaaggcgagaaactgatgatcatcagcaatggttccgctcctgcggcaatggccgtagatgaattatttttacagtcaggcaaattagcacaattatctgctgatactcagcaacaattgcaagccattgtgcaagacacatctgctattcgtaatccgcttaatttaggtgatgataccacggtagagcgctatattagggcagtgaattgtctattagatagccatgatcatgatgcattactcttaattcatacaccaagtgctattgcaccaagtattgaaacagcacaaaaagttattgaagcaattaataagcaccccagaagaaaatggctcactctatttactaattggggaggcgaatattcatctcaacaatcacgtaaattatttagtgaagcggggattcccacttatcgcactcctgaaggcgcaattaccgcttttatgcatatggtggagtaccgccgaaaccaaaaacaactaaaggaaacgccggcattacctttagaaataaaaatgaacacccagcaagcccatcgctgtattgaagacgctctcgacaaaaaacagtatcgccttgatacacaccaagtccagcccattatggaagcctatggctttaatactttacctacttggattgctcataatgcacaagaagcggtcagtattgcagaaaaaataggttatccggtcgcgctgaaattacgctctcctgatatacctcataaatcggaagttcagggggttatgttatatttaagagacagcaatgaagttgaatcggctgcacatgccattatcgagcgggtaagcgagctttaccctcaagcgaaaattcaaggactattagtacaaagtatggcaaaccgtgcaggctcccaagagctacgtgttgcgattgaacaagaccccatctttggcccactaattctattaggagaaggaggcgttgagtggcaaatcgaaacaaaagctgccgttgctttgccaccacttaatatggcgctagctcgttatctggtcattaatgcaataaaaagtggcaagctccaacctagaagtgcattacaaccactgaatatcctaagcttaagccattttttggtgcaagtttcacacttactattagattgtccacaaattgtcaggctcgacatacatccgttgttagtatcgggtaatgatttcactttgttagacgtggctatggagctgtcacctatcgaaggcgatcctcatcaaaaactttctattcgcccgtatcccaatgaattagaagaaactttctttttaagagatagcaaaccttgttttattcgacctattttgcctgaagatgaacctctactaaaaacctttattaatcaagtgaccaaagaagatctctattatcgctattttagtgagatcagcgaatttacccatgacgatctcgctaatatgacacaaattgattacgatcgtgagatggcttttgtcgccattcgccaccctcacgatgatccagaaattattggtgttgctcgagctatggcagatcctgataatcaacaggctgaatttgctatcttggtacgctctgatttaaaaggtaatacactgggtcaccaattaatgatgaaattaatcaactatactaaggcgcatggcatcaaacggttaactgccattaccatgcctgaaaatcgtaatatgataagtctagctaaaaaattagggttttctgtggaagtacagtttgatgaaggaatagtcaatctcaacttgcttcttgatcctctcagtgatgtatag

SEQ ID NO: 1268 - DNA, 252 bp, Proteus mirabilis
gaagggtttatggcacgagtaacgagtgtaactttaggtgaacacttcaatgattttgtgggctcaatgattaattcagggcgttatggaaatacctctgaggttattagagatgctttgcgtatgatggaaatcagagaagaacgactccaattggttcgtaaaatggtactagatggtgtgaattcactagaaagtaaaaatgacatggatgatatttttgcaagagctgaaaaggacttaaatgtataa

SEQ ID NO: 1269 - DNA, 708 bp, Proteus mirabilis
ggtatccttatgccagacacacaccaaaagaaaactcgaggggaacttgcaaaacgacagttattagaagctgcctgtgaaatctttggtaaaaatgggcctgatagcgccacaactcgccagattgcgcaagctgcgaagcaaaatatcgcggctattgcttactattttggctctaaagaagggttatatctcgctgttgcacagtatattgccgatttaattcgaattgattttgaacccactgttgcacaacttgatgattttcttgaaaaacctaatccaacagagcacttacccctattacaaaaactgatcattgacagttttttgcaatatgcccgactcgtacttgataaaagcaatgtacatatcagtcgcattatggcaagagaacaacttgttcccacagaagcctattcccttatccaccagcaagcgttatctccgctattaactcgtgtaaatcgtttattagcactttatattggcttagatccaactttaccaaaaaccatgctacatactcacgctattttgggagaggtgctatcatttcgattagtacgagaaaccattttacgccaaactggatgggatagaattggtaaacaggaatatgaaattatttctaataccttaaaagtacatattactttactacttgatggactaagagagatctatactcataacaaccatgcataa

SEQ ID NO: 1270 - DNA, 219 bp, Proteus mirabilis
agaggtttcttttccaatcttccatgctggattaataccctcaatggtgttcttgtttgcatcgtagctgaaaatctatacccttctaaaacatccccaccagggtcattatctattgaagagggtcttctttgggcattaaataagtgctcaaatggagagtatgactttaatatgtatatccttgttccatcatcactatcctgccctgtatcatga

SEQ ID NO: 1271 - DNA, 282 bp, Proteus mirabilis
ggatttattatgagtagaactattttttgtactttcctaaataaagaagcggatggacttgattttcagttatatccaggagagcttggaaaacgcattttcaatgagatttctaaagaagcttggggtcaatggatggcaaagcaaaccatgcttatcaatgagaaaaaactcaacacaatgaatcctgacgatcgcaaattattagaacaagagatggtaagatttttatttgaaggccacgatgttcatattgacggctacacaccacctgaaaaataa

SEQ ID NO: 1272 - DNA, 312 bp, Proteus mirabilis
ctcaccattatactgaaatacgtattaagaactcaaaaactcttaatacgggcttacgtgctttcttcttcaccttcgcttatgcttttttatcttctccaaccccactctacactggagaaaatcatgacatcacatcagttattacgcctgaaacaggtcgaagaaaaaaccggtctgaaacgctcgcaaatctatctgtatatgaaagaggccacttttccccgttcaataaaggttggccctgccagcgtagcctggctcgaatctgaaattgatgaatggatcaacctcaaattagccaaccgctga

SEQ ID NO: 1273 - DNA, 909 bp, Proteus mirabilis
ggtaacattatgttagataaagcaagattacgaattgccatgcaaaaatcaggtcgtttaagtgatgattcacgagcacttttagcgcgttgtggcattaaaataaacttaaaccaacaacgccttatcgcttatgcggaaaatatgcctatcgatattttacgtgtcagagatgatgatatccccggtttagtgatggacggagtggttgatttaggcattattggtgaaaacgtattagaagaagaattactaaaacgccgagcacaaggagaaaatccaagttatatcacactgcgtcgtcttgactttggtgcttgccgtttatctcttgctgcaccggttgattttgattatcaaggggttgaatgcctcaataatacccgtattgccacctcttaccctaatctattaaaacgttatttagaccaaaaagggatcacctttaaatcttgcttattaaatggctccgttgaagtcgcacctcgagccggtctggctgattctatttgtgatttagtttctactggcgccacattagaagccaatggattaaaagaagtagaagttatttatcgttctaaagcttgtttaattcaacgtgacggtgaaatggacgcaacaaaacaagcccttatcgatcgcttaatgacgcgtattcaaggagttattcaagcgcgcgaatcaaaatacattatgttacacgcgccaagtgattgccttgaagatgttatcgccctattaccgggtgctgagcgcccgaccatccttcctttagcgggtgatcaaaatcgagtagcaatgcacatggtcagcagtgaaaccctcttttgggaaacgatggaaaaactaaaagcattaggggcaagttcaattcttgttttaccaattgaaaaaatgatggaataa

SEQ ID NO: 1274 - DNA, 2376 bp, Proteus mirabilis
aaaataattatgaaaaaaagtaaactctctatcattttatttatgctgttgtcatctcctttatatggggaaaataatgaagataaaagtaaagaaaatgaaaaatcacacgatgttattaccgttaaagcaacatcaataaaaaacaaagaaacattctcctctttattacttaataatcgggaagagataaaaggaaaacaattagatcaaataaaaacgaatacgattggtaataccgtttcaaaagttgctggtgtacaagcggaaggttttggcccaaatgcggcaaggcctgttattcgaagtctctctggcaatagagtcgggattttagttaataatcttccgattaatgatgtttcatttattagtgggaatatgcctgttcctgttgatatgaatagaattaacgaaatatcaattagtaaaagctccgaagcactactttatggtggcagcagcagtggtggtgcaattcatttgtgggatgaccgaataatgacacagtttcctgaaaaagcaatttcaggtgccgtgacatttaatggtagcactaataatggtaatggtggatcagtaaatattaaattcagtaataaagaaaactggatttttaatatttctggtgccactaagcgagtctcaaaatataaaattccaacacgctctaaagttggggcttgctatagctatcaacagctaaaagaccactttgcattacgtgatcaatgccaagtggatatgaaagtgtttactgtccgtaaccctgaagcgtatccttacattagtgagttttggaaaaaatatcaggttgaatatgagttaagcgaggatgaaaaatatacctttaaagataaggactatttttcaggtattggttatgtcgataatgaacctaactcacaatataaacctggtagccccacatctattgaacatgtcacacctccaaagcattatgttgaaaacaataataacgaaattcccaatagctttttaaaaagccaaagcggtaacgcatcactctcttatatcggagatgacggttatttaggtttttctgtcactgattttcaaacatcgtatggagtgccaggctatgcttatctcacaaccaaaacaactcgagaaaggtataaacctgtttcggtttcaaatagtaatcgaagaatagatgtacaaggaaaacatgatcatttagcaccatttttaagagacagtgctttttactactcttattctgaatcgaaagatgaagagttagtcggccaaattgcttcatcggtatttaatacaaaaagccatcagttagctttagaaactgcacatactccgctgtttaatcgacttaatggtgcgtttgggatcaacggtaattatcgtgatttgaaaacatcagggtatgacgcttatttacctagtgtattaaccaaagagtatggtatatattggattgaatcgctggacttatctccctttgagatcaccacaggatatcgtaaaggccataccagtcatcatctaaatattcctgataattacaatcgaggccgagggcaaggtgcaaatctgcaaaaccgtgattttgataccagtgcaagtacgttagcattatcttttacaccgattgatgaatggacattaaagctacaaaaaaatatttcttatcgagcacctgaaattaatgagctttatacacatggtcctcattatgcttatttaattgaagaacaaggaaacagtaagtttaatactgaaaaaagtaaaagtattgaattgtcatccattattgaggtgggtgatttctctaataaacttaatttatataaaacagactacagtgattttaaatttaggcgattaacgggtatcagtcgtggtggtgttactgttatggaatgggatgaaaccgatcttgaaacaaaaggattagaatatgaatttaaatatttatatgaaatgcctcatgatcacaatctaacatttacgttatttggtgattttgtcgaaaataaaagcaaaagaaaactgtttattgcaggtaactatttgccaaatttacctaatgaaaagcatggtatcagtattcattaccaacatgatgaattaactgcatttagtagtgcaacttactataaaaaacaaaaagaaagcggtgggttaatgtatggtggagatatgacctttccttcctatacgttagttgatgcgggtattggcaaaaaataccaccttgataaggtagatgtttcggttgattttattattaataatctcaccgatactgaagcaagacctgcatcttctcaattgaaatacttagccccattaccgggtcgaaattatggggtaaatgtcaaaattgatttttaa

SEQ ID NO: 1275 - DNA, 1836 bp, Proteus mirabilis
agagtaattattattcttggcgtttttgatactttgtatctcacctgcagatttgaatcttttctcatggataaaactaaacaaaatgaattggttcgatggctgaaacagcaaagtgctccagcccgccgttggttacggctatcaatgattttaggggtagtcagtggtttattaattattgcgcaagcatggttattagccattctactacaagcgttcattatggatgggctaagtcgtgatacacatacgactactttccttatccttatcagcatctttattttacgcgctgtcgtgatggcgatacgcgaacgtgtaggctatcgctgtggtatggcggtcagacagcaaattcgcaaaatagtacttgatagacttgaagcgctaggccctgtatgggtcaaaggcaagcccgcaggaagttgggcaacgattattctagaacaaatagaagatatgcaagattactatgcgcgttatctaccgcaaatgtatctcgcctctattgtacctttgcttattcttattaccatttttcctattaattgggccgcaggattaattctttttgtcacagcccctcttattcctttatttatggcgttagttggcttaggcgcagcagatgctaaccggcgtaattttcttgccttaggtcgcttaagtggcaacttccttgatagattacgtggtttggatacattgcgcctattcaaccgtggtgatgcagaagtaaaacagataacggatgcaacggaagactttcgtaagcgaaccatggaagtgctacgtatggcatttctctcttctggcgtattagaattctttaccgccgtatccattgcggtcgtcgcggtctattttggtttttcctatcttggagaattgagctttggtgattatgggttaggcgtgacgttattttctggttttttagccctgatccttgcccctgagtttttccaaccattacgcgacttaggcacctattatcatgctaaagcacaggcggtaggtgcagctggctctttggttgagtttttagaagccgaaggtgaacagccccaacctacgggtaatcaaactattaataccgaccaaggtattgaaatagttgcccaacaattagaaatcttgtcacatcaaggagccaaactggcaggccctcttaactttaccattcatcccaaacagcgtattgcactggtcgggcaaagtggcgcaggtaagagttcattacttaatgtattgttaggttttttaccttatcgtggctcattaaccgtcaatggtgttgagttaactcaactctctccacaggcatggcgccaatgtatcagctgggtgggacaaaaccctaacttaccagagcaaaccctgctggataatattcgtttaagtgatccgaacgccagtgaagcgaagataaatcaagctattgaaaaagcttatgtaagtgattttattaacgaattaccggatggtttaaacaccattattggtgataatgctgcccgtctttccgttggtcaagcccaacgtattgcggtagctcgcgcccttttatcaccttgtcactttttattattagatgagcctgcagcaagtttagactctcacagtgaacagcgcgttatgcaagcgcttaatgaagcttcattacatcaaacgacgctgttgattacccacttattagaagaaacgatggaatatgatcagatttgggtaatggaaaaagggcaaatcattgaaactgggacttatcagtcactcagtcaacaacatggtgcctttgctcgtcttcttgctcatcgtaaagaggaactttga

SEQ ID NO: 1276 - DNA, 276 bp, Proteus mirabilis
ggaaaaattatgtttaacaataaaaaaaaaaatactattattaaaaataaatccgattggttaaccatacctgaagctgtatacctagccaaccagaaaaaaacagagaaacaattaaccgacagcgacatttatcgccatgcgctatctggaaacatttatttatctatatactttcaatctccaattatattaaggaaagtcacaaaaattaagaataaaattaaattgaaaaaaaataggaaactctctcacagatcgtttatgctatcttga

SEQ ID NO: 1277 - DNA, 780 bp, Proteus mirabilis
tcgagcttcttcatggtttcttcaatcaaaacagataaacagcagatagcccagtgttttagtaaagcggctagccattatgatcatcatgcctctattcaacgttatagtggtgataaattgatgtatttagctcgccaccaagctggggatagggtgctagatgcggggtgtggcactgggtatttcagtcaaaaatggcgacaacaaggacggtttgttatcgcacttgatttatctcatgccatgttacaagtggcgagacaacaacaacgggctaattgttatttacaaagtgatattgagcactgtgcgatcaccccccacagcatagatatcgtttttagcaatttagctatgcagtggtgtgatgatcttgccattgcggtaaatagcttaatgagtgtcgtcaatccacaaggggcgctctatttttctacgttagcaacatcaacgttacaagaggtacgagatgcttggcagtttcttgataaccaccaacatgttaacccgttcctctcttaccaacagattgaacaagcctgtagtggttttcaatatcaatttgtgactgaaaaggtgacagaacaatatgcatcattgcctgagctttttacctcattaaaaggggtaggcgcgaattttgtgcaaggagaacggccaaaaggattaatgacacgccaaaaactgcgtcaattagagcaagtttggcgcaaaacagactctggtaaatatttacttacttatgaactcgttataggaaagatttctcatggctaa

SEQ ID NO: 1278 - DNA, 300 bp, Proteus mirabilis
gaggtagttatgaaaatcaaagtagagttcccattgttatcaaacaaattttcaggagtggaaattacaggggatgtgaaaagatatggcattggggctataaaaataagtgaaaaacctatattaacgtcagaaattacagtaacggagatagtgggaaataataccccagatgaagaaccaaagttacaatttaagtacacagaggattataacccaaatgaaacatttgcttcatttatggggagagcggaaaaatatgcaagaaccatgatagatcgcataaaggcggcacagtaa

SEQ ID NO: 1279 - DNA, 1230 bp, Proteus mirabilis
cgcttacctattatttttaaagcaatgagttatggcataacaatgatgagaaatgtaaaaaacgattttgatgcagtcattgccggtggtggcatgattggcgcagccgttgccattgggctggcgcaagaagggttgcgtgttgcaatggtagaacggcaatctccagcaccttttgatgcctcatctcatcctgatattcgtatttctgcgatcagctgcgcgtccgttagtttattaaaacagctaggtgcatggcaacatgttttagcgatgcgcagtgcgccatacctaaccctcgaaacatgggaagaagataatgcccatgttatttttgatgccaaaagtcttggtttacctgaattaggttatatggttgaaaatcgcattttgcaattggcattgtggcaagaagcagaacgttatagcaatatcactttattatgcccaaatagtctaagtaacatgaaatacttagataataaatggcaagtcacgcttgctgatggtcagaaaatcaccactcagttagttgtaggggccgatggggctaattcgcaagtgcgtcaaatggcggggattggcagtaatggttggcagtatcgtcaatcctgtatgttaatcaccgtgaaaacgcaattaccaccagaaaaaggtacatggcaacgcttttacccttcagggccacgggcttatttgcctctgtttgataattgggcttgcttagtttggtatgattctccgcagagaattagaaagctacaaacgatgtcaatggcacagttagaaaaagaaatcgaacatgctttccctgaacgcttaggcaaagtgacacctattgcagcaggctctttcccattaactcgtcagcatgctagtcgttatgttgataatggtgtgattttggtgggggatgcggcacatactattaatccattagcaggacagggggttaacctcggttatcgtgatgtggattgcttgcttaatttagtggcgcaagcgaaacagcattttgaaccttggcattcaatggcattgttaaaaaaatatcagcgccgtcgtatgcctgataatatgctgatgcaggcaggaatggatctcttttaccacgcttttagccatcaattaccaggcttaaaattagccagaaatatcggattattagctgcgcagcatgcaggaaaagcgaaagaagccgcgctacgttatgctttagggattaaatga

SEQ ID NO: 1280 - DNA, 1332 bp, Proteus mirabilis
ggatgtactatgagtgattttacccagaccgttcctgagttagtgtcttgggcgagaaaaaatgatttctctatttcactgccaccggaaaggttagcttttttgatggcagttgctgtattaaacagcgaacgccttgatggcgagatgagtgaaggggagttgattgatgcctttcgagaggtgtgtaaaggctttgatcaacccgcagaatcaatacaagttcgtgctaataatgccattaatgatatggtcaagcagcggctttttaaccgttttaccagtgaactggtagaaggtaatgcgatatatcgtttaacgccattaggtattggcatcagtgattactacattcgtcaacgtgagttttcatcactacgcttgtcgatgcaattgtcaattgtggcaagtgagttagattcagcggcaagtgctgcagaagaaggtggtgatgcataccattggcatcgtaatgtttttgcaccattaaaatattcggtggctgagatattcgatagcatcgatttatctcaacgcattatggatgaacagcaaaatatcgttaaagaagatattgctgcactattaaaccaagattggcaagctgccatttcaaactgtgaacaattactatctgaaacctctgggacattaagagagttacaagacacactggaagcggcaggggacaaattacaagcgaatctattacgtattcaagaagcgaatatgagttcaggccatgtcgaccaaatagatactttagtttttgagttacaaagcaaacttgaccgtattattagttggggacagcaatctatcgatttatggataggttacgataggcatgtgcataaatttattcgcacggcgatagatatggataaaaaccgtattttttcacgtcgcctacgccaatccgtacaaaactatttcgacagcccatgggcattaacttatgctaatgcggataggctatttgatatgcgtgatgaagagcttgtgttgcgagatgaagaagtgaccggggaattgcctgaagagctggaatatcaaatgttcagtgaagtaaatgaacaaattgctcaatgggttgaacaagagctggctgcttataaattagaacaacgagcgttagatctcagttcagtattagttgagtatcttaatcgttatccacaacagaagcattttgatgtggcacggattgtcattgatcaagcggtacgattaggtgtcgcgcaagctgaacttgcaggattgccagcaaaatgggcagaaattaacgaatatggagctaaggtacaagcgcatgtcatcgatacatactga

SEQ ID NO: 1281 - DNA, 2046 bp, Proteus mirabilis
ggagttgctatggttcgttcttttttaatagcattgatgttgatgctattttcattatcttcattagccgccgatacaggttggctaactatgccagacaatgatcatgctcaggttagggctacggctgacaagtcatcgacaggcgatgttaaaatattgcttgaggtgcaattagcgccgggctggaaaacatattggcgctctcccggagaaggtggcgtagcacctgaaattaattggacgcaatctgtgtctgatatgatatggcattggccatcaccttccgcttttgatgtcgcaggtattcatacccaaggttacgataaagaagtcgtcttccccattgaactaaaatctgtcgatagcgataacttaaatggggtattaacactttcaacctgtagtaatgtctgtattttaactgattactcattaaatctggatttaaacgagcctgctcccgctgattttgaatggcaatataatcaagccatggccaaagtacctgtgacaagtggattaatttctgctgtttcatctgattatcgaaatagtcaattaaccctctcattacaacgagaacaaggtgactggcatcaacctaatatttatctcgatccaccacaaggaatgctatatggcattccacagttaacagcaaaaggtgatcatttatctgttactgtcgatgtaaccgatgattggggagacgctgcgggtgacattgtaggaaaaccactctcctttgttgtgactgacgatggctattcacgtcaagtcaatgacactataggccaaggcgatagcgtatctctgcctactgctgactcgggggtaggattgtggagtattttagcctttgcgctgttagggggcttaattcttaatttaatgccttgtgtgttacctgttttggcaatgaaattgggctcaattcttcatatcgaaaaacgtgatacaggggctattcgtaaacagttttctgtttctgttgtgggaattttagtgtcattttgggccttagcgctgtttatgaccgtattacgctacagtcaagaagcaataggttggggcatacagtttcaaagcccttggtttatcggctttatggtgctgatcacggctatttttaccgctaatttatttggcctatttgaattacgtttatcaagtaatatgaataccaaaatagcgacagcaggaggccaaggttatagtcgacatttctgggaaggggcttttgctacattgcttgccacaccgtgttctgccccattcttggggactgcggttgcttatgcattgatagcaccattaagtgagttatggttaattttcaccgcattaggtcttggaatgagtttaccatggatcatggttgctatgtttccatcaattgccaaagtgttgccaaaacccggtaaatggatgaatcgcctaagagttgttttaggctttatgatgttgctatcttgtatttggctgatcactttattgatcccccattttggtattggcattgttgcggctatttttgtggctatcgccctgatcttgctttttgctattgctaaacattacggcaaaaaaacgctatttgcttcaatggtgatcacccttattttgggtggtacaagctatctatttattgctcagcctgatactcagaccttggcggggcaagatcatgtaaattggcaaccactctcagaagaggctattcatcaagcgttagctgaaaataaacgggtgtttattgatgttactgcagattggtgtgttacctgcaaagcaaataaatacaatgtattattacgcgatgatgtgcaaaaggcactttcagagcctgatgttgtcgcattaagaggggattggacgaaaccgtcagaacagatcacccaatttttaaaacagcgcggtcaagtcgccgtgccgtttaaccagatttatggaccatgtaacaaggagggggagatcctaccgcctcttttaaataaagatctaatgttaactattctttcagaggctaaaggagcccaataa

SEQ ID NO: 1282 - DNA, 1389 bp, Proteus mirabilis
ggtatttatatgacattgagtcagcatgtagctaattttattactacaacgacattttcacagcttccaacgcaactgatagctcgagccaaattacatttattagatacattaggtgtagcacttgcagggagtacacaatctagctcgaaacaaggacgtcatgggattactcttttacccgatagccaaggtaagatccccatttggggaagtatgcagacagctaataccactgcagcagccttagccaatggtattgctgcacatgcattagatttcgatgatacacatactgattctattactcacggtagtgctgtattaacaccgatagcttttgcgttaggggaaacattaaacgcctcaaatgaagaaatattaacggcttgggttattggttgggaagttgctgcacgggttggtttagcgagtcacagtggtttccatcaacgtggatttcatgcaacggcgattgctgggatcttcggtgcaacagcatgtgcggcttcattattaaaacttacgtcacagcaggcggtaaatgcgttaggactaacggcaagtcaagcagcgggtatcgctgaatatctgactaatagctcatcggcaaaatgttttcatgccggatgggccgctcaatccggtattattgcagcctcgttagctaaagggggaatgactgggcctgagacaatatttgaagggcgatacagtatttatcatactcatgggatcagcgagcaagcgatccctgaacaagttgcacaaggattaggtgaacaatgggagtttttaaatgtttcaataaaaccttatccggtttgccattttgctcatgctactgttgattgtggacgtcgtttacttaaaagagggatcagtgcggaagaaattgaacaagtagaatgtgtgattgatccagttgctgctgcattaatttgtgagccactcgaaacaaaatgggcgccaaaaacagcttatggggcaaaatttagcttaccttggttatttgctattggttttttggataatgcgttaactttatcatcgctttcagcggaaaacttacagcgtaacgatatccaactattggcgaaaaaagtgagctatcgttatccatcagaaaatgaaattccctttccgagctattttcctggattaatctttgttagattgaaaaatgggcaacaattaactgaaaggatcgatattcagtatggtaaccctgaaaatccgatggttgatacggatgtaatagcgaagttttatgataatgccaagtgtgtaatgaaaaagacacaagctgatcaactgattgaaaatataatgaattttgaaaatatacctatttcattacttacacaattattacgggtagaggcataa

SEQ ID NO: 1283 - DNA, 1251 bp, Proteus mirabilis
attatctatatggtataccaatttggtataccagaaaagaatgtttctatgactcaattatataacagcttttggcgtcgaaatctgctcgtttgctttattggttctttttcaactgtttttgcaatgaccttgatgttaccgttcctccccctatatgttgaagagcttggtgttcaaggtcacgccgccattgtccaatggtctggcgtggcattcagtgcaacgtttatcactgctggcttaattgctccagtatggggaaagctcggtgacaaatatggacgtaaatcgatgctcgtaagagccagtcttggtatggcggtgaccgtctcacttatgggaatggtaacaaatatttggcaacttgtcggtctaaggctattagttggtttggcggggggatactcatctggagcaactattcttattgcagtacaagctccaagagagcgtgtcgcttgggcgttgggcattgtttcatgtggtgtaatggcgggtaatcttattggccctctagctggagggtggttacctgacttgttcggtattcgaaacacgtttttctgtgccggtgcactgatctttttatcctttatcatgacccttacgcttatccgtgaagatacgccgaaatacataaatactacgacaaaaatgcaagtgagttggtcgcagttaccagcacgatttgtgatagttagcatgctttgtacggggttgttgctgatgctggccaatatgtcgatagaacctattattacagtttatgtgcgtacactcgttaatgatcctgctcagataactagggttgcaggttatgtcatggccgctgctgccttaggtagtattatttcagcctcttggcttgggaaattagcagataggatagggcatttgcgtattatcacgctggcactagctatagccggtttattgctgatccctcaggcctttgttacctctggttggcaacttattattttacgttttcttatgggattagcattggggggattgttgccttgtattgcggcagtaatacgtcatcacgttccagaaggaatgataggcagtatccttggctattcggtcgcagcccagtttgcaggtcagttcatcggcccgttaataggtggcgttattggtggtcatataggtatgcgcgcagtttttctggcaactagtgttgtcttattgttgggagccgcttggaattttaaattacatcgtaattcagttatacgctga

SEQ ID NO: 1284 - DNA, 723 bp, Proteus mirabilis
gtaatatatatgaataaaccaatagatactttgccactaaactttcgtattttaataaaatcagccccactccctctgattagtggcattattatggcaataatctcaacaatgctaagtttagcaccattatggatcatctataaaatcagccagatttgtttttcaccatcacctaatattcaacaaataaataatctagtttatatcactgtgattattttaattttacgttggggattaatggcaataagtcatattgcctcacataggggcgctttttatattcagcatcaattacaactcgcaatagctaaaaaaatcagtaaagtaccattatcattttttgctcaatatggcagtggaaatctgcgacgtattatcaatgatgatataaaaagtttagaaggttttttcgcacatatgctacctgatctcgtctcagccatagtgactccctttatcgccattatattacttttttatgtgaattggcctcttgccctattatctctaaccccattacccattgcttttatggctcaacttctcatgttgcgtcgagccaataaacaaaccaatgagtggatgaatattcagaaaaaaattgctaatgaaataggagaatatattaaaggaatacgagaaataaaagcgtttaacttaacctcccatacttttggtaaattatctcaatctatcaattcctctgtaaatggataa

SEQ ID NO: 1285 - DNA, 2172 bp, Proteus mirabilis
ctactgatttttatacagtattatgcgacaataacgcttattttaatgacaaatagagtagttatgtccctttctcaatctgtaaaaatgcaaatcagccaatggtataaagcattacctgagcatattgaaggctttattccacgagcgcctcagcgcgaaatgattgctgaagttgcgaagacattttctgatgaaacggggcgacatctaattattgaagcgcctacaggagtaggtaaaacactctcttatcttattcctggtattgctattagtcgggaagagaaaaaaccactgattatcagtacggcgaatgtggcgctacaagatcaaatttacagcaaagatctgcctttactaaaaaaaattattccagacctgacttttactggggcttttgggcgaggtcgttatttatgtccccgtaatttagaggcaatttgtgcaacagaaggcgagcaaattgatttaatgttcttgctggaagataaagttgatgtcgcaaccagtgcggaaagggagatttgccaagagttaaagcacgattttaccagctttggttgggatggtttgcgtgatcaccataaacgagcattaacggatagtttatggcgcaagattagcacagataaaatgaattgcttaggtcgtaattgccaatactatcatcgctgtcctttttttctggcccgtcgagaaatagacgaagttgatgtggttatcaccaatcatgctcttgtgatggctgcgatggaaagtgaatcggtgttacctgatgcaaaaaatattttattagtattggatgaagggcatcatattcctgatgttgctagagatgcgcttgaagttgaaggggaaataaccttatcggcattaaatatgcaacttgataatatgactcgtcatgtcagccaatatttagcacaatttatcccagtcaaaccacccaaattagccgatcccattcgttttgatgctcatattgcaaaaatgcgcgaagcctatcaagacgttgaacattttacccgcgcgttattgcctgagcgcagtgaaaatgatgaatatttatttccattaggtcaattacctgaacaattactattatgttgccaagacttatttaagctaaccgatggtttaaaaatgttaggtgagtcgattcttaacgacttaactgagcgaacagcaaaagaagatgttgtacgtttacatcgcgcgattttaaccaccagcagaatggttggttatctggaaaatatggcaaaattatggcgacttgcgacattagagcagacatcaaaagcacccgtttcgaaatggcttactcgtcgttatgataaaaagcagtcacatctctatttacattgtgctggtattcgcgttagtgaacagttaacacaattattatggaaaaatattcctcatgtggtgatcacttctgccacactacggtcattaaacagtttttcgcgtattcaagagcttacaggactaagcgaacactttgatgatcgttttattaccttgtcatcgccttttacacatgaaaggcaagggaaacttgttatccctaaaatgcgttatgaaccgacaatggcgaatgaaaaagcgcatttaaaagagatggcacgctattttcgtcaaggaatggtagaaaaccaccatcgagggcaattagtattatttagtagtcaacgggcgatggaaggttttttagaggaagttaaagatctacgtttgagtcttttagtccaaggagatcaaccgcgctatcgtttagtggagacacattgtaagcgtattgatgcgggcgataatagtgtgttaattgggttacaatcttttgctgaaggattagatttaaaaggtgactatttaacgcaagtacatattcataaaattgcttttccacctgttactgatccggttattgtgacggaaggggaatggctaaaatcactgaaacgttatccttttgaagtgcaaagcttaccaagtgcatcatttaatttgatccagcaagttgggcgtcttattcgtagccatcattgccatggtgaagttgttatttatgatagacgtttattaacgaaaaactacggttcacggctattaaccgcgctacctgtctttcctatttatcagccagatatacctaaaacagaataa

SEQ ID NO: 1286 - DNA, 1221 bp, Proteus mirabilis
tgtaaacatattattacgtttatgccttttttattgaaaatatggattgatttctttacattgcatgttatcttatcgtttagacacacaaaaatcacaatgacagacataaaaaaggtaaagattatgatcatgcaaaaagacgcactcaataatgtcaacatcagcgaagagctggtgttaattacgccggaagagttaaaacaaaaatacccgttgagtcgtaatgatctgcatgccattactcaatcacgtcaaactatttctgaaattgttcaacgtcgtgatccgcgtttattagtggtatgtggcccttgttctattcatgatgtcgatgttgcgttagattacgcaaaacgtctaaaagtcttagcgtctgagttaagtgatagtctgtatattgtgatgcgtgtctattttgaaaaacctcgtacaacagttggttggaaaggtttaattagtgatccgtttatggatggcagttttgagatggaaaaaggcttacatattgcccgtaaactattaacagagttggttcagttaggtttacctttagctacggaagccttagatcctaacaatcctcaatacttaggtgatttatttagttggtcagctattggggcaagaacgaccgaatctcagacccatcgtgaaatggcatcaggtttatcaatgcctgtcggttttaaaaatggtacagatggtaatttagatacggctattaatgcgatgaaagcggcttctatgccacatcgttttatgggcattaatcaatcaggacaagtctgtttattacaaacacaaggcaatcctgatggacatgttattttgcgtgggggtaagaaacctaattaccatgaagaagatgtcgcgttatgtgaagctcatatgataaaagcgggattaacaccatcattgatgattgattgtagtcatggtaattcaaataaagattttcgtcgtcaatctgtcgtggttgattcagtgattgagcaaattaaaaaaggtaatcaatcaataacaggaattatgttagaaagccatattaatgaaggcaatcagtcatcagagcagcctcgtagtgagatgaagtacggtgtttctgttactgatgcatgtattagctgggaaaccactgaatcggtgttaagaaatctgcatcagcaaatttcgccagttttagcacagcgtgcagcgcaactaagaaaagttagctaa

SEQ ID NO: 1287 - DNA, 2373 bp, Proteus mirabilis
aatatgattttattagccaagataaaatatatttatagaaataaaatagcgttaataaaatggcattatctatatgctaaatatattgcaatgctagggctaaaacctcttaatatagattatcttgccgttatcattatattaagttgcttacctttacttattcaacgtgaaacactgagtttatctctgagctatacactgattatcgtagggatattgttatatttaattcctttttcatacttacgttttttgttgctattactctgtttttggtgctatgcaaacagtactgcctcctctttaatggccaaaacctctcaacttgctgacaccattgccacaatagaaagcgcaattctagaatatcgtcgattgccggatagcaatataatgattaaagttgctattcctaaacagcatctcttttctgctaagctctatgccaatatatattggcgtcatccgcctaaaaatgtcgtagtcgggcaaacatggctgtttaaaattcactttcgtgcagtacatggttatttaaatgagggaggatttgacagccaaaaatatgccgtttcagtaagagaaacattgtcaggaaagatattatcagccacattaacgaattctcaccttcctatttatactcaatttattcactatctttcatcttattggcaagccacaaaaaatagtggtgaaatcacagcattagtgttaggtgataaacgaggtatttctgccgaaaataaaatactttatatgaaaacaggtatttcgcaccttattgtgatttcagggctgcatattggccttgctgctctgtttggttggctgatggcgagaggagtacaatatcttttcccaacgcaatggattaacccacaatttcctttggttattagtttaggttgtggtgttttttatgcggctttatcaggatgggggatccccgcaaccagagcgataataggcctaactatttgggttttactccattggcgtagtggactttttttaccttggcagtgggcgatttggagtgcggcagtgattttattgcttgatccgcttgccatattatccgctagtttttggttatccttttctgcggtatttgccatcattgtttggtattggctctatccattaaataaaagatttagccagcaaaaacgttggtttgttattagactcattcatttgcaactagggctattgatcatcttattaccctttcaatactacttatttggtggtggtaatctttttagtttgcttgttaatttatgggctgtacctattatttcgtttattaccgtaccacttattatgtgtgggctatttactgcctttttacctgttatacaacctattatttggtcatgggttgatcagtctatcaattgggcatttttctgtgcgccttattttcttgcgtattggcaaccctgtggcgctgtcccctggttatttgcattaagcggtattatgactcttttagttatcaaaatgagctggtggcgtcatcatgtgattattttgatcactattgctacttttttatattgtgaactgtctttctctaaacgttatgattggcgaataaccatgttagatgttggacatggtttagctattattcttgaaaaagagggagaagcggttatctatgacacagggatacgttggaaaagtggtggcactattgctaaaaatgttattattccctatctaacgcatcatcgattacagcctgttgccatgataattagccatgatcaccttgatcataccggtggtattgacgacttattacgtgcttatcccaagttaactatccgtagtagctttgacaatccccaacatttaccgtgcttacaagggggagtatggcaatggaaagaccttactttcaacgcgctctggccgctgacattatctcgctcacctaaaaataatgattcttgtgtaatttcattaacggatggtaacagtgttattttattaaccggcgatctggaaaaagagggggaagctcaactactgagaaggaaaaaagcctatttaaaagcggatattttacaagttcctcatcatggtagccaaacatcatccacattggcgtttattcaagcaatatcaccaaaatatgcactagtttctgctgcacgttatagcccttggcgtttaccttctgataaagtacataaccgttataaaaaagaggccattgattggctaacaacatcgataaatgggcaaatttctatcgagtttaaacacggaaagattgatgtagtcacctatagacgagatattttacctcgttggtatcatcagtggtttggtgttttgacgtttcccgagtag

SEQ ID NO: 1288 - DNA, 2034 bp, Proteus mirabilis
aattataatatgaatttattttataagattaatgtaaataacttttcattgaataaaaaaggaattgatatgactataataataaatatgaaagaatcgactaatttctatttacctaaagggatcgtaacaacaggagttatggctggttggccccaaaaatcaccaaataaaataacaacagtaacttatacatttccagatcacaatacatatcgagaaattataaaaagcaagaccccaataacagaaagtgaagaaaaaaacacgttaaaaaatatatatgaatatcatagattatataatgttagggaacaaaaaaaacaagaattaaacacaattaaagataaatatagcgaggattcaaaaaaaagaattaaagaattagaagaagaaatagaaaaaatagaagataagattattaatacagtagataatatacatccctatttttatttaactcaagaaacgatatttcctcatcaacaagaagttatcgaagatatattacaacacatctcagatatattatctatatttttttataaaatttcaccctatatcaatgctgatttaaagtttggctattatagtcaatttattgatatgtccactcataaattaatttcaaattctcgaaaaggtaatgctgctaatcctaacgtggaaggtacacctaggaaagaaataaaaccagatgaaactcatgaccttcctggaactatatttgttaatatttccacacaagaatattataaaacaatcaatcaggatggtattgatgagtatataaaaaatgaggctaaaatcaatgacgtgtattattttaataatgataaaactatttcaatagcaagaggtaataataatttattcgaagaataccaacaaaataaacataaaattggctcatatgaatatcttgtttttatgcatgaaataggtcatgctctagggttaaaccatagctggaaatatataccaaataaagaacataaagtattatattcatataagtattcaattatgagcattgattttgctgatattgaagatgcagattttggtggcctttatcctatgacctttatgctagtagatatattattattacaatatctctatggcccaaatatgaccacacgccttgaaaataatacctatggatttaattccaatacgggacgcgccgcttactctttaaatagcatagaagataaactagtgagctgtatttgggattcaggaggaattgatacattagacttttccctatataccgttaatcaagtcattaatctcaatgaaggctgtttttcagatattggaggattacggagtaatatctctattgcctataaaacgattattgaaaatgcgattggtggtaaaggtgatgacactctcataggaaatccttttgataataacctaatcggtggtgatggcaatgatttattctatggcggtgatggcaatgatttattctatggtggctctggaaacgatgttatatacggagaattgggaaatgatgtgctctatggtgatgatggagatgatatgcttattgattattatggtgctaatatgttggatggtggtaagggtaatgatcggatctgtgtagcctcaacagatagagggcttccaggtagaaatatcattctagggggagaaggtgatgatgaaatatatttgggcacgggaactcatcgtataacaggtggacaaggaaatgatacctttaattttttctgctatgagagcgttgaaagcaatagtttcatttgggattttgaaaaaaacaaggataaaataacattgattactagagattatagaaaaatagatatatcaaaaatgaaaaaagttgataagttatcaggaagtaaaaatgaattttcattaaatcataacaaaccagccaataagaccatcatagatgtttcaacatcttctaacgacaataagtccattgtacatatagagattgtcggtatatttaaccacgatgaactctttgcggtataa

SEQ ID NO: 1289 - DNA, 792 bp, Proteus mirabilis
agacataatatttaccaaataggacaagtgatggcttggcttaatcaatacgaccactttgtgccagaagaacaccttgcatcagttgtgggtattgctgcagagatgggaaaacatgattcaggttttcactcacatgatagggggcagttactgtttactcaatcgggttgtatgagaattactttagcctctcgtgtatctgttttgccacccatgagaattgcctggatcccgccaaaactggaacaccgagtcgagatgtatgcggctgtaggttatcgttcagtttatattgccgataaatttcatcatcgtttcccaactgaaagcgaaatattaactatttcacctttacttagagagatattagagcgtattgccattgctgattttgacacccagtgggaagtaggacgttatgcaaatttattagctgtttttttagatgaaattcagcaagctaaacgtcaacctaatcatttatcaatgcccagtgatagacggttaagaaaattatctttcgatgaattacctccgccactacaagaattagcgcaatatattggtgctagtgaaaaaaccattactcgattattttataaagaaacaggattaagctatcaacaatggcgtcagcaatggcgattaatgaaagcgatagagttattagccacacatcatcgttatttagaaattagtcaattattagggtttgccagcgatagtgcctttatcactttttttaagaaaatgaccgggcaaacaccacaagagtatttaagaaattga

SEQ ID NO: 1290 - DNA, 297 bp, Proteus mirabilis
ggaggtaatatgaccaagtctgagttaatcgagagacttgcaggcctacaatctcatctttcggctaagacggttgaagaagctgtaaaagaaatgcttgatcatatggctgatactttggctgatggtgagcgtatcgaagtccgcggattcggcagtttttctctacactaccgtgcgccgcgtacgggtcgtaacccgaaaactggtgataaggtagagctggaaggtaaatacgttccacactttaagccaggtaaagagttacgtgaccgtgtaaatatttatacggaataa

SEQ ID NO: 1291 - DNA, 474 bp, Proteus mirabilis
gatcacaatattatgagcgaaaaatatgttgtaacgtgggatatgttgcaaatacatgcccgtcaattggcacaacgtttgttaccagtcgaacaatggacaggcattattgccgtcagtcgtggtggattagttcctgccgcattacttgctcgtgaattgggtatccgccatgtggatactgtctgtatttctagctatgatcatgaccatcaacgtgacctcaaaatcttaaaaaaagcagaaggtgatggtgaaggttttatcgttgttgacgatttagttgatacaggtggcaccgcaaaagttatccgtgaaatgtatccgaaagcacattttgtcactatctttgctaagccagaagggcgtccgttagttgatgattttgtggttgatattccacaaaatacctggattgaacaaccttgggatatgggcgttatgtttgttccccctgtttgtgataaaaaataa

SEQ ID NO: 1292 - DNA, 747 bp, Proteus mirabilis
cgcatgaatatcacagcagatgtacaaaaattagagccgggtaataaggttcaattaattgaggtggatggcagtgagtttgatgggcccattcttcgcttccatgcttacaatctacctcatacaccagaagagatagagcaatctaatggtgatatcaagccaaaaccaatttggtggcaaggcaatgaatacggggcatggccttatgaagttgaaggaatggcaaaaaatagtgatggtagtccagcgagaccatctctaaaggttgctaatatagatggcttaatttcatctctatgtcttcagtttgacgacatggtgcaagccaaagtgactatttatgagacatttgctcactatcttgatgctaaaaactttcctgagggaaattcaacagctaatccagacgaatgctttaaacaagtttattacatcgatcgtaaaactaatgaggtggctggcgaatccgtagagttcgagctgtctagcccgtttgatttgcagggagtaatgatacccgttcgacaaattcataatctttgttactggtgcatgaaaggcgattatcgtagtggtaatgggtgctcatattcagggaataaatattttgatgagagaggaaaccctgttgatgatccagcgctagatagttgtggtgggcttattagtgattgcaaaaaacgctttggtgagaatgagccattagattttggagggtttcccgctgcggggttaacgagatga

SEQ ID NO: 1293 - DNA, 630 bp, Proteus mirabilis
ggtaagaatataatgaataatacaaaactcgcccaattagattggcaaaaagtcgataacctaatgcctgtcattatccaaaatgctatttctggtgatgtcttaatgcttggttatatggataaagccgcattagaaatgacgctaaacagtggcaaggtcactttctattcacgaactaaacaacgtttatggacaaaaggtgaaacatcaggcaatttccttaaattagtggatatttatcctgattgtgataacgatactttacttattttagctcacccaatcgggcctacttgtcataatgggactgaaagttgttttgctccggctcaaagccaatggggatttctttatgagcttgagaacttactgcgcgagcgtaaaagcgcctcgccagatagctcttatacggcacaactttatgccagcggaaccaaacgtatcgcacaaaaagtcggagaggaaggtgttgagactgctttagctgcaactgttaatgatcgtgaagagttaaaaaatgaagcttctgatttgctctatcatttaatggtgctattacaagaccaatcgctatctctatctgatgtgattgattgcttacaaaagcgtcataaaaaagcgcaataa

SEQ ID NO: 1294 - DNA, 2940 bp, Proteus mirabilis
atggcagatatagcaacaatatcattaaaggctgatacgtcagatctggagcgtggcacacaaaagttaaaggaattcggcgatacggcagaaaaggtaagcggttcttcgcgaaatttaaatgaccagtttaatagaggggttgatcatcaaaagagagcagccgacgcgataaagaggcaaaagaaagaacttgatgacttattaaattcaataaatccaaccaataaagcatttgatgcgcttgataaagccactcaaaaattaatagaggcaaataaaaaagggatattaccaaaggatcagtttgcagactataacgccatacttgaacagactagagataaattaacacgagttaatatgtcccttactgctgaagggcgggcgttgttagctcaagaggcagcaacaaatagagccaagcaagctgctgatgattttttaaattcactgaaaaatcaaactgaaattataggaaaaacgaggacagagattttagagctaaaagcggctcaacttggcgtgtcgcaacaagccgcgccgatgatcaacaagctaaaagagcaagaaaaagcattcttaaatggctcaatcactattggtcaatatcgaaacgctatgcgacaactaccagcccaaatgacagatattgttacgtcattagcatcaggaatgcctgtttggatggtgatgatacaacaaggggggcaaataaaggactcatttggtggtgtcggtaactcactaaaagcgttagcatcacttattacccctgcaagagttgctatgtttggttttgctggtgctgcggcagctgtggcgttagccgcgtataaagggtcgcaagaatttggcgagtataataagcagttaattcttactggtggttatgcaggaagaacagctgcacagctggatgctttggctagaagcttatcggggaatgggataactcagtatggaatggctgatactatttcaaaagtagttggctctggtgctttctcgggccgagatgttgacatggtatctaaaaccgctgctgctatggaaaaagccgttggtcaatcggttgatgagacaataaagcaatttcagagattgcaagaagatccagttaaagcagtcactgaattagataaatcattacattttttaactgctacccaattagaacaaataaccacacttcagacgcaaggaaaagagcaagaagcggctaaaatggctatggaatcatatgccaatgctatggatgagcgaaccaaacagataaaggaaaatctaggtacgcttgaaaaagcttggcaatgggttggcaatgaagctgaaaaagcatgggataaaatgttaaatatcggcagggagaagactcttgagcagcaaattcaagagtatgaagaagctttaattgaagctcaaataaaacctgctggaaaagatatactacgatacaaaacagggttaaccgtagatgaagttaaaagtaaactcgctctattaaaagaaaaacagactcaaatcgctataaaaaatgcaagtgaaaaagccgcaagagatgaggaagagcgtaaaaaggcgcaatttagagccgatcaagaattaaagcgacaatacgaaaccgcagaggaaaagcaccagagaacactcaatgagataaaaaataacgcgtatgcatctcaagctgcaaaagatgaagccatccgccgagagaaagagcgttacgagaaagaaaaagccaaaggtaaaggtaaaaccccaacctaccgaccagattatggtactagagtagatgaatcagcaaatcaagccctactatccctgcaagcacaattgaaggtgctaaaagagcataaaacagtcagtgatgtgattagctctgagcgtaaaaaactttgggatatggaagcgaaaatatcaatccttgaggaggctcagaaaacaagacagttaaccaaggacgaaaaggcgttgcttgctaaaaaggactacattcttgcttctcaagaagcactggccatagctggtgatgaggttaagcttcaggagttacataatcgtgagttagataaacaacttaaacgtgttgaagaaattaatgccagaagtcgcgccttagagttgggagctggtaagtctgaccgcatgtatcaacgagacattgcactagagaaagctaaatcaccagacgagagaaaagccttagaggagtattatgctaaggaagactctattcgtgctaactgggagttaggcgtcaagaaaggctttgctgaattccaagaacaggcaacaaacgtttacggtaacgtagctcaaattagtcaatcagcattccaaggcatgagtaacagtctctctgattttgtattgacgggcaaagctaattttgctgacttcactcgctcattcttagaaatgaccaccaagatgttaatgcagatggctatgctaaatgctatgaaagcggcatttggtggtaatgcggtaggtaatttctttgggtttgcaagtggtggttatacaggcggtggtggtaaatatgaccccgctggcgtagtgcataaaggcgagttcgtctttaccaaggaagcaacgcaacgattaggtgtagataatctctatcgactaatggatgcaggaaagagaggttatgcttcaggtggtcatgtcggtggttctgcgccaatgtcggttacacagccaacagcatttatcgctcgcaatcctcaaattgctggtggtggggtgaatgtgacaattgatatgagcggcgtcaagattgaaaccgaacagcaacaaagtgcaatgccaaatatagatgtgagagctgctgagcaatcgttaaagaataaagttaaaagcctttttattagtgaagggcgagaaggtggtgatttgtacaagatcattaaagcagtatcaggaaatagataa

SEQ ID NO: 1295 - DNA, 2169 bp, Proteus mirabilis
gatatggatatgatgttgatagcgttttttaaaacactatttaaattcttatttcgagtaagaattgaaggactaattaatcagttttcacaatatgaaaaatgcattattacgccaaatcatacatcgtttattgatggtatattattgcgtttatttttaccgattaaccctgtctttgctgtttacacctcagtggctaatgccaaacataccaaatggctcaatcgttatgcggatattgttcctttagatcccgctaatccaatggcggttcgccaattagttaaagaagtcgataaaggccgtcctgttgttattttccctgaagggagaattacggtaactattggtttgatgaaaatttatgaaggtgctgcgtttattgctgctaaatcaggggcaaaagttatccctgttagaatagaaggtgctgaatttagctacttttctcgagtgcgtaaaacgttaaatataaaagcaaaactctttcctaaaatcacaataaaagtgctacctgcggttgatttacctatgcctacagcggaaaaatcagcagagcgccgtcgcttatcgggagaaaagctccgtgatattatgatggatgctattatgcaagcacgtcctaatatcacgctctatgaggcatttttacaaggaatgtctcagtttggtcgtttcagtcctcttatttcagatattaatatgaaagaggatagttatcagggcctattgaaaaaaatgttaggtgttagtcgtattattgaacgctataccgagcctaatgaacgaattggccttttacttcctaatactaccgttacggttgcggctttatttggggcaacgatgcgccaacgggttgtggcgatgcttaactatactgcgggtagcttaggtgtacaaaatgccatgaaagcggcatccattaaaacgatttttacctcacgccaatttttagagaaaggaaatttattacatattccagaacagactccggatgcgaactggatttatcttgaagatctcaaagatagcattactagagaagataaacgctggattgcacagcacttactaactcctcataaagcgatgttagcgcaaaaatcgacggatgcagcagttatcttatttacttctggatctgaaggcacaccgaaaggtgtcgttcatagccactccagtttattggcgaatgtagagcaaattcgcgctattgctgacttttcacccagagataaatttatggctgcattaccgttattccatgctttcggtttaacggtaagtgtattagcacctatctgcttaggggcacgagtattcctctacccaagcccactacattatcgtgtagtacctgaattagtgtatgaccaaaattgtacagtattatttggtacttcaactttcttaggcaattatggcaaatttgctcatccttatgattttgctcgactaagatatgtggttgcaggagcggaaaaactgtccgaatcgacacgagtattatggcaggataaatttggtattcgtattttagaaggttatggggtcactgaatgtgctcctgttgtctccattaatgtaccaatgagtgctaagccatataccgtgggacgtttattaccaggcatggaagggcgtttaattcctataagtggtattacggatggtggaagattacaactgcgtggtcctaatatcatgcttggctatttgcgcgttgagtccccttataaattagaacagcctacagcaataaatgccgaaggcatcgaagaagcgggttggtatgatacgggagatatcgttgctattgatagcgaaggtttttgcactattaaagggcgtgtaaaacgttttgcaaaaatagcaggagaaatggtttctcttgaaagtgtagagcaattagcggctaaagcctcggaaggcaaccatgctgtggtggcggtaaatgatccacgtcgaggtgagtcattagtgctttttaccaccgataagcaacttgatcgcagtatgttatcggcattagctaaatccactggtgtggcagaaattgcggtaccaaaagatattcgttttctcaaagaaattcctgttttaggaagtggcaaaacggattttgtctcgttaaagcaactcgctgaacaggaaaataattaa

SEQ ID NO: 1296 - DNA, 612 bp, Proteus mirabilis
ggaatggatatggttaaaagaccagattgggaggccatcgagtcggcttaccgagctggcgtgatgtccataagggaaatagcctctcaatacgagataacccatcaggcgataagtaagcgtgccaagaaagaaggatgggagcgagatttaaaggcaaaggttaaggctagggctgaaaacttggttgccaaaagggaggttgccagtctggttgccaccgaaaaggctatttcagaacggcaacttattgaggctaatgccgaggttatcgctaatgtccgcatggagcatagaggcgatattcgaagggctagagaattaaccaacaacttatttgatgaactatctgctgaatgtgctgatgtgccagccttaagaaaacttggcgagttaatgtttagtcctgatgataacggacgcgataaactcaatgaaatttatcattcaatcatatctctccctgagcgcgttaagtcagccaaagcattaagtgaaacactcaaaaacttggttgggcttgagcgtcaagcatacggccttgatgatgttcagccgaataagacagctagtcagctatcagaactaatggacgacttatctaaggaataa

SEQ ID NO: 1297 - DNA, 735 bp, Proteus mirabilis
ggcaaggatatgctaaagcgcctcatttatctctttttgaccctttttatcttagttgcggtggcattaattgcttgtgatcgctggataggtgtaaaaactagcccctatatatttgaagatatagataaactacccgccaaaaaagtaggcatggtattaggtactgctaaatattacaccacaggctatcttaaccaattttatcaatatcgtattcaaggtgctgttaatgcctataacagcggtaaagtgcaatatctgttactcagtggagataatgcacagcatagctataatgaacccaatacgatgcgtaaagatttaattaaagcaggcataccggcatcgcgtatcgttatggattttgctggatttagaactttagattcggtagtacgcacaaaagaagtgtttggaacagatggctttactattatcactcagcgtttccattgcgaacgagccgtatttattgcccttgaaaaaggcattgatgcccagtgttttgctgttgcttcgccgaagagtatgtttaaggtgcgtgtacgtgaagttttagccagagcaggtgcagttgtcgatctctatatattaaaacgcgaaccgcgttttctaggtccaccagaagcgatacctgctgtacaaaatattcctgatgatattaagggctatccggcggtttcaccacaagaggtagaagcgttgccattaaacaatggcaaaaacagttaa

SEQ ID NO: 1298 - DNA, 1065 bp, Proteus mirabilis
ggtgattgtatgcggaaaattattcatgtcgatatggattgtttctatgctgcgattgaaatgagagataaccctacattaaaagagatccctattgcagtcggtggtaatgcttctcgtcgaggtgttatctgtactgctaattatcctgctcgccgttttggtgtccgtagtgccatgtcaacggctacggcattaaaattatgtcctcatttaaaagtattgcccggtcgcatggcattatataaagagacttcagctaaaattcgtcagatttttgcccgttatacagatttaatagaaccgctttcattagatgaagcttatcttgatgtgtctgatagcaaacactgtcacggctctgccacattgatagcgcaacagatccgccagcaaatttttgctgaacttaacctcacggcttccgccggtattgcgccgattaagtttctcgccaaaatagcatctgatttaaataaaccgaatggacaatatgtgatcacccctgaacagatggatgactttattttaaaattaccattaaataaaattccgggagtaggaaaagtcacctttgctcgattacaagagatgggattagaaacctgtgctgatgttcgtggtacggatgttatttccttagtgagaaatctaggtaaatttgggcaaagcttatgggagcgtagccatggtattgatgagcgattaatcaatcctgaacgtttaagaaaatctgttggtgttgagcgcacactagctgaagatattgattcatgggatgagtgtttagcattgcttgatggattatatgatgaattagaaaaacgattaagccgagtgaaacctgatcttagaattgcgagacaaggggttaaattaaaatttgatgattttcagttaaccacccaagagcattctcatcctattttagaaaaaacggatttaattgatattgcttatcaggcatggcatgaacgtcgaaatggcaggggagtaagattagtcggttttcatgtcacgttgcaagatccacaaatggaacgacaacttcttttagcattataa

SEQ ID NO: 1299 - DNA, 714 bp, Proteus mirabilis
gctacctgtatgctcccctgtcgtggagatagcaaaatgatgatatcagaaattaccaaaccgaaacgaggacgtccccccaaaaatcatagtcctaatacagatgtaaaaaatatagttattcaaagtggtatagaaatgtttgctgaaaaaggctatatcagttcagacatttgtaagatattagaaaaagttggtatcccgaaaggatcattttattattactttggtagtaaagaaaaatttggtttagtcgtcatccaacattatgacaactttatttctaagcaactagataactatttgtcttatactgcattacctttccccaaaagactattagcattttgtcacatgataaaatcagaaatggaaaagtatcattggcaacgaggatgcttagtaagtaatctcatacaagatattgttaatttacccattagctattataaaatactgaataatgtgatttctggatggcagaaaaaggtagaaaattatcttctagaagcacaaaaatataagtttatatctaaaaacattgattgtagacaaatggctatttttttctggatgggttggcaaggagcaataatgcaagcaaaactaacccgctctaatcagccactagatatatttatctctatttttatggcgcagatgtttgatattcctcaacatgaactagaaattactaaaaatagaataatttaa

SEQ ID NO: 1300 - DNA, 285 bp, Proteus mirabilis
ggattatgtatgccacactcaccagcagaaaaaaaagccgcgttaacccgtgtaagaaaaatcaaagggcaaattttggcattagaaaccgcccttgaaaacgaaaatgaatgcggccaagttttacagcaaattgctgccattcggggtgctatcaatggcctgatggcgggcgtactcgaaagtcatttacgtgaaggtctaatggatgccgtcgcttctcctgaagatcaaaaaaactccgttgatgatgcaatctcactaatacgcacttacctgcgctaa

SEQ ID NO: 1301 - DNA, 708 bp, Proteus mirabilis
ttcacgtgtatgggatgggcgggtaacaaaagtgtggggaaaaagggggcagataattatccaagaggtgcgatagtgaatattgagtggatacgcgagcgagtaagtacagcgttgatgaatgtttgtattatagaaaatgggccgttaagtgccatggaggaacaagcaatacttgtaaccgataggtttaaaagaaacccaatacgctatgcgggtgaaagaaagtctcgatacagactcccctcacatccactcaaaattaagcaaaaacatgccaaaggaaaatcaaaaccattaattaatgaagttacttatcgcacttcatcatggcgcagaggtattcatcaattgcctaacgaaatgcgcttatggttactctattgctatggtgattatcaatattatcgtgagcaaatactcattgttccctatatttggcatgagtttcagcgattaaatagtaaaaaaaggataacgaaaaaagttaagcaacgacttcaatctcttaccttactagccattcaggcggtaaaagcagaaattaatcaaacagcaaaaaaatatacggatgttaagcttgctgaattgttgggcgtcagtgctgatgcttggcgaaagagctataaactgtattggatttgtttattagattgttgctatcaattagatagagattcgctattcaaaattagcgctttaagctga

SEQ ID NO: 1302 - DNA, 333 bp, Proteus mirabilis
gtcattggtatacgccctttcacagcaaaatttatggcaaaagaacaaactgatcgcaccacactggatttgttcgcaaatgaacgcagacctgggcgacctaaaacaaacccgctttctcgggatgaacagcttagaattaataaacgaaaccaattacgacgcgatcgcgtcaatggattacgtcgggttgagttgaaattaaatgaggatgctgtcaatgcgcttaatgagcttgcgagcgcaaaaaatgtcagtcgtagtgagcttattgaagaaatattactagaacaactcgcacaaacttatgcgttaaaaaaacatcaaagctaa

SEQ ID NO: 1303 - DNA, 303 bp, Proteus mirabilis
tgtaagattttagctaggaaatctttagccctttctgatttaggattatcaaagaagtcatttttcgggctatcttcgacaatacgaccttcatccataaaaataatacggtcagcaacttttttagcaaagcccatttcgtgtgtaaccaccatcatggtcatgccttcattagccaactcaaccataacatcaagaacttcattaatcatttcaggatcaagtgcggaggtgggttcatcaaatagcatcgcaataggatccatacataaagcacgagcaatagcaacgcgttgttgttga

SEQ ID NO: 1304 - DNA, 2061 bp, Proteus mirabilis
agctggatttttatccagtatcataaggagtgtctgcgaggagataagaatatgagcaaagtttttaaactgcattcagaatttaaacccggtggtgatcaacctactgctatcgcttcattatgtgaagggttagaagatggacttgctcaccaaaccttattaggggtaaccggatcaggtaaaaccttcactattgccaatgtgatagctaacctaaatcgtcctactatggtattagcgccaaacaaaacgctagctgcacagctttatagtgaaatgaaagagtttttccctgaaaatgcggtggaatactttgtctcttattatgactactatcaacctgaagcctatgtgccaagctccgatacctttattgaaaaagacgcctctgttaacgaacatatcgaacaaatgcgtctatcggctacaaaggcactcttagagcgtaaagacgttattgtggtctcttcagtttcagctatttatggtttgggtgatcctgatagctatttaaaaatgatgctacatttaagcaatggcatgattattgaccaacgtgcgattttacgccgacttgctgatttgcaatatacccgcaatgatcaggcttttcagcgcggtactttccgagtccgtggtgaagtgatcgatatctttcctgctgaatctgatgactacgctttacgtgttgaattatttgatgaagaggttgagcgtttatcgctatttgatcctctcacagggcaaattcattacaatgtgccacgtttcaccgtctatcctaaaacccactatgttacgccgcgcgaacgtattctggatgcgatggaaaaaatcaaacaggagctagctgaaagacgtaaggtgctattagccaatgataaattggttgaagagcagcgagttacccagcgcactcaatttgatttagaaatgatgaatgaattggggtattgctcaggtattgaaaactactcccgctatctttctggccgtgggcctggtgagccaccaccaacgctatttgactatttgcctgctgatgggttattagtgattgacgaatcacacgttactattccgcaaattggcggcatgtataaaggcgaccgctcacgtaaagagacgttagtggaatatggcttccggttaccttctgcgttggataaccgcccattgcgttttgaagagtttgaagcattagcaccacaaaccatttatgtttcagcaacaccgggcaaatatgagctagaaaaatcaggtaatgacattgtagaacaggtggttagacctacaggcttacttgatccggtggttgaagttcgccctgttgccacacaggttgatgatttattatcagaaatacgtatacgagcagctaaaaatgaacgtgtattagtgacaacattaacaaaacgtatggcggaggatttgaccgaatatcttgaagagcatggtgaacgggtacgttatttgcactcagatattgataccgtcgagcgggttgaaattatccgagatttacgtctaggtgaatttgatgtgctggtggggataaacttacttcgtgaagggttagatatgccagaagtctctcttgtggcgattttagatgcagataaagagggattcttacgttcagaacgttcgcttattcagacgattggtcgtgctgctcgtaaccttgaaggtaaagctattttatatggcgataaaataacagattctatggcaaaagccattggtgagacagaacgtcgtcgggaaaaacagcaacaatttaaccttgaacatggcattgtgccaaaaggcttaaataagaaaattggtgatattcttaagattggtcaaccgactcaaggccgtaataagaaaggacataaagcggttgatactcatgaagattatccattactttctacggctgaattagaaaaagaaattcagcgcttagaaacggaaatgtatcaacatgctaaagatcttgaatttgaaaaagcggctcaaacacgggataaattacaaactttgcgtgcgcaatttattgctaattcttaa

SEQ ID NO: 1305 - DNA, 249 bp, Proteus mirabilis
aggtacatcttgcttcatttgttcttgttcgatttgtttaataatattgctcataataactctcttaccctaggtaaactgatattaatgacactttgtgtcagacttactctgctgttctttgcaaatgttcctgctggaattctgctaacagcactctttgctcgtcagtcagagctaggctttccagaagctcaggtcttcttagccaggtccggcccagcgattgtttcatacgccagcgattaa

SEQ ID NO: 1306 - DNA, 249 bp, Proteus mirabilis
attaacatcttgtttaagcaaagaattaacacctcaaatatcaatgtcgtatttgaggtgttttttatattatcaagtataaagtggtcatgtagtttaatgactgatacttattttattgcgcttttttatgacgcttttgtaagcaatcaatcacatcagatagagatagcgattggtcttgtaatagcaccattaaatgatagagcaaatcagaagcttcattttttaactcttcacgatcattaa

SEQ ID NO: 1307 - DNA, 228 bp, Proteus mirabilis
ttatctctcataataaaaaaggctggtagagttatatttctctccagccttgctattcgttgtgtttattcttctattctaggcaatttcaaatcattattttacttaatggtgctattacttgttttcgatgtttttgttatctatcgtcatgggctgtttaggctcttaagggtgtttacagagagaaaacgaatggttagattgaagaaacagaaatcatattga

SEQ ID NO: 1308 - DNA, 1236 bp, Proteus mirabilis
gaagaactcatggatataattattctaggtgttgcgatgtttaccctgattgtattggtgctaactgcattgattttgtttgcaaaatcaaagttagtcaatacaggggatattgaagttgaggtgaatggagatcctgaaaaaagtttccatgcgccagccggtgataaattactcaacgtattatcaaacgaaggtatttttatctcatctgcatgtggaggtggtggctcttgtggtcaatgccgcgtaaaagtacttgaaggtggtggagatattcttcctactgagctttctcatattaataagcgtgaagctaaagaaggttgccgtttagcttgtcaggttaacgttaaaaataatctgaaattagagctacccgaagagatcttcgggattaaaaaatgggaatgtgaagttatctcaaatgataacaaagccacgtttattaaagagttggtattaaaaattcctgaaggtgaagtggtacctttccgtgctgggggctttattcagattgaatgtcctcctcacacagtgcgctatgaagattttgatgttcctgaagagtatcgtgaagattgggataaatttaatttattccgctatgtttctgaagttaaagagaccacagtgcgtgcatactccatggcgaactaccctgaagagcatggcattatcatgttaaacgtgcgtattgcgacaccgccaccacgtaatcctgatgtgccaccgggaattatgtcatcttatatttggtcattaaaaccgggtgataaagtgacaatttcagggccgtttggtgaattcttcgcgaaagaaactgatgcggaaatgatcttcattggtggtggtgctggtatggcaccgatgcgttcacatatttttgatcagctaaaacgcttacattctaaacgtaaaattagcttctggtatggtgctcgttctgtgcgtgaaatgttctatacagaagattttgatatgctggctaaagagaatgaaaactttacttggcatgttgcgctgtcagatgcattaccggaagataattggacgggttacaccggctttattcacaatgtgctctatgaaaactacctcaaagatcatccagcaccagaagattgtgaattctatatgtgtggaccaccagtgatgaatgctgcggtgatcaaaatgcttaaagatttaggcgtagaagatgaaaatattatgctggatgactttggtggttga

SEQ ID NO: 1309 - DNA, 402 bp, Proteus mirabilis
tgtttcatcatatccgttaatacagaaagattagcttttaaggtattacttacacaggcggcattttcaacaatagctggattgcgtttatgtggcatagttgaagagccaacttgccctttaccaaaaggctctgaaagctcatcaatttcattgtgtgctaatattaagatctcgttagctattttccctaacgttccactaattaatccaattaacataccatattcactaaatctatcacgtgctggttgccatgagatttccggtatatctaatcctaagcgttttaatacgcgtttttctaattcatcagctttatcgcttaaagaagctttagtcccgacagcaccgactacactgccaacaaatagacgaggttccacctctttaagtcgttga

SEQ ID NO: 1310 - DNA, 1497 bp, Proteus mirabilis
ggaataatcatgaagccagaacatcttgcattattaagagataagctctggcgattgaatcacctctactggatcacaaacaaagaaggtaagccagttcgatttaaaatgacgcctgagcaactcgaatattttgaagggatgcacacgcgaaacattatcctgaaagctcgtcagcttggctttactacagaagtctgcattatccaattagacgcagcgttatttgaggcggctaaatgtgcattgatagcccacacacttaacgatgctaagcgactattcagggaaaagataaagtatgcctatgacaagctacccgatgaaatcaaagcggctaacccagcgagtaatgatgcggttggtgagttggtgtttagcaaaggcggctcgctttatatcagcacgtcatttcgtggcggtacactccgttatttgcacgtttctgagttcggtaagatatgtgctaagtatccagagaaagcccgtgagattgtcactggcgcatttgaggcggtatcaagcgattgttttacgacgattgaaagcacagcggagggtcgagcaggttatttcttcgattattgccagtctgctgagaaagcgcaaattcagaataagactctctctaacctagactggaagttctttttcttctcatggtggaagaatccagagtatgccattaaccctgttgagccattaccccagcggttagttgattactttgatgagatagccagcaaacatggtgttcaattaaacgagcgccagaaagcatggtattacgccaaagagaaaacgcttggcgacgatatgaaacgggaatacccgtcaataccgtctgaggcattccaacaatcggttgaaggcgcttactacgctaagcaattccgctttctctacgaaaataaacgcattggtacgcttcctgataattcacacttacctgtgcatacttactgggatattggtgtgggtgactcaacgtcaatctggtttattcgtgaggttggtgaggaattccacattatagaccactactcaaacagcggtgaaggtctacggcactacatgaaagtgttaaaagacaaaggctacacatatgcaagtcacaatggccctcatgatatcgataaccgtgagtttggctcggatgcgaaatctcggcgtgaattagcgcgtgaggggtacgaaatcgacggacaaatttactcaatccgatttgaagtagtgccgaagctttcagttgatgaaggtatcgaggcagtacgtgaaattctgccactttgcgtgtttgatgagcataaatgtagtgaaggcattgctcatctagaagcttatcgtaaagagtgggatgacaagcgaggctgttggaaagataaaccgcttcacgattacacgtcacatgatgctgatggatttaggtattttgcggtgagcagaagaaacactaagcgcccagcattcgaaattaacctaggaacaaccttctga

SEQ ID NO: 1311 - DNA, 723 bp, Proteus mirabilis
agggtaatcatcatggatcgattttcacgttcaaatgattcaatcgtacagcgcactggtacaggtctacaaacctttatggcgcaagtgtatggctggatgacagtaggtctgttacttactgcatttgttgctctgtatgttgcatccagcgcgactttaattgagatgatcttcactaataagatctttttcttcggtttgattatcgctcaattagcattagtttttatattatccggtatggtacataaaatgagtggtgcgcttgccacaaccctctttatgctctattccgcattaacaggtgtcactatttcgagtgtgttaattgtttatacttactcctctgttgctagcactttctttatctgtgcggcaatgtttggtgcattaagtgtttatggttacaccactaaacgtagtttaactgggatgggtagcttcctgtttatggggcttatcggtattatcattgcttctattgttaatatctttatgcaaagcagcatgatgagcatggttatctcttacgcaggtgtactgattttcgctggtttaaccgcatatgacacacaaaaattaaaggatatgggtagcgaaattaatcaagaagataaagaaaatatgcgccgttactcaattatgggtgcattaacgctttatttagattttatcaacctgttcttaatgttactgcgtattttaggcgatcgtcgttaa

SEQ ID NO: 1312 - DNA, 201 bp, Proteus mirabilis
gttaaaatcattaggtttcattctgaaaagcgcactattatcactaatagcgcgcttttttcttgcttcccaattagtgctcaagtagcctttaacctattagaaaaccctgagtcattaaggcaaggatatgctaaagcgcctcatttatctctttttgaccctttttatcttagttgcggtggcattaattgcttgtga

SEQ ID NO: 1313 - DNA, 186 bp, Proteus mirabilis
gtatcagtcattaaactacatgaccactttatacttgataatataaaaaacacctcaaatacgacattgatatttgaggtgttaattctttgcttaaacaagatgttaatttatattaaccctcttatttttagcgattacattgcttggcggaatatctcgataacatcactttcactaccttga

SEQ ID NO: 1314 - DNA, 1470 bp, Proteus mirabilis
aggagatccatcgtgtctgaactatctactctatccccacaaccattatgggatatttttgcaaaaatttgttcaattccacacccttcatatcatgaagaagccttagcgtcccacattatggcttgggcgacagaaaaaggtttatctgttgagcgcgatgcggtaggaaatattttaatccgtaaacctgccaccaaaggtatggaagatcgtaaaacagtcgttttacaagcgcacttagatatggtgccacaaaaaaataacgataccgaacacgactttaccaaagatcctatccaaccttatattgatggtgaatgggtaaaagcgaaaggcaccacattaggtgcagataatggtgttggtatggcttctgcactcgctgtattagctgacgatactgttaaacatggccccttagaagtattgttaaccatgacagaagaaactggaatggatggcgcttttggactacagcctggttggttacaagcggatattctgattaatacagactcagaagaagaaggcgaaatctatatgggttgtgccggtggtattgatgttaaaaccacggtagacctcacttatgaagctattcctgcaaaccatatcgtcaaaaaactggtactaaaaggcctaaatggcggccactctggtggtgatattcatttaggtttaggtaatgcaaacaaattattagcgcgtttccttgctgaacatgcggatgaattagcactaaaattaattgatttccatggtggtacactgcgtaatgctatccctcgtgaagcgcatattatttttgctattcctgcggataaagcgactcaattaaatagcattaccacagaatttgaagcgctattaaaaagtgaattagccattgctgaaaaaaatctagctatcgaattaacagatactagcaccgaaaaaccagtatttactgctgattgtcaatctcgcactatcaatttacttaatgccatgccaaatggtgttatccgcatgagtgatgatgtggaaggtgtggttgaaacctcattaaacgtcggtgtagtgagtattgttgacgataaagtagaaatcctatgtttaattcgctctctgattgatagtggtaaaacttatgttgttagcatgctgacagcattagccaaacttgctcaagcagatatcgaaaccaaaggtggttatcctggctggaaacctgatgcggattcaccggttatgcacttagtacgtgacacttatcaacaactatttgataaagtgccaaatatcatggtgatccatgcaggtcttgagtgcggtctatttaaaaaaccttatccagatatggatatggtctctattgggccaactattcgcggtgcacactcaccggatgagcgagtacacattaagagtgtaggccaatactggcagttactgacagctattttaaaagcgatcccggctaaataa

SEQ ID NO: 1315 - DNA, 1791 bp, Proteus mirabilis
gctgctcccatcttttgcgcccaacaagtcagttttcgtatggagaaaacagatatgggttcccacctgatgcaaaggctgaatgcctttgccgatgcattttccttttttctgttatggctgcaaaacagccctgtcatattatccctgctcgcaggtcttacattaccttttatattccaccttccccgcgaggaaagaaagaacgccccattctggttaaagtcggtggcgtgcgtgtccattttcttttttatattcggcaccatatcaccgctaactattcagggattgagctacttttttaagtcactcgacaacaacatactgttcagagttccgctatggatcatgaccataatatttacggcagcaggattaatatttcatattgcagcccgacgacttttagcaggggaaattgacaacctaaaacatcgaatgattaagaaaagcaagctggagagaaataccagaacggatgtacgcaaagtaaaagagctgttacccgacagcatagaatacaatccactcgattacattgatttaaagaaaggtgtttttattggcttaaacaaagatgaccagccgcaatacataaccataaaagaatttaaaacccaacacgcagcaatcatcggtacaacaggttccgggaaaggcgtaactgcgaccgttctactttaccaggctattcttttgggtgaggctgtttttgtagaagatccaaaagatgatgaatgggcaccacacgtactcagggaagcatgtaaaaaagcaggcaagaaattcacacttataaatttaaacaagataaatttccagcttgatttactggctgatatctctcatgaacaactggaggaattatttaacgctggctttagcctggctaagaaaggggaggcttcagatttttatcgtatctctgaccgtcgcgcagccagaaatacatcggcaatttatgaaaaaggaatgacgcttcgtgatttatttaacactgactttgttcagtcattacgtgaagatgttcccgcattttgtggtgagctggaagaaattgctttagttaactcaattaatgccaccaaaggattttcattaaaagaggtttttaatgagggtggttgttgctacattattggttcaacgcgcaatcaaaagataatttccgcacaaagaatgattctgacccggctgatacaaatagcagagaccagggacagaataaacagcaccccgcgtactgttgctattttcctcgacgagttgaaatatcatctttcacgccctgcacttgaaggacttggaacggcgcgagataaaggcgtgcatatattcatggcttttcaggcgatagacgatctgcgtgactgcccgtctgatttaaatagtgattcagttattggcgctatcattgaaaacgctaaattcaaattaatttataaaatccaaaaccccgaaacggcagagtgggcggccaaaatgacaggctctatcctggtcgatgatgaaatgaggaaagtacggactgatttgtcattaacggagaaagtggatacagaccgtatgataagacaggcagaaagttactacgttgacagcaatatgtttttaaatctccctgaaaaagttggttttgtatttacgtcaaccgaactaccaagatctacaaagatgtttcaggttcaggtcaaaaaagaaaatattgaacttctttcatttgagtataaggaagccacgccggaaaaaaatgaaagtcaggaacataagccatcaattaatctgtga

SEQ ID NO: 1316 - DNA, 186 bp, Proteus mirabilis
ttaaatcccataacctcttcagttatgggattttttgtatttataaaatacgggcagcaagtcgttatttatagcgtgagatgtttattcttatctatcaaggtacagattttatactatcttcctgcggaaaagataataggcaatagagcctgtcccaatagcaataacaatcagtgcccataa

SEQ ID NO: 1317 - DNA, 315 bp, Proteus mirabilis
ggatttaccatgaaaaaaaccgttatcacggcggctgttttatgcctgaccgcaggaacgccgatttattcctttgccgctgacccgtgcgaagttgttctttgcatgtacggaaaagctacgggtaatagtggcgggagtgaatgcagttcagcagaacgcgcattttttaaaatcaacgcctttaaaaaacaccatcgttttaatccgggtaaaacatttgatatgcgaaaagaatttttagtcgaatgtaacgccgcagatcctgaatcaataagcaaaatcctttcaaaatttggcagagtgaaaggataa

SEQ ID NO: 1318 - DNA, 654 bp, Proteus mirabilis
aaggtatacatgaaaaaagtaaatgaagttattggcgaaaggttaaaatccattcgtgaatcaagagggctaagtcaagctcaattagctaaattgtgcggctactctgctgcgtccagaataggaaactatgagcttggagagcgcaagattagcgctgatgatgcgattgttataagtgaagctcttggtatatcacctgccgaattaatgtttggcagtcaaagtgagcaagtgatcaaaaattatgaataccctctattcacaaaggtacaggccggcgctttctcaacagaatttaactcatacacccagaaagatgctgtgtcgtggatacctacagctaagaaagctagtgaacgttctttctggttagaagttgaaggtcaatcaatgacagcaccaccaggaggcaagccaagctttccagaaggaatgcttatcttggttgatcctgaggaagaagttgagttcggagatttttgcgtcgcgcgtttactgaatgatgaattcacattcaaacgattgattagagaaggtggagttgagtatctagagccattaaacccacgctatgacctgatccctattaacgggaactgtacaatcataggtaaggtaatcaagtcacaatggcctgacgatacgttttag

SEQ ID NO: 1319 - DNA, 864 bp, Proteus mirabilis
ccaatggtctttatcttggtcaatttcttttgctctttaaataaggaattttttatgcataaaaaggatatttcgcgaaaacagcgtttaataagctattgtgttatttatttaaccgctatttacccattgcatcctgcttggggctctgtcattacttcatctgataaaacgataacaataaaccagcaaaataatattcctattattaatattgcaacacctaatgacagtggtgtttctcataataggtttaatgtctttaatgttaataaacagggggcagtacttaataattcgcaagttgatgccaatagtcaattagcaaaaaaaatatctgctaataaaaatttaaaaggtaatacggctaatttaattattaatgaagttgtcggtaatagtcgttcacagttattaggtaaattagaagttgcaggacaacaagcggatgttttaattgctaatcctaatggaattagttgtgatggttgctcatttattaataccccatcaattactctcacgacgggaaagcctcaatttagccctcaaggtacctattcggcactagaagtaaaaaaaggcagtattgttattggtaagcaaggtatgaatgccgatttgcaaaattatgccgatattattagtcgtagtattgaaataaatggaaagataaatgctaaaaatctctctttaatgcaagggaataaccatattgatttcggcaaagggacagtaaatagcattaatggagaaggtgtaaaaccgaccgtcgctattgatacaaaagcattgggtggaatgtatgccaatcaaatacgcttagttagcacagaaaaaggggtcggtgttaatttaacttga

SEQ ID NO: 1320 - DNA, 1167 bp, Proteus mirabilis
ggcactaacatggaaaaactcgatttattagcaatcagagataaaatcactgcgctagattctgaactactttcactattagctcaaagacgccaattatcgactgaagttgcccaatttaaattaaatacccaccgccctattcgagataaaaaccgtgagcgtgaactgcttgaactattaatcgaaaaagggaaaaacgttggattagatggcttttatatcagccgtattttccaaatgatcatcgaagattcggtgctcacgcagcaagccattttacagcaacaccttaatgcgactgcaaatgaatctgcaagaattgcttatttaggccctaaaggttcttattctcatattgccgctcgccaatatgcagcccgccattttgatacttttgttgattgcacttgccataaatttgaagatatttttacactggtagaaacaggacaagcggattacggtttactacctattgaaaacaccagctctggtgcaattaatgatgtttatgatttactacaaaccacctcgctgtcgattgttggcgaaattcgtattccgataaaccatgctttattaacagcagttaagagtagcctagaagaattacacactatttatagccatccacaaccattccaacagtgcagtcactatttaaatcaataccctcactggaaaattgaatattgtgaaagcacagctgcggcaatggaaaaagttgcattagcacaatctccccatgtagccgctattggcagtgaagctggcggatcgctttataatttaacaccacttgctagtaatttagctaatcaacaaattaatgttactcgttttattgtgattgcccgtaaacctattgatgtatcagaacaagtacctgcaaaaaccacctttttaatggcaacggggcaacaagcaggggcattagttgatgctttaattaccttaaaacaatacagcattattatgactaaattagagtctcgcccaataaatggtacaccttgggaagagatgttttatattgatgtacaagctaatttacgggatatcaatatgcaaaaagcattacatgacttatcaaaaacatctcgttcactcaaagtattaggatgctatccttcagaaaatattgtacccgttgaaatacaatag

SEQ ID NO: 1321 - DNA, 2727 bp, Proteus mirabilis
aggttaaacatgaattatatctctattattctttctgatactgatatcaccattaaatatctttcagaaaaaagccattattcatttaataccacaaatagccattaccttgattggctaaatatggctaaagctattaatcataaatttaactctgctcaaggtggtttgatatattcgacaagtaataaatcggatagcgctattattaaaaccattgataataaagtaataaatttatcaaatttctttactgaaatatttaataaaccttttatttatatcaataaagcgcagcttgaacatcatcatgatttagaagaaaaaatggttacagttgccaataactttgcttggtcaattgaatattcaggcttagaaacaggaaaagatgaatattgccaagagtctctcttaactacggccaatggttatattgggttaagaggaactttgcccgaaatgactataagtgatgagcactaccctgctacctatattgctggcctatataatcaagcaagttcacaaatagaaaaccatcaggtgattaatgaagattttgttaatgcacctaatggacaatttatttctcttaaaattggtaagggagaatatcttcatccaaagcaactgataacacaccatttaacacgtcaattagatttaaaaacgggtgtattcactagccaatggcgtgtagaaacccctgaaggacagcaacttgatattcattgtacaaaatttgccaatatggctgatatgtcacattacgccattttatatacctttaaaccattaaatttctcaggtgagataacggttataactcgcctagaaggaaatacttataattacggtgtacaacgctaccgtagccttaatccccatcattatcatgtgctacaaactggagcgaataagcaacacgcatttatattagctcaaacagatcagtcaaaaatagggatcggattatcgtcaacaatcaggggggatttctttgcaaatgaagatattgtttgtcatgtttcagatacgcttgttgaacaaaccatcaccttcaacgctcaacaaaataccacctatcaacttgaaaaatgtgttgctgtaacaacctctacggcttacccagactcatggcaagatgtggttaattgggaacaacaacctttacacagccaattgataaatagccaaaaagcgtggcaaacgttatgggatagtgccgatatctcgatttctggcgatctgctgacccaaaaattactacgcttacataccttccatttactgtcatccgcatcaccatttagcaatcagcaacatcaattagatgtttcagtcaccgcccgagggttacacggggaagcctatcgaggccatattttctgggatgagatctttattctgccattttatattatgcacttccctgaaaccgcacgccaactattactatatcgttaccacaggctacctgctgcgcgtcttgcggcacgagcagaaggatttcaaggtgctatgttcccttggcaatcagggcatgatggtagtgagcaaacccagacactgcatttaaatcccttatcagggcaatgggatgccgaccacagttgtcgtcaacgtcatgtctcattagcgattgcctataatgtgtggctatattggctaaatactcatgatcaccaatttatggaacagtatggacttgaactactcaatgacattaccttgttctggttagaccaatgtcagtgggatgaaggcgatcaacgttttcatattaatggagttatggggccggatgaatttcatgagaaatacgcagactcacttgaaggtggcttaaaagataacgcatacactaatttaatggtggtttggttgtttaatcaaatagagatgttcataaacaatgatcgtttttctaaaaaattacaacagctaaacagccaatctagcgttttcaataaaatacaagaagttaaaaatcgtattgctatcaatattgatgctcatgaaattattgaacagttctcaggttattttcaattaaaagatctggattgggaaagctatcgaaaaaaatacggcaatatctatcgtatggatagaattttgcgtaaagaaaataaatctgccgatgattacaaagtagctaaacaagcagataccctgatgttatttaataacttagataagcaaaccgtacattccctaattacctctcttggttattcagtttctaagcactttgctgaaaaaaatctacattactatttagaaagaacctctcatggttccacactgtcacgcattgtccatgcttatctcgcagaacaaatacagttacatgatttgtcatggcaactttatcaagatgctctttattcagattataatgatatccaaggtggaacaactgccgaaggtattcatactggtgtcatggcggcaacattaaataccaccatcatggcttatgccggtgttgatattcgtcaggatatgctgaccatcaccccttcactccctcaacaatggcaaaagctaagctttaaattattgcatcgctctactttatatcaaattaatctcactcataaagaaattagtattttaagtgataagcccagtactattttaattaaccatcaaacgcataagctaaccgccaatacgttattagtattaaatttaaatggagacacgcaaaatgactaa

SEQ ID NO: 1322 - DNA, 1092 bp, Proteus mirabilis
gaacaaaacatgaaaagaatatttgttatattatttcttttaactctattccctagtctggctgttgctggtgcagatgactacgtaccgtctccaataacaatcaacacatctaccctccctgttgttgttattggtcctgctgatgcccatacttacccacgagtgataggggaactcaccggaacaagtaatcgatatatatttaacggcggtagtttaatagcattaatgcgtggaaaatttactcctacattacctaaaataggcaaaatcacatataactttcgccaaggaaataacactcaatcttccgatttcgatatatttgatactggagttccagggctaggtattattattggtatggcgggctattggcctgcaacgccattggttcccataaacagctcaagtatatatattgatcctgttgccgccaatacaaatccaaatgcttataatggtgcaactggaaattttggtgctcgtttatatgttgcttttgtcgcaacaggacgattacctaatgggtatgtaacgataccaaccaaacaactgggccatattttattggaatctaatcgggcaagtttgaataataaaagattaacagctcctgttatgttaaatggagggcgcatccaagtgcaaagccaaacatgctcgatgaatcaaaagaattatgttgttccattaaatactgtctatcaatcccagttcacgtctttgtataaagaagtgcaaggaggggaagttaatatacaacttcaatgccaagacggtattgatgtttatgctacattaaatgatgcgacccaacatgggaatcgttctgatatattaacattagcaacggattctacggcaaaaggcgttgggctaagattatataaaaataatgaagtaactgcgattagttatggttcagacactcctaacaaaggaaatcaaaatcaatggcatttttcaaattatagaggagagataaatccacgtataaaattaaaagctaattatataaaaacagaaaatactattacgccaggaagtgtaaaagcagtagcaacgattactttttcatatcaataa

SEQ ID NO: 1323 - DNA, 1389 bp, Proteus mirabilis
acaatgaacatcaaacaccttgcgatagcgacttgtatcggcattgccgtgccgacaattgctcacgccaatacaaatgaattatcgatagaacaacgtttaactcgactagaagagagaacgttagccgctgaaaaaagagctgagttagcagagcaacgtgccgctaagttagaaaatgcgttaaaacaaaatcaggcgcttaataacaatctatcacaaactagcgaaactataactgcgccaccatcatcgctgatagaaacaaataccggttatggaaaactcaagttatatggtgatgttgaatttaatacagatattgcaagtaaaaaaggtcagctaacctccattaacatgcgctcaggtaaagaaaaagactatggcgattatgataaatgggggatcaatgggcgtatattaattggcttagacggagagcgtctgttagataataaaaattatgcaggcttcactgttcaaccactggcaaatattgatggtaaggtatctctcgacgatgccgctttttattttggtaaaaaagagcgttggcaatttaagttaggtcgttatgaagcttatgacatgttcccgcttaatcaagatacttttgttgaatattcaggcaacactgcaaatgatacttatagtgatggttttggttatatctacatgatgaaagaaggtcgagggagaagcaatagcggtggtagcatgatgtttaatagccaatataataattggtattttgaaactaatttattaattgaagatggaacgtctatttttgctaacaaggaatatcacggaaataaactatataataataaaaatgttatttattttcgcccagttattgcatggaataacaataattttaaagttgctgtagccttagaaaaaaatattatcaataatgcttatggttatgatgataaaaaaacgggtgaatttagagatcaatccaaacgcaacggttatggattaactttaggctggagcaatctacaacaaaatcctgaaaatggtgtcacaataaattggaataccgcttatttagacgctaacgatgagaacgactttacaacaggtactaatattttatggcgtaaattacaattaggctatatctatgcccataataatattaagtcatatactattaatagtaatgatgataacaataatgatattatatttggcccaggaaaatataatatccacactctctattcctcatatgaattacctaatattttagatatggataattttaaaatctatttaggtgcatattattctgttattaatggtaaagatattgaaatagaaaatagcgataaagatcgttatggtgtaagagcacgttttaaatacttcttctag

SEQ ID NO: 1324 - DNA, 591 bp, Proteus mirabilis
gggcgtgacatgtcagatcagttcatgaagtcgattaatatctttatcgacaaatctaacgcaaatattgaaacggttgtcaaaaatacagggtttaaaatattagcgaagcttgttgatatgtcacctgttggaaatcctgaattatgggaagttaatagggttgcctcaaactacaataaagcagtttttgaacataatgaatatctaaaacaagatcctaataatttaacaccaaagcgacgtcaattaaaaaagcgtgttcgtgttaatgactctatggatatttatgttcctcctggttatacaggggggcggtttagaggtaattggcaggtgtcatttgatgccccagcggaaggcgagacggggcgcatagataagtcaggcaatatgacaaaggcgttaggcaacgttgttattgaacaatttaaggtaggaatgaaagctatctatttcacaaacaatgtgccttatgcttaccgccttgaaatggggcattcgaaacaagcacctaacggtatggttgctgtgactgctgaggaatttagtcagtttttcaactctgccgtatcggaaactaaatcatga

SEQ ID NO: 1325 - DNA, 1308 bp, Proteus mirabilis
aagggagacatgatgaagcaggcattaaatgttattttcggacttttgatattatgcgttacaacgctcgctaatgcagaagttcgcattgaaattacacaaggggtgaatactgcacgccctattggtgttgttccttttaaatgggaaggcacaggtcaaatgccagaagatattgctggagtgattgcggctgatttacgaaatagtggtaaatttaaccctattgatatgaatcgtttgcctcaacaacccgttaccgcttctgaggttcaacctgcactctggacagcattaggtattgattcagtggttgtagggcgtgttcagccctcggcagatggtcaatatgttgttagctatcaattagttgatgttgctggctctccgggagcggttttagcgcaaagtgagtataaaatcagcaataaatggttacgatatgctgctcataccgccagtgatgaaatctttgaaaaattaactggcattcgtggtgcgttccgtacccgtattgcttatgtcgttgtgactaatggtggcgcttatccatatgaattacgtgtatctgactatgatggatttaatcaagatcgcgtttatcgttcatcacagccattaatgtcacccgcttggtctcctgatggtgctaaactagcatatgtcacatttgaaagtggtcaatctgctttagttgtacagacattagcaacgggggaagtgcgtcaaatcgcttctttccctcgacataatggtgcacctgctttttctccagatggctctaaattagcctttgcactgtcaaaaagcggtagtctaaatctttatgtaatggatttagccagtggcaatatgacacaggtaaccaatggtagaagtaataatacagaaccgacttggatgcctgatggacagactttggtctatacttcggatcaaggcggacgtcctcaaatttataaaattaatattaacggaggaacgccagaacgtattacttgggaaggaaaacaaaaccaaaatcctgcagtaagtcctgatggtagtttcttagttatggtgagttctgaaagcggtaggcaacatatcgctaagcaggatctagaaacgaatgctgttcaatatttaacagatacgtttctggatgaaacgccaagcatcgcgcctaacggcactatggttatttatagctccactcaaggcttaggaaccattttgcgactagtatcgactgatggacgtttcaaagcgcgtcttccggcgactgatggtcaggttaaatcacctgcctggtctccgtttatgtga

SEQ ID NO: 1326 - DNA, 333 bp, Proteus mirabilis
ataccggacattttaaccatgcagttcaccgtatacgggaataccggtaaaagcgtcgtttaccctctgctactcgatgtcacgagtgatattatcgggcaactgaaccgccggatcgtgatcccgttgctgcctgttgaaaaatatccggccagccgccgcccggatcgacttgtccctgtggtcagattaactgacggcaaggaatacgcggtaatgacccatgagcttgcgagtgtccctgtccgggtgctggggacggtgttctgtgatgcgtcgcagtaccgtactcaggtaaaggccgccattggtttcctcattgacggcatttag

SEQ ID NO: 1327 - DNA, 1017 bp, Proteus mirabilis
caaccatgcataaatataaatagagttattatgaaaacgaaaaaaatcagtgtctttattatcttaatgattattatcggtattatcgcaggtatctattattatgaagagaacaaagatcctgagttagtactctatggaaatgttgatattcggacggttaacttaagttttcgtgttgcaggcaagttagcggaactacaagttgatgaaggtgcgccggtcaccaagggtcaattattaggccaactcgatgatgcaccttacattaatgcattaaataaagcttatggtgaacgtgatagtgccatcgcttcattagccttaatggaggctggttaccgcagtgaagaaattgcacaagcccagtcagatgtgtcattaaaacgtgccgcatggcaatatgctgaaaacttttataagcgacaacaagatcttgctaatcgcaaagttatttcagctaatgacttagacagtgcccgcaataatcgtaaccaagcggctgcggcattaaaagcagcacaagacaaactcaatcaatatcaaaatggttatcgccaagaagatattgatatggcaagaggtcaagtacttcaagccaaagcggcagttgcccaagcagagcttaatcttcaagacacccaattaacctcacctgcagaaggaactatactgactcgtgctgtggagcctggcactattttatcagcaggaagccctgtttttactgtttctttaactaaccctgtgtgggttagagcttatattagtgaaaatcatttaggtgaagcgatacctaatcgcgaagtgtatctttataccgacagtcgcaaagataagccttatcacggcactataggttttgtttcgccaaccgctgaatttacccctaaaagcgttgaaacaccggaactacgcactgatctagtttatcgtataagagtggttgtcaccgatgctgatgatgcattacgccaaggaatgccagtgaccttgaaatttgcaccgactcattaa

SEQ ID NO: 1328 - DNA, 255 bp, Proteus mirabilis
ggtggatgcatgattaaggttctttttttcgcccaagtgcgtgaattagtgggtgttgattcactggaattacaaaatgattatccaacagtggatgatttacgccgtgctttaattaacaaaggcgatcgttgggcattagcgcttgaagatggcaaattgttatccgcagtaaatcaatcctttgttcaaggcacttatgccattaaagacggtgatgaagtggcttttttcccacctgtaacagggggctaa

SEQ ID NO: 1329 - DNA, 396 bp, Proteus mirabilis
gtatcccgcataatcaatttgccaacgaaggagatcgctatgcgtaaagcctgttttactgagcatcagatcatcgccgtaattaagtcggttgaaaccggacggactgttaaagttgatgactttaaccgtgagacattgtcgattaaaatcattctgaatctgccagatctgcgagtgatccgtgtactcgacagggtcgcggcaaactgcggctatccggtcatgctgcgcatgaataatggtccggaatttatctcactgacactggctgaatgggcagaaaaacatgcattaaaacaagatgttatccagccggataagccgacgcagaacgctttcattgaatactttaaccggacataccgtacatactcgatttttatatgttcatga

SEQ ID NO: 1330 - DNA, 522 bp, Proteus mirabilis
tcccggcgcataaccgattcgctggatatagctcgttccggaaaaagccgtttcaggctgttgcccggtactgaaattgccggagtaataacaactcagcgctcttttcagcgtgccgccgcgccggtagcagtcactgagaatgcgttcaaagatggacagattggtacagggatcaagcagctctgtggcggacacaccataatggcggaaattggtgctggtgatttgcatcagcccgacagagtaacggcgatcctgtgctgccaggcggcggagaatatgctctgcatctccccgactggctggcaggtgagaaataatgtgtttatcgcgggaagagggtccggccttcgggacaatctcagcgatggcataagggttaaaaccggattccacccgtgccacgtcgagtgcagtggacggatgaatactggcggcgcactgcatggctaccgccagaaaggctgtggtggaaagcatgatgacctcagtaaacaggtggcatgcagagcctgctga

SEQ ID NO: 1331 - DNA, 1860 bp, Proteus mirabilis
gccaatagcattacgcttgacgttacaacttattattgtcgttgcgctgttggtttatcttatttatggaacaattgtggtgtggggtgtgtaatgaatctgccagttagagaatttgacgcagttgtaattggtgctggtggtgcaggtatgcgcgccgctttacagatttctcaaatgggtctgtcatgtgcactaatctcaaaagtttttcctactcgttctcatactgtttccgctcaaggtggtattacagttgctttaggcaatacccatgaggataactgggaatggcatatgtacgatactgttaaaggttccgactatatcggtgaccaagatgctatcgaatatatgtgtaaaaccggtccagaagctattttagagctggaacatatgggacttcctttctctcgtcttgatgatggacggatataccaacgcccatttggtggtcagtcgaaaaattttggtggtgaacaagctgcccgtactgctgccgctgctgaccgtacaggccatgcactattacatactttgtatcaacaaaatttaaaaaatcataccactatcttttctgaatggtattcgctggatttagttaaaaaccaagacggtgatgttgttggttgtaccgctatttgcattgaaacaggtgaagttgtttattttaaagctaatgccaccattttagcgacaggtggtgcggggcgtatttaccaatcaacaaccaatgcgcatatcaatacgggtgatggtgttggtatggcagttcgtgcgggtgtgcctttacaagatatggaaatgtggcaattccacccaacaggtatcgcaggggctggggtgttagtgacggaaggttgccgtggtgaaggtggctatttactgaataaagacggtgaacgctttatggaacgttatgcaccaaatgctaaagacttagcaggtcgtgacgtagttgcacgttctattatgattgaaatccgtgaaggccgtggttgcgatggaccatggggacctcatgccaaactgaaactcgaccacttaggtaaagaagttctggaatctcgtctgccgggtatccttgatctctctcgtacctttgctcatgttgacccagttaaagaacctattccggttattcctacttgtcactatatgatgggggggatcccaactaaagttaccggacaagctattcgcatgaatgagaaaggcgaagatgaagtgatcccaggattatttgctgtgggtgaaattgcttgtgtatctgtccatggtgctaaccgattaggtggtaactcactgcttgaccttgtggtatttggtcgttctgcgggtgttcacttaaaagagtctttgatggagcagggcacgatgcgtgatgccagcgattctgatgttgaagctgcattaacacgcttacatcgttgggaaaataatcgttcaggcgaagatccggttgagatccgtaaagcattacaatcttgtatgcaacataacttctcggtcttccgtgaaggggatgcaatggcgaagggcttagaagagctgaaagtgatccgtgaacgcctgcaaaatgcccgactcgatgataattcaagtgaatttaatacacagcgtattgagtgcttagagttagataacttgatggaaacagcttatgccacagcggtatctgctaatttccgtacggaaagtcgtggtgcacatagccgtttcgatttccctgatcgtgatgatgaaaactggttatgccatacattatatcaaccgcaaaccgaaacaatgacacgacgtaaagtcaatatgcagccgaaactgcgtgaggctttccctccaaaagtgcgtacatattaa

SEQ ID NO: 1332 - DNA, 783 bp, Proteus mirabilis
gagaacggcatgaacaacagtaacttcagacctttattgatgagtctgttgttactggttggcgtagcggctcctgtagccgctattgcccaagcgccaatcagtaatatcggttcaggctctactgatgaacgactcgcccaacttgagcgtatctctaatgctcatagtcagcttttgacccaattacagcaacaactcgcagattctcaacgcgatattgatatgttgcgtggtcaaattcaggaaaatcaataccagttaaaccaagttgtagagcgtcaacgtaatatctatcaacaattagatagcctaaatggtggcaactcagcaccaacaacggatgaggcttcaacgggtggcaatgtaccttcaacatctgatacaagtacgagttcgtcgtcaacaggtgatgaaaaagccgattataacgcggcaattgatattgtattgaattcaaaagattacgataaggcaattgttgcattaaacaactttattaaaagttatccgaagtctagctatcaatcaaatgctcaattttggttggggcaaatgtattatctaaaaggtaataaagatcaggctgcgagtacttttgctattgttgtgaaaaattatccaaaatctcaaaaagcaagtgaggccttttataagatagggcttattatgcaagagaaagggcaaaaggataatgcgaaagctatttatcaacaagtggttaagcaatatccaaacagtgctggtgcaaaattagcacaaaagcagttagcagcactataa

SEQ ID NO: 1333 - DNA, 783 bp, Proteus mirabilis
ggcgttttaatgtcagaccgtaattttgacgatattgctgataaattctctcgcaatatctatggcacaacaaaaggaaaaatccgccaagcggtgatttgggatgatttacaacaattattaactcaactccctgatcgtccgttgcgtattttagatgcggggggtggtgaaggttatttttccagacaactggcaaaattagggcaccagataattttatgtgatctatcacaagagatgcttaaccgcgcacaagaagcggctattgatgaaggtgttgtcaatcaaatgacgtttatttgttgtgcagcacaagagataaaccagcatctagatgatggtgttgacttaattctattccatgccgtattagagtggatcacagatcagaaaaacgccataaatgtacttaccgatatgctacttcctaatggtatcctatcgttaatgttttacaatgcgaatggtattgtcatgagaaatgctattttgggaaatttccatttggcaaatccggaaataccacgcagaagaaaacgctcattatccccacaaaatccgctacaacctgaggatgtttatcaatggttagcgtcattttcaatgacgattttaggaaaaacgggagtgcgtgtttttcatgactatttgcaaagtcgtcagttgcaaaataaagattttccagcgttgcttgccttagagcaacgctattgtcggcaagagccctatatcagtctggggcgttacattcatgtcatggcacaaaagtgtgtaaattaa

SEQ ID NO: 1334 - DNA, 1530 bp, Proteus mirabilis
caagttttaattaaaccgatatttgtaagtattctacttgtaataaaaacaaggataataataatgaagtacttgcaactcacaaaaacacagtttcgcttaagtgatacactctgcttgcatatcgatgatttaactatcaatgaaggagaaagttgggcattcgttggtagcaatggtagtggtaaaacggcgctcgctaatacattatgccaagaggggattttattatcgggtgagcttattaataggtttactcgtccgattagtctctcttttgaaaaattacaaaaaatgatagaggaagagtggctgcgtaacaatacagacttattaagtgaagatgaggatgatacgggattaaccgtggctcaggtgatccaaatgcaggtaaaagataatgatcgctgcctgttattagcaaaacaatttggtattgatgcacttttatcaaggcgttttaaatatctttcaacgggagagtctcgtaaggtactgcttattcagttattgatgaataaacctgatctattaattttagatgagccttttgatggtttagatattgactctcgtcgtacattaagtgagttactttcatcactacatcaacaaaagctaacgattgttcttattttaaatcgctttaatgatattcctgattttgtgcaaaatgctggcttattgattgactgtaaactcgtggcacaaggtaaaaaaagtgatattttatcagactcagtaattgcgcaattatctcacagtgaaacacttgaaaatctgatcttacccgcctcagactccgttgatgcagttcctaccttaccaccaacgctttcccctattatacttaaggatggcgtggtcagttataatgataaacctgtgctccatcacttaacctgggaagttaaaccacaacaacattggcaaatattaggtcctaatggcgcaggaaaatcgaccttattaagcttaatcacaggagatcatcctcaaggctatagcaatgatttaacactatttggtcgtaaaagaggcagtggtgaaaccatttgggagatcaaacgccatattggttatgttagtaatgccttacatcaaagctatcgcgtctcttcaagtgtgaaaaatgtgattatttctggttttcatgactctattggtatttatcaagccgttaccgataaacagcaaaaattagcggatgaatggctaacactaattggtttaactgcactcgctaaccatccttttcactcactttcatggggacaacagcgtctagtattaattgtaagagcattggttaaacacccgacattattgatcctcgatgaaccactacaaggattagatacaaccaatagactattagtacagcgctttattgatatcatgataagccatagcaatactcaactactgtttgtcagtcatcatcaagaagatgcacctcactgtattacccatcggctaatttttattaaagaaggagatatctatcgttaccaacaacaaccctgttaa

SEQ ID NO: 1335 - DNA, 1560 bp, Proteus mirabilis
aagaatttaataaattcaggttatttgctttctaataaaaaagataaagatttaatggtgggtctatgccttgccgtagttgaaggtctttttgctactattccgtatattctactctattttttattaattgatctttttgccaataaaatcacactagctcagttattttattactttttatcaatactcttatctattgttctgcgtattgtcattggtacttatagtatgccaatgatttttattggtgcttataaaatgatgggacaagcccgtctaagaatagccgatcatttacgaaaaatcccgattggctggttttcttctcaacgcagtggtgatcttgcatcacggcttactgctgatttagagatcattgaaaatatctggtcacatttcttaggaatgtttatcagtaccttagcgatgcctgtttttctctcactattcttagtatgggtagattggcaactcactttaattatattattttctattccaatcgctctgttcgcattatccataagccataaaataatgttaaaagctgcacaacaggcagctgatgctaatgccaatgtacaatccgaattactcgattatatccaaggaattatggttattcgtagttttgggcgacttggtcctgcatggaaaaaactaaaagcagccttagaaacacaaaataaaacccaaatagttctcgattccaagcctgccccttggattgcactttatggttttattcttgaatcaggttttattttattaatgataataggaacaagccgtttaattagtggctcactttctccttctcaattcgtttttttccttgtattagcactccccatttatcgacaattctttgatttaggattatccagtatgttgttaaattatgcacaaaaatcattacaacgcatagaagaagtaatgaaagtggttccactttctgagcctaaatatactcaattaccaataagaacagatatctattttaacaatgtaagctttgtttatccttataatagtcaattaacattagataatatatcttgctgttttcctgaaaaaagctttactgctattgttggccctagtggctcagggaaaagcactttactacagcttatttctcgtctatgggatgttaaccaaggtgaaatattgctagatgatattaatattaaccaaataaattccgataaactctgttcatatgtatcttctgtttatcaagatgtcgttttattttcaggaacaattaaagataatattttaatgggaaaaacagatgctcacgatgatgaaataataactgcagctaaattagctaatgcacatgagtttattatacaaaaaccacaaaattatgatactcctattggttacggtggtatgttactctcaggtggagaacgtcaacgtctttctcttgctagaactttattaaaaaatgcaccaatttttactgatcgacgaagcaacatcgagtatcgattgttcatcagaagtattaattcaacaagctttatcattgttatcaaaagataa

SEQ ID NO: 1336 - DNA, 9225 bp, Proteus mirabilis
aggatattaatcatgctgaattttgaaactttctatggtaatagtgaacctatagctgttattggtctttctggtcgcttccctgatgcacaaaatattgatcaattttggcataacataattaataaacacgatagctctcgtcttttttctgaagaagaactaaaagccgcaggtgtcgctgaacaaacttatcgttcacctgattttgttaatcgtggcgcgccgttagatgaagcggaatattttgacgctactctatttaattattcacgctcagaagctgaacttatcgatccccagcaaagaatttttttacaaggtgcttggcatgctttagagcacgctggatatgccccttgcaatataaccatcaaaacaggcgtttttgcttcagcaagaatgagcagctatcctgcccagcaagatttagcattgcacaatattggccatgtccgtggcatgcaaaaattattagggaatgataaagactatctcgcaacacgtattgcatataaattaaatttaactggtccagcattaactatacaaaccgcttgttctagctccttagttgccgtacatatggcttgtgaaagtttacgctctggtgaatgcagtatggctattgctggtggaattggtatcacatttccacaaaccggtggttatctatatcagaaaggcatgatcttctcaccagatggtatttgtcgtccttttgatgcagaggcaaacggtacttttgctggtaatggatttggtattgtagtgttacgtcgtcttgaagatgccttagtggatggaaacacaattattgctgtattacgtggtagtgccattaataatgatggtcatcaaaaagcgggattcacagctccctccgtagcaggccaagtttcagttattagagaagcaatacaactggccgatattaaaaatgaagatattgaacttattgaagcacacgcaacagctacaccattaggtgatccaattgagtttagtgcattatgtcaggttttcgctgatcgctctcttactgcttctaaatgcgctattggctcagttaaaggcaatatcggacatctggatacagcagcaggtatcactggcctaattaaaacgatattagcggtaaataaagcacttattcctccatctatgcattttaatcacccaaatcctcaattacaaatagaaaaaagcccgttctacattcctaaaagccctaaagcttggtctagcagaatacgaactgctggtgtttcttcatttggtattggtggaacaaactgtcatatcattgtgcaatcattgcctgactcattagtatcaatcaaacctgaacaagaggtagacaataattttgaatactcattattgcttagtgccgccacaaaagagagtctaaaaaaacttgctggtgattatgcaccattaataaaaattaccccagcaaacattctggctcataatgcattacagcaaagacaactcaacttaccatggcgcttatctatccccttaacaagtgagagtgatatttcactgttagctttctctcaaggaagtgctgattctttaatacaatatggtcatacatcaacaaataagaaaatagcgtggctattttctggtatgggatcacaatatcctgctatgggtaaagtgatgtaccaacattcaacaacatttgccgaaactatcgatcgttgtgagcaagcatgcctgcaacacttaacatttccgttaaaagaagtcatgtttagcctacatagcgataaacttgttaatgccagttatattcaagcggctattgtcgcctatgaaatcgcaatggcagcacattggcgagcaatcggtattttacctgaaataattgtaggtcattcttgcggagaatatgccgcagccgttatcgctggtttctatacaatcgaacaaatgatgccacttgctgtatatagtggacaattaatggaaagtcatgttaatggtgaaatgattgctgtatttgcaaaatatcaagatattcaaatcattgctaaacgatgtcatgttgaattagctgcaattaatggtcataacaacttatcattcgcggggcaacccgatgatatgcaaaaattcactcaaatattaaaagcaaagaatattcgatttagagaaatgaataacgtgtgtgctgctcatacctcttatattgacaatattcttgatcaattgatggaatttactgcgccattatcagccacacaaggaaaaatagccttagtctcaggctatacagggcaattaatttctcaaaaagaacttcaacatccatcatattgggctcagcaactacgcaatacagttatgtatcaagatgctatacaaacgttagtcaatcatggcgtcacccatgctatggaattaggaccaacttctgtattaagtgatcttggtgaacgtgaaggcattactgagattagttggataccaactgccagaatgggagttgatgaaattcagatgaaacaacaggctgcaacagccctatttattgcaggctatgatttatcatggcagtcactgtttaaaactcaaggaagttatataccattacctctctatccctttgaaaaacaatattattggtatgaaaaaaaggatagtgaaaaatatcaaccacaaaaaagcacatttgatttacctattagccaaggtcgtgaaacggcattaaaagcgcttacaacactcgatcttcctcgtttaaactcatttaattcaacacttaccactttgcataattattacgtcgataaaatgatatgctcgtgtttaggccatgagttgaatacccccatgtctgtaatcgatattatgcgagcaggacgcattttaccccgctattatcaattattagtacgtttattagaggcctgtgttgaggatggatattatatttaccaacagataaatcagcacaactactataaaaaaataaaatctatttctagtgataaattaccattattattccatcaattacagttagatagcgaaggtcttcaatctattcctgacaccgtcaaacgagcaggagagcaactctacgatatgatgacaggcgtgattgaacctgtttcagtgatctttcctgaaggtgcatctcaaggtgttgaagttctctatcaagattttagttttggtcgttattttaaccaaattgctgccgcggtacttaaaggattactttctcactaccagcccactgtggctaagcctttgcgaattattgaagtcggtggtggcacgggaggaaccacctcttggctgctacctattttatcaaccatacaacatgttgaatacgaatttaccgatatttcacctatcttcacccgacgtgccgcacaaaaatttagtcaatattcatttgttaactatcgagagttcaatttacaacaatcccctgaaatacaaggttttcaatctgattattatgacattattattgctgctaatgttattcatgccactcaacatattggagatacattaaccgctcttcgtactttactgcgttccaatggtcatttgcttatgcgcgaaataaccaaacaagctcgcttatttgattttgtttttggcccactggtgttacccctccatgatgaaaagatccgtaaaggaaaactatttttatcaccagaattatggcatcaacagtgtcgcttagcaggatttcaacatattcgctggttacctgatgcattaccagaaaccaaagatatgtgtgaacacattattctcgccagtgtttcgacagaaaacgatcactttgatcaagagttacctagtgacactaagatacaacaaagttcacactaccaatggcaattaacaccttgtgtggaacaaggtcttatcaagccaaaattaatatttaaccatcaacaaatattgccttctgaaatcacagctattttatccgctattggatgtctttctgaacagggtgaaaatcaattaatcattgccaaccttgcagatcctttaattatcgccgagcagatccgccaaatattactgtcatcgtctaatgggtttgttgttatcacgcaacaagcctgggcattaactgccatagaaacggttaatccagcacaacgcagtattcgaagtttattaaaaaccattcaaaaagaatatagctcaaggttaattgccattgttgatttaggtataaatgcctcatggtctgaattagttcccgcttttatacaaatagaacaaggtaataatgaaattattgttcgtaaccattgctgctacttaccacaattaaccccactgccctcatcttctacgatcatagcgcagaacatcatggtatctccgcgctggcatattattactggtggttttggaggcttaggtcgaattacagcaagttggttagtaaggcaaggtgctaaacgtatcgctatattggcaccacgagctgatagcagcgcattagattggatgaataacttacagaaatctaaccagctagaaataaaatggctaacatgtgattgtcgtgataacgctcaatgtcatgcagcactcactcagcttgaaaatgaaggtggcattgaggggcttatacacagtgcaggtattttggatgatgctcttatgacacaactcacccctgagcgtatgtctgacgtattttctgttaaagcgatatctgccaaacaattttgtgatgctttagaaaaaacagatgccagttaccttattttatactcctctgccgctgcaactataggctctgaaggacaagcagctcattccctcgcttgtggatatttagatggactagctgaatatgcacgtcgcaatatcaagggattaaccgtcatttctatcgcttggggggcatggcaaagtgttggctttgtagcagaaaaacaactccatgataaattacaacacaaaggtatgagtacgcttactactgaggaaggactggcacatttagatgcttgtctgctagataatacctcttgtcgccttgcaatgcgcttagcaactccacctttaatgacacaaaaaacgcctttatttcatcagactaatcataatgatataaattatgataatcatgaacttaatcacacacgccagctttgcgaaaccccaactcaaacggatcaaacagagccggtaagccctaacagggttgattatcgcgttggtgataacttagagcagtggctaacagcatgtatcaaacaactgttgcgtcttggtgatgaacatattgatactcacattgaactattccaattaggactagattcactctctttcctcgacctcagtgcggaaattaagaaacagtttgcggtcaatattgacgctgaacaatcttatgatgatatgactattgctggtttagcctcagttattcgaaccgcagcacctgagaaatttactgtgacagaagccccccataatcaagacaatatttcccacacaatggagtcagaacgatatgtcccatttccattaacaccaattcaacacgcctattggatcggacgtaaaaacctctttaactacggaggtgttgcttgccatgcgatttttgaatgggattgtcaacgccagatatgggagccggcctcacttgaaaaagcttggaataaggttattcagcgtcatgatatgttgagaatgatcatagatgatgatggacaacaacgtatcttaaaagaagttccttattttcattttattcaacatgacctaacaaatttaacccaacaagagcaacaagagagcctaacacagataagggaagctctttcttatcgggtattaccgactgagtcatggccattatttgaagttgaaatttcttggctaaataatgattgttacagattacatatcaatctagatttactgcagtttgatactatgagctttaaaattctgtttgatgatctatataacgcctattcaggacaagaattaataccacaaacatttaccttccgcgactactgcttaaaaaatcaaacaaatcgtaacagtgatgagtggaaaatggcatggtgttactggcaagatctattatctgatttaccttctgccccatatttaccgataaagaatgcatccattaccgaacaacctcgctttacgactttccaacatcatgtttctatagcgcaatgggacaaattaaaacagaggtggaaaaagcatggtattactccatcagcagggcttttaacactttttgctttagttttaggtcgctggacaaaataccctgcctttacactaaacttaactttctttaatcgtcaaccatggcatccagatgttacacaacttattggtgattttacctctgtactccctatagatatttatctagataacgactgtacattaaatgagtcaatggcaaagatacagcgcagactttggcaacatttaagtaagtcccaagtaaatggtgtagagattttacgcgaatggggacgctataaaggggatagtagccaatcgctgttacctattgtatttactagcatgttaggtatgacactagatggtgacaatattgatgaagcattaaatcagcttttcggtcaacccgtatatagcttcgcgcaaacacctcaagtttggttagatcaccaagtaatggaaggaaaagagggactaacattaaactggttctgcatggatgacatctttgccgacggtttattaacaatgatgttctctgattatcaaagcttgatcactcaattatgccaagatgaagataataatcaatcagttgataagattattgcacaactcccttcatatcaacatttagcaatagataatcacttccaatcacgctatcaacaactcgagcaaacattggaaaatcatccgcaaatcaaacgtgctcatgttatggtaaaagacgatacgaaagtagagtctcctctacaattactgtttgaagcctcttctgatattccactatccgttattaaacagcccaattggttacctaatttactttcgccatcagcttcactcagtgacattattgaaaagagttggcaacgatttgaggaacgagcacggtatggcatatgtcacacactgtatcgaaatgctctttttaccgagctaaacacaccaatcaccctagctgaaatagtgactcgtttaaaagcaaagcctcagtatgagaggctacttaatcagtggctagatttattatgcctgcatcacttattaaccaaagagggtgatcagttttatgccacaacacagtttattgacttatgtttatctgccccagtatttcaacaacctgttaatgattgggaatatgtactttgggattaccttgagcaatcactaaaccaacatgaattactctttagtggtaaggtttctcctctttcactactttttaattcagatgaaattaccacagcactatacgccaaacaccctgcactaaattatttaaatcaatgtgcaaaagatattgttagtgcaatggttggtgcaacatcttcactcaatattttagaaataggggcaggtacaggagctaccactcaaggtatagtcgcagtacttaagaatacgcattactcatacacctttactgatatatcacattacttccttgataaagcgcgaaaaaaatttactgctgtaggagaaatgcgctatcaactctttgatattaatgcaccaatacaattttctcatcatccagataatggctatgatctgatcattgcatctaatgtattacatgatgcatcacatatcggccacgcactaaaacggattagaagcctgttaaaacctcaaggctatttattatttatcgaagcaaccgagtgtcaaagtgctatgcaaatggcgactgttggctttattgagggattaagtgcatatcaagataagcgtatattgacgaataaagcgatgcttgatagtgaaagttggcatgatattttaatcaatactggttttgaaactattggtcaatggccccaaacagattcctcatctttgcgacaaacactctttttagcctctcccactcgtggaggaaaaccttatttaggtaaattacgtgattatttatctcattctcttgatcagaatatcgactctcttgagttgttccaatgtgaaaatattgaagcaacccttaatggcatagcagcatcatccgctcaagaactaaatgaacagatacaacctgttacaatacctgatgtaccaaccaatatgattaatgaagtcattgcattatggtctgagttattaggtcgtgaggtcaatagcacaaatgatttcttccgttctggaggagatagtttgattgcaaccaaaatgatcagccaattacatcaacggggatatccggcaacattacaacagatttttacctatccatgcttagccgatttttgtgctcatttagagcaggaaaagcaatcacaacgagagtactcctctttgatacctctaagcgctgtatctgctccaaaaccttaccactactttatggtgcatgcttctgatggtgatcccggtgtttacctacctcttgctgagtcgttaaataatacagtgtggggattaacagttacagatgcttcaaaactaactgatttggatacattgttatcattacatttatctagcataaaaacagcacagcagactggcccttatattcttattggttggtcatatggcgcttttattgccagttaccttgcagaacaactctcgcaacaaaatcagtccgtattattagtattaatagatcccgtctatcgacatgattttattaaattttgccatgatgactcagatagttcatcagatgaaaataagcagcttgcatgcactaaaaggcttatgtcattcctacctgaaagtgacctaccattatctgatgatatcgcctgtttatggctggaagccaccaaccacccaacagaatggacatcacctgaaaaagagtggtaccaacgattaccgccacatacccaacatcactatttttcaggggagcactggtcaatactgcaagatcgcgctaccagcacacatctggccgaaatcattgatcagtgggtgcaacaaaaactttctaataacggatatccatccgaaggaggtaattaa

SEQ ID NO: 1337 - DNA, 543 bp, Proteus mirabilis
ataacgttaattgagagtcgaggtgaaacaaccttcatgataaataatgatgaaatgacccatctgagcattgaagtcggtcaggcactgctagagcgaaaaaaaacgttaactactgcagaatcatgtactggaggatggattgcaaaagtcattactgatatagcaggtagctcggattattatcatcgaggttttgtgacttacagtaatcaagctaaacatgacatgattggtgtagatgagcaaacattgtctgattttggtgccgtgagtgaacaagttgtctgtgagatggcaaaaggggcactgctaacagcaaatgcagactatgctgtatcggttagtggtattgcaggtcccggcggcggtagtgaagagaagcccgttggtttagtttggtttggctttgcaataaaaaccccagaggggcttcgagtggttgctaaacactgtatttttagtggatcacgagaggaggtgagagccaaatctgtgattttctctttaaaatcaattcttaaagaaattattaataattaa

SEQ ID NO: 1338 - DNA, 612 bp, Proteus mirabilis
agaggactaattgccatggaacattatataagcttatttgttcgtgctgtttttattgaaaatatggcactggcgttcttcttagggatgtgtactttccttgcggtatctaaaaatgtaaaaacagcatttggattaggtattgcggtaaccgttgttctggggctttctgtacctttgaataacttggtttacaactatgtactacgcgcaaatgcattaatggaaggtgttgatttaagtttcttaaactttatcactttcattggtgtgattgcggctctggtacagatcctcgagatgattttagatcgctacttcccttcgctatataacgcattggggatcttcttgccactgatcactgttaactgcgctatttttggtggtgtgtcctttatggcacaacgtgactataactttagtgaatctattgtatatggtttcggctctggaattggctggatgttagctatcgtattactggcttctattcgcgaaaaaatgaaatacgcggatgtaccgtcaggtatgaagggattaggagttacttttgtcaccacagggttgatggcattaggtttcatgtccttctctggtgttcagctataa

SEQ ID NO: 1339 - DNA, 825 bp, Proteus mirabilis
gaagtgctaattaatctattgttatttattacatatgtacactacgcactgtggcgccgtgataacaaggagaaacaggatatgaaaaatactgatctagaattaattattaatgaaaagctaagtattgagaattttcacgactacgcacctaatggtcttcaagtagaagggcgccctcatattcaaaaaatagtgacaggagtaacggcttgccaagctttacttgatgaagcggtacgtttaaatgcagatgctgtattagttcaccatggttatttttggaagaatgagccagttgttatccgttcaatgaaacgcaatcgcttaaaaaccctactatgtaatgatctcaatctatatggttatcacttacctttagatgcccatcctattttaggtaacaacgctcaattagcgttaaaaatgggcgtaaaagttgagggtgagatcgagcctttagtgccgaaagggatttttgatctacctgtcacagccaatgaattaaaaacacgactcgaaaaagccttacagcgtaatgtgcttcactgtggtgacaatgcaccagatgttattcgccatattgcttggtgtactggtggaggacaaggatttattcaacaggcggcagagcaaggtgttgatgcatttgtaacaggagaagtctcagagcagacgattcatatagcaagagaaatgggcgtgcattttttcgctgctgggcatcatgctaccgagcgttatggtattaaagcattaggtgaatggttagcacaaactcaccatttagatgttacttttgtcgatatcgataatcctgcctaa

SEQ ID NO: 1340 - DNA, 2544 bp, Proteus mirabilis
ggtaatataatgaattttaataaccaattacacctcatttcctatcgttattctcttccgttttgtgtcgctttagggattggggtgataacaatttcttcattcgctgctgaagaagctgaatttgatcctagctttttgcattcagtacaaggaaagaatgcgattgatatacgtcgctttaattatggcaaccctattcctgagggcaagtattacgctgatatctatctcaataatgaatggaaaggaaaagctaatgtacagtatttatatactgacaatgcgaatacgtcgacgttatgtctaacgccggaattactttcattaattgatgtcgtcaaaggcactgttcctgaaaacagttataaagccacttgttatcccgcctcagaaggactcccctcagcaaaatttcattttgatttatccactttaaagctgaatatagaaattcctcaggcacaagtgaatactcgacctcgaggatatattgcccctgcacagtggcaaagtggagtccctgccgcatttgtcaactatgatgttaactattatcaatacaatactccggatataaataatgagcagacttaccttgggttaaaagcgggactcaatttatggggatgggcttttcgtcaccgtggtggtgaaagctggaataatggtcattctaccggatatcagaatatcgaaacaaatgtgacgcatgatattgctcggttacgggcacaattcacattaggtgatttttatacgaatggcgagttaatggatagccttagcttacggggaattcgattagcatcggatgaacgaatgttacccaactctttacgtggctacgctccgatcgtgcgaggcattgctaatagtaatgctaaagttacgatttatcaaaatgctcacatcctttatgaaacaactgtgcctgctggcccctttgtcattaatgatttgtatcccagtggatatgctggcgaccttcttgtgcaaataaccgaatctaatggacaaacaagaacatttacggttccttttgcttctgttgcccaacttattcgtcccggatttagccgttggcaaatgtcagtgggacgctatcgttatgcaaatgagacatatcatgatttaattgcacaaggcacatatcaatatggtttgacaaatgatatcactttaaatagtggactgaccacaagctcaaaatataccgcaggattggctggtgttgcttttaacacgccgattggggcaattgcatctgacattacattgtccagaacaacatttaatcactctaacgtaacgcgtaaaggctacagtttacatactagctatagcgtcaatattccgaccacgagtacaaatatcacgttagcagcctatcgttattcatctaaagatttttaccatttgaaagatgcgctattggctaatcacagtgaatttattgatgatgtttccataaaaagtgccgcattttatcgccctaaaaatcaattccaagtttcaattaatcaagaattaggtgaaaaatggggaaatatatttttaactggtaccacttataattactgggagcataaaggaagtcgtaatgagtatcagatgggatatagccatttttggaaaaaacttggttatcagattggcttttctcaatcacgagataatgagcaacaacgccgagatgacagattttatgtgaactttacgcttcctttgggagagcgtgttcaaagccccattttttctactgtcttaaattataataaaggcgagaaaaacagcattcaaacatccatcagcggtatcgctggggaagataatcaattctcttatggtatttcaggtaatagtcaggaaagtggaccttccggctatgcgatgaatggaggctatcgttcaccttatgtaaatgtaaccgcaaccgtcgggcaagatactcaacataatcgtcaaatgtcattgggggcgtcgggggcggttgttgcacacccttatggagtgacattgagtaatgatttaagtgatacttttaccattatccatgcaaaaggagcacaaggtgcggttattaataatgcaccaggtagccgattagatttttggggtaatggtattgtgccttatgtcacaccctatgaaaaaaatcaaattagtatcgaccccgctaatttagatttaaatgttgaattatcagcaacagaacaagaaattattcctcgtgctaatagtgccacgttagtgacatttaatactcaaacagggagaagcctgctgtttgatattcgtatgccagatggcagtactcctccaatggcttccgaggttttggatgatcatgaacagttagtcggatatgttgctcaagctgggcgcttatttacccgaggtcttcccaaacaaggtcaacttgatgtgatatggggaccaaatcatgacgataaatgctcatttacatatcatgcgacacacaatgaaactgacatgcggcctcaaatcattcctgttcagtgtataccgcactctaattag

SEQ ID NO: 1341 - DNA, 2814 bp, Proteus mirabilis
gggatcataatgcagaacggcgcaatgaaggactggctagattccacatttctagcaggagagaatcagtcttacatagaagaaatctatgaagattacctaactgacccaaactctgttgacgaaagttggagagaaatctttcaacaactacccgtaagtcaaggcgcagaacagtcgcattctcaaacccgcgactacttcagacgcctcgcaaaagaatccactcgatatcatacctcggtaagcgatcctgcaatggactcaaaacaagttaaagttttgcagctcattaatgcgtttcgttttcgtggtcaccaaaatgctaatctcgatccgcttggtttatggaaaagagaatctgttccagatttagatcctgctttccataatctcaccaaagaagattttgaagaaacctttaatgttggttcttttgctatcggcaaagaaaccatgaaactcggtgatatctatgaagcactgaaacgtatttactgcggttctatcggtgctgaatatatgcatattaccaatacagaagaaaaacgttggatccaacaacgtttagaatctgtcaatgttgcagaccaatttactaaagaagaaaaaattcgctttttagcagaactgactgcagctgaagggttagaacgttacttaggggctaaattcccaggagcaaaacgtttctctttagaaggtggggatgctctgatcccaatgttaaaagacttaattcgtcatgcagggaaacaagatacccgtgaagtggtacttggcatggctcaccgcggacgtttaaacgttctggttaatattttagggaaaaaaccggcagatttatttgatgaatttgcgggtatacacaaagagcatttgggaactggtgacgttaaatatcaccaaggcttttcatctgattttgcaacagaaggtgctcaagttcaccttgctttagcctttaacccatctcacttagaaattgtgagtccggttgttatcggttctgtccgtgctcgtcgtgaccgcttagatgaagcgcgcagtaatatggttcttccgatcaccattcatggtgacgcagcagtgacagggcaaggtgttgttcaagaaacactgaacatgtcacaagctcgcggttatgaagttggtggtacggttcgtatcgttattaataaccaagttggttttaccacatcaaatcctaaagatgcccgttcaacagaatactgcactgatattgtgaaaatggttcaagcacctattttccatgtaaatgcagatgatcctgaagcggtagctttcgtcacccgtttagcgttggatttccgtaatacctttaagcgtgatgtgatgattgaccttgtttgttatcgtcgtcatggacataacgaggcggatgagccaaatgcaactcagccattgatgtatcaaaaaatcaaaaaacatccaacacctcgtaagatctatgctgataagttagtagagcaaggtttaatcgaagctaatgatgttactgagttagttaatctctatcgtgatgctctcgatcgtggtgattgtgtcgttgaagagtatcgtcctatggggctacattcttatacatgggaaccttacttaaaccatgaatggaatgaagagtatccgcataaagtcgaaaaatcacgcttacaagatttagcgcgtcgtgtcagcacagtaccttctgaaatcgcaatgcaatctcgcgtcgagaaaatttatgccgatcgtgctgttatggctgaaggcgaaaaattactcgattggggggcggctgaaaccttagcgtatgccactttagtggatcaaggtattactattcgcctctctggtgaagatgcaggtcgtggcacattcttccatcgtcacgcggttattcacaatcaaaccaatggttcagtttatgtaccattagccaatattcataacgcccaaggtcaatttaatgtttgggattctgtcttaacagaagaagcggtattagcatttgaatatggttatgccactactgagcctcgcgggctgactatttgggaagcgcaatttggtgactttgctaacgtagcacaagtggttatcgaccagtttattagctctggtgagcaaaaatggggtcgtatgtgtggcttagtcatgctgttacctcatggttatgaaggtcaaggtccagagcactcatctgcacgtttggaacgctatctgcaattatgtgcagagcaaaacatgcaagtttgtgtgccctccacaccagcgcaggtttaccatatgttacgtcgccaagcgttacgtggcatgcgtcgcccattaatcgttatgtcacctaaatcactgttacgtcatccattagcggtatcaagcttagatgaattagcggatggtaaattcttacctgtaattggtgagttagatgaattaaatccagcggatgtgaaacgtgtcgtgatgtgttcagggaaagtttactacgatttattagaacaacgtcgtgctaatgggcaaacagatgttgcgattattcgtattgaacagctatatccattccctcatgatgatatggcacagattttggcaccttatgctcatgtgaaagattttatttggtgtcaagaagaaccgctaaatcagggcgcttggtattgtagtcagcataacttccgtgatgctattcctactggcgcaacattacgttatgcaggtcgtcctgcatcagcttctccagctgttggttatacctctgttcatcaggagcaacaaaaagctctggttgaagatgcactgaaagttgaataa

SEQ ID NO: 1342 - DNA, 3561 bp, Proteus mirabilis
ggatcaataataatgaaattaccggttttctccatttcaaacattacgagttcggtaaaaaaactcttttttgctgataaatctaaaattgcctcctttttgctatttttattggcattacttcccgctttgctcattatttggatctggtggtgggggccaacatttcgttatcaagattccataccgtttagcgaggtcaccacacgttggttagcaaccgtcgttattgtattgcttgttgtgagttggattggtctagcaacatggcgtcgagttaaaaaattggaagcattaaaacttgatgtcgaattggctgtagttgatccggtaagacaagatcttgattttcaaaaacgttatttaaactattggaaatcacaatttattcgtcacttaaatggtcatactaaagcggtttatttacgcccttggtattttgttttaggagctaaccaaagtggaaagcatagcttattaaaaaatacggtaaacccattagatattgcgcctagcgacaatattgttaacgaacaaaatattgcattaaatattcaatgtctattaaccgacaatgctgtactttttgtccctaatggtgatctattaacccaaccggcaaatcaggctgataaacctcaactttatcaccgtttgtggggcgatttactcaattggatcaaaactaatcgcccaagacaaccaatgaatggcatcgtcttaactgtcgataccctatcgttattaaccaatagtaaggagcaaaatagtcagctacttgctgatttacaaatgcgtattgaagaaatacgcatgacatttaatagtcgcttgcctttatatatcgtcttaaccaagctagatctattacgtggttttgactcaatgtatcaatcattagatgttcaacaacgtaatgaagtactaggtgtttctttcaaccagaaagcaaaaagtaattggaaaaaggaattaaatcatttttggtcacaatgggtaggccaaatgaacagcgcattaccagaaatgatgctacaaagagcagaaggtaaccagcgtagtgatctatttagtttcgtgcgccaaattgaagggttacaacattctgtatgcacattaattgatgcattgctcatcaataatgagcaacataatatctgtttaagaggggtttatttaacttctgcattgcaaatcggtcaaatcgatgatgtgtttagccaaacagcgtccgaacaatatcatttaccgacagcacctcttactacatggccaattaatgatagccacccttattttactacccaattatttagtcaagtgctatttagtgagcctaatattgcagcagaaaaccattattgggttaaaaaacatcggactcgcctattagtcaccactgctgttagctttgtcggcttaatcgcaatttggaatggttggagccactattacgacaaaaactatcgtgctggagaaaacgttcttaatgaggtaaaagcattccgtgctattgagaacaatgctcagaaagatactgatggtagcctacaattaccggtgctcaatccattacgtgaagcaaccttagcttatggtaatcatcgtgataaaaatgtgctcttttctgatatgggtctttaccaaggtcaaaaagttggcccacaagttgaacaagtctatttacaactactcaccgatcgttttttacctgcggttatgtctgggttgttaaatgaacttaacagtgccgacaaaggaagtgaagataagttagagatattgcgtattatgcgcatgttagaagataaaagtggccgtaataatggcatggtagaagattttatggccgattattggagccaactgttcactggtcaacgtgaaaaacaactgcaactaaaagcccatttgcgctatgcccttgagcacacagattggaaacaagagcgtgaaaaaggatttgtttcagccactaaagcctttatgccttttgctggacctataaaaaatgcacaagcagagttaagtgtattgtcactttatcagcgtgtatatcaagccttacgcttaaaggctaatcaagagctttcagcgcctttaaatttacaacatcaaattggcccaagttttaatacggtctttacggctattgatgatgataaattagaaattccacaattcttaacgcgctcagggttattaaactattttatccgccaaaatgataaattggtcgagctaacattacttgatgcttgggttcttaatctaaccaccaacacacaatatagtgaaagtgatcgtaaagaaattcagcgtcaaatcagtgaacaatatcttagtgactatacggctcaatggcgtaatgccatgagcaatttagaaattcgtcaatttgattcaatacaagatgaaattaccgctcttgagcaaattattagtggtgaacaaccattacgccgagcattacaagttctacgtgataacacggttattccaactattgatgaaaatttaccacttgatgaacaaaaaacactgatggctgagccatcttaccgtttattaacccgcttagatcgcgaatttactcctcaaactgagatattagtcagtaaccaaggggaaaatttacagaatctgaatcaaaaactaaatgacttacatcgttacctattggggatccaaaactctccagtgccggggaaagcggcgcttaaagcagtttcgatgcgcttaaacgataataatcgcgacgctatttttgagctatcacaaatggcgaaaacattaccagagccgcttaaccgctgggtcgatgagttatcagtgcaagcatggaatgtggtccaaaaagaagctattcgttatatggaagtagaatggaatgaaaatgttgtcaaacaatacaatacttatattgccggtcgctatccatttaacccagcagctaaacaagatgttcctttaagtgaatttgaacgtttcttcaaaccaaatggaacattagatagcttctatcaacaaaatctgcgtttattcgttgagaataacttagtcaacgatagtgatagccaatcattgatccgcgctgatgtattagcacaaattgaaatagccaatcgtattagagaaaccttctttaatgcccaaggtaatttagaagcacaatatgctattgagccactgtcattaagtggtaataagcgtcgtagcatcttaaatcttgatggacaattgattgattacgctcatagtcgcagccatgtgacacacttggtatggccaaactcaatgcgttccaatattgaaagtaaactgactttagtgcctctttccggtgataaatcgccacgttcaatcagtttctctgggccatgggcacaaatgcgattagttgataatgcaaaactcatcaatatcaaatctaactcattcgatattcgcttcacaatcgacggtggtgatatgacttatcgagttatagttgatgaatctaataatcctttcttcggtggattattcacaaaattccgtttacctgaaacgctttattaa

SEQ ID NO: 1343 - DNA, 1509 bp, Proteus mirabilis
tcaaaaataatgtttatagaggattatttcatgtcactaaatgcagaagctcaagagcaacaagcccccgcatctacaggctctttacttgatgaaattatggctcaatcacgtatgtctccagaaacagaagcatacgatattgccaaacaaggtgttgctgcttttattagtaatattttcgccagtgaatctgaagaccaacagatcaatcgattattaatcgataaaatgcttgttgaacttgataataaactaagtactcaagttgacgaaattcttcacgcgcctaaatttcaagaaattgaagcttcgtggcgttctttaaaattactcgttgatcgcactgattttagagaaaatattaagatcaatattcttcatgcaactaaagaagagttattagaagattttgaattttctccagaaattgttcaatcaggcttctatcaacacgtctactcttcaggatacggccaatttggtggtgaacctgttgcaacagttattggtaactacgcctttaacaatactgcgccagatatgaagttaatgcagtatgttagtactgttggtgcaatggctcacgcgccattcctatcatctgtttcacctaatttctttggtattaatagctacgctgaactgccggcaattaaagatctaaaatctgtttttgaaggccctgcacatactaaatggcgctcactgcgtgaagcagaagattcccgttatttagggttaacagcaccgcgtttcttattacgtttgccatactctccaacagaaaaccctgtaaaaatgtttaactattcagaaaatgttaaacaagaccatgagcactatttatggggtaataccgcattcttattagcaagctgtattaatgatagttttgcaaaatatcgttggtgtccaaacattattggcccacaaagtggcggtacagttaatgatcttcctgtgcatatttttgaagcgatgggtgaattacaaactaagatcccaactgaagttttagttaccgatcgtagagaatttgaactagcagaagaaggctttatcacgctgaccatgcgtaaaggcagtgataatgctgcattcttctccgcaaactcggttcaaaaaccaaaagtcttcccaaatactcctgaaggcaaattggcagagactaactataagttaggaactcaattgccatacatgtttattatcaatcgcttagctcattatataaaagtattgcaacgtgaacagattggctcatggaaagagcgtcaagatctggagcgtgaactcaatatttggcttaagcaatatgtcgcagatcaagaaaacccaccagcagatgttcgtagtaaacgtccattgcgttcagctgaaatcaaagtacttgatgttgatggcgatccaggttggtaccaagtcgctattcaagttcgcccacattttaaatatatgggtgcaaactttgaattatcacttgttggtcgtcttgataaagagtaa

SEQ ID NO: 1344 - DNA, 1371 bp, Proteus mirabilis
gctaagataatgtttgagaatttaagtgacagattatcgcgcacattgcgcaatatcagcggcagaggccgactgaccgaagaaaacattaaagacacactgcgcgaagtgcgtatggctttattagaagctgatgtggctttgcccgtggttcgtgagtttattgcacgtgtcaaagagagtgcagtaggtcatgaagttaacaaaagtctgaccccaggtcaggaatttgtcaaaattgtacaaaatgagctggtaaatgcgatgggagaggtcaataacgatcttgacctttcagctcagccacctgccgtggtattaatggctggtttacagggtgcgggtaaaacgacaagtgttgctaaactcggtaaatttttaaaagagaaaaagaagaaaaaagtattagtagtttctgctgacgtctatcgtcccgcagcgattaaacaactggaaaccttagccgaaactgttggtgttgactttttcccttcaacggtacaagaaaatcccgtcaccattgctagtaatgcgttaaaacatgctcagctccaattttatgatgtattactggtggatactgcgggtcgtttacatgttgatgaaggcatgatggaggagatccaacttcttcataaagcaatcaatccagtagaaaccctatttgttgttgatgcaatgacagggcaagatgctgccaacaccgcaaaagcctttaatgaagcactccctttaacaggggtggtattaactaaagttgatggtgatgctcgtggtggtgccgcattatctattcgtcatatcacagggaaaccaattaaattcctcggtgttggtgaaaaaacagaagcattagaacctttccatcccgatcgtattgcctcacgtattttaggcatgggcgatgttctttcattaattgaagatatcgaaagtaaagttgaccgagcgcaagctgaaaagctggcaactaaactaaaaaaaggggacggttttgatttaaatgatttcttagatcagttaaagcaaatgaaaaacatggggggcatggcgagtatgctaagtaaaatgcccggcatgtctcaggtgcctgatgcggtgaaatcacaaatggacgactcaattttagtcaaaatggaagctattattagctcaatgacgaaaaaagagcgccaaaaacctgaaatcatcaaaggttctcgtaaacgtcgtattgcgatgggatcgggaacacaagtgcaagacgtcaaccgcttattaaagcagtttgatgatatgcaacgtatgatgaaaaagatgaagaagggcggcttggctaagatgatgcgtggcatgaaaggtatgatgccaccaggctttccaggtcgctaa

SEQ ID NO: 1345 - DNA, 312 bp, Proteus mirabilis
aaaatagtaatcaggaggctcatgatgaatttacgcaatgaggcaaaagggcgtgaatgtcagattagaataccttcagtttgtaatggtaactctgaaacggttgttttagcccattacagaatgtcaggtctttgtggcgtcggaataaaatcgcatgacttatttggcgcttgggcttgtagtgcatgtcacgatgaagttgatagacgaacacgatttacggatatggagtatgcaaaacaatgtcatctagaaggtgttttgagaacgcaagccatattgatccaagaagggaagttgaacgtgtga

SEQ ID NO: 1346 - DNA, 441 bp, Proteus mirabilis
gcaaaagtaataaggtcagccatgaattatcaattccaagaaggtgctatcacattaccggatgaagaatatcaagacaatagtcttaatatgctgcgtttccctacgcgacaaggcagtatttctattacgcgtgatgtagtggctccagagataaccctcaataactatctggctggacagttgtcggccatcaaacgtgaaatgaaaaatgcggtggtaaaagcacccacagattttcgtaccgaaaaaggagttacgggctgtgaaatctattgtgaaaccaaacaaaaagggatccctatttatcagtggatcgccgcttttcgtctcgaaaataaaatagtggtgttgacttactgccaaattaaaccgttttccaatactgagcaggcgcaatggcaagcgttaagagacagttttacgccatcgcccaattaa

SEQ ID NO: 1347 - DNA, 237 bp, Proteus mirabilis
cctttttcaatatacgcattagtcattgatttaatgatatgttgcatatcacttaatgttaaacatttatttatatatttagatattaattctttttgtgccttattagttaataaaccattcctttctatttttatttcattaattaagaagcaattatttacattattatttatttctgcaaaagttatcttacttatcgttaataaaaatagcgccattaatcctaataaatag

SEQ ID NO: 1348 - DNA, 192 bp, Proteus mirabilis
tatcattcaataatgacacttaatcagactatttttataaacacttcctcattgccccttaaccaacaatccatcaaagttggactctttgtaacagagagtccttatgaacaaacctatttcctttataatctgtttcactaccttatttataaaggcttgtactccgaaagaaaaacttcagcaacttga

SEQ ID NO: 1349 - DNA, 1194 bp, Proteus mirabilis
ataacatcaatacaatggagccttatgaatacctcaacccacccaagccattcagcacaagcctttcatatcgcttttagtggtttccttgctttagttgttgctatggggatagggcgttttacttttacgcctcaagtaccgctaatgattgcggacacacaactgacattaaccagtgccagtattgttgctgcatttaattatctaggatatttagctggttcatatgatgcgatgaaagcaactaaaggtgtgggctatcggctttgggggggattatggggagcggtgatcattacactgcttagtgcggtacttaatgatgctttaactcatagtattgcccgtttttttattggttgggcaagcggttggacattagtgctcgttgcttcgtgggcaaatgaagtattagcccgtttaaatcgcccggcattaagtgtggcagtctatgcaggaacaggggcggggatctttattagtggccttcttgcggtattcattctcaagtggcagatgagtgcgacaacaggttggttgatttacggtgtgttggcatttatttgtgcaatttatgtgagctatcatttacccaaaccttggtcaattaatcgtgagcaagtcaaagtagagccacttatcttaacgccggcgatgaaaaaattgatttggggttatacctttgcgggctttggttatattttacctgcaacctttttatctcaaatggcgacggaacgttttcccggtagcttagttgctcaatttgtctggcctatttttggtgcttccgcagctttatgtattgggatcgcgatactgacacgtaatgtccttaatacacaattacgattggcgataacactatggttgcaagcactggggatcatcattgccgaatggctacccacaattacaggtcttgctattggcgcatttttagtggggggagggttaatgtgtgcggtgcaattggcatttttacgtggtaaagagttggcacctgatcatgctcgttatatggcaggattattaacaacattttatgctattggacagctagttgggcctctggtttccttcctttcaacggcgttaacgggaagactagagccggcattatatgtcgcctttgtgatattgatcatcggcggtattttggtttgtatgaaagaaaacaataaagggtaa

SEQ ID NO: 1350 - DNA, 744 bp, Proteus mirabilis
aggagcccaataatgaaaaaaacactttctgcactggttatctcttcgttactttttggtgcaaatgttcaagccgctgccttgaatgcagctcaagaaaaagaagtacgtgcattagttcgtgatactttagtgagtaatcctgagattttggaagaagctatcatggcattgcaaactaagaaggcagatgagcaacaagcacagttccgtcaagcattggcctctgaacatgatgcattatacaacgatgcggcaagtccacgtattggcgctaaagatgctaagttagtgttagtgtcgttcactgattataactgcccgtattgcaaacgctttgacccattattagaaaagatcaccgaacaataccctgatgtggcggttatcattaaaccattaccatttaaaggtgaaagctctgctaaagcctctcaggcggtgctttctgtctggaaagaagatccaaaagcattcttagcacttcatcaacgtttgatgcagaagaaaacgatgctagataatgcaagtattgaagatgcaatgaagagcactaatactagcaaaattaagttaactgatgacagtttaaaaacgttgcaaaataacttagagctttctcgtaaactgggtattcaaggtacgccagcgacggtaattggtgatactattttaccgggtgctgttgattatgatcagttagaaattattgtgaaagaacaactggcgaaagtgaaaaaataa

SEQ ID NO: 1351 - DNA, 759 bp, Proteus mirabilis
ccaaatacaatgagtaatagcaacttatttatagataatgaggtgcatatctggattggtaatctaaaaacgatgccatgtttaagtaaagctaaatccagaatgcacatcttaaataacgatgaaatttcatcgttattcgactacccttttataaaacaacgaaatatttttttgctatcaagagtcatgttacgcgatattttatcattttatttaaaaatctcaccagaagatgtaagattttcaaaaaatgagtacgggaaaccatttattttaaacgaatcaaaggaaagcatttacttcaatttatcacattcaaataattgtgttgctctcgctatttcaaatacatcatcagttggtgttgatattgaatatttcaaccgtgatatagaaataaatagcattatagattattatttctcaaaaaaagaaaaaaaatatctatcttattttgacgagactcaaaaaaaacataatttctataagatgtggacattaaaagaagcctatattaagtcaagaggcattggattatcagaagaaatcattaagaatttagatttttatataaagagagatcaatttgataaattatattttatagaacagtattactctgctcatctttcatatattaccaaatcaatattagatagctataaaatatccataatcacatatcaccatccatttaactataaattcttaacatggggtgatataaaaaacaacctgccacatcatttattatag

SEQ ID NO: 1352 - DNA, 666 bp, Proteus mirabilis
aggttaacaatggcctataacattcctaatgggtcgcgtgtttacgtcgcaagtaaatacgatgacgaaattaaaattaccgaggcaactaatgccgaagaagccgtactaacagttgatgacgtgggcgacattgcaaaaggcgatattgtgcatgtgacatctgggtggaagaaagcttctggcgcgttccgtgttgcaagtgttattgaatctaaagtcaccctagagggtgtagataccagtgataaaaacgtattccctgtaggtggtggtacaggaacattaaagaaagtactatcatgggaagtcatgccacaggtaatgacactgtctaccgaaggtggggaacagcaaactcaagaggttcaatttcttgaagatgagcaggcagaaactatcgatacctataaaaatggtgttgtacaggtttatacctttgctcacgatgccaagttgcctatccgtaaattgctaacaaaattggacgacagtaagcaagttactgcaatccgattcttcaataaacgcgcagaagaagatcgctattacacagcttcaatttcattccaacgtgtgccaaacaccgctatcaacgaagttgaaaacgtaacagcgcgattctcacttaaatctgaaatgcagatttataccaacgcatcttaa

SEQ ID NO: 1353 - DNA, 324 bp, Proteus mirabilis
cacataacaatgggtcagtttgattttttaacagaaactacactaggggagaaggtctctcagttaaatgagccacctgcgatgtataaggtgatcttgaataatgatgattacacccccatggattttgttgtagaagtattaacaatgtatttttttcttaacgaagaaaaagccacacaaattatgttggacgttcatcataaagggaagggagtgtgtggtgtctatagtgcggatatcgctgaaactaaagttgcacaagtgaatcaatacgccagagagaatggccatccacttttgtgtacactggaaaaagcgtag

SEQ ID NO: 1354 - DNA, 315 bp, Proteus mirabilis
ggactgacaatgcctaaatttacactcgtcccaaatccaaccttcaaagctaacgtcaaaattcctgttgctggcaaagaaaagccagaagtagttacattcacatttaaacatcactcagtaagtgagcttgatggaatgcgagaaaaaccgatttctgagttctttgagcagattattgctgactgggcgatcgaagaaccatataacaaagaaaatttaaacatattgttagataactacccatcagcttctcgtgctatttcatcaacgtattacaacgagctactaggtaaccgcgaaaaaaactcctaa

SEQ ID NO: 1355 - DNA, 714 bp, Proteus mirabilis
gatgttgcaatgaaaattcaatctatattgaattctcaatttttagtctcattggggattagcgtgttgacattgtcaacagaaggaatggcggatcaaagtcaacatcaagttttaaaaacagagcaacaggcattagaacaatcactaatcgctgaaaatgctcaagaatggaaattaacagagaaagaatggcaacgttatgaaatgctaaaaaaggggaaacgagggctgttttcaccgaatttagatcccttaactttattaggtattgaagctcgtacttatgaggagcgacgttattttgctgaattagtggtgaggcaagaatttcagcgtgttgaagcagaattagcctttcagcgagaggcgaatcaagcatggcttcgtctttatcctgaaattttaccaattcaaaatgaaatgagagaaagtcgtcaggctttatttgtaaaagaaagttgttctatttgtgaggtaaaactcgctcagcttatcaaactaaatcaacctattgatatctatttagtgggaagtggggggaaagatgatgtgatacgaaattgggctaaaaaacatcatattcctatcgaaaaggtaaaaaatcgccatatcacattaaaccatgataacgggatatggctaaagcatggcaatggaataatgcctgttgttttacaacaaggaacgcaaggatggcaaagagtcgattag

SEQ ID NO: 1356 - DNA, 1785 bp, Proteus mirabilis
ggagaggcaatcaatatggataacacaaattacaccatcaatttaagcggtgttgaaaaacgctttgttgggcttgaaaaaccggcggttgcttcactcaccgccaccattaccggtggttcagtcacaggtcttgtcggccctgatggtgcgggaaaaacaaccctaattcgcatgctagcaggattactaaaacctgatgctggtgagatcaaaattttaggaatggatccgcaaaaacagagtgttgatgttagggcgatcctcggttatatgccacaaaaatttggcttatatgaagatctcactgtgctagagaatctcaacctttatgcagatttaaaaaatgttatcggtgaagagagaaaaagagtttatcaacagctactctcttttactgacttaacacgttttacctctcgtctagcgggtaatctttctggtgggatgaaacaaaaattagggttagcttgtactctattaggtagtcccaaagtactgttattagatgagccgggggttggtgttgatcccattgcccgtcgagagctttggcaaatggttcataccttagccggtgatggcatgcttatcttatggagtacctcttatcttgatgaagcagaacaatgtaaaaacattctgctactgaataaaggtgaattactttatagcggtgtacctcagaccttaacggctaaaatggcgggacgctcttttttactcaatgttgaaggtcatcagcgtcgaaaagtattgcaacaagccattatacaacctcaagtgaccgatggcgtgatccaagggcaatctgtacgattgatcttaaaaaaacacagtgaccaaacagcattgttaaacgccttaggaaaaccagatgcaaaacttatcccggcgacaccgcgctttgaagatgcctttattgatttattaggtggtggcccttctcataaatctgaactggcggagatcatgccacaaatccccccagcacccgatgaaaccgttattgaagctcaacaattaacgaaaatgttcggtcaattttccgccactgatcatgttgatttccaagttaaacgtggggagattttcgggttattaggccctaacggtgcgggaaaatcgacaacctttaagatgatgtgcgggctattagtaccaacgagtggtaaagcattagtgttaggtatggatctgaaagtcagctcaggtaaagctcgccaacatttaggttatatggcacaaaaattctcgctatatagcaacttaaaagtggggcaaaacctgaaatttttttctggggtttatggattatatggtaagcaacagcgcaataaaatcaatgatatgataaccgcatttggcttacagccaatgattaaccaaatcaccgataccttacctcttggctataaacagcgtcttgcccttgcatgctccttgatgcatgagccagatattctttttcttgatgaacctacctcaggggttgatcctttaacacgccgtgaattctggcttcatatcaatggaatggtggataaaggtgtaacagtgatggtaacgactcactttatggatgaagctgaatattgtgatcgtatcggtttggtttatcgcggaaaaattattgcagcaggcgagccggattcattaaaacagatggtagcaacagaagaaaatccgaccccctctatggaagatgcttttattggcttagtactggattacgataaaaaacttgaacaagaaaatcaccaagggagcgaaaaacatgagtaa

SEQ ID NO: 1357 - DNA, 501 bp, Proteus mirabilis
tacagacaaatcaatagagaacacattatgtaccaagattatctcaatacgccgaaaggttttccaaagccttatatatccattactgcagatgatgatggcatcaccagccttaactttgttagtgaaaaagaggcgttagttaattcaaatgccataattgacctgtgtataaaacagttaaaagagtatttttcgggtaaacgcaccctattttcagtgccactagcgcctaaaggaaccgaatttcaaatacgcgtttggcagactttacagtctattccttatggtgaaatttggagttataaaaagttggcacttacattaggttccgtcaactattgcagagcggtaggaatggcaaattcacgtaacccaatctcgttaattattccttgccatcgcgtcattggtcataatggtaagttagtaggctatactgggggacttgatatcaaacgttggctattacactatgaaaaagtggatattgacgaatag

SEQ ID NO: 1358 - DNA, 990 bp, Proteus mirabilis
agtgataaaatgtttactatacctattgataaaaaatgcaaattagaaattattaatactttggcgacaatggaatctgagttatttaaaaacatttcccccttggaattttttgattctattttaaacttaaggattttagcttctgaagatcctcgttatcaagatgcatatggagatttaaatcaacactacattaataataatgattggactctagagtatatcctccttgaaagatttgactttttaaaatcagacgaattatttaccctattactcaacacactggtatctccatccataatgaaaataggtgtgaatgaaatttcttacatctataacaagttaaatccaattttaattatatataacatagagtatcaattaaatggacacgatgaaaataatataccaatttatgaactatctaattttaataatgatgatgaatttaaagatataaaaaataacaacattccctttataataaaaaacaataaaaataaagaaaacgaatattttaaattaatagaaattaactggaatgatttcggaagatataataaatttctattgtcttattataaaaatcaaaaagaatacatcattggagacttaaaaataatctctaaagaagatataagtacaacaaatgagataaaaaataatttttttaaattagataataaacattgttctctaggtcaaaaatttgaatattatgagaatatatttaaaggtaatgcattatcaatactaaaagcactaaatgatgtagctttctttactaaaatacaagagtcatttgaacatttatctcaatttaaagatagtttaattcgatatgacgaacaagagcagttattaagacaggctaggcatcgaataagaaaatacgatttaagtcaactttattccttcgaatatatatttaaacctgattacattgatgatgaagataaattaaagttaacttttaacttttaa

SEQ ID NO: 1359 - DNA, 339 bp, Proteus mirabilis
gagggtaaaataatggctaaacaacgtagtcgccgtttacgcaaaaaaatgcgtatcgatgaatttcaggaattaggtttttcagttaaatggacgttcccagaaaatacccctattgaggaggtcgacagctttgttgatgactttatccttaatgtgatagagccaaatgggctggcatttgatgcgagtggttatctgagttgggaaggcctgatctgtctacaaaaaattggcaaatgtaccgaagagcatcgtcaattagtagaaaactacttaaaagaaaaaaatatgcaagatgtacagacctctgaactatttgacgtttggtgggactaa

SEQ ID NO: 1360 - DNA, 840 bp, Proteus mirabilis
ggagtcaaaatgaacaacattgaacgccatgcctgttttggcggttggcaagaggtttatcaacacacctctaccaccctcaattgtgagatgaaatttgctatctatctcccgcctatggaagatgggcaaaaatatccggttttatattggttatcaggattaacttgtaatgaacaaaacttcattactaaagctggagcacagcaatatgctgcgcaacacggtgttattttagtggtacctgatactagccctcgtggtgaaaatgtggctgataatagtgcttatgatttaggacaaggtgctagtttttatctgaatgccacacaagcaccttggaatagtcattataaaatgtatgactacattgttaatgaactccctaaattgattgagacacattttcctgccaatgagcaacgtgctattagtggacattcaatggggggacatggcgcattgatgattggtttgcgtaatttgtctcgctattgcagtatttcagcgttttcacccattgttgcaccaacccaagtcccttggggacaaaaagcctttagcgcttatttaggcgacgatatggcacaatggcaacaatatgacacgattgaattactgaataaaacacaacagacagtgcccatacgagtggatgtcggtcttgatgatcctttttaccaacagcaactacagccagaacgtttagcacaagtgtgtgataaaaaacagtttgcgtgctgtttaaatttacatcaaggctacgaccacagttactattttgtcgcgagttttatcggtgaacatatagcctttcatgctaagcacttaaaggcttaa

SEQ ID NO: 1361 - DNA, 711 bp, Proteus mirabilis
gaagaaaaaatgttaatattaatgaatatttggtggtcattaccgctaacacttattattttctacttagcacgtaaactggcggctcgatttaaatggcctattttaaatccgttattgattgctattgttgttattattcctattttattagtgacacacaccgcctatgaggattattttgccggaagtcgtatccttaacgacttgttacaaccagctgttgttgctttagctatccctttatatcaacaattacaccaaatacgcgcacaatggaaatcgttaattagtatctgctttattggtagtatcgccgccatggctagtggtacagcgattgcattatgggctggcgctactcctgaaattgccgcctccattttgcctaaatcggtaacaacccctatcgcaatggctgttgcggattccataggtggtattcctgcaatcagtgctgcatgtgttattgcagtaggtattttaggtgccatttttggtcatacgctatttaaaatattacgtattccaactcacgcttctcgtggtttagcgatgggaacagtctctcacgcagtgggtaccgcaagagcagctgaaatcgattatattgaaggggcatatagttcattagcattaatgacttgcggtattattacttcacttatcgcaccctttatttttccttttattttgcacctttttagctaa

SEQ ID NO: 1362 - DNA, 1137 bp, Proteus mirabilis
ataacgaaaatgagaggagccgggatgagtgataaatcccccgagcagaccacccctgagattctgaaagaaaaagtttcaggtgtcttgtctacttttgaacacccgacattgaaacgtaatctgctttccctaaaagcattacatcagtgtgcgatgattgatgatgtccttcatatcgaattagtgatgccgtttgtgtggaaaaaacctttccaacaactgattgaagaaaaaacggcagagctgcgtaatatgacgggagccaaagctgttgagtggaagctaaaacacaatattgccacactacgtcgtgcaaacgatctaccaggtattaatggcgtacgtaatattctggcggtgagttcaggtaaaggcggggtgggtaaatccagtaccgcggtaaaccttgctttagcgctagcacaagaaggggctaaagttggtattctggatgcggatatttatggcccatccattcctaatatgttaggtacaaccatggaacgcccaacttcaccagatgggcaacatatggcacctattatggcgtatggtctagcatctaactctatcggttatttagtcacagacgataatgccatggtatggcgtggtccaatggcaagcaaagcgttgatgcaaatgctgcaagatacgttatggcctgatttagactaccttgtgatcgatatgccaccaggaacgggtgatattcaattgaccttatcacaaaatattccggtgactggcgccgttgttgttacaacaccacaagatattgcgctggtggatgcgatgaaaggcattgtcatgttcaaaaaagtcaatgtacccgtattaggtattattgagaatatgagtgcgcatatttgtagcaattgtggtcatcttgagcctatttttggtactggtggtgctgagaaattagccgaaaaatatcattgccaattattgggtcaaattccactgcatatctctttacgtgaagatttagatcgcggacaaccgacggtgatgcgtgatcctgaaggtgaattcgctgatatctatcgtgaaattgcttcaacagtttctgcgcaaatgtattgggatggggatgctattccaacggaaatttctttccgcgcggtataa

SEQ ID NO: 1363 - DNA, 183 bp, Proteus mirabilis
gagaagaaaatgaagaaattaattatttttatactatcaagtttattcgctttttatgctagcgcttatacttgggataataaaatcaaagataccagcactgttaatcagtattgtcaacataatagcaatactcaacaatctactcgctgtgtttggcccccttgtgatgatgagtggtaa

SEQ ID NO: 1364 - DNA, 2226 bp, Proteus mirabilis
aaaactgaaatatttttacttaatatttcagcgagaattttttaccaaaaaaaggtattaaaaatgaaaaattataaaatagcggtcagctacgatatgtctgactatatttcaacccaccgtgaatgtgtcgatattctacatactgatttttctgatgttgccgtgattgttatttcacttaatgacattcagaatggaaagcttaatttaattgaacaaaatagctttgaacagcctatttttgccattattaataaagatgaagttatccctgctaatattattaatcgattaactggtgtaattgatttaaataaaaaaaatagtgagttatataataaacaactagaaactgcagcgttaaaatatgaagagagtctattacctccttttttcggcagcttaaaaaaatacgttgaacaaggaaattcagcttttgattgtcctgggcatcaaggaggtgaatttttccgccgtcatcctctaggtaaccaatttgtcgagtattttggtgaaaacttattccgctctgatttatgtaatgccgatgtttctatgggtgatctgctgatccacgaaggtgccccatgtgccgcacaacaacatgcagcaaaagtctttaatgccgataaaacttatttcgtacttaatggtacatcttcctccaataaagtcgttcttaatgccttattggcaccagatgacctagtattatttgatcgtaataatcataaatcaaaccatcacggagcattaattcaagcaggagcaacgcctgtttatcttgaagctgcacgtaacccatttgggtttatcggtgggattgatgctcactgttttgaagaaaaatatcttcgtgaactcatcaaagaagtcgcccctacacgtgcaaatgaaaagcgccctttccgcctagccgttatccaattaggtacctatgacggaacaatatataacgcacgtcaggtagtcgataaaatcggacatttatgtgactacattttatttgactccgcgtgggtgggctatgaacagtttattccaatgatgaaagattgttctccacttctacttgaactgaatgaaaacgatccggggatcttagttacacaatctgtacataaacaacaagcgggattctctcaaacctcacagatccacaaaaaagatcgccatattaaaggtcaaaaacgctatgtaaatcataaacgtctcaataacgcctttatgatgcatgcctcaactagtccattctacccattatttgcagctttggatgtgaatgccaaaatgcatgaaggtgagtcaggtaaacgtttatggatgaattgcgtaaaaacagggattgaaacccgtaaattactcctgcaatcctgtaaacatattcgcccgtttattccagaaactatcgatggccgtgcatgggaagattttgatactgatgaaattgccaatgatctccgattctttaattttgttccgggagagcgctggcactcatttgagggatatgaagaaaatcaatactttgttgatccatgtaaattactactaaccaccccaggtattaatgccaaaacaggaaaatatgaatcatttggtgttcctgccaccattttggcgaactatctacgtgaaaataacattattcctgaaaaatgcgatcttaactccatattattcctgctaacgcctgcagaaagcatggcgaaaatgcagcatctggtcgcacaaattgctcgctttgaacaattactggaacaagatgccccactgaaagaggtacttccatcagtatatcatgccaaccaaacacgttatcaaggatacaccatccgtcaattgtgccaagaaatgcatgatatgtatgtgaaatttaatgtaaaacaactgcaaaaagagatgttccgtaaatcacatttcccacaagtcagtatgttacctcaagaagccaatatcgcttttgtgcgtggcgaggtggagttagttgccgtggaaaaaattgaaggccgtatcgccgccgaaggtgctctaccttatccaccaggagtactgtgtgtagtgccaggggaaatttggggtggctctgtacagcaatattttctagcgctagaagaaggaattaatctattcccgggattctcaccggaattacaaggtgtatatatccgcaatgatgaggacggtcgtctgcgggcatatggctatgtaattaagcactaa

SEQ ID NO: 1365 - DNA, 705 bp, Proteus mirabilis
atgaatgaaataacaacgctagcaggtgcgaccgtgactacggtcacacttgctatttctgctcttattatcggattagttctagccatgctgtttactgcgtgggaatccgcaaagtggaaagcctttgcttttctaggaacttgctgggtaacactaattagaggactgccagaaatgctggtggttctttttgtctattatggcaccttacaaggtgtcatgatgctcatggatggtattgaattaggtcctttcaccttacaatttgactttggtgatactgaatctttacctttctattgtggtgttatcgccctttcacttctgtatgcgtcttacgcttcacaaactttacgtggtgcattaaaagccgtgccaaccggacagtgggaagcaggacaggcattgggtatgggaaaaatcaccatttttttccgctttatcatgccccaaatgtggcgtcacgcgttacccggactcggtaatcagtggttagtgctcttaaaagataccgctttagtctcattaattagcgttaatgatttaatgctacaaacccagagtattgccaatcgtactcaagagccttttacttggtatagcattgtggcacttatctatttagccattacattagtcagccaatatattctgaaatggttagagatgagaacgacccgatttgaacggagtgcctcataa

SEQ ID NO: 1366 - DNA, 6114 bp, Proteus mirabilis
ggtatagaaatgaaaatattaagtgatattaataacataaaagaattatgttccaagcaaataaacattgacaaaaataaattttcagataaggacaatctgataaaattaggtcttgattcaattggatttatgcaatgtttatatattttccaaaaaaatggttatgctataacattaaaagatttgtatttaaatccaacaataaaaggatggtataaaatattaaaaaaatcagatataaataaaaaagaaagaaaagataatatatatacacataaaacaataaaaaatgctggtgagttttcacttacacctatacaacatgcctattttgtcggccgtttgaataaacaaactcttggtggtgttgcttgccaaatttatcaagaatttgatggcatccctaaatttactccggaaagtctagagaaagcattagtattattatcaaaacgtcatcccatgttgaatatagtatttcaccaacagggtacacaattttggtctcctaacctaaatagaaaatatgttacatatcatgattttagtaaattaccaaaagatgagtatgagaaaaaacttttacaattacgggaagaattaagccatcaggtactaaatgttgaaagcggtcagttaattgattttcacatgatatcgctacctaacaacagatatcgtttatgtactaatattgatatgttgattgcagatggtacaagttattcattactctttactgaactttgtttattattgagcggagaaatactgcctcagttagatgagcactatgacttttaccattatttacaagataaaaaacagtatgaaaacaaagaatcagcatatcaatattggaaaaataaaatcccaaacctaccagactctcctcttctgccattatatatggatccagaaaaaataaataaaataaaaactaaacgccttagctggacatttagctcaaaagaatggaaaaactttagtaatttggctaaagaaaataatattacaccttccattgcattagcaacctgtttctcatctgtacttgcaagatggactggccaaaatagcttattactcaactttacattatttgatagaaagccattagcccctgcagttaataatattatagctgattttactaatgtcattcttttagaaatgaaaacagacaatcgaccattaatttcattatctaaagacaatcaaaatacatttattgaagcttggcaacattctgattattctggtattgatatcattagagaccttcgtaaaaatggcacccatccttatgggtgtcctgttgtctttactagccatattaatcaaccacttattgataaaaatatagagtctgtattaggttctataggatggggaatatcacaaaccccacaagtttggcttgatcacatggcaattaacaaaagtggaaatattgttttacagtgggattataacaatgacttgttccggaatgatgttataacaacaatatttgatgtttatatttctcgtatacgccaacttgccaacgatcctaatgcctggattgaaacccaacctgatttaattcctaaaaaacaattaaaaaatagaatatcagttatcaaaaaagataattcactattaccacatacactgcataagtctattttccataattattcaaattcatcaaaaattgctgtcattgatatcgactctcaggaatggagctacaaaaaattattatctaaagcaacaatactcagtgatcaaataatacaacaaggttataaaccagaagacagaattggtgtatgtatgccaaaaggagtagggcaaatcattagcgttctggctattttattaatggggggaacttatgttccgattgatgtactacaaccagaagaacgtataaaccgcattgctaaaaatgctcagctttcattactcatcgtatctgatagtgatccatcctattcaatctatgctacattttgtaacaggattgtttggcaaaaagttcaaccctccgagaataaaccactacacaatatagatatatctcctcatcaagcagcttatgttatttatacttcaggttctactggagagcctaaaggtgttgttgtatcccatgccagcgcaatgaatacctgccttgatctcaatcggcgatataacatttcagacaaagatcgggtacttgccatatcagcactacattttgatctgtctgtttatgatattttcggtgttttaaatgccggagggactcttgtattagttaaagaagatgagcgccgtaatcctgatgcatggttacgacttattaaccaacataaaataacactttggaacagcgtacctgcactgtttgatatgttactaacctatgcagaaggaatagggtcatccattccacaatcgctgctattaatctatctctctggagattggattgggcttgatctcccgacacgttactatactttctgccctgatggacaaatagtcgccatgggaggtgccacagaagccgctatttggtctaactattttaatgtcacaacattagacccatcctggagctcgataccttatggatatcctttatccaaccaacgttatcgtattgttaatgctagaggagaagattgccctgattgggtatcaggagaactttggattggtggtgcaggcgttgcgttaggctacctaaacgatcccgaaaaaacagcacaacagtttgtaaaacaaaatggtgaaaattggtataaaacaggtgatatgggaagatatctccctggcggtatacttgaatttttaggaagacgtgaccgccaagttaagattggcggataccgtatagaaccaggggaaattgatgccgcattcaataagcttcagggtgtgcaaaatgcgattacactatgccttggtaatggtaataaagaaaaagcattacactcttttgtgatactaaattcgggtaattaccagaatattatcagttcaaatagcaccttttctcccctctactatctgcgctcaaccccaataaatgtgcaacaacaatcccaagaaacggcaatcatagctggatttttatatgattatcttactgaacaaaatattgatttcgacaacctcttgtcagaaaaaaaatcagcagataaccatggcattattgctagctatcagtcattaatggctaattggctaaatttaatagcacaatatccacaaactacactcaattcccccccaactaatagtacccagcgaacgctaatagaaaatttgcagcgccacaaaaacaatttaacagacatactcaaaggtaaaaaatcagctctaacactatttgatgatccctattggtcaccagaacaagtcactatgcgtattgatggaatgcactactccttagaaaatttactacaacaaataagagaacttcatcattcactaaaaaggccaataaaaatcattcaattaggtgctagaagcggtatttcagcaaattatattctgcaacgattacccaataatatggttaccctactgctaactgatgagtctctttcaatggtaacgcaagctaaccaaaatttatcagattatcaaaatagttatgctgagcctcttacagaagtattccttcataaaaatcgatatagtgcagatatcatttggatgaacaattatcttcatcgattagacagcccacaaaaagagatacaaaaattcgtttcactctgtgctccgagtggaatgatttttatacaagaagtgttacatgcccctgcacaatcactgataagcatctctttattacaacaaaatggtagtgatcctgctgatgaattattaacagcaaaaaaatgcaaagatatctttagcgcttctactgcgacttataaaagtgaaggagttaacggcgaaatattgacacagttataccaagcaccagaaaaaatttatttaccagataaaaataaactagagcatgatttgcgccaatttttaccagactatatgatcccaaaacatatttattttctaactgagttccccttaaccgcaaatggcaaaatagataaccaatcattaaaattgtattgtcaggaataccaagaagaatacctaaatcaacaacctatcaatggtaaagaacagatcatcataacaatatggcaaaagctccttggcaccaacaagatacaccgtcacagtcatttctttcgtgaaggaggagatagcctagttgctattcgattgatctctgacttaaaccatattggctaccaagttgaactggagcatatctttgcttatccgatcctttctgattttgcacaaaatataaagcagagcgaagttttcgaaaaacagccagcaatttcacataacgaggcgtatagatacaatccatttccactcactgatattcagcaagcttacttagttggacggcaaaataattttacacttgggggtgttggtacacatttttttgtccattttatagcggaaaatttagatgtacctaaattagaacgtacaattaatcagttgatttctcgtcatgatatgttacgtggtgtcattattaatggacaacaacaagtacttaaaaaagttccttattattccgttaaaacgcattatatccctacagaaaaaagtgacgcttttctagtattacgagctcaacttgctaacattgtttatgatccagaaaattggcctttatttgctattcaagttatcaagaccaaagaacaaccagatcatatttttattagccttgataacttattccttgatggaatgagtatgcagatatttttcagtgagctaaaaacgctatatatggagccaaatcaccaatttatccctctagatattacttttcgagattatattgattgtgatgcctatccgattaacacacaaaatgattgggaatattggttaacgcgtttaccacaattaccaccagccccacaattgccactaataaaagatccagcacagattgtgcaacctcgcttctcgcgtttacaaacatcattatctacttctgtttggcaagcactacaacaagttgctcaacaaaataatgttacgccagcagcacttttgattgctgcttattgcgccacattatccgcatggagtaaaagccctgagttaacaattaatttgacattatttaatcggcatcctgtacatcctcaaataaatgaagtacttggtgattttacctcattacaattactcgattggtatacctgtgatctttggtcaaacagtatctcaatgatgcaaaaacgtttacataaagatatgcaacatcgtagtgtttcagccattaaagtaatgcgtgaaatggcaattcaacgacagatgtctcatatagagatacctgtcgtttttacctgtgcattgggctataaacatgatgaaggttttctttctcatcattcatggctaaaacctgtttggggaatatcacaaacaccacaaacatggctagatcatcaagtatatgagtcagacggtgaattatatttaaactgggattttgtcgaacaattatttgactacacaaccattttttccatgttccagcaatatgaacatatactcactaaactggctactgaaccacaatcttggcaattgccactaaataaacttataccaagatgcaataatctcgtcatcaccccagttttcaatgccaaaaataatcaaaacacacattataaacaatctactgatacacaaaaaacaggtcagacaatacaaaaactacaacaacttgttaagcaagttattggaataacgttagcacctgaaacaaattttttcgaagcaggtgccagctctttacaattggttcaacttcatgcagcactacaaaaaaatggctatagccatattacaattactgatctgttcgctagtccaaatctaagtacattagcgcaattgctttggcaaaacacttcaccaacatgtgagcaatattccgaccgagacaaacacaaaaacaagagaaagaaacggttacaactacgaactcatagtagataa

SEQ ID NO: 1367 - DNA, 912 bp, Proteus mirabilis
ggaatagaaatgctatcagggttattgattatcctattgcccctgtttatagggtatttgattaagttaaacaatcgccctttgcttcaattggctaaccgtttacttagtgcaatggtctatgtgatcctctttttaatgggggttagcttagccatgttagataatattggtgaaaatttattttctatccttgcctatgccagtgtcttctttatctgtacttttggtgccaatctgctgtttttatggttgctggataaaaaagatccttggcatgtccctgcacataaacaagctaagcccccttcacgtatcaaaatggtactcgaatcactacaactttgtggtgtagtggtagtaggtttttttgtcggtttaaccggatggtcaatttttggttatgcatctcaagccagccaaggcgcacttatctttttattatggcttgttggtctacaattacgtaatagtggcatgagtccaaagcagatcttaattaatcgtcgcggtactaccattgcaatagtgatggcaataagtgcccttgcaggtggtgcattagcggcttatttactcggattacccacaaaaatgggattagcgatagcctctggttatggttggtattctttatcggggatcgtattaaccgatgcgtttggcccggtaattggtagtaccgctttctttaatgacttaatgcgtgaattagccgctatcatgctaatccccattattgttaatcgttatagaaatacggcattaggtatttgtggttcaacttctatggactttacgctacctgtattacaacgcagcggaggggttgccatagttcctgctgcaattgtgcatggtttcgtattaagtttggtcacaccaatcttaatggcgttctttacttcatag

SEQ ID NO: 1368 - DNA, 1380 bp, Proteus mirabilis
acaagagaaataagcactgtgatgttgtctaaactaaaacttgctaagcatcaacaacaccttgcacaactgcctaaattagctcagtcagttgctgatgttgaaacgctttatcagacatccgcgtttcgcagcaccttattgaaatatatcgcgcaagctcaaaaagagatttttattaccgcactctatctagaacatgatgaagcgggcgaggagatccttgaagcactttataccgcaaaacaacaacgtcctgaactttccatcaccgttattgttgattggcatcgtgctcaacgcggtcgtataggtgtctctgctgatgcaacaaatgcagattggtatcataaagttgcacaacagcatcctgatgttgacgtccctatttatggtattcctgttaatacacgtgaagcattaggcgtattacatctaaaagggtttatctttgatgatacggttatttacagtggtgcaagtattaataacgtctatttgcataaacttgataaataccgttatgacagatatcacatcattcataatgctgaactcgcaaacacaatgaagcaattcattgtcgatagccttttgcaatcagatgctattcaacgtcttgattcagaagagagagtgcgttgtgcagaaattaaaaattgtatccgtcaattccgctttaatttacgcacacatgatggttacgatattaaaggaaatgcctcaaataatcagttaacagtgactccattggtcggcttaggcaagaaaaatatcttgaataagactatctcccacctcatggccgtgactgaagaaaagttggttatttgtacaccttattttaatttacctgctattttggtgcgtcaaattagtcatttactgagaaatggtaaacaggttgagattattattggtgataaaacggcaaatgacttttatattccgccagaagagccctttaaaataatcggtgctttaccttatttatatgagattaatcttcgtaaattcacccaacgttttcaacgttttattgataatgaccaattaacagtaaggctttggaaagacggtgataatacctaccatttaaaaggcatgtgggttgatgatgagtggcaattaattacaggtaataatctaaaccctcgagcttggggattagatcttgaaaatgccatcttaattcacgatccacatcatgaattacatgaacaacgccataaagagttagcttgtatcagagaaaaaacactaattgttaaaagctatcaacaattagagagtattaaattttaccctctaaaagtgaaaaaattaattaaacgtttacggcgtatccgtgttgatagactaattagtcgtatactctaa

SEQ ID NO: 1369 - DNA, 240 bp, Proteus mirabilis
tatgggcgaatttccagatggagaagagccagcatgaaccacgaacaattcatagagcagaacgtactagccgagttaaaaaagctcggcttttctttacctgtttgtcgtagagcaagttacatggcggtagatcattatcgccgaagctctcaagcaagtagaaaagggcgaatgtttgacgactgcttacatattgccaaagtgtgggcgagtaagttcgctaaggagaaagtatga

SEQ ID NO: 1370 - DNA, 240 bp, Proteus mirabilis
ttctctagaatagatacaactatagcgttattattcgttattcgtgaagaaatgccaactctggctttccgaatataccatgataaagaggttatcatgtttgaattattgaaaagtttagggttcgctctcttgatggtacctgttgtgatggtacttatcatgggcattatttatggtttaggcgagatttttaacttaatttcacctagtcagtcaaaggctgataaaaaagcataa

SEQ ID NO: 1371 - DNA, 543 bp, Proteus mirabilis
tgcataagaattatgtatggcaaacaaataaaggaacaattagagatgcaattaaacaaagtgtttaaagggttgatgttagcattaccactcgttgctgttgcagcatgtagctcaaacaaaaacgacgatcaaacagatacaagcaacaatgtacctgttactgagcaaggccctactgctgaagaattagcacgtcagcaattagaacaactgaaacaaactaacattgtttacttcggttttgataaatatgacgttacttcagaatatgctcaactgttagatgctcacgctgcattcctgcgtgctaacccttcagtacgcattactatcgaaggtcatgctgacgaacgtggtactccagaatacaacatcgcgttaggcgaacgtcgtgcaaacgcagttaaaatgtatctgcaaggtaaaggcgtatcagctgatcaattatcaatcgtatcttacggtaaagaaaaacctgctgtactgggtcatgacgaagccgcttatgcgaaaaaccgtcgtgcagtactggtttactaa

SEQ ID NO: 1372 - DNA, 306 bp, Proteus mirabilis
ggaggaagaataatgatacttttccgcaagctaaaagctgtggtcagccccgtttcggcctgtacgctgacaactttttctgcaaccccggcactggccgacggatttcagcgggcaaatactgtcatgcaaaaagtctccaccgggctgcatggtctggcggctatcacgatcaccgtggccgtgatctggattggttacaagaccctgtggaaaggcgagagcctgtcacagtgcggctacatcatcattggtggcattttaattggcggaggcagtgaaatcggcgctctgctgatgagctga

SEQ ID NO: 1373 - DNA, 780 bp, Proteus mirabilis
ctatttttgataaaaaacaaagagatttttggttttacgctggaaccagaaggatttcaaaactataatctgcgcgagcgtaatatttacatattattacgttattcctcttttttatttcaaaccaggttttttattatggctgacacagcacatcagtgcacaattgtaggtatcgctggagcctctgcttcaggtaaaagtcttattgccagtacactttaccgtgaattaagagcgcaagtaggtgatcataatatcggtgtgataccagaagattgctattatcgtgaccaaagtgatttaacaatggaagagcgatataaagttaactacgaccaccccaattcgatggatcacgcacttttataccaacatttgtgtgaactaaaagccggaaacgccatcgaactccctcaatatgattatgtcgctcacacccgtaaatcagaaaccattcattttaaaccaaaaaaagttattattattgaaggtattctgttattaacagataagcgcttacgtgaagagatggatttttctatctttgtcgatacgccattagatatctgtctaatgcgtagaattaaacgtgatgtgaatgaacgtgggcgtagtctagattctgttattgaacaatataataaaactgttcgtccgatgttcttccagtttattgagccttctaaacaatatgccgatattattgtgcctagagggggaaaaaaccgtgttgcgatcgatattttgaaagcaaaaatcggacagttttgtgaataa

SEQ ID NO: 1374 - DNA, 507 bp, Proteus mirabilis
gagtcattgatgtctttgactattttcgagcaattaaccacattactcaataaccaccacgcccgttatcgcgtcatggaacacccgaccgcgggtcgttctgaggaagttgctaaaataagaggtacacaattagggcaaggggcaaaaggtctagtttgtcatgtaaaaggtaatggtattaaacaacacgtactggccattttacctgctgataaacaagctgatctatcaaaactcgctatcgctattggtgggacaagagcctctcttgcaagcccgaaagaagttgatgaactaacgcaatgtgtatttggcgcgatcccaccttttagttttcatccagcactaaaactggttgctgatccgctattatttgaacgttttgatgaattagcctttaatgctggaacattagaacgctcgattattttaaatacacaagattatcagcggattgctcagcccgagttaattcattttattcgccaagatgataatgattaa

SEQ ID NO: 1375 - DNA, 204 bp, Proteus mirabilis
aactgtctgatagtaggaaaacatacattaatttatctctattttagaatgttattgatgtgttgtatggtgttgtttaaaagcgtttgttactattctgtgcgttattgcgcaataaccgcaataataaaagggagacatgatgaagcaggcattaaatgttattttcggacttttgatattatgcgttacaacgctcgctaa

SEQ ID NO: 1376 - DNA, 744 bp, Proteus mirabilis
cgcgttatgattattccggcattagatttaattgatggcaaagtcgttcgtcttcatcaaggtgattataataaacaacgtgattatgatgatgatccgatccgccgctaccaacaatatcaacaagacggagcaaaattattgcatctcgtcgacttaactggcgcgaaagatccacttgcacggcagatcccactattaaaacagctagttgcctgtgttaacgttcctgtgcaagttggtggtggtattcgtagcgaagaagatgtgaagtcactattagccgcaggagcaagtcgggttgtgattggctctacagcggtgagccagcccgaattagtcaaaacatggtttgagcgttatggtgctgatgcgattgtactcgcccttgatgttcgtatcgacgaacaaggtaaaaaatgggtggcggtaagtggctggcaagaaaactccccctatacactagaagagatcatcgcactttatcaacctgtaggattaaagcatgtattgtgcaccgatatttctcgtgatggcaccttagccggttctaacgtcgaactgtataaagaaattagccagcgtttccctgatattttattccaagcttcaggcggtattggtgacttacaggatattgcagcacttcctggatcgggtgttgcgggcattattgttggcagagcactattagaaggtaaattcacattacaagaggcgatatcatgttggcaaaacgcataa

SEQ ID NO: 1377 - DNA, 879 bp, Proteus mirabilis
agttatatgatcaaaatatttattgcaatttcattcctcttttactcagtatttgttatggcttctcctaaaattattgcacacagaggtggcacagcggatgcacctgaaaataccgaaattgctatcaaaacagcactaagcaatcaagctgatgcaatttggataaccgttcaactgtctaaagataatgtccctgttctttatcgtccaagtgatctaaaaagcctcactaatgggcaaggggcaatttcaacctttactgccaaagaattggcgcaatgggatgcaggatataaatatggggaagcacaacaatttccatatcgcaataaaggagttactatcccgacattggagtatattctgactcaatttcctaaaacacaattctatattgacttaaaatcacctgatgccgatcccgttatacaaggcaaagcattagcttcggtattaagcaaacataatgcgttagaaagaacgcgtgtttattctaccaatagtgcttttttagatgcgttacctgataacgtacaacgctttgaaagtcgtgatgttacccgcgatatcttagccaatattactatggggcatatctgtttactgccagaaaatcttgatatcacacgttggtatggccttgaactgcacagaaaagttgaggtggttgaaaaatataccttaggtgaagctcgttcagcggctgtattaagttgggacaaagatgcgatgtcttgttttcgtgcggggggtaatgcgcatatcgttttattcggtatcaatactgagaaagattatttgcaagcagtagaattaggtgctgatgcagttatggttgattctccagctaaaataaaagcatttagaaaagagtaa

SEQ ID NO: 1378 - DNA, 714 bp, Proteus mirabilis
tgccacatgatgaggcgtaatatgccgttgtttcaattagatgaacacgatgtgacttttcctgccccccatttggctttaaaagagccaagtgggttattggcaattggcggcgatatttcccctgctcgtttgaaagaggcttatcaaacggggattttcccttggtatacaccccatgaaacgccgttatggtggtcacccgatccccgagccgtcttacccgcaggaacattgcatattggtcgtacgttacgtaagtttttacgccaagcgccttataccatcaccttaaatcaggcattctctgatgtcattgaggcctgtagtgtacgtgatgagggaacttggataggccctgatataaaaaccggctatcgggcattgcaccaacaaggagaagcccattctgtagaagtttgggagggcgacgaattgatcggtggtttatatggagttaacgttggtgccgttttctgcggtgaatcaatgtttagtcgtcgaaataatgcttctaaatgtgcctttgttgctttttataaccattttctgcgttatgggggtcaactatttgattgccaagtgttaaactctcatacggcagcattaggtgcgatagaaattgccagagatcgctatttagaggcgctatctcgttggaaaaaggtgattattgataaaaagtgttggtatcagcaatcgttggaattataa

SEQ ID NO: 1379 - DNA, 1323 bp, Proteus mirabilis
ggtgagatgatgaaaacggcgtttaatacattaaacttctgggataaatgcacccaacagcaacaacaacagctactcactcgcccagcgatatccgcatcagcgtctattacagagcaagttgctacgattatttctcaggtacgcaacgatggggataaagcccttaaggcactgagtcaaaaatatgataaagcggctcccgatagcgtattggtgacaaaaacacagattgacgtggcttgtgcaaggctcaataacgaaatcaaacaagcaatagcgcaagccatgagcaatatacgccgttttcatgaagcgcaaattcctaaaaccattgaggtagaaacgcaacctggtgtattttgccaacaagtcagtcgccctattgatgcagtaggactttatattcccggaggatcagcgcctttactctcaactgtgatgatgttggggctaccggcccgtattgccggttgtcgcaaaataattttatgctctccgccaccgattgctgatgaaattttgtatattgcgcaacaaattggtattgatgaaatattccaagtcggtggtgctcaagccattgctgcgatggcttttggtacagagtctatcccaaaggtagataaaattttcggcccgggaaatgcctatgtgacagaagcaaaacgccaagtcagccaatcgctacaaggtgcggctattgatatgccagccggcccttcggaagtattagtgattgctgatgccgatgctcatcctgcctttattgccgctgatttactatcacaagcagagcacggtcctgactcacaagtggtgctattaaccccagatgaagcccttgccaaagcggtcattagcgagacgcaagcccaattaacacaattaactcgcgcagaaatagcacaacaagccttagccgaaagtcgtgtcattatcacccgtgatctcaaccaatgtattgaaatcagtaatcgctatgggcctgaacacttaattattcagactaatgatgcagactcacttgttgatagcattactagcgccggctcagtgttcttaggggcttggtctcctgaatcggcgggagattacgcttctggcaccaatcacgtactacctacatacggttataccgccacctattcgagtttaggcttagccgattttatgaagcgtatgaccatacaaaaactgactgctcaaggtttggctgatttagccaataccattgaaatattagcgcaagcagagcaattaactgcacataaaaatgccgtcacacttcgcgttaacgccttggctcaaggagataactag

SEQ ID NO: 1380 - DNA, 231 bp, Proteus mirabilis
ggaggcgtgatgaatccttaccatgaacttgacgcaagggaagagcgcaaacaagaagaagcatcatggattgatgcaaaggatgctgagttaagcaatgtcgcatttaatgtggttgatggattaccaaaggatattaccagtcaatggagtgacagcgttttcgatatgacaattgatggtctttacaaggagttaaagaactatcaggaacgtaggaggatgtcgtga

SEQ ID NO: 1381 - DNA, 327 bp, Proteus mirabilis
tgcaaggtgatgaacggagacaacatggaaaagccctctaaacgggatatgaaaacactatcagatatgccaaagccaattattattattgaactaattggtattgtgctattggttatcgcttacttatatattaatcaatatatgacttcaccggaatggttaacaacctatacagggcaattgaccttggttgttttaggggtgctttgtatgatcccacctgcaatacatatcgtttggcgagcgatctatcgtttaaccttcttaggtattgatactaaggcaactgaaaataaaaagaaaaagccacataacgaaaaataa

SEQ ID NO: 1382 - DNA, 267 bp, Proteus mirabilis
gttgaggtgattatgcaaatttcatacagctactcgaacggaactcgggtagtagacggcaagacagtcatggaatttgacaaaagtagcaagctcagtattgaggcaggaagtttcgctgagctggctaaattaacggaaattgacccagtggaagccctgcaatggattatgcagttcgacaaggaagagtttgacaggattgtcaatgaagcaagcaaggatgcccctatttctaagctggctctgctaaggagggttgcgtga

SEQ ID NO: 1383 - DNA, 270 bp, Proteus mirabilis
aggagtgccttcgggaacgctgagacaggtgctgcatggctgtcgtcagctcgtgttgtgaaatgttgggttaagtcccgcaacgagcgcaacccttatcctttgttgccagcacgtgatggtgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataa

SEQ ID NO: 1384 - DNA, 456 bp, Proteus mirabilis
acgaacacgatttacggatatggagtatgcaaaacaatgtcatctagaaggtgttttgagaacgcaagccatattgatccaagaagggaagttgaacgtgtgaaggtctttaatatcgaaccagtacctaaaccaaggatgactcaggctgataaatggaaaaaacgtcccccagttttaaagtattttgcgtttaaggacgaagtaaagttaaacaaaatcaccctacctgaatcacattaccacattacattcattctacccatgccgaagagttggagtaaaactaaacgctccgaaatgaacggtaaaccccatcaacaaaaaccggataaagataatctcgaaaaagcattacttgatgctatttttgacgatgattcacgtgtatgggatgggcgggtaacaaaagtgtggggaaaaagggggcagataattatccaagaggtgcgatag

SEQ ID NO: 1385 - DNA, 777 bp, Proteus mirabilis
gagcgggcgatgtgtgaattgttgggcatgagtgcaaatgtacccactgatatcaattttagtttaagtggcctcattcctcgtggtggtaaaactggccctcataaagacggctggggtatcaccttttatgaaggattaggatgtcgtacatttaaagatccacaagctagtgccgtttcacccgtcgctcgttttgtacaagaataccccattaaatcacatgctgtcattgcgcatattcgccaagctaatcgaggtaatgtcagtttagaaaatacgcatccttttacccgtgaactgtggggtaaaaattggacttatgctcataatggacaacttaaaggttatcaatcactggatacagggcgttttagagcggtaggacagactgatagtgaaaaagccttttgctggatattaaatcagcttgaaaagcgttaccagagaacaccatctaattggccagcggtctttcgtttcattgctattttagctgatcaattgcgacaaaaaggtgtgtttaatatgttgttatccgatggccggtttgttatggcatattgttcaactaatttacactggataacccgtaaagctccttttggtaaagccaaattgctggatcaagatattgaaattgattttcagcaacacactaaagcggatgatattgtgtcggtaatatcgacattacccttaacaggtaatgaatcttggcaaaaaattcctgttggtgagtttgttttatttgatcgtgggttgcgaattttgtaa

SEQ ID NO: 1386 - DNA, 285 bp, Proteus mirabilis
gagatagagatggaaatatggtttaaggaatttgagtcacacgggcgtcagattctaatcaagaaagctcataacgccgatgagtcaaaaatcggggtgcaatattgctggccagagaaacttttcgaggtcgattttggattatggatagattacgacgacgatgatgaggaaggctgtaataaagcggaagaagcacgcaacaagctattcgacaccatcgatcaggaagcagtagataccacagtgagtaacttaattcaaaaactcaagcttgatgattag

SEQ ID NO: 1387 - DNA, 264 bp, Proteus mirabilis
aggtcatggattaaagaccacccaaaatcagcaggctctgaggttggtatatcataccccataccagaatattccatgaagctaatacatgatttttatctttatattctaagtattgccaactatggcttagcccgagtgcatgaccaacttcatgcaaaacaactttataatgatatgtacctggctgatatttattattttttagtgtttcaattagagtattggttttttttattatcagaacagtaccattatctttaa

SEQ ID NO: 1388 - DNA, 999 bp, Proteus mirabilis
ggagaaaggatgaaacaggtagtctacgtagcaagtccagagagtcatcaaatccatgcgtatacattaaatagcgcgggagagatgcatctactgcaggttgttgaggttgcaggacaagttcaacctatggtggctagtgcagatggaaaacatctttatgttggcattcgtcctcattttagtgtggtgacctttgaaatcgcacctgatggccagttagaacaaaaagcaataacggcaattccaagtgcgccggttcatttgtgcttggataaaaccgaacgctttttgtttgttccttcttatcaccaaggtaacttagcggtattgccgattaatcaacaaggtattgctcaagcaccaatacaacttattgaaggattaaataaaccacactcttctaatattgattggcataacaagcagcttattgttccctgtttaggtgaagatcatattcgtctatttaatctttcagaagagggacatttaagtgaagcgcgtagcgaagagttaaccacagcaataaatgcagggccgcgtcatttagcgttcaatcctaatggcgaagtgttttattgccttaatgaattagatgcaacaatcaatgtttatcgtcgtatgggtgatctttatcgtttaatgcaaaccatcgatattgtgccagaaactttcaatagcacacgttgggccgctgatatccatattaccccagacggtcgtttcctctatgccagtgaacgttcggaaagcttgattagtgtaatggcagtttcagaagcaggggatcatctacaacctgtaggtcattatacaacacagacacaaccacgcggttttaatcttgataatacaggaaattatctcatttcttgcggtcagaaatctgattttgtctctgtttctcgtattgataggcaaaccggcgcattaacggaattagcttgttatccagtcggaaaaggggcgatgtgggtcactgtagtcaccaaataa

SEQ ID NO: 1389 - DNA, 879 bp, Proteus mirabilis
gaggacgggatgaagaagttattacttggtgtagcgttgttgttgattggttcaaatgccattgctgaatgggaatacaaaaaacattttgatgagatgaggggatctgaaagctatacggcatcgcttcaatcaatgccaataaataaagatatagataacgagttgttacttctcttatccagcgataataattccacgtcgagtttagctggcttacacttactcagtggcagatttgattgcgacaaccccaatctatgcaaaatagcggtaaggtatggcaatggcgcggtgaaaagtgtatttgttagacttaatgatgaaaggaaccttgcttttttcattaactctaatgaggttgcggaaacattaaggttatcagatgttatgtatgttgagataccaatattcagaaaaggtagcgcacagtataagtatgatacatcaggatttaaatggacgggaattgaaaaaacaggagaatatttaacatccttaggttccattgatttcacaaaagaattaccaaatattcctagtaatacttataaaaatgatagagggagtgtttgctatgacattaatgatttttcatttgggataaaagtaaaggcggtaggaaaggctagtgtgtgcatagatgggaaattccctatttatgttgaagttagtaatgtaaaagttaataaaaatgactttgtgaaagaggttaatttagctagaaaagccgatgaagacacagaggggaatactcacatgtggttagcgagtgatgatgaatttctgactatgattcttcttacaaaaccaaataaaaatggatatgagatattcatggattattcgccaagaataaatatttatagtcaaaagtaa

SEQ ID NO: 1390 - DNA, 192 bp, Proteus mirabilis
atttcagtttttaaagtatcccctgtattttcaccaaacccccaatctaacttaatgccaaagactaatggtgacgttctgaagttaaccggttttggagggttacccatttttcctgttaacattgtttcttgtgcgttagcccaaacgctggatatttcagatgcatttatcgcacgaactctcacctga

SEQ ID NO: 1391 - DNA, 936 bp, Proteus mirabilis
aaactatacttatacgctattttgacacaatgctttatcaatcccctagttttcactagatttttactctcagttgctgacatttcactcaacttaggaagatttatgctgtttttgctcaaaaaatatcttggtagcctaatcatgccactaccgctgttattaataattgctttttttgcgcttattttactgtggtttactcgttggcaaaaaacaggaaaaagcgtactcactatcgtgattgtgttacttacgctgttaggcatgcaacctgtcgcagatactctattgatgccgagtgaaaaagcgtatcaagcacgttatgaattacgcgaaaactcaccacaagatgttaactacattgtcgttttagggggcggttttacttataatcctgaatgggctcctagtgctaacctgctaaataatagcttatttcgtgttgctgaaggcgtaaggctttattatcgttatcctaatgccagcttaatttttaccggtggtgccggcgtcaataaaataagtagcgccgaagtggctgcacaagttgcacaatcattaggtgttccagcagaaaaaacgatcgccctttctcaacctaaagataccgaagaagaagcgtatgaagtggataaacttatcggtaaacaaccttttttattggtgacctcagcaaaccatttagcgcgagcagaacgtttctttttagctagaggtatgcaccctattgttgcacctgctaatcagctagccattactacccctctgcatccttgggaaaaatataccccttccgcgtattattttcagcatagtgagcgagcatggtatgaatttatcggctcgatttggcaaaccataaaacctagcgaaccatctagtgtagaggcggttgttgagaataaaaatgaagctgacaatggcataaaatag

SEQ ID NO: 1392 - DNA, 1122 bp, Proteus mirabilis
gggagagtttttatgtttcatcgtcttctcaccctgataatgaaagagctacagtcattattacaagagccgcaaacacggattatcttaatattaccggttatctttcagatgatcttattcccttttgctgccacccttgatgttaccaatgcctctgttgctatttttgatgaagacaatggtaaacaatctattgaattaacccaacgcatagccaaagccagtgctttttctgaaaccctattattaaaaagtgaacatgaaattaaagagacgattaataatcgtaaagccttgctattagtgcgttttccacaaaattttagtgctaatttagccagtcatactccggtaaaattacaattaattcttgatggacgtaattctaatagtgcacaaattgcggcaaattatgtacaacaaattgtgcaaaattatcaaacagaattagccggcgataccccatctttactgaataaaagcgaattagtagtacgtaattggtataaccccaatttaaactataaatggtttattgtgccttctttagtggccttaattatcaccatcggagtaatgatagtaacatcactgtctgttgctagagagcgagagcaagggacattagatcagctattagtttcaccgttatcaacttggcaaatctttgtaggaaaagcggttcctgcgatggttgttgcggcagtacagggaaccattgtattaattatcggtattttcggctatcaaatacctttttcaggctcactgctattattttactttaccatgcttatttacggtttatcgctggtaggttttgggcttttgatttccgcgttaagttcaacacaacaacaagcatttattggtgtgttcgtatttatgatgcccgcagtattattatcaggctatatttctccagtggaaaatatgccagtttggttacagcaagccacatggataaacccaatccgtcatttcactgatattaccaaacaaatctacctcaaaaatgccgatattaccgtaatatggcatagtttatgggcactgattgttattgctattgggacaggctctattgcctattatcttttccgcaggaagatagtataa

SEQ ID NO: 1393 - DNA, 978 bp, Proteus mirabilis
gtattccacttaaacagggctaaattcatgaaaaagatccttgcgttagttactgcctctcttctgtcagttagcagtttttctgcattaagtaatacctcagttacataccagcctaatcaaattgttgaacagcaaaatgataaagttgttatcaagcacctattaggtgaaactgcagtatctaaaaatccgtctaaggttgtactgtttgattttggtctatatgactctttagttgcattaggtttagcggataaagtggttggtttaccattaggaaatgcacctgaatatattaaagggcgtattgcgaatgatgtggctaatgttgggggaatgaaagcccctgattttgagagactcgctgagcttaaacctgatttaattattattaccggtcgtcaaggcgcttcttatgagaaactcacaaacattgcccccacgattaatttaggtacaaatagtgcgaattatcttgattcagtggaagcgaatattcaattaataggtgaattatttgataagcaacaagctactcaaacacaattagcaacattgaataccgtgattgaacaggctcagaaaaaagcggcaggatcagataaaaaagtgttggtcttactgcacaatgcaggcaatttaatgcccaataaccaaagcgtgatttacgatgtggttaaagcgaagaaagcagaattaccacctgttgctgaagaagagaaaggcaaacgtcgcgtggttacttctgaaatgatcgccaaagtaaatccggatgttatttttattatcgatcgcagtgaagccattggtgccggtaaattagagaaaaacacctttgaaaatgatgaagtgaaaacaacttctgcttataaaaatggtggtattgtttatttgcaatctgatctttggtatctctctggtggtggattagaaagtcttactcagcaaattgaagcggtgcaaagtgcactttaa

SEQ ID NO: 1394 - DNA, 321 bp, Proteus mirabilis
aaacagcacttgaacgcggttctcccacttcagtgccttattgatttaactcaccattatactgaaatacgtattaagaactcaaaaactcttaatacgggcttacgtgctttcttcttcaccttcgcttatgcttttttatcttctccaaccccactctacactggagaaaatcatgacatcacatcagttattacgcctgaaacaggtcgaagaaaaaaccggtctgaaacgctcgcaaatctatctgtatatgaaagaggccacttttccccgttcaataaaggttggccctgccagcgtagcctggctcgaatctga

SEQ ID NO: 1395 - DNA, 312 bp, Proteus mirabilis
caaaaaaacttaaaggtgaacggtgatatgagtttcttcaatgatctaaaagcctctttagaagaagccgtagaaattaaaaatggcgataaaaaagcatcgaaagtgactcggtttgaagttgctgatgtaaaagcgattagggagcaacttaacgtttcacaaagtgaatttgcacatgcattagggacaagtatcgatactgtaaaaagttgggaattaaaaagacgtaatccgacagggcttacagcgaaagtacttattgctattcataaaaaccctaatttatttaaagagttagccaatatctaa

SEQ ID NO: 1396 - DNA, 201 bp, Proteus mirabilis
ttaacccttgtgagggacaaaatggatcaccgcttactcgaaattattgcttgcccagtttgccatggcaaacttatctttgataaagaaaattcagagcttatctgcaaaattgatcatctcgcttatcctgttcgtgacaatattccggttctactagagaatgaagccagagagttgtcattagaagaggaaaaataa

SEQ ID NO: 1397 - DNA, 255 bp, Proteus mirabilis
tcacatattgtgtgtaatattggaataaacaaggaggatacacacatgaacaatatcgcagaacagcgaaaaaaactgggaatttctcaagctgttttagcttcatcaataggatgggggcagtcacgaattgctaactatgagttaaacattagaactcctagcttaaatgactgccgagctattgttgaagcattacaaaaattaggggcaaattgttctttagacgacgttttccctccaaaagtagcttga

SEQ ID NO: 1398 - DNA, 531 bp, Proteus mirabilis
aaggatattgttatgccaactccttgctatatttccattgaaggaaaaactcagggcaacatcactgcaggcgcgtttactgcagattctgtcggcaacatttatgtacaaggtcatgaagaccaaatgttggtacaagaattttctcacgtagtgacggttccgactgatccgcaatcaggccaaccttctggccaacgtgcgcataaaccgtttcgttttaccgtggcattaaacaaagccgttcctctgctgtataacgcactggcttccggcgaaatgttgccaaaagttgagttaaaatggtatcgcacctcggtagaaggtaaacaagagcacttctttaccaccacactgactgacgcgacgatcgtgaacatcgattgccaaatgcctcattgccaagatccggctaaagccgacttcacgcaacttatcgaagtctccctctcttaccgcaaaattgactgggagcacactgttgctggaacgtctggtgcggatgactggcgtgcgcctctcgaagcgtaa

SEQ ID NO: 1399 - DNA, 345 bp, Proteus mirabilis
aaagggaacttaatgagtcatgctatagaatttattgaaacctcaatatttactcagcaaatcaaactattggctacagataaagaaataagaatacttcaaaatgaacttatcagtaaacctgataaaggcgacttaattaaaggaacaggtggattacgcaaaataagaatggctgtaggtaacaaaggtaaaagtggggggactagagttatttattttttagcgactaaggaagttatctatttagttatggcgtatccaaaagcaataaaaattagtttaactgattcagaaaagattgagttaaaaaaactaacaaaaaaacttaaaggtgaacggtga

SEQ ID NO: 1400 - DNA, 198 bp, Proteus mirabilis
cttcaagttgtcgcgttgttgactgaatttctatctccattgctatctctacttttgtctccctattccttgaattatttagagtatttagctgttagctatttaacttcaagttgtcgcgttgttgactgcgtttctatctccattgctatcgccatttttgtctccctatttatcgctatatttattgatatataa

SEQ ID NO: 1401 - DNA, 1410 bp, Proteus mirabilis
gagatttctgttttgaccgattttacatcgcttggtttaagtgaggcgcttctccgcgctattgatgaacaagggtataaaaccccaacccctattcaacaacaggcgattgagccgattttggcgggtaaggacgtattagcaagtgcacaaacgggtacgggaaaaacggccgcatttacattaccgatactggaaaaactcgctacatcagcagagaaaacgaaagggcgtaagccagttaaagcgcttattttaacccctacacgtgaattagctgcacaaattgccgataacataaaagcttatagtcgttatttacctattcgttcattggtggtttttggtggcgttagtatcaatcctcaaatgatgaaactacgaggtggcgtcgatgttttgattgcaacaccgggccgcttacttgatcttgaacatcaaaatgctgtcgacttatctcgcgttgaagtattggtgttagatgaagctgatcgtatgttagatatgggatttattcatgatattcgtcgagtcatcaataagttaccgaaaaaacgacaaaatttactcttttcagcgactttttcaaaagagataacagggcttgctaactcactactcaacaatcctataagtattgctgttgcccccaaaaactcagcggctgaatctgttgatcaatatgtccatttagtggataaaaagcgtaagacagagctgttatcacacttaattggtctagaaaattggcctcaagttcttatttttactcgaactaaacatggtgcgaataaattagctgaacatcttaatttagatggcatcaaatcagcggcgatccatggtaataaaagccaaggagctagaacacgtgctttagctgattttaaagacggtaaattaaaagcgttagttgccactgatattgcagcgcggggacttgatattgaccaacttccttatgtggtcaactttgaattaccgcaggtagcagaagattacgttcatcgtattggtcgaacagggcgtgcggcggcaacaggtaaagcgatatctttagtttgtgttgatgaacatggcttattagccgatattgaacgcttattaaaacgtgaaattcctcgtttagcattagaaggttatgatcctgatccctcaataaaagcggcacctttgcataaaaagccaaagaataaagcacgtaataataaagaaggcggacatggtcgtgctgatatgcgtggcaaagataatcgccatacaccacgtaataaaaatagtcgtaatcaaaaagagagtgaaacgggtgagataaaacagaataaatctaaaccagctagacgttcacgcaaacacgatgatgatcgtgataatcaaaatccttggtcaaaagctagaaaagaattttga

SEQ ID NO: 1402 - DNA, 213 bp, Proteus mirabilis
cttccctctgtattttggtatctaatttttattaaaaaaataacgcatcatgaatctactaaaatacacaaaactatattccctaaaaaaataaaaaaacataaattgaattatgtagaagttaaatataagttacaattatacttcatatatcattatgccttccttggtacttccgccactctccgggtctacaacctaaaatgcgtttga

SEQ ID NO: 1403 - DNA, 1176 bp, Proteus mirabilis
cgcggcactgtaatgagttggcaaaactatctagataagcgacttaatgagcgtagaaatacgccattatggcgaaaaagacaggtgatccagtatagtaatggacgctatttaaccacactgtctggtgataaatatgttaatttttctggtaacgattatttagggataagccaacatcctgatgttattcaagcatggcaacgtggtgcgaatgaatatggtatagggagtgggggatcgggtcatattaccggttttacacaggcccatcagcagttagagcaacaactcgctgactggttagggtacgatcatgcgctattattttcttcaggttatagtgctaatcaaggtgttattgcgacattacttgaaaaagaagatgccatcattgccgataaactttgtcatgcttcattaatggaagcggctatcttatcaccggcgagtttatggcgctttttgcataattctgcgccatctctatctcagcgacttcataaaacctctgcgaataaaagcttagtcgtgacagaaggggtttttagcatggatggtgataaagcgccattagcggctatggcagaaataagtcaacagcatcaggcgtggttaatggttgatgatgcgcatggtattggcgtgttaggtaaagaaggtaaagggagttgccatgaagcagggattaaacctgagttattaatagcgacttttggtaaagcctttggcattagtggtgcggctgtactgtgtaataaggcgactgctgagtttttcgaacaatattcacgtcacttaatttatagtacctcaatgccccccgcacaagccgttgctttacatgcagcgttaaaagttattaaacaagatgatgaaggacgagaatatcttcaacaacttattagctttttccgtcaaggtgtctcatcacttccagtcacattattaccttcacaaacagccattcaaccgttaattattggtgatgaactacgctgtcaacaactttcagactatttacaacgtgaaggtttctgggtaaaagcgatctttccaccgactgtaccccctcacagcgcacgtttacgcattactttaacgactcgtcaccaaatttccgacattgcgatgttaatcgagcttcttcatggtttcttcaatcaaaacagataa

SEQ ID NO: 1404 - DNA, 225 bp, Proteus mirabilis
tttctggctgtctttcatccgtttacgttctgctttttcaaggctgacaaacgggcgatagcagaccgtcaggaacaggcggttgcgccggaacagaccgacagaagcgtagtaaagacggctgacttcatctgcatacgggttgccggaatctttatgaagattgtcggtaaacgtattgcggtcgttatggatatagaaagtaacgggcataccttcgaatga

SEQ ID NO: 1405 - DNA, 342 bp, Proteus mirabilis
ctgttaaatgtgaaaggctgcaatggttgccggatctttttttggtgctatgataagtgcatcaagccgtgtagattacacgtatctcatgacgggagagaagccatgaccgtgaaacaacgcaatacgcagagcgtgaccatgacggtggaacgcgcattgctggtccgggcgcgtgaggttggtattaacctgagtgcgaccctgaccgccgccctggatgcagaagttcgacaccatgaagcaaaaaaatggcaggaagagaacagagagaccatcgaagcattaaatcgtttccatgatgaacatggctgtttcagtgatgaataccggacattttaa

SEQ ID NO: 1406 - DNA, 471 bp, Proteus mirabilis
ccgcatgatgtccgaccatgcttagccaaccttcgtgctcctccgttactctttaggaggagaccgccccagtcaaactacccaccagacacggtccccgacccagtttatgggcctaggttagaacatcaaacgttaaagggtggtatttcaaggttggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttactggggcttcgatcaggagcttcgccttacggctgaccccatcaattaa

SEQ ID NO: 1407 - DNA, 1131 bp, Proteus mirabilis
agttatttcgtctggagaacgtccgcatttttgcgctgcggtgtcaatgtgagacctgacattgacgagattctgtttaatagtattcatggcaactcaggagataataagatgaatatggaaaaattaattatatatagtgtaaagcataatgcttccgatctgcacctttgttgtggcgatgtgccacgattacggatcaatggcgtactttatcaacaaaatcaatgtaaacctattacttctgatacgctactcaaatggataacaccttatctgaccacagcgcaattgcaattttttggtaaggaggggcaagttgatacggcgataactcttgctgaggggcagcgcttacgagtgaatttatttcgccaacaattagggatatccgcagtactaagagtgataaattcacagctcccgacattaacatcactacgcgtaccaaaatcaatcactgcattattagataatgtttctaatggacttattttagtgacgggagcaacagggagtggtaaatcatccacattagcagcgatgattgattatctcaatcagcataagcgtcagcatattcttactttggaagcgccaatagagtttatttacaccaataagcaaagcattatccaacaacgtgaaatagggcgcgatgtacaaaatatagcgagtgcaataaaagccgcattacgtcaagatcccgatgtaattatgctaggggaattaagagatctagaaagtattaaaatggcattaattgcggctgaaacggggcatttagtactagcaacattacatacgcaaggcgttgttcaaacgttagagcgtgtcactaatgtattttcatccaatgaacgacaatggatctcggcacaattagctggaagcttaaaagcaattatttctcagcaattggttccagcaacacaaggcgggcgtgttgccctgtttgaagtgatgtatatgacgcaggggattgcacatctgatcagagaagggaaatatcatcaagtgacgacattaatgcaaactgggtttgaatatggcatgcaaaccttcactttaagtcgccaacaacgtcaatatgaaggtttgctcaatgagcacatcaatgaagaaaattaa

SEQ ID NO: 1408 - DNA, 1416 bp, Proteus mirabilis
acgatattcgtcaatctttcgtaccctatagggcggaggattgctatgtcttatcgttatcaaatagccattatttttttactgggtttttttattgattgtataaatatttttatgtcggcaattgcattaccagcaattgcagcggatatgaaggtatctatcgtctccattacatgggtatcaaatagttatattttaggtttaacactgattattccattgagtcactggttatctcaacgttttggcgtgagagtattaatggtcagctcgatgttgatatttagtgcttctgtggcgttagtaggctattcacactcattttttgagctgattttatggcgttttattcaaggtcttagtggtggattattaattcccatcggccaagctctaacatttcagtattttcaagggcatgaaagaagcaaagtctcaactttaattatggctgttgctcttattgcacctgcaatttctcccataataggtgggtttatcgttgatgctgtatcttggcgttgggttttttatagtaatgtgcctttttcattacttactgcgtttttggcttttatttgggtaaaagagtctaaatcacaagaaaatataataccagatcttaaagggatcttattaatcagtattattatcgtatcagggttatgtgcattatctgcttacggtgagtatcactctacacaattagcattagtcatcagtttttttgctgcattattttctcttctttattatcgtcattataaacagagtttatcaccggtaattaatctaaatttattaaaaaatagaaacttatcactttccatttttctctattactgtattccaggtgtttttactggtgtaaatattctggcgattttttatttacaacaatatctccatttttcggggcagggtacaggcagttttatgctgctatatgctataggtgcatttatttccattattgttggtggtgcactttataataaattgggtatgaagcgcttagctatattcgctttaattctgcacagtattggtattgtattattagcattagtaaataaagagaacgatctgcctttattaatactggcttatttaatgatgggaattggtggagggatcggtgcaaatacagcacaaacaacggccctttatgactttgataaacaaaggcttattcaagctagtgttatttggaatataaatcgtcaagttgtatttagtgttggcgcgacacttgttgcaatgatcttcaacacattatctctttttgtatcgtcacaaatggcttatagcacgacattttttatctgtgcaaccataggattatttccgctatttcttttcatattgttaaagcaaaaaacaaacttacaggaaacaaatcatgagcattaa

SEQ ID NO: 1409 - DNA, 654 bp, Proteus mirabilis
aaaaagttcgtgaaggagagatcaatggctgatacaaaagagatcaaacgcgttttactcgggccgttgttagataataacccgattgccttacaggtattaggggtctgttctgcattagcagtaacaaccaagcttgagacggcattagtaatgaccattgcggtaacattagtgacggcattctcaaacttctttatttcactgatccgcaactatatccccagcagtgtacgtattattgtgcaaatggcgatcattgcttcattagtaattgtggtagaccaagttttacaagcgtacgcttatgaaatatctaaacagctttctgttttcgttggtcttatcattactaactgtatcgtgatgggacgcgctgaagcctatgcgatgaagtcaccacctatcgaaagctttatggatggtatcggtaatggcctaggatatggggttatcttgatccttgttggatttttacgtgagctatttggttcaggtaaattatttggcattacggtgatggaatctatccaaaacggcggttggtatcaacctaatggcttattcctattagcgccaagtgctttctttattattggcttgctaatttggggattacgtacattaaaacctgcacaggttgaagaggactaa

SEQ ID NO: 1410 - DNA, 915 bp, Proteus mirabilis
tatttatttttaatgacatcccccctcgtacttgcgccgttattacgactaacatttgtgctaggagaacaagctcaacgaaaacaaatcctaaaacatatcagtatgatccttgaactttcagagcataaacaacatgataaacattttactctccctaaaaatagcgatattacttttaaagatgtctgtttggatcatggtgataaaacgatattagagaaaattagttttaatgctcaagcgggtacaacaactgcaattgtaggccacagtggtgcaggaaaatcctcattattaaaactaattccccgtttttatgattgtacttctggccaaataaaaataggtcaatatgatatcaactactggccagaaattgatttactttctcaaataagtgttgtttttcaagatgtatatctatttcatggaactattttagaaaatttactcatagcaaatcctaatgccttatttgaggatattatcaaagcaactaaagcagccaatattcatcatgttattgaaaaactcccagcagggtataatacattaattggtgaacaaggaaataaactttcaggtggagagaaacagcgattatcaattgcaagagcactattaaaaaactctccaatcctacttctcgatgaaattactgccaatgttgatgctgaaaatgaaattttgatctatcgcgcattaaagagtctatgccagaatcggactgttattatgatcactcataacctacatactattattaacgcagataaaattattgtgcttgataatggaaagattattgatacaggtacacacacccatttattaaacccatgcccaacctataaaaaattatgggatgattatagtcacactattcattggcaattaatccaagagaattaa

SEQ ID NO: 1411 - DNA, 858 bp, Proteus mirabilis
agaattatcgttttgtgtcggcacaaaaaatgcgataaacagacaaaccagaagaagcctatcattatgcaagcagaaatattactgacactgaaacttcaagataagctctttgctgatccacgccgtgttgcgctgttaaaacaaattaaagcaacaggctcaattagccaaggggcgaaaatggcgggcattagttataaaagtgcttgggacgccatcaatgaaatgaatcaactggctgacgaactcctggttgatagagcaactggcggtaaagggggtggaggcgccacactgactcattattgtgaacgcttactacaactttatgatctactaggacaaattcaacaaaaagcctttgatgtattaaaagacgattcattacctttagacagccttttagcggctatttcacgtttttcgttacagaccagtgccagaaaccaattttttggcaccattattgaacgcgatcacttacaagtacaacaacatgttaatgttcagcttgctgatcaaaaaacggttattcgcgcggcgttaactgaaaaaagcgccgatcgtctaaatcttaaagaaggcaaagaagtactcgttttaattaaagcgccatgggtcaatatagaaaaaggcgcctctgtagcacaacaatatgacaatgcgctatcaggcaccctaacccaaattgaaacgggtaatgaaaatagcgaattagtggtaacgttagaaggtggactagaagtgtgtgcgacttgttctaaccagcatgttacacaacaaaagctacatattaatgataccgtaacagcgttatttaatgccgatcaggtgattatcgccacattatgttaa

SEQ ID NO: 1412 - DNA, 936 bp, Proteus mirabilis
gaggatgtcgtgacaaatgcagttcaaagaatatatgaggttgtaaatcctcttaaaaatgagttcgaacaagtgtgtagcgagccaagcattgcattcaaaagggaatctgaatttgctatgcaaatatttgcgaacaatgattatctggcaaatgttgcagttaataatcttgtttcagttcgtagtgcgatcatgaatgtctcagctatcggaattagtttaaatccagcgcaaaagctggcttacctagttcctagagataaaaaagtatgtctcgatatcagttacatgggcttgatgcatattgctcaacagtcacaggctattaagtggtgtcaatcaagcattgttcgacaaaatgataatttccaacttacatcaatagataccgcacctcgccacgaatacaacgcctttgctactcaggagcagagaggtgagattgttggcgcttacacagtagtaaaaacagaagatggagactatctaactcacacaatggctattgctgatatttacgcaatacgtgacagatcaactgcatggaaagcttggatatcaaagaaaaaatcgtgtccttgggtaactgacgaagagcagatgattctaaaaacagtagtgaaacaagcagccaaatactggcctcgaagagaacgtttagataaggctattgactatgttaatactgaggctggagaaggtattgattttgggaacgagcaacaagaaccaagggacataacgccagcaagtgaagatcaattaaaggctatcacggacttgatgcttaaagttaatggcgaatggagtgatgcttttttcacattcattagtaaaaaattcaaccatcagatatccagtccagagcaattaaccgcatttgaggccaataccattatcgacatgctaaggaaaaaggcagaagggaaatga

SEQ ID NO: 1413 - DNA, 210 bp, Proteus mirabilis
ttattatttttagtcaccagtttagcgcgtgctttgacctcatctgatgcgttgcccatagcaacacctaaaccaacatgctctaacatacttaagtcattgaagttatcaccaaacgccataacatcactcatcttcatgccattagcttcaacccaacgctgtaaacggcgacctttgctattacctttcttggcgatatcaacttga

SEQ ID NO: 1414 - DNA, 210 bp, Proteus mirabilis
ataacccccgtagcagaagcacctgcattatttactgtatcagttacagcggtagcgttattagatgttcccgtaatggttgcaacaactttctccataccttcagcattaaatgcattttggttagcttccattgttggatcaactataaatgaaacactcttagatccagcaggaataacaaccgttacagttgaagctccatcatag

SEQ ID NO: 1415 - DNA, 1812 bp, Proteus mirabilis
ataataaccgtagatatcagcttaaatagcattaatatgtcatcaaaatcctactttaccaatgaatcagaatacttaaatgagctgactgaacaagttgccaaagaaaaaccgcaacttgttaatttgctttcgcacaatgttaaagatcctgatacttcgcggattatggatgggctatcttatttatcgggtaatttacgccagcaaatagatagacaatttcctgaattaactaatagtttagccaatatgctttggccaaactacgcacgccctgtgccaagcatgacgattgttgaatatcatcctaattatgctcagtgccaacacgcaacaaaaatttcagcaggacaaccctttagtgccgctccactttatgtgcaaagtgaggaaacaaaccacgagacgttatttcaatgtcgatttagtcaaagtcgcgacctctggttaatgccgacaaaaatcagtaacattttgcagcaaacaaccgccattgaaataacatttgagttagcaacaaaacagccacttgccaatattggcttagataaattgtgtttttacttaaatggtgcgccatttactacaaatcagctctattttttattaagccagcatgtgcagagtgcctctttagtcacagatgtacatacgctacctcttactcacttttcagttacgcctgttggttttcaaaagcaggatgccttacttccatacccgaaaaatagctatgatggctatcgtatactgcaagagtttttctgttttcctgaagcctttctctttctagatattcatggtttggatgacattcctttggctatcgaagcagagcaattcaaactggtgatcaattttgatctagaaattcctgatggcgttattctttacgacgacagtattaaacttaattgcacccctattgtgaatttatttcctattgatagtgaagcaataaatttgacggggaaaagtgaggagtatgttttaagtcctaattaccaacttactgaatgttttgatattttttcgattaatgaggttagagggttacgttatcctaatgatgctaaaccttatccgatcacctatacagcatttgaaagtttttatcatcaaaaccatcagactcaaaatcatggctattaccgtttaaagataagtcaaaatgaacagttatacggctattcccatcgactttcttttgttcgtcagcaagagcctcagttacaacagtgtgaagaaaccgtttctgttgcactcaactgtactaaccgctatatcgcttcccagttatcgacgcgttctatcgatttagatagtgcatcaatgccttatggggctttatctgctaagaatttattcgcaccaacactgcctttatatccattattagataaaacattatattggtctgaattaactaatttatctttaaattatcagtctttgctcaatcttgattcattaaaaaaaatattacaactctatgatttaccgtctgtttataacacacaggttgcaaggcaatcacaaaaacgcctagatgcattagttgatttacattcagagcatattgagcatatctacaaaggccttcctgttcgcggtctgaagacaacgttagttgttcatcaaaatgcgtttctttcagaaggaagtttattcctattttgtaccgttatcgctcaatttttcaccttatataccagcattaatatgtttcatgagttggaagttattaaccttgataataaggaagtttatcgatggccagcacaaatcaaccagcacatactgaagtaa

SEQ ID NO: 1416 - DNA, 936 bp, Proteus mirabilis
  unsure (41),(42): Identity of nucleotide at the above locations are unknown.
tgtctattttttatacacaccctcttgtcttttggtggagnncataataaaatgtcttatatatcaagagaaaagatagattacttgtccattggtcatcgactgcgtgcttatcgtattgcttcctcattaaaagctgaagatgtagctgaaagtttagggatctcccgtgccgctgtctatcgattagaaaagggtgaaatcgttaaaattgagacattagataatcttgctcgattacttaacacctcattaagtagcttattaggtattaatacggagtattactctagcgctaatggtttttttgaacgaatgcgccaacttgaaacacaatcttcccatatttatacccatttcgaacccttttcttatttattaacctctgattgttatgataaaacgcttgtcgaaatgttaacagaagcctctcctgaaaatgcgctaacaaagaagcaacaagaagttttatctattttaaaagagcgtaaaaagcatcaatcattacactcaccgcatatttataatttaattagtcaacagcaaatcgaaaaatttctttatgttggtatgctaggctctgttaatgtaagtaaagccattcaacaagaaagaaaacaacgcgcaaaacaagaaatcagccatttaattgaaaagttagagcaaaaaaatagtcatcttaatattgcgattatttcagatacgatgccatctttaacctttcaattgttttatcaaaacaaagcacctctctctttagcggttagtccatttcgtttaggtgaatttcctaatgtaagtacgggtattgcgacagtatcttcatcaacagaagcaatattccaatatcaatctctgtttgatacgttatgggcaaaagcaataaaaaatgatgatgccattacacgcttaaaagagattatcagtcattattga

SEQ ID NO: 1417 - DNA, 1488 bp, Proteus mirabilis
tattattacgtcttttcttacagtgggttaacgatgaatcaacagcgtgtattggtattaggtgccagtggacatattggacaaaatcttattcctgccttaatagcacaaggccatcaagtcaccgccggagctcgtagagtcgattggatgatgtcgcaagggtggcaaaatacacgctgtgtatttgttgatttacacgatcccaaaacattacgagatgtcatccgtaatacggatattgtgtattaccttgtgcacagtatgggagatgcccataaccttatcgaacaagagcgccaagcggcattgaacgtcgtagatgctttagaagagagtgacgttaaacaaattatttttttaagtgcgctccaacataaagatcaaccctactctccccatcttgttgcccgcaagctcacgggagaagtacttagaaccagctctattcctgtgacggaaatccgcacctctatgattgtcggtcccggctcggccgcttttgagatcatgcgagatatggtatataacttaccgatattaaccccgccgcgttgggtgcgttcaaaatcatcccctattgcgttaaaaaatttaatttactatttaacagaaattattcatcacccaacccatcaacaccgcatttttgatgccggtggccctgaatatattagctatcaaacactttttgagcgctttattaacatctccggcaaaaaacgattactgatccctttgccgatccccgccagtattatttctgctgggtttattagcctaataacttcagtaccgacttcaatcgccaaggagcttatccaagggcttaaatacgatcttcccgctaaagatgcctctttacgcaaactgatcccacaaaagttaatttcttttgatgacgcagtcagagaaacactcgcagatgaagaagcagctttagatgatcaagattggggttactctcctgaagtacgtaaccgttggaaacccggctatggctattatcccaaaaatgccggatgtacagtgtcaacaccagcaagtgcggcggcactttggcatgtcgttcagcaaattggtggtgaacaaggttatttttatggtaatgcattatggaaaacacgtgctttattagatgatcttgtcggcaacaaagtcacttatggacgccctcagcgtgaaacgctagcgctaggtgatatgattgatggttggcgggtaataaagttagagcctgaaaaacaactgactttactcttcggtatgaaagcccccggtttagggcgcctctcttttactattcacgatagtggtaacctacgctcattagatgtccgtgcttggtggcatcctgctggttttagtggtttactctattggtttgccatgatgccagcccatttatttatttttaaaggtatggctcaaaccatctcaacttacgcctatagattggataaaaattcacctaaaaagcccgattaa

SEQ ID NO: 1418 - DNA, 744 bp, Proteus mirabilis
gggtttcacgttatgcgtattcctcgcatttatcatccagagccactcagtgcaggtacacaaacttcattagcagaagaagctgcaaatcacgttggacgagtattaagaatgtcaaaaggccaaaaactggcactttttgatggctccaatcaagtatttgatgctgatattatcgaaagtagcaaaaaatcagtgattgtgcagattaatgaaggacaaatggatgatagagaatccccacttgatctccatttaggccaagtactttcacgtggtgaaaaaatggagtttactatccaaaagtccgttgaattaggtgttaacactattactccgctgatctctgaacgttgtggtgttaaactagatcctagtcgtttagaaaaaaagcatcagcaatggcaaaaaattattatctcagcctgtgaacaatgtggcagaaataaaattccacagcttatgccggtgatgtcattagaggcgtggtgtgcccaaacggatgatagcttaaaacttaatttacaccctagagcaagccaaagtattaataccttgccacttccagttaaaaaagtacgactattaattggccctgaggggggattatcccctgaagaaattgccatgacagcaaaataccattttactgatattttattaggtcctcgtgtattaagaactgaaacaacagcactcaccgcaatcaccgctttgcaggttcggttcggcgatctgggataa

SEQ ID NO: 1419 - DNA, 192 bp, Proteus mirabilis
tttcattgcgtttttattttttatcatatactcgttatatatatgttatttttaatatatcaatatgtagcgtcacaaagggctttaaaacctattattccctctgattttctaacacgttatgttcctatgaataaattgatatctcaaaaaaacctctttattgctcttaaatcaagattaacgccttaa

SEQ ID NO: 1420 - DNA, 3738 bp, Proteus mirabilis
ggaactggcgtgataaaaaaaatattagatattctccctatttttgggaaaaaagacgtcgatattactgaacaatatcttcaaggctctcttgtcctactggctatatttgatgaaagtttacctaagcgtgcattagattatgtacttacaggtacaaaccctgaaattctatttgaattaaataaactagatgcagcgaaagccgccgtttattttcatcgtgcaggaacattagagtggtggtatgccagtaatgttgatacaggaaagtacggtaaggttatcacccaaggccttaatgcccgccataaactctactcaaaggttggtgaaagtttttccttagagcaagtggcccgttttgccaaagtcatcgctgccgcatgtcaagatatcaatattaaagtaacaacaacgcaagtccccacttgggttatctacctgttagttgatgcgttttataccacttacgataatgcacgtaaccttaatttagaacatcgtaaacattggagtatggagtttatcgccaatatggtcgaagcagaggccaatattggcggtgaaaacgcgttatttgcaatttttgatagaaaagatgtctctgaatattatgccgctaatcttaagcgtatttatgaactgtgtgatttaaaagactatctactttcacatcaagaatttgttagaaaagaattagttgaaaaactttcagcgaatggcttagtcgagctaataaattatctaaataaaaatacgatattacgcgatacttttgcagatattattgttttacttgccactagcagtttaagaaccgtcaaaaaaacggctgaacctattttaaataccttacctgctgaaatcgtaaaagaaaatttaacccatgttttaatgaatggtactcccaaacaacgtacacaagccgctgatttattcgcgcgccaaggtgaaaaccgtgatgtgctggcagaagcattaaaacatgaaacctcaaaagcagttatcaagagcattgaaagtgcgctacaacgtttttgtgttgctgataatgcaaataccgttgaagccattaaagcgcctgattttactcccttagaagacacaccattacccgatagtgcccgcgatattctggtgaataacttcaatgaaatgttagtaaaagcaaaagaaaatgctgaacgtgaaattgaagaaaataaaacgtctaaacactcttataattgggcacaacgccattataaagatctctctaaaattgatgaaaaacagtgtcgagcattagtggataaactcaatagcggacaaggcactattcaagtcaatgagatccaaataattaaacacaaaaaccgtattcctaatttacctgaatacacctttttccatgccgtgcgcgtgatcaccaataaccgccaacatgcggatcacttttcctctcactattttaatagtgatattcctgaacgtttattgagtgatattgaattacgacacgttgaaaatgtattagaacgatgtcatttcaaacgtgcaacgcgtatcacagcggcgctgtgcttagaatcttatcaagatggcttacgtcgtttccgtaaaccagaacaagtttggcctttcttctctcaacatactgattatattgcagaagcgctaaacttaatgccaaatcaaagtgaacaccgctatcgccaatttgaaacttcacaaggtattgaagtattaagccgttttccaaccattcctgcacaattcgttccgcgtatcatggaattggctctaggtgaaaataaaacacaccgagtttcagctcagaaattattagaaaccttaccgaatattcacttaagtgcacaagaaggcttaacttcaagtaaacaagaaattcgagtcaccgcgattgaatggttagcacgtttaaataaccctgactcattacctgcccttaatgccttactgaaaaaagagaaacgcgaagtagtacgagccgctctgctcactgcgttagaacaattaggtgaggatatttcaagctatttatcgccaaagacattattagcagaagctgaaaaaggtctcaaagccaaaccacccgcaagccttgcttggtttaacttcgaggcgatccctgcattaacatgggaaaacaaaaaagcggttgatcccgcgattattcgttggtggattattctcgccgtcaaattaaaaatgccagggggtaatgcgttattacaacgttatatcagcctactttgcgttgatagccaacataaactttcaagctttatcctgcacacttttgtcgctcaagatattaaaggaccaacacttgaagaagcgatggctgaagcgcaacaaaatgccccttctcgattaacacaatacaaagattgggccaaacgttatcctgaatattatgctaaatatgaaacctatactttagagcaagtcgtcgaagaaattaaaaacgaggtactacgtcgttatttaggttcggcaatcagcgataaaggaatgctcgcgcttatttgtggaattgaggggcatattgcagtatcagtattacgtaactatatgcgtgatcactatcagcgtcgtgcgcaaatcgaagcgatgattgatgcggtagcttcaagtaatgatcctattatcattcaacttctgctttcattatcacgtcgttatcgcacagcatctgtgcaggaaaaagcgcgtaatttagttacgcaaatagctgaacgcaatggttggagtgctgatgaattagccgatagaaccattccaaccgccggctttgatgattcaggaacattagtactggaatatggtgagcgtactttcaccgccaaaatggatgcaaaacaaaaaattgttctgtttaatcctgaaggtaaggaagttaagtcattacctgcagcacgcaaaaatgacgatccagagctgattaaagaagcgaaaaaacttttcacttcaagtaaaaaagaacttaaacaagttattgaattacaaagtgtgcgtttatatgaagcgatgtgcgcgcaacgccaatggctaagcgctgattggcaagagtatattttagctcaccctattatgcataaattgattgaacaattagtttggcaagaagtaaaagaaggtgaagttatcaataccttccgcccttctgatgatggtgctttacttaaccttgaagatgacgaagtcaccttacaaaatgattctttgattcaattagctcacgccgccctagttaatgaagatgagcgtaaagcatggattgcacacttcaaagattacaaagtgaaattcttattttcacaaatggaacataagatccctgatttagatctgacacaaacagaagttgaagaccgaaaaggttggatcacagacaccttcaccttacggggtattttaaccaaaatgggctatcagcgaggccctgctgaagatggaggctcgttctctcactattacaaattcttctctagcttaaactactacgtcaatatcggttttagtggtagctatgtaccagaagaaaatattccagcggttttattcgatttaagttttgagaaagatcagcaaaattactgggatcgcaataatattgagttaaagcaagtaccaccgattttattagcagaaagctacgcggattatctaaaagtcgctgaagcctgtgcaggatttgatcctgaatgggaaaagaaaacaccttggtaa

SEQ ID NO: 1421 - DNA, 288 bp, Proteus mirabilis
ttttatttagtgtttgacactatcaatcaatggtgcgggaggcgagacttgaactcgcacaccttgcggcgccagaacctaaatctggtgcgtctaccaatttcgccactcccgcaacaacctttgagaaaaaaagactcgtttaacgagtctctctttcagaatatggctggggtacctggattcgaaccagggcatgccaggatcaaaacctggtgccttaccgcttggcgataccccaaaatggtggctatgacgggattcgaacctgtgaccccaacattatga

SEQ ID NO: 1422 - DNA, 558 bp, Proteus mirabilis
ggaggcttagtgcgatatctattttcgctgttttttgcgttagcggtgttggtcaccgctggctgcggttttcacctacaaggtaaaacccaagttccagctgaattaaaaacgctttacctaagctctggtgacccatacgggccactgtctcgtgtaatgcgtcaacaattgagattaagtggagttcaactggttgaaacgccaaaagcagatattcctgttctcaaaattgttggatcttcagaaaataaagagactgtctctgtgtatcaagacggtaaatcggctgaacgtcagctcacttttgtcctagatgcacaagtgattatgcctgatggaaccatctaccctatttcatcacaggtttcacgtccattctttgataacccattagaagcattagctaaagatgccgaaaatgatattatcaaacaggaaatgcgtgaacaggctaccgctatcttagtacgtaaattattggtggttcacaatgctgaacgccaaaaagcgtcagaggcagctaaagcgaaacagataatctcaccagccaaatga

SEQ ID NO: 1423 - DNA, 309 bp, Proteus mirabilis
ataaaagtagtgtggacctttcagggatttcgaagtgcgattacacgtaatacacaaatggcttattgtgtgtttcgacaaaaaatccaccttaaaggcgggcgctattggtctttgccgacaatattatcgcatttagataagtgtgttgtgttttatcataccaccaactctcaagcggaagtgagctatttagcgcataaaaagcaattatacagctcagcccaaacagacatttatgtgtgtgtattcgtttcaggaatggttttgaccccgaagaaacgttggggggttatcactgtacagtga

SEQ ID NO: 1424 - DNA, 1059 bp, Proteus mirabilis
gagataacagtagcacgacacagcgactattatctcttacccatcacaacagaaggaaaaactatgcgtaatccagttctctgggcaacagtattgtccgccacactgataagcactcagttatccgctgctgatttacccggtaaaggggtttcggttcaaccggtacaaagtactatttctgaagaaacttttcagacactcattgtcaataaagcactcgaaaaactcggctacacagtgcaacccattaaagaagttgactacaacgtagcttattcttctattgctaatggtgatgccacttttatggcggttagttgggtacctttgcataactcacaatatgaagccgcaggtggcgataacacattttatcgtaaaggtgattatgtggttaatgcagcccaaggttacttaatcgataaaaaaacggctgagaaatataacatcactaatatagagcaatttaaagatccgaaaattgccaaattatttgatgccaatggtgatggaaaagcagatttaaccggttgtaaccctggctggggttgtgaagaagccattaataatcacttaaaagcctatgatttagagaaatcagtcacccataatcagggtaactatgcggcaatgatggcagataccattactcgttataaagaaggtaaacctatcttctattatacttggacaccatactggataagtgatgtattaaagccgggtaaagatgtcgtttggctacaagttcccttctcttcattaccgggagatgacaaaaccgatacaaccttaccaaacggtaaaaactacggtttcccaccgagtacaatgcatatcgcggcaaataaaaaatgggccgaagccaaccctgctgctgctaaattatttgaaataatgaaagtttcagtggctgatatcaacgcccaaaacttacgtatgcataatggtcaaaaatcacaagcagatattgaacgtcatgctaacgcgtggatcaaagcacatcaaaaaacctttgatggctgggtagaagaagcgcgtaaagcggctaattaa

SEQ ID NO: 1425 - DNA, 738 bp, Proteus mirabilis
cgactgacagtattagacatgatcaagaatgtaatttctccggaattcaatgaagaagggcgtgctttacgacgcgttcgtagttttgttcgccgacaaggccgtttaactcctcgtcaggaacaagcattagaaaagcaatggcctatctttggcattgaatatcaaccggaacctatcgacttcagtcaggtttttggacgtaacgcccctgttgttttagaaattggttttggaatgggcgcttcgttggtgactatggcaaaaaattcgccagaaaataattactttggtattgaggtacatgcccctggtgtaggtgcttgccttgccagtgcacaagaagagaatatctcaaatctgcgagttatgtgtcatgatgcgatagaagtactcaatcacatgatcccagataatagtttacagatggttcagttgttttttcctgatccatggcacaaagcgcgtcataataaacgtcgtattgtgcaagtaccatttgcagagttaattttaactaaattagcgccaaacggtgttttccatatggcaacagattgggaaccctatgcagaacatatgcttgaagttatgacaagtgttgatggatatcagaacttatcagaaactcaggattatgtaccacgaccagaaacacgccccgtgactaagtttgaacaacgcggtcatcgtttagggcatggagtatgggatcttatgtttaagagggtaaaataa

SEQ ID NO: 1426 - DNA, 756 bp, Proteus mirabilis
actatggcagtaactaagcttgtgctagttcgacacggtgaaagtgtatggaacaaagaaaaccgttttacaggctggactgacgttgaattgtcagataaaggccgtaatgaagcgcaagaagcaggtaaactgctgaaggctgaaggttttacttttgactacgcatatacttctgtactaaaacgtgcaatccacactctgtggaacattcttgatgaagttgatcaacaatggctgccagtagagaaaagctggaaactaaacgaacgtcactacggtgcattacaaggcttaaacaaagctgaaacagctgaaaaatacggtgacgagcaagttaaacaatggcgtcgtggttttgcggttaccccaccagagttaactaaagatgatgatcgcttcccaggtaaagatccacgttatgcatctttaactgaagctgaactgccattaacagaaagcttagcgttaactatcgaccgtgtaacaccatattgggaagaagtcattaaacctcgcgttgcttcaggtgataaagtgattattgccgctcacggtaactcactgcgcgctctggttaaatacctagacaatatgagtgaagaagaaattcttgaactgaatatcccaacagcagtacctttagtttacgaatttgatgaaaatatgaaaccaatcaaacgttactacttaggtaatgcagaagaaatcgcagcaaaagccgcggctgttgctaaccaaggtaaagcaaaataa

SEQ ID NO: 1427 - DNA, 534 bp, Proteus mirabilis
gaaaataaagtaagagaaaaagagaaagagagtatagagatgattgataataaaaaacgtccgggtaaagatcttgatagaatagaccggaatattctaaatgagcttcagaaagatggtcgtatctcaaacgttgagctgtctaaacgcgttggtttatcaccaactccatgtttagagcgtgtacgccgattagaacgccaaggatttatttctggttatactgcgctattaaacccccattacctagatgcatctctgttggtatttgtggaaatcacattaaaccgtggtgcaccagatgtctttgaacaatttaatatggctgttcaaaaacttgaagagatccaagaatgtcatttagtttctggtgactttgactatctgttgaaaactcgtgtacctgatatgtctgcttatcgtaaattattaggcgaaacgctattacgtcttcctggtgtaaacgacacccgcacttatgtggtgatggaagaagtaaaacaaagcaatcgcctagtgattaaaacacgctaa

SEQ ID NO: 1428 - DNA, 777 bp, Proteus mirabilis
gtaaaaaaagtagttcaatacgcttctaggagagcgattatgggatttaaaaagttggtcgttgcattggtttttgtcgcaagttcagccactgctgcacccagttttgactgtgctgtcacgccaaaagatgatttacgtattacacctgaatttgttgaagtggccggctctaatggtttacttgttatttatcccgatggcacgttactgcgcgatgaaaagagcgtcacactaacccctgagcaacaagctattgcgaaaaaatatcaagcgacagttaggcaagatattccttggttaagaaaagagacgggaattaaattacaagagtcaagaaaagtactggataaagttgttattgaagcctttgggcaagatagccgtattttaaagcgcttaagtgacttagaaaaaaatcttaatcaacaaatggatactgttatttcgctcaagcctgataatgtcacattccatgctcaagcgattaaacaggtcgaaaccaaagggcgagaaataattgagagtagccttggggggatgttgcaagatagcattaatgaattaggtcaaaaacaattactagctgctgcgagtggtgataggaaaaaagccttaagtggattattaggtaatcttgatggttttcagcaaatcatcgaaaaagagtggaagcaacaagaagcttcatttaatcaatttgggcagcaggcatgtaataaaatcacccaaatggaaaaccaacgtgtcgaattgataaattcactaaacaaatag

SEQ ID NO: 1429 - DNA, 606 bp, Proteus mirabilis
atgaaaaaagtattactcacagtctgtgctatcgcgttgtttggtagccaagccgcttgggcggatgctcgtcaagacttacaacaacgtcttaataaagtgaatagctttcaggctaactttagtcaaacggtgaccagtaacgaaggtgcgttaattcaaaaaggggaaggacatttaaaagtacagcgtcctgatctgtttaattggcaaatgacggcaccggatgagagcacactaatttctgatggtaaaacattgtggttttataacccatttgtcgaacaagtgacggcaacttggttagagagtgccacaacgaataccccttttatgttgattgcgcgtaatgatagtaaagaatggcaaaattacgatgttaagcaaaatggtgatcgctttgaattaacccctaaaacagagaacaatttaaagcacttttctattaccgtttcacctaatggtcaaatccaacaatttgcggctacagagcaagatgggcaagtcagccaataccaattaacggcacaaaaggtcgcccccattgatgcatcagcgttccgctttacaccacccgcgggtgtgacggtggatgaccaacgctag

SEQ ID NO: 1430 - DNA, 936 bp, Proteus mirabilis
actgtgcgagtcctattagcgccaatggagggggtgttagacccccttgtgagagatctactgacggcgattaatcattacgatctctgtatcacggaatttattcgcgttgttgattcattattaccgccaaaagcattttatcgtttatgccctgaattacacacccaaagccgcacgcaaagtggcactttggtgcgggtacaattattagggcaaaatccacaatggttggcagaaaacgcttttcgagccgtctctttaggttcatggggggttgatcttaattgtggttgtccttctaaaaccgtcaatggtaatggtggtggtgcctcgttattaaaacaaccagaaacgatttatcaagcaactaaagcgatgcgtggtgctgtacctgcggatttacctgtttctgtaaaggtacgattagggtgggattgttcatcttattgccatgaaattgccgatgctgtagaacaaggtggcgcgacagaaattactatccacggtagaacaaaagaagatggttatcgtgctgataagataaactggcaagcgattggtgaaattcgccaaaaattgactattcccgttatcgctaacggtgagatttggtgtcgagaagatgctatctcttgtttaaagataaccggctgtgatgcgattatgataggtcgcggggcgatgcatacgcccaatttaagtaatgtgataaaaggtattgaagaaaaaatgccttggtcacaagtgatccaattacttaaacgctatattcgtctagaaaagcaaggggataccacttattaccatgcttcccgtataaaacagtggttgggatatttaagaaaagagtatcaagatgctgatgcactttttagtcaaattagaacgctaaaaacctcacctgaaatagccaaaataatagaagcgttataa

SEQ ID NO: 1431 - DNA, 936 bp, Proteus mirabilis
gataacagagtactcaacgctttacttttgacgaggtttttcaggatgttgtcagccagacactcagctaaattacaggtgttctaccctgtgcttcttttgcttctttctatgctatcaatacaaagtggcgcatcattggcaaaaagcctgtttcctgttattggcgcccccgcagtcacagcattacgcctttttttaggtactctgatcctgttttttatttttaaaccatggcgtctaagcttttctcgtagtgccataatgccactatttttatatggtttatcattaggggcaatgaactacttattctacttggctcttgaaactattccattaggtattgcagtagcacttgagtttacgggaccgcttgcggtagcgatgttttcttcacgcagagcaatcgattttttatggataatcttagtgattgctggattagggttattactgccgattggggataatattcacggactcgatcccctaggcattttatatgcattaggtgcgggtgtcggttgggcactgtatattgttttcggacaacgtgcaggaaaaggctatggcgcagcgacagtttctattggctcacttatcgccgcctttatctttttccctattggtatgctacaaagtagccctgagctagtttttagttggtctatattacctattggattagctattgcgattttatctaccgcttttccttatactttggaaatgattgcacttacccgtttaccggcaaaaacctttgggacattgatgagtttagagccttgtatgggggcttttattggtattattttcttacatgaacatttaacgttaatacaatgggttgcgttggcatttattgtgttagcgtcaattggttccactgcaaccatgaaaagaaaaaccaaaattgaaaaagtagaataa

SEQ ID NO: 1432 - DNA, 369 bp, Proteus mirabilis
ggtaagagagttattatgagcaatattattaaacaaatcgaacaagaacaaatgaagcaagatgtaccttcatttcgtccaggcgataatgtagaagttaaggtatgggtcgttgaaggttctaaaaaacgtctgcaggcattcgagggcgtggttatcgctattcgtaaccgcggtctgcactctgcatttactgttcgtaaaatttctaatggcgaaggtgttgagcgtgtattccaaactcactccccagtcgtagatagcatcacagttaaacgtcgtggtgcggttcgtaaagctaaactgtactacctgcgtgagcgttcaggtaaggctgcacgtattaaagagcgtcttaacgctaaataa

SEQ ID NO: 1433 - DNA, 480 bp, Proteus mirabilis
gtattcggagtgttttcaatgagttttatttcatcaattatccttagatctgtaactgttacatctaataaaatggacttcacaagacctgatattgatgtcacaaaagtagcagttaaatttaagttacgcaatgagttagaagaagataaagactccaagagctgtaagctaactttttcatctgatgtcattggtaaattaactgatggcgagggtgatgatcctgattttgatttggttgataacgagtttagtttttcacttacagtggagtatgagtttgagattaaagattatgaaaaattctcttcggttgatgaggatgaaagaactgaggcttgtgcaaatatagtttatttagacttccgaagaagaatgactgttggtgcaaataacataggtataagtagttttagattacccttatctataatgtcattaaataaatcaaaagaaaaagaaaaagaaactgaataa

SEQ ID NO: 1434 - DNA, 1584 bp, Proteus mirabilis
gagcaaggagtcaagatgtttgatattgtcgaactgtcacggttacagtttgccttaacagcgatgtatcacttcctgtttgtcccattaacgctcggtatggcgtttatgctggcaatcatggaaacgatatatgtcctgtcaggtaaacaagtttacaaagatatgacaaagttctggggtaagttattcggtattaactttgctctgggtgtcgcaactggtttgaccatggagttccaatttggtactaactggtcatatttctctcattacgttggtgatatcttcggtgcgcctttagcaatcgaaggtctgatggcattcttcttagaatcaactttcgtcggattattcttcttcggttgggatcgtttaggcaagaagcaacacttaatggtaacttggttagttgccttcggttctaacttctctgcactgtggatcttagtcgcaaatggttggatgcaaaaccctgttgctgcagacttcaactttgaaaccatgcgaatggaaatgttgagttttgctgatctggtcttaaacccagtcgctcaggtgaaatttgttcacaccgttgctgcaggttactgtactggtgcattctttgttttaggtatcagctcttactacctactcaaaggtcgtgatatcggttttgcaaaacgttctttcgctgttgcggcaacctttggtatcgctgcggtattatctgttatcgtactgggtgatgaatctggttatgaaatgggtgacgtacaaaaaaccaaattggctgctattgaaggtgagtggcatacagagccagcaccagcttcctttaacttgattgcattccctaatcaagaaaaaatggaaaacacgtttgctctacaaattccatatgtcatgggtattatagcaacacgttcttttgatacgccggtattaggtctgcatgatctgatgagccagcatgaagtgcgtattcgtaatggtatgaaagcgtatgacctgttaactgaactacgttcaggtaacactgatcctgccgtacgagctgcattcaatgagtctaaaaaagacttaggctacggtctattattgaagcgttatactgaaaatgtttctgatgcaactgaagagcaaattaagtcagctgtaaaagattctattcctaacgtcgcaccacttttctggtcattccgtatcatggtcgcggccggcttcttgatgttactggttgttgcgatctccttctggactgttctgtctaaccgtatcggtaactacaaatggttactgcgtgctgcgctatttagtattccattaccatggattgctgttgaagcgggctggtttgttgcagaatatggacgtcaaccatgggcgattggtgaaatcttgcctacggctgtagcaacttcttcactgacacaggctgatattctcgtttctatgggacttatctgcggtctgtatactctgttcctcgttgccgaaatgttcctgatgttcaaatttggtcgccttggcccaagtagtctgaaaacgggtcgctatcactttgaacagaagacagcttcttctgcacaaagtaagtaa

SEQ ID NO: 1435 - DNA, 525 bp, Proteus mirabilis
aaagaaatggtttacctaatcagggaactagtaaattaccaacatgtaggtgattatatgaaagaaaatattgctgtaaaatcgatagaaaacatatggcaagacccacaatgtttttgtataagtgaatttattagagatgagtttttttattattttaaatgtttagatattgtatcaatgaagaaaggaagtatagtcgatgcagaatatcttggttgttttaatattgaaaacatgttggcagtaaaacatacaagatttacaaaaacagaaatttatcctgtggatatagaccatgattataaatgctactattatgaggttaatgactccaattggttgaataatatattgaatgaaagaactaaaaatgatagtgattggaataaatatgatactaatatctataaacactttattttggaaaataaagaatattgggtagaagttataggaagtaatttgattttttctaaaaaagaaaaggatgaagctaaattagtactttgggatactatttaa

SEQ ID NO: 1436 - DNA, 1242 bp, Proteus mirabilis
aaaatggtggtgctggcccatctgttggggatattactcgccaaatacttgatcacattatacttggagacaacaacaccgagttgcctatttccccgccttcaccgcgtggctcagaggaataacccaatgacagaaaataacaagaaaaaatcactctggacgcgtttacatatcgatccattctttatgctctgtattattgccttattatgctatagcgcatttattatgtggacagcaagtgggcaagatcccgatatgatggaacgcaagctgggacaaattgctacgggttttatcgttatgattatcatggcgcagatccctccacgggtgtatgaaaactgggctcctcacctttacgtattttgtgttgtattacttatttttgttgatgtctttgggcaaattagtaaaggtgcacaacgctggcttgatttaggtatcatacgttttcagccttctgaaattgccaaaattgccgttcctctaatggtcgctcgctttatgaaccgtgatgtttgtccgccaacattacgtaacacagcaatagccttagtgttgatcttcgtccccacccttttagtggctgcacaacctgatttgggtacctctattttaattgctgcttcaggaatttttgttatcttccttgccggtatgagttggcgtttaattactgtcgcaacactattaattgctggatttattccgatactctggtttttcttgatgcatgattaccaacgaacacgggtcatgatgttacttgatcctgaaattgaccccttaggagccggatatcatattatccaatctaaaattgctatcggttctggtggattacatggcaaaggttggttacaagggactcagtctcaacttgagtttttaccagagcgccataccgactttatttttgccgtactcgcagaagaattaggactgattggtgttttaatcctactaacgctctatatactcttaattgctcgaggtctttatctcgcgacaaaagcacaaaatacatttggcagagtcatgattggtggattaatgctgatcttctttgtttatgttttcgtcaatattggtatggtgagtgggatcctcccagtagtcggcgtgccattaccactggtaagctatgggggatcggcattaattgtactaatggcaggatttggcattgttatgtcaattcatacacaccgaaaactattatcaaaaagtttataa

SEQ ID NO: 1437 - DNA, 444 bp, Proteus mirabilis
agagtaacggtgatggcatccaattatggctggcaggctaatgctggcgccagcttatttgaacggatccgagggaaaaacttaggtttttcccatcgttcgcgaacaaatacactcattgaatcaataaaacagaatttaaattacatcttaaatgctagacctgatggttgccaaggaacgccacccttagggatccctgatttaaatgatgcgactcaatctacggttgattttaaatctcacctagaagatagcattagtagttgcattattgcgtatgaaccacggatcagcaaagttgtagtgaaatttcttgaagaagatgcagatagtttatctttacaatttaatattaatgcttttattgatttagaaaataagcagcaacttattgaatttaatgtgtatttagataataaccgtagatatcagcttaaatag

SEQ ID NO: 1438 - DNA, 564 bp, Proteus mirabilis
tctgtcgcggtggtaacaatgagcgaacaaaaaacctttaaagagcctgtagaacctattgttatgggtaagttgggctcaccttacgggatccgtggttggctcagagttttttcttccaccgaacatgccgaaaacatttttgaatatcaaccgtggtttattcaacgacatggtcaatgggaatccattgagatagaaacttggaaacaccacaatcaagatattatcgtcaagctaaaaggtattgacgacagagatgctgcaaatattttgactaattttgaaattgtcgtaagtgctacacaacttcctgatctagacggtgagtattactggaaagatctgatgggttgtcaggtagaaactgacaagggctacgatttaggtgtcgttaacgacatgatggaaacgggctcaaatgacgtcatggtaatcaaagcaaatctgaaagatgcattcggtgtcagggagcggttagttccgtttcttgatgggcaggttatcaagaaagtcgatctctcagcgaaaaaaattatcgttgattgggatcctggtttttag

SEQ ID NO: 1439 - DNA, 1011 bp, Proteus mirabilis
aagagagcggtatgccaattaaaaagaactttattaacctttataaaaataatacctcttgcgttttatttcgcaccacaacaccaattaagagataataaaatgacttctgcaaagcgccctatttttaatttagagttagacctactcagaacttttgttgctgttgccgatggttccacctttgccgcagccgctgaatcagtttgccgaacacaatctgcagtcagccaacaaatgcaacgccttgagtcattaataggtaaagagctttttgctcgacaagggagaaataaaacattaaccgaagcaggcactcaactgcttaattatgctcggcggattttgcgcattaatgatgaagcatgtttatctttattgcatgaagaaattgatggaatattaaagattggctctcccgatgatacagcaaacacaatcttacccgatctacttgctcgtttttcaggtgcttatcctcgtttaattatggagattattgttaaacgtagcccttttttaatgtcaatgttggaaaataatgaggtcgatttagccatttctacagaagagcatgtcggttaccctaaaattgtcttacgcgtatcgccttcgttatggtattgcggtaaacattttagatttgatcttgacgaaccgttacctttagtggttcttgatgaaccaagtacttaccgtgatatgatgataaatcaccttgatcaacaaaatattcgctggcgcattgcctatattgccaccaccttatctggtgccagagcggccgttcgtgctggtttaggtataatggcacgctctatcgagctttctggtgatgatttacgtattttgggtgaaaaagagggattaccgccattacctgctattcgttataacctttatcttaatgccaatagcccgagtaaagcagctcagatactatttgattcattaaaaaatgagcagaatgaagtcattaatcacgcagatattacccttcaaaaccactaa

SEQ ID NO: 1440 - DNA, 1089 bp, Proteus mirabilis
atgagtcaggtatataactttagtgcaggtccggccatgttaccggcagaagttcttcgtcgtgcagaattagaattatgcaactggcacggattagggcgttctgttatggagatcagccaccgcagtaaagaatttctggaggttgcccatcaggcagagcaagatctacgggatctactcaatgtaccagaaaattataaaattctgttctgtcatggtggcgctcgtggtcattttgcggcattaccgcttaatttattaggtgagaaaaccaccgctgattatattgatggaggatattgggctaaaagtgctgccgatgaagcggaaaaatattgttcacctaatatcattaaaataaagacagaaattgacggtaaaatcgcggttaagccaatgaaagagtggcaattaagtgataatgcagcctatgtgcattattgcccaaatgagactatcgatgggattgctatccacgaagagccggattttgatgataaaaaaattgttattgccgactactcttccgctattttatctcagccacttgatgttagccgttttggtatgatttacgctggagcacaaaaaaatattggtcctgcggggttaacactggtaattattcgcgaagatttactgggtaaagcacgtaaagaaaccccttcagtgtttgattacacagtactggctgaaaatgactccatgtttaatacaccgccgacttttgcttggtacttatcaggcatggtgtttaaatggttaaaagagcaaggtggcttacaagagatagcaaaacgcaattatgagaaagcgacactgctttatagtgcgattgataacagtgatttctatattaaccgtattgcaacagaaaaccgctctttgatgaatgtacctttccaaatgtcttctcctgctttagatgcggttttcttaaaagaagctgaagagcaaggattagttgcgctgaaagggcaccgtgtttcaggcggtatgcgtgcatctatttataacgcaatgccttttgctggtgtacaagcattagttgattttatggctgattttgagcgtcgccacgcttaa

SEQ ID NO: 1441 - DNA, 1062 bp, Proteus mirabilis
cttatgaaggtaacacaaatccttttttataataatgaaaatagtattacagataatgaaataaaaaacctatttaatatctttgatactcaggtcattaataatagtagagtggatgttaatcttgagactgccaaaaatcaaataaataaactcgctgatgcagttaggaatggaagctcaatagatttagattatttagtaaacatcatgtttcatgatgatataaaaataagcttatatgcaactaatcagctctacttgatttatccaaaattaaataactcgataagagaagatattaaagagttagtcaaattactctatgaaataaaaataaaagaggatcaagagtattttaaagaacgacctttattaagtgcaatggcttgtgaggaagcgattgctagacaaaagggaaaaggggagaatgtttttatctcagcggttgataattatttaaatataaaatgtaatgatagcgtattggccaatagtaatgaaagcgtaagtaataataatcgatatatatcttcatctgaattagagtcttgggcgtcatttcaaccctatcagtgtgatattggttcctatgaatcaatacttaaaaaaatagaaaatagcaaaggatccgcggagttaaaaaattatgtggttttagtcaataataaccattgggttgcgttattgacttataaagatagctgttttttatgtgattcattgccctcaagcaaaaaagatgaacgtcataacttattaattgaactagaaaaaaaaggatttaatactatcaatatagaatataatctacaagaaaatgtacctaatggatgtggtcttttggcgcttaattatattgatagtttacataatgaatggaataaatttaatcatgaaaaagaagatgatttaatatccacaatagaaacagtattacaaaaaacaggaaaagactttctaaacctaagttgtggtgagcaaaccacatttaatcatgatgttaggaaaaaattgattatggatacacttttttgtattgttaaatctagttatgaatag

SEQ ID NO: 1442 - DNA, 240 bp, Proteus mirabilis
ggagagaaggttatgttaaaaatatttctttttgccttcatcttgttcttactggcattctttggaatggctttaggatatattgttaaacgtaaaagtattcagggcagttgtggtggtttaggctctattggtattgagaaagagtgtgattgtcctgaaccttgtgatgctcgtaaaaaaagaatggcgaaagaagctgctcgccaagagctattgcagaaaaaccgcatcttatag

SEQ ID NO: 1443 - DNA, 249 bp, Proteus mirabilis
ggtaaacgggtatttaatggggcagcggttttatcccactttacaggaacgggaggtggtggcgatgaacatctggtaactattgccgctaacatgattactttaagtttttttatcatgctttcatttcctcaaaatattgatttcgatggattggacggaaataaatgtcattcatgcggcggacatttccgtccaaatcgatgctcacaatcacgtccagactgtccagaaccttacgtaacataa

SEQ ID NO: 1444 - DNA, 1038 bp, Proteus mirabilis
gtcaccagggtgcacggtagaaatgcccgcatctcccgaatttggaaaggtgttattatgcaacaacttgttgatgcgttttcccgcaaatttttctatttacgtctatcaatcacagacgtgtgtaatttccgttgcacttactgcttacctaatggctacaagccaaatggtcataagtcttttctatcactggatgaaatccgccgactgactcactcttttgctgaattaggcacagaaaaaatccgtttaacgggtggtgagcctacgatgcgtcgagattttactgatattatcgcgactattaatgaaaacccagccattaaaaagattgctgtgacaacaaacggctatcgtttagcccgtgatgttgcacaatggcgtgatgcggggctaagtgcgataaatgtcagtgttgatagcttagatccccgccaatttcatgccattaccgggcaagataaattccatcaagtgatggaaggaatagacgctgcttttacggcaggttatgacaaagtgaaagtcaatgttgtgctaatgcgcaacgtaaatgataaaaacttgcctgattttctccattggatcaaagacagaccgatacaactacgctttattgaactaatggaaactggtgatggtagtgatgtttttaatcgctttcatttatctggtgaagtgatccgccaacgtttacttaacgaaggttggctacaaattcctcgcgcccgtagtgatgggccagctcaagtctttactcatcctgattatcaaggtgaaattggtcttatcatgccttatgaaaaagacttttgtgtcacctgtaaccgtttacgtgtttctgcgattggtaatcttcatctttgcttatttggcgaaaatggtattcctttacgcgatttattggctgatgatgcacaacaacaagccctacaacagcgtattcagggtggacttcttcataaaagagaaacacattttcttcatcagggcgatagtggtattacccctaatctttctgtgattggtggataa

SEQ ID NO: 1445 - DNA, 765 bp, Proteus mirabilis
tgtttattattatcaccttctgtgattaatataaaaattaaaggaaagagaatgcgtaaagtcacacttactcttagtgcaattgcgttggcgttaagtttaaatggcgcagcaatggcaaaagttcatatgccagaagttgttagcccaggggttactgttactgaacttgcacaccagcaaccaattaaatgggtttctgttgcagaaattgaaaaaagcttagaaggccaagcaccaatggcggtaggttttgatattgatgacactgttctgttctcaagcccaggcttttatcgtggtaaactagaatattctccaaacgatttcagttatctgaaaaacccagaattctgggaaaaaatgaacaacgaatgggataaattcagtatgcctaaacaagtcggtatcgatcttgttcagatgcacttaaaacgtggtgatactgtttatttcattaccggtcgtacacagactaaaacagagactgtgactaaatatgttcaagaaggtttaaatattcctgcagacaaaatgcaacctgttatttttgccggtgaccaacctggcgcaaataacaaagtaagctggatgcgcgatcacaaactgaaaatttactacggtgatgcagatgctgatatcgcagcagcagatgagctaaatatccgtgggatccgtatcttacgtgctgctaactcttcttaccagccgttacctaaagcgggacaatttggtgaagaagtggttatcaattcagagtactaa

SEQ ID NO: 1446 - DNA, 345 bp, Proteus mirabilis
gtacaattattggaaaaaatcactatttcgtcttacactcttaaagtgaccatttttaatatactatctatattatcactacatttagggggaactatgggatttctttcttggattgtgttcggtcttattgcgggtatcttagccaaattcttaatgcctggctcgtatgatatcggccttatctggacctgtattctaggtattgtgggtgctgtagttggtggtgtaattagtaatttctttggtaaaggcaaagtagatggtttcaattttggtagttttgtcgttgccgtaataggggcaatcgttgtgctttatttagcaaaaatatttgccagttaa

SEQ ID NO: 1447 - DNA, 264 bp, Proteus mirabilis
aggctgttatttatctcaattaagattaattttaggataaatttcaaccagtcatctttgtttaaaaaacaacgtgcagctaaaataactgtgcgttgttttattatgtcaccactacaccactatatccccttccctgtgctatcaaattatcacctattaggctgttttttctttttattcagacaatctgttgttatttacttagtaagatttttcatcaataaggttgttttttggatcttttttcgacaaaatgattaa

SEQ ID NO: 1448 - DNA, 183 bp, Proteus mirabilis
tttaaaatattaaacaaaatgccatttatttaccataaaaaacaaaaagtgttttatataataaatatgctatttttttattcatacttacaacaaataactttatctactataacaactagagagaaatatggagccaatcacccgcttaatcgatcgcatgttatcttttgcattacttga

SEQ ID NO: 1449 - DNA, 1407 bp, Proteus mirabilis
aaacgattttttattattcttttaacaggggaaataattatgggaactagtgtgtttgattctgttttattaaaaaacttatggtcaacagaagaaatgagaactattttttctgacaaaactagaatgcaaaattggcttgattatgaagcagcattagcaatagaacaagctgagcttggtttaattcctcaaaaggcggcggaggttattgtacagagtgcaaaacttgaaaaattagatatggattatgtattagaacaagttcgtcttactcgacatccattagtacctactattcgaggcttagaacatgcttgttctgaacattatggagaatatgttcattttgggccgacaacacaagatgttattgatacaggcttagtgctacaacttaaagctgctcatcaaacttttttacgtgatattaaaatattaggtcgttcattactttctttaagtgaaaaacaccgcaatacacctatggttggacgcactttagcgttacaagcgttaccaatcacatttgggcataaaacagcaatttggttgacagagttagcgcgtcattatcaacgacttaaagaggtggaacctcgtctatttgttggcagtgtagtcggtgctgtcgggactaaagcttctttaagcgataaagctgatgaattagaaaaacgcgtattaaaacgcttaggattagatataccggaaatctcatggcaaccagcacgtgatagatttagtgaatatggtatgttaattggattaattagtggaacgttagggaaaatagctaacgagatcttaatattagcacacaatgaaattgatgagctttcagagccttttggtaaagggcaagttggctcttcaactatgccacataaacgcaatccagctattgttgaaaatgccgcctgtgtaagtaataccttaaaagctaatctttctgtattaacggatatgatgaaacatcaacatgaacgtgatggtgctatctggaagatggagtggaagattatgccagaaatgtgtctgatgttatctgttatcttggataatatgaaaacagtactaggtgggctaaatgttcatgttgaaaaaatgcgtcacaacatggatatcttaggtgggtttatgttagcagaacgtgtgatgtttgctctgtccgataaagcaggcaaacaaactgctcacgaaattgtgtatgaagcgtcaatgtctggacaagaagaggggattactttcgtagaagctattaatcgtgatactcgtattcgtgaccatatttcacaagaagagttaaatgctttgctagatccaactacctatgttggtaatgctcctgagcaagttgatcgtgtagtcgctcaaacaaaagcttccggctggttaaatgattaa

SEQ ID NO: 1450 - DNA, 1335 bp, Proteus mirabilis
ggctgctctttcgggcagccttattatctaatcataaaacttttatatttagattatattttcttattagaggtaatatctgtgttttctataaataaactcaaaataataacgtttgttattttaggaggtgtattatttaattcacatgcaaactctttaaagtatatattaaataattcattaaataatgcgcctgagttattagaagctaaagctgatatagatatagccgttgcaaaagttaatcagactagagctcaacattttcccgtaataagcgtaactggaaataaattattaggacaatatcatagagataaaagcgactatgataataatagttttattccaggattaagaggtgaattaaatatctattctttcggtggaatagaaaatgatgttgaacgtaatgaaaaagaacaactctattatcaatttaaatatagcgaaacgaaagaaaatgtcgcttacaccatatcagatctctatttaaaagcattgctagctaaagaatctattgcggtaaagaaaaaaagtttagatagacataataagattatatctgaattaaatgtgatagcccgtaatgatgaagggcgtgtttctgaatatgttcaggcagaagcaagaaaaatattagtagaacaagatattaactattatgaaaaagaattaatgacaacgttaagtacgttatcaaaatatacgggtttccccgttggtgaaagcgatcttgtcaatccttttgatggaatgacggtcagtgatatgtatagcgaattcactgcggaaaataataatcaaaatccagcttatctcgtgagtcaggctgatatcgatgctaaaaaaatgggcgttaaagtagaaaataaaaaacaattaccaagaattaatttaactggaaatataactaaagatgatcgtcagataggcattgatgtgacatgggacattattaatttttcatcattatattctattgatgaaaaagtaagtcagttaaacgcggcacaacagagaatggagagagtgattagagatattgaagaagcaagacgtttatcagtaattaatatccaaaaaagtactcaaaaattgaagatattagatgcacaaattttatcatcgacaaaagtagtcgatttttatcaattgcaatttaatgttgcacgccgttctttgttagatgttttgaatgcagaaaaagagttatctgatgttgaattatcttatgccacgacattgagtgatcttaggtacgggatgcttgattatttgtatgcacaaggaaaactttcgcactgggcacttaattcacacactcactaa

SEQ ID NO: 1451 - DNA, 732 bp, Proteus mirabilis
atgacctcattgatttatcctgattggccacagcctgacaatattggcgcatgtagcacattaagaactggcggtgtcagtttgccaccttatgacagccttaatttaggggcgcatgtgggcgatgatgcgctattggtagaacaaaatagacgtatcatttgtcaacaagctcaattacctgaaatgccattatggttaacacaggttcatggtattgaggtggttaatttggataatcaagacaatcataccgttgaaggcgatgccctttacacctctagtgctaataaggtgtgcgctatcatgaccgcagattgtttacctgtgctatttagtaccattgatggaacggaagttggcgctgcccatggtggatggcgcgggctttgccaaggtgtattacaacagacactcactcaatttaaagcctctaatgagaagattatggcgtggttagggccagcaataggccctaatgcttttgaagtaggggcagaagtccgtctcgcttttgtagaaaaaaatattgcctttgatagcgcatttattccccacaatggcaaatacttagctaatatttatatgttagcgagaataattctgcaggaaagtggggtaaatcagatttatggtggggacttttgtactgttagcgataaatcacgctttttctcctatcgacgtgaacatactaccggacgtatggcctcattaatctggatcaaatag

SEQ ID NO: 1452 - DNA, 237 bp, Proteus mirabilis
gttagatctttttactgctggttttgttacttaatagttcagtctccttcgctatcgggtatcaaaaccaaacagttgttaaaggttttgagtgagaaactcaaaacccgccccacaagcacgtttaatcgtgaacagaacctgcgttttcaagggcagtatttcgacaaagacaaatttgtcgggaacaaatttgaacagcgcttgcgctggcccgtagggcgagtatcaggatga

SEQ ID NO: 1453 - DNA, 900 bp, Proteus mirabilis
atctttccattttattacaaaacatggagatcaaaaataatgattaacttaactccatattctgattctagtatctcttttttacgttcaattattaactcaaaaaatagaggagattataaagatagaatatctaatttatttaattcattaaatacctattatcaaaattatgatacatcttttgataataatactttaaatcttattcaacaatcgcttattttttcagatttagaaaaaaaagatttactcaaactatataattatagttcaaaaccatttgcaaattttaagaatcaattattaaaattaccaaatggtagagatatggatacttgtcagtattgcactttaaatagcgtaaatacattagatcatattattcctaaagaaaattatcctgaatatgcagtacatcctaaaaatttatttccagcttgtagtcaatgcaacagcaaaaaatcaaataaatggttagataataataataactttgagtttataaacttatattcacatgacctacccaatttacaatatctttttgcaaacattaatttaattggtaatactttcaatgttaactttgaattaagaaatgaaaataacattaatgaagatattttcatgctaattgaaagacattatatcaatcttgatttgttaaatagatttaaatcaaaatcaaatgaaaaaatagcacaatttgaaaatatcataatttcaaacatagagagctttgatatacttctttcttctgcactaaactctgctctagttgcagttaataagagtagacttatttttggggcaaatcattgggaacaaatattataccttggattaataaacggctctgcatttagaacttattgtaacaataaaggctatcaataa

SEQ ID NO: 1454 - DNA, 354 bp, Proteus mirabilis
actcttccattggttactccaataaaaaaggcgatacaaagccgcctgatcaaatatcaggatattaataaatatccattaggttattttatatattcagcccagagaaacttaccgaaggaatggctgacttacttcgatggagaattgaatatgttagttagtgaaatggcaaaagacatagaggcccttcaaacacgtactcttgctttagagtatataattcaagtaatgattaggaatatgtctgatattgaaaaagaaaaacttattagtgaattaaatagagtatcgcatgatagtcctgtaactatcgaggcgtttggtatcattcagtcacatttacataattag

SEQ ID NO: 1455 - DNA, 2661 bp, Proteus mirabilis
tttctgtttttccagcttgatttcgggataattatgagcaaaagcaccgctgagatccgtcaggcgtttctcgacttttttcatactaaaggacatcaaatagtaccaagcagttctttggttccaaataatgatccaacattgctgtttacaaacgcagggatgaaccaatttaaagatgtatttcttggattggacaaccgaccttattcccgagcgacaaccgcgcaacgttgtgtgcgcgcgggtggtaaacataatgatttagaaaatgtgggttatacagcacgtcaccatacattttttgaaatgttaggtaactttagttttggtgactatttcaaacatgatgcaattaactttgcctgggaattattaactggcaaagagtggtttaacttacctaaagagagactttgggtaaccgtttatgccactgatgatgaagcttatgatatctggaataaagaagtcggtgttccagctgagcgcattattcgtattggtgataataaaggcgcaccatttgcttctgataacttctggcaaatgggagatacggggccttgtggtccatgtactgagatattttacgatcatggtgatcatatttgggggggaccgccaggaacacctgaagaagacggtgatcgctatattgagatctggaatatcgtctttatgcagttcaaccgtaaatcagatggtacaatggatccattgccgaagccttctgttgatacgggaatggggttagagcgtattactgctgtactacagcatgttaattctaactatgatattgatttattccgcgcattaattaaatccgttgctgaagtgactaatgcgacagacttagcaaataaatcattacgtgtgattgccgaccatatccgttcttgttctttccttgtttgtgatggtgtcattccttctaatgaaggtcgtggctatgtgctacgtcgtattatccgtcgtgctgtacgtcatggttatatgttaggtgcgaaagatactttcttctataaactcgttgcaccacttattgatgtaatggctgaagctggtaaagagcttaagaatcaacaagaaatcgttgaaaaagtacttaaaacggaagaagagcagtttgcacgtactttagagcgcggtttacaattattagatgaagagctagaaaaattaaccggtgatactttagcgggtgaaacggctttccgtctttatgatacatacggtttcccattagatttaactgcggatgtttgccgtgaaagaaatatcaaagttgatgaagaaggctttgaacaggcaatggaagagcaacgtaaacgtgctcgtgaatctagcggttttggtactgactataacgaactgattaaagtcgatagtcgcagtgatttctcaggttatgaccataatgagcaacaaggtactattaatgcgattttccataatggtcaaacagtcactgagcttaaagcaggtgaagaagggattatcttcttagataaaacggctttttatgctgagtctggtggccaagtaggtgataaaggtcttctgattggcaaagatagccagtttgaagttaccgacacgcaaaaatatggcaaggctattggtcatattggtaaagtcatttctggatcttttattgttaatcataagatcaatgcagtcattgatgtggctcgtcgtgatgctattcgcttaaatcactcagcaacgcatttattgcatgcggcattacgccaagtattaggcactcatgttacccagaaaggctctttagttaacgataaatatctgcgttttgacttctctcactttgaagcagtaaaaccagaacagttacgtgaaattgaagacattgttaacgcgcaaatccgccttaactcgccggttgtcaccgagttaatggatcttgaagatgcgaagcaaaaaggtgcgatggcactctttggtgagaaatatgaagaacgtgttcgtgttttaaccatgggtgatttctcaactgaactttgtggtggtactcacgcagccagaacgggtgatattggtctattccgcattatgagtgaatcagggactgcggccggtattcgccgaattgaagcgattacgggggctacagcgattgaaagtgttcatgagcaatcggatctgatttctcttgtggctcatgcacttaaaagtgatggtagtaatttagttgagaaaattaaaacggttcaagaaaaataccgttcattagaaaaagaacttcaacaactgaaagatcagcaagcagctcaagaaagctcctcgttaggaagccaagctaagaatgtgaaaggtatcaaacttttagttcgtgaactgaataatgttgaaccaaaaatgttaagaacaatggttgatgatttaaaaaatcaattaggttcagcaataattgtactttctactatttctgatggtaaagtgagcttaattgtcggtgtgactaaggatttgactgctaaaataaaagcaggtgagctaattagttttgtcgctcagcaaatcggtggtaaaggtggtggtcgccctgatatggcacaagctggtggtacagatgttgaagcgttacccgctgctttagcgagtgttgacgagtgggtagaatcgcatctttaa

SEQ ID NO: 1456 - DNA, 363 bp, Proteus mirabilis
ttaaaacaattggttattttatcttggtattttttaaaaccttatgttggtatttttatggacataaataagattttaggccgagagattaaatttttaagaaaacgttctttgctgtcaggatgcgaattggcaaaagcctttggaataagtcaacagcacctttcacggattgagcgaggagaagttcaatggagtgtatctttcctacttagagtatgcgctttttttgatattccaatgattcattttattaaattgatagagaaagaaacatcttcattttctattgttgataataatttatgtcaatttgaatttattgaaataaataataggagaaggataggtcatagaaagtaa

SEQ ID NO: 1457 - DNA, 444 bp, Proteus mirabilis
ctaaataaattggtaaatgttatgtcaaaagagataagcgaattacagtttagtcttcactatgcctcagaaacagacagtgaaaagaatacctccatcattttaacggcgaatatccatacggctgatggtgaaactcaacaactgacacaattaatttgcacgacatcttccgcaggtaaaaagcaatatcgaatcggcttgcaaaaaattagtgatgctggtgctccattgctggtggcgattgaatcctattggcgcaaaaacacacaagagagttgtgtttatttgttagagaaagcgaagcaatttattcaaggacacttacaacaaacgaatacatggatatctatgtatggtcttgtgattgtttctaatgcgtcactggaagaacagttgcctgaaggtttattaaaggcacttaaagtatcaatccccgcctaa

SEQ ID NO: 1458 - DNA, 183 bp, Proteus mirabilis
ctcgtcaaattctttcatcattttttcgtcacgctcaacagggaaatatgctatttcttttcctgcaggcattcgtgggtcaaaatttgcaaaatgccagatatccttacttgtaacccacatggaatattgaacttgagccacatattcctttttcattgcatcgattccattcaatgctaa

SEQ ID NO: 1459 - DNA, 696 bp, Proteus mirabilis
aaggacttttcaatgatccattaccctgaatatattcttgatattatttggcaaagagcgaaaaaaatatctgccgataatgaaataaaaggatttcgtaaagataaagaaactaaatggatcaagcgccaactgtttaatcaacaaaatgaatttggctgggtattatcaaaacaacctagttcgattcatcaacttattgaagatgaaacaattgtgcctttacattggcaaacagcgagagcctatgagcaaaaacaagaagcaagctctaaacgtctcaatatgatcccacttgacccaccagcactatcgcgactcattcaatcaccaacagatgttttaccttattggcaacatgcccatcagatttccagcgataatgaagaaaaaggttttcgtaaagattattacggtcgtattatccagaaaaatgcgtttggagataaacaacatcaatatggttggacattagctcaattaacaccagccaataagaataatcaaatcgttattcctattaatattgtaccaatacatattaatacctcaaaacgcacttacaatgaaaaggaattaattgttcaaggtagccaagaagcaaaaataaaacgcagacgtaaaaaacttgtctatgagataatcgattttattgtcagcctacctggcattattttttcttcatttaaactctga

SEQ ID NO: 1460 - DNA, 1014 bp, Proteus mirabilis
tggagaaaattaatgggcagaagcagaagtgcaaagaacaaggggctaccgcctaacttgtatttgcgtaaagggatttactattacagggatgtaagaactaaaaaggaattttctgttggctcaaacaaatcattggcaataaccgaagccatacaagccaatttagctatttataaacctaaagagccattagttgacagaattaataatgttcactgtgtaacattgcatgagtggcttgatacttatagggggaaggtaaacagcagggggttaaaagagaagacgctctacgattacgaatcaagaataaagttaatcaaattacactttaatgactgtccaattgagaatgtaacaccaagagatgtagccacatttatttcagagtaccctaaaaaggcaatggcaaaattactaaggtccactatgctagatgcttttaatgaagccattgcggatggtgtgataaaggaaaatcccgtttccgtgacaaagccgccaaaaacaagcgttcagcgatcaaggttatcgctagaagagtttaaatacgccttggagcacacaaatgacaaatataggcatatgtttctactagcggtccttacagctcagcgcattagcgatattatcaatatgaagtgggatgatataaaaaatgataggctgtatgtcacccaaataaaaacaggttctaaagtagcaataccactctcattaagacttgagcctattggttattctattaaagatgttttaaatctcatgaataggaactcagataaaatctgtggcaataccacagcaaaaacattaagaggtaagtttatcgaagccctacctgagtatttggaaaataaaccaacatttcatgaaattagaagtttatctgcaagattatatgaagaagaaaaaagtgctgagtttgcaaagaaaatacttggccacaaatctatgagaatgacagataaataccttgatgatagaggtaatggctacgttgaattgtga

SEQ ID NO: 1461 - DNA, 1020 bp, Proteus mirabilis
cgtcttatttctcctacaatcgctcaattcgcatcaagcctaatcaaagatgaggtatccatgagcaccatcaaacatagcaaacttattattttaggttcaggtcctgccggctatactgcagcagtttatgcagcacgagctaacctagaacccgtgctgattacgggtgttgaaaaaggaggacagctcactaccacaactgaagttgaaaactggcctggcgaccctgaaggattaactggtcctggtttaatggatcgcatgtttcagcacgctgaaaaatttaataccgagattatctctgaccatatcaacaaagtcgatctgaaaaaccgacctttccgcctatttggtgatgaacaagaatatacttgtgatgccttgatcattgcaacaggggcatcagcacgttatatcggtttaccttctgaagaagcatttaaaggccgtggtgtttctgcctgtgcaacctgtgatggctttttctatcgtaaccagaaagttgctgttgtcggtggcggtaatactgccgtagaagaagcactgtatttagcaaatatcgcctcagaagtgcatctaatccaccgccgcgattcattccgctctgaaaaaatcttaattgaccgtttaatggacaaagttaagaatggcaatatcattttgcataccgatcgtaccttagatgaagtgttaggtgatgatatgggtgtcactaaagtgcgcttaaaagatacgaaaagtgataaaaccgaagagctagaggtcatgggcgtctttattgctattggtcatagccctaacacgtcaatttttgaagatcaattagccttagataacggttacattaaagttcaatccggtacgcaaggcaatgctacccaaacatctattgaaggtgtttttgccgcaggtgatgtaatggatcatatttatcgtcaagccattacctcagctggtacaggttgtatggctgctttagatgcagaacgttacttagacgcactaaaatctaactaa

SEQ ID NO: 1462 - DNA, 354 bp, Proteus mirabilis
aaatggaaatttaataactactacccctggggaaataaagtgatgacaaatgaagcttttttaaaatttaaggattcagaaaataaaattatcattccgtacctcaaaaaagtatttccatcattgaaatcagcatgttgtttatatcatatgatagaacaattagaggatgtttatacttacttaattaatagcaaggatgttatttttattgaagtgtcgaggttaaataattctattaaccatacggatattttatcaattaaagattatgctattatgaaaaaggggaaacaatatcatcgttatatgaaagagattattgctttatcaaatagtgagataattaaatga

SEQ ID NO: 1463 - DNA, 246 bp, Proteus mirabilis
gagataatttctcactatttattgaatttagcagaaatatggctggggtaccaggattcgaacctgggaatgccaggatcaaaacctggtgccttaccgcttggcgataccccatccgctaattcaattgtcaacacgcatattatctatcaggaaaatggctggggtacctggattcgaaccagggtatgccaggatcaaaacctggtgccttaccgcttggcgataccccacctgataaattga

SEQ ID NO: 1464 - DNA, 249 bp, Proteus mirabilis
ggtaaaatttcagcatcaattcattttatgcaggagaacactatgccagcttataacgaatacactaaaaaacatgttttagcccgtcgtactggtgcggtagcgctaggtattgtggcatttcctgttatggtttttcatcctaaacgcgctcagttttatagctatttacatcgtgtatggtctaaaacaagcaataagccagtttggttggctaaatcagaaatggcattaactagccataaataa

SEQ ID NO: 1465 - DNA, 348 bp, Proteus mirabilis
gactcggtttccctacggctcccctatgcggttaacctcgctacagaatataagtcgctgacccattatacaaaaggtacgcagtcaccccataaagaggctcctactgcttgtacgtacacggtttcaggttctttttcactcccctcgctggggttcttttcgcctttccctcacggtactggttcactatcggtcaatcaggagtatttagccttggaggatggtccccccatattcagacaggataacacgtgtcccgccctactcgtcgagttcacaataacagcatcttcagatacggggctatcaccctttactgccggactttccagaccgttctcctga

SEQ ID NO: 1466 - DNA, 612 bp, Proteus mirabilis
gctttaacttcttccatagtgaagacgtggttcgccatcctgtggttgctaagattgttgtcgcatatgaagcttgggaagttgaagatcaaaaacgccgccaagcaattaaagcagaaaaagagagactgcagagagaaaatcatgagtgaagtgattcttgatttacaagttgccactgaaaatacacaagggcttccgagtgaagcccaatttatcacttggctggaagccgtactaccgcaatttcagcctattagtgaagtgactatccgtatcgttgatgaagcggaaagccatgagttaaacctaacttatcgtggaaaagatagaccaactaatgtactttcttttccttttgaagcaccgcctgaagtggaattacctttactgggtgatttaattatctgtcgtcaggtcgttgaaaaagaagccgatgagcaaaataaaactgttgaagagcactgggcacacatggttatccatggttgtctgcaccttttaggctatgatcatattgaagatgatgaagctgaagaaatggaaggtttagagacagaaatcttacaaaaattaggttatgaagatccctatttgattgaaaaagagtaa

SEQ ID NO: 1467 - DNA, 864 bp, Proteus mirabilis
caatcttattcgccaacttatttgcaccgctgtttgactatgtggttgttcaggcgaatattaagcggagaaaagctcgtggctaaagaaaaaaacaaagatagcgtcggaagaacgttcctcgttgtatttattctatgtcttgtttgttccgtggtagtggctggctctgctgttggacttaaatctaagcaagaagagcaaaagctactggataaacaacgtaatattctagatgttgctggtttattggtgcctaagatgagcgccagtgaagtactcaaagtttacgatacacgtattaaagctaagattgtaaacttcaaaactggcgaattgacagacagtaaaggcgactttgatttaaatagcgaactacgtagcgatgaaacctctatcgcactatcacctgaagaagatattgcaaaaattcgtcgtcgtgccaataccgcagaagtttactttgttcttgatgatcaaggtaaaacccaagaagtggtactgcccgtctatggttcaggcctatggtcggtcatgtatgcctttgttgcggtagatattgatggtgtaacagcgaaggggattacctattattctcatggtgaaacgccggggctaggtggagaagttgataatccgcaatggaaggcacagtggaaaggtaaacgcttactgaatgaagaaggtgtgcctgctattaaaatcgtacgtggcggggcatcagatagtccttatggtattgatggcctttcaggtgcaaccttaacctctaacggcgttcaacatatgttcgatttttggttaggtgataaaggtttcggcccattcctgaaaaaagttcgtgaaggagagatcaatggctga

SEQ ID NO: 1468 - DNA, 186 bp, Proteus mirabilis
gccacatattcctttttcattgcatcgattccattcaatgctaagtctataaatacgtccgtgttattaggacatttaagctctaatccagagccatcactgcaaatgccgtctggtgagcaagccatccgtagttgctcatctttaaatattattggcacttcctttgccgttaatccggtgtaa

SEQ ID NO: 1469 - DNA, 4197 bp, Proteus mirabilis
aatatggaattaattcatggtgcaaaaggtggtggcggtggcggacatacgcccacggaatcaccagatagcttactttctgaatcaacagctaagattttattggctatctcggaaggtgaaattgctggtggcttagacgatactcgtatttttcttgatgatacgccgattggcaatgcggacggtactaagaattttgagggtgtcacttgggaatttagaccgggtagtgaacaccaagaatacattcagggtatcccatcagtagatagcgaaacatcggtagggttggaattaaaagacgagcagccctatgtgcggagcattaataacactcagctatctgctgtgcgcattagactatctgttcctcaattgtttcaacaacacgataacggggatactacaggctatagaattgaatatgctattgacttatctacagatggtgctggatataatgaagtattaaagtctgcttttgatggtaaaacgaccagcgaataccagcgtacgcaccgcgttgatttgcccaaagcaaacacagggtggcagatccgcgtccgacgattaactaagaatcagaacaccgctagaattgctgataaagtgactatttctgcggtaacggatgttatcgatgctaaattgcgttatccaaatacggccctattatttatcaccttcaatgcgcgtcaattcaataaccgcattcctaaaattagtgttcgtcctaaggggggattactgattaaagtgccaacgaattacgacccaattaaccggacctattcgggtgtgtgggatggtacttttaagcttgcagcaaccaataatccagcgtgggtattttatgacttggttttaaataaccgctatgggtgcggtgatcgtattaaagcttcgcagattgaaaagtgggatttatacaaaatagcacaatattgtgatgagctagtaccagatggtcatggtggtgatggtaaggagcctcgatttctgtgcgatgtttatgttcaatcgcaagagtcggcataccaagtactgcgagatatagcggctatttttcgtggtatgacattttgggctgataacaaggttaatgttgtcgctgatatgccagatagtatttttagaacgtttaccaatgccaatattgttggaggtaagcctgcctattcaggaggtagtcagcaaaatcgatatacgcaagcattagtttcctacacagacaccaataaccacagtaatgatgcgattgaggctgtggccgatattaaactacagcgtcgttacggagtacgcaaaactgaaatatcagcgataggttgcactcgacagacggaggctaaccgtagaggtcgctgggcgttactcaccaatgctaacgacagagttattagttttgcgacaggactagagggggcaataccttctcctggtcatatcattgctgttgccgactctacgttagctggaagagataatggtggacgtatatcgcgtgtagaaggcagaaaaataacacttgatcgcagagccaatattaaaactggtgataggttgattgttaatctgccaaacgggcactcagagggaagaaccgtatcactggttgctgataatatcattacagtttcaacggagtactcacaggagccagagaaaaacgcagtttggacagttgatgctgatgatttagcattacaactttatcgggtcgttaacataactgataatggcgataatacatacactattactggcgcaatccataacccaagcaattacgatcacattgactctggcgccagaatagatgagcgtccaatcaccattgttccaccgggtgtgcaagcaccacctaaaaacattcgtatatcatcctattctcacgttaatcaaggcatttcattcactactctgcgcgttgattgggatgcagttgataatgccattacctatgaggctcaatggcggagagataataataactgggtatcaatgccaagatcatcaacatgcgggtttgaggttgatggcatttatgctggtcgttatcaggtgagagttcgtgcgataaatgcatctgaaatatccagcgtttgggctaacgcacaagaaacaatgttaacaggaaaaatgggtaaccctccaaaaccggttaacttcagaacgtcaccattagtctttggcattaagttagattgggggtttggtgaaaatacaggggatactttaaaaactgaaattcagtacagcaaaaccaataatggtgaaggtctgatgctgttatctgatgttccttatccctcaaaaacctatgagatggcaggcttagctgctggagaggtattttatttcagggctagactggtggataaaacaggtaatcaatctgagtggactgattttattctgggagaatctgagtttgatgctagtattattcttgatgaattagcggggcaaatcagccgagaccaactcacacaagacctattgggtgaaattaacagtaaagctaaccaaatcgatattactgaattacatgagttgatgaggataaatcatgacaagattttatctgagttgatgaggcatggagcaacgattgaagaaagtgaaaaaaaatgggaggaggcaggaaaattactggctgagcggataaatcaagtttcaacggcaacagaagcacaggcagccgcaattaaacaagagcaacaagcacgtattgagggtgataaaaccgaagcgcaacaacggcaatctttagcgactcaacttcgtggtgattatactggcaatgatttatcgaacgtgaccgcaggactcatttccgccgagaaacaagcgcgggtctcgggtgaccaagcggaagccaaagccagacagtcattggaaacacggatgaatgggaatgtttccgcgattaataaatcattaggaaccctcacctcgaaacagcaagcacaaacgcaagagatttcaacgctcaattcaaatcttaaagggaaagctgatagtagtgcggtaaatgcattaaatacgcgagtatctaatcttgatggcaaagtgacgtccgcaacctctcaggtacaaacgttatccagcaaattagatacagtgaaagccgatttaacggagtctgtggtggtggatttagatttatctaaactcaatgaaaacacctattatccgattattttgccattagtaacttctcgacgttatgcctttaaggtttttaggaccttagggcaatatagagacaataaacccagctatgcgactcacaataccaaaggttttgccatgattgtggaatggcaagtgagtggttccggatggggaacccagtctgaaaaccgcatcattgataattttgattggcgatggacaaatcaatcccctgtgatgggacctgctcaattaacgaatggttctgtggaatatatctatttgcgaggaggggctaaatatcagctcactaagcataaaagtgttaaccatcaaattatcacccgcacttataccaataacaaacaatcggtggcaccaaaaggatttgtggcgaatgaagtacctaagtccagcgaacagaaagccaatgcaacggcgaatgcggtaaaccaacttgaaactaaggtgactgaggtctcaggtaaagtgacctctaccgcccagcaagtcactcgccttgaaagccaagtgggtacaagttcagccaaaattgaacaaacgtcgaaagtggtcaccgacataaatggcaaaatttccgcatcatggacaatgaaagttcagcaagatagcaaagggaataaagtcattacgggcattggcttagggtttaatgcacaaggaaatagccaatttctggtcaatgcccaaaactttgcagtgatatcgtcattaaatggcaaagtggtgacaccgtttatcgtgaagaatggacaggtggttgttaatgaagcttttattggtgatgcaactattaccagtgcaaaaatagctaatgtattgcaatcaaccaatttcagccatgcaaacaaggtgggctatcaacttaatatgcgcactggtgaagaaattaaatatgggaataatgctcaggggtactggattgaaacaaacatattaaaacgtttgtttgataaaaaaggcacaatgcgtatcagaatggggatatggtaa

SEQ ID NO: 1470 - DNA, 897 bp, Proteus mirabilis
gtcatgaattctgaagagataaatgaaccagacccattacttcgcgatgctatagagtatgtaattgaaaaacagagagtgtcaatatcaggtgtgcagaggcaattccgcatagcatacagtcgcgcagctaacataataaaagagatggaagctattggaattatttctgagtgtaatcacaataatagtagagatgtattaatactagataacttgagtgccgatttattaattgatgaatatttagaagtattgcaaaactctgaaaacaaaaatgaaccagatagtattaatgatgactttagttctgttgaaaaccagatgaaaagagaagctataataaataaaaggattgttatatggcttcatgatacagggcaggatagtgatgatggaacaaggatatacatattaaagtcatactctccatttgagcacttatttaatgcccaaagaagaccctcttcaatagataatgaccctggtggggatgttttagaagggtatagattttcagctacgatgcaaacaagaacaccattgagggtattaatccagcatggaagattggaaaagaaacctcttcataagttaccaaaaataattagaagcgaatgggaaggtatatggatccctcatacaaggtcgtggaaagatatggggatagatatgaaggaatggaatacagaaggaagtatggcttcacaaatagggcaaattccttcaaatggcggggattatttgaggtttttgatatttgccagaaatatcaaagaggcaaaagcatcaagcgaagaaaaaaggaatatgataaatttaggtcgttgcatgtatggtgaggaaggcactccatttaaagacttcattgaagactataatttcagtaataaataa

SEQ ID NO: 1471 - DNA, 213 bp, Proteus mirabilis
ttaattttctcaccgcccaacaggcttgcgatttggttaaataagctcatgcttgctccaataactatcaacgcattattacgttatattgagatgttaattttaaaggcgagtagtgtacgtgaagttagtatcttcatctatactcaagtgatatttatccgactaagcaagaatagaatgcaggattttattacgccaaagcgatattga

SEQ ID NO: 1472 - DNA, 516 bp, Proteus mirabilis
ccctttgtctctattatgaaaaactggcaccttctgtattgtaaacgcggacaaatcgctcgggcgatcgaacacttagaacgtcagcaggtgatctgctttacgccgatggtgacaatagaaaagttaataagaaataaaagaactttggtcaccgagcctttgttcccgaattatctatttattcaatttgatccagaggtcattcataccactacgataaattctacccgtggtgttaatgcctttgtgcgctttggacgctatcctgtcacagtgccacaagaggttatagataccttacaatcgccgacaccgtcttcagttatctacagtgaagaaaatgtgccgcatagtggtgattatgtattaattacggaaggtgtttttcaggggatcaaagcgatataccaagagccagacggcgaaactcgctctattttgctattaaaaatattaaataatgaagtgaaaaaatccgttgataataaagagtttaaaaaagagcctttctaa

SEQ ID NO: 1473 - DNA, 270 bp, Proteus mirabilis
gagagcagattaatggcacacaaaaaggctggcggctcgactcgtaacggtcgcgattccgaagcaaaacgtctaggtgtaaaacgtttcggtggtgaagctgtattagcaggtagcatcatcgttcgtcaacgtggtactaagttccatgcaggtactaacgttggttgtggtcgtgaccacaccctgtttgcgttagctgacggaaaagttaaattcgaagttaaaggtccaaacaatcgtaaatttatcagcatcgaagctgaataa

SEQ ID NO: 1474 - DNA, 237 bp, Proteus mirabilis
aatagtctatcacaatatattgatttatcttcgattattaacactcaagtattaccctctggatttaatactctgggtgatgtgagccttatatgcttaatagtttactcattgtgcttttgctgtgtgccattagcgcctttttttcgctgtctgaaatatcactggcggcctcccgtcgtattaaactcaaacagttggttgacgaaggaaatatcaacgccgctcgtgtattaa

SEQ ID NO: 1475 - DNA, 1215 bp, Proteus mirabilis
tttcggccatccagcacgttaatggctatcatacggagtaaaatcatgaaatttgttgatgaggccaagatcctaatcgtcgctggcgacggtggtaacggctgtgtaagctttcgtcgagaaaaatatatcccgaaagggggaccagacggtggtgatggcggtgatggtggtgatgtctacatggttgcagacgaaaacctcaacacccttatcgattaccgttttactaaatcttaccgcgctgagcgtggtgaaaatggccaaagccgtgattgtacgggaaaacgtggtcaagatattactattaatgtccctgtggggacgcgtgcccgtgatcttgctacaggtgagatcattgctgacttaacggtacatggtcaaaaacaaatggtcgctaaaggtggcttccatggtttagggaatacgcgttttaaatcatcagtcaatcgtgcaccacgtcaacgcacaatgggtacaccgggtgaatcacgtgaagtactgttagagctgatgctacttgcggatgtaggtatgttaggtatgccgaatgccggtaaatctacctttattcgagctgtctcggcagccaaaccaaaagtggcagattatccatttactacactagtacctagcttaggtgttgtgcgtatggacagccatcaaagctttgtcgttgcggatataccggggctgatcgaaggggctgctgatggcgcgggtcttgggatccagttcctgaaacatttagaacgttgccgtgtattattgcatttgatcgacatcgatcctattgatggttctgatcccgttgaaaatgccaaaatcattatttctgaattagaaaaatacagcgataaactggcacaaaaaccacgttggttagttttcaataaagtggatctgcttgatgccgatgaagcaaaacagaaagcacaagcgatagttgaagcgttgggttgggaaggtgattattatatgattgctgctatcaaccaagaaggggtgaaaaaactttgttgggatattatggaattcctgaaagtaaccccacgtgagcaagatattgctaccgctttagcagctgaagaaaaagttgattttatgtgggatgactaccataaagaacaacttgaaaatcctgactttgaagacgatgacgaagattgggatgaagaagatgatgatggtgtagagtttatctaccaacgctaa

SEQ ID NO: 1476 - DNA, 192 bp, Proteus mirabilis
atgataacatcaattcttcacagacgggaaaagcacagactatttagacaatattttgtgaacagggtgcgcgtatcaggcgatattttaaagcatgtttatctatttcttatcccctataataaggcaatattttccattcattcaatattcactatgatgaggtttctacagcgtgtagaaacaaaataa

SEQ ID NO: 1477 - DNA, 219 bp, Proteus mirabilis; identical to SEQ ID NO: 887

SEQ ID NO: 1478 - DNA, 300 bp, Proteus mirabilis
agtataactcctaaaatagttgaggaacataaaatgggcggtattagcatttggcaattactcatcatcgctgtcatcgtagtcttattatttggtactaataaactgcgcactttaggctcagatttgggtgcttcagtcaaaggctttaaaaaagcgatgggtgacgaaaaccaaaaagagaccaacaacgcagaaaaaaccacgaacgacgcagattttgatactaaaaatttagcgcagaagacttcgacagaagagaagtcaaccactgagagcaaaaataaagagcaggtgtaa

SEQ ID NO: 1479 - DNA, 1548 bp, Proteus mirabilis
cctggtaccccacttttaagttttgaagaggcaactaggatgaacaaagagattctggctgttgtggaagcggtctctaacgaaaaatctcttcctcgtgagaagattttcgaagcactggaaactgcattagcgacagcgactaagaaaaaatatgagcaagagattgatgtacgagtttgcattgatcgtaaaacgggggattttgatactttccgtcgttggcttgtggttgaagaagttactcagcctactcgtgaaatcacacttgaagcggctaaatacgaagagcctgaaattgaactaggcggcttcattgaagaccaaattgagtctgttactttcgaccgtattaccacccagaccgcaaaacaagtgatcgtacaaaaagtacgtgaagctgaaagagcgatggttgttgatcaattccgcgaacaattaggcgaaattatcacgggcgttgtgaaaaaagtaaaccgcgataacatcaccctagatttaggaaataacgcagaagccgttatcttacgtgaagatatgctaccgcgtgaaaatttccgcccaggtgaccgtgtacgtggtgtcttatacgatgttcgtacagaaactcgtggtgcacaacttttcgtaacacgttctcgtcctgaaatgctgatcgaattattccgcattgaagtacctgaaattggcgaagagatcattgagattaaagctgcagcacgtgatccaggttctcgtgccaaaatcgctgtaaaaaccaacgataaacgcatcgaccctgtgggtgcttgtgttggtatgcgtggtgcacgtgtacaagccgtttccagtgaactgggcggtgaacgaattgatattgttctgtgggatgataatcctgcacaattcgtgattaatgcaatggctccggcagatgttgcttctattgttgtcgatgaagacaaatgtacaatggacgtcgctgttgaaagcagtaatcttgcccaagcgattggccgtaatggtcaaaatgttcgcttagcagcacaattactgaaaaaacatcgtggtgatgacaaatgggaactgaatgtcatgactgcagatgaactgaatgctaagcatcaggcagaagcaaacgcagccattgaaatatttactaagcatctcgacattgatgaagacttcgcaactgttttagttgaagaaggtttctctacccttgaagagttagtttatgtgccgattgacgaactgttagctatcgacggtcttgatgaagaaacagttgaagcattacgtgaaagagcaaaagcggcattaacaacgattgaactagctcaaaaagaaagcctaggcgataaccagccagctgaggacttattagctctcgaaggcatggaacgttctttagcatttgatctagctgcccgtggtatctgcacactggaagatcttgccgaacagggtatcgacgacctaactgatattgacggtttaaatagtgagcgcgcaggcgaactcattatggctgctcgtaatatctgctggtttgggaatgatgcgtaa

SEQ ID NO: 1480 - DNA, 198 bp, Proteus mirabilis
tcgggtaccccttttggctcccatttactactacacccagttattaaaacgattgaaattaaaggtaaaaaaacaaatttcatattaaatattgtcataaaaagaagaattaagaatactaatcataaaacaaaactaatcactttgactattgtttttgaaaatgattcgcatttgataacgggggtgactaaatag

SEQ ID NO: 1481 - DNA, 891 bp, Proteus mirabilis
atacaaaccccaggctttctggggtttttttatataggtatcaacgaaatgaaattaattgccagaggaagagagcttaatttatcttcaccccaagtgatgggcattttaaatgtgacgccagattcattttctgatggcggaacgcataactctcttaatgatgctattaaccacgccgctaaacttattgctgaaggggcttctatcatcgagatcggtggtgaatcaacaaggccgggtgccagtgatgtttctgtcgatgaagagttacatcgtgttattcctgtggtcgaagctatccagcaacgttttgatgtgtggatttctgttgatacatccaaagcacaagtgatcacggagtccgctcaagcgggtgcctctattatcaatgatatacgttcacttaccgaacctggagcactgcaggcggctgcaaaaacggggttacctgtttgtattatgcatatgcaaggtttacctaaaacaatgcaacattcgccgcagtataagaatgtgatgatagaagttgatgcttttctggcagagaatattcaacgttgtattgatgctggtatcgagaaaaatcaaattattcttgatccaggcttcggctttggtaaaaatttagcgcataattatcaattattagcacatctaagtgattttcatcactttggtttaccgatactcgccggaatgtcacgtaaatcaatggtaggacagttactcaatgttccgccacaagagcgtgttgctggtagtgttgcttgcgcagttattgctgcaatgcaaggggcacaaattattcgtgtacacgatgttaaagagactgtagatgcgatgaaagtcgtgcaggcgactctttctgcaaaggaaaataatgaatga

SEQ ID NO: 1482 - DNA, 1533 bp, Proteus mirabilis
cttatagtgtttcaaagagggctttgccctcttttctctcactcactggctcgtaagattatgatgaaataccgcgatttaagagatttcctttcattactcgaagaaaaaggtgaattaaaacgcatcacctttgaaatagatccctaccttgaaatgaccgaaatagcggacagaacattacgtgctggtgggcctgcactgttatttgaaaatcctaaagggtttgatatgccagtgctatgtaatttatttggtacacctgagcgtgttgctatggggatggggcaagatgatgttaaagccttacatgaagtgggtaagctattagcatttttaaaagagcctgatcctccgaaaggatttcgtgatctttttgataagttacctaaatttaagcaagttttaaatatgccaactaagcgcctgagcaaagccccttgtcaggaggttgtgttaactggcgatgatgttgatttaactaagatccccgtgatgcattgttggcctgaagatgcagcccctttgattacatggggacttacagtaacgcgagggccatttaaagagcgccagaatttaggtatttatcgccaacaagtgcttggcaaaaataaggtgattatgcgttggttatctcatcgcggtggctcgttagatttccaagaatggtgtcaaaaacacccaggagaacgctttcccgtttctgttgcattaggggctgatcctgcgacaattttaggtgccgtaacgccagtaccagatacattatctgaatatgcctttgctggattattgcgaggtaataaaacagaagtcgttaaatgcctttccaatgacttggaagtcccggcaagtgccgaaattattctcgaagggtatattgaacccggtgagcttgcgccagaagggccatatggtgatcatactggttattataatgagattgactcttttccagtatttaccataacacatctaacacgtcgtaaagatgctatctatcactctacttatacagggcgtccaccggatgagccggcagtattaggcgttgcgcttaatgaagtattagtaccgatattacaaaaacaatttcctgagattgtcgatttttatttacctcctgaaggttgctcttatcgtttagcggttgtgaccatgaaaaagcagtatgctggtcacgctaaacgcgtaatgatgggagtttggtcttatttgcgacaatttatgtatactaaatttgtgattgtttgcgatgatgatgtgaatgcaagagattggaaagatgtgatttgggctatcacaactagaatggatcccgcaagagataccattatgatggaaaatacgccaattgattatcttgattttgcttcacctgtttcaggtttaggctccaaaatggggttagatgcgaccaataaatggcccggtgaaacagagagagagtgggggcgacctatcgtaatgacggatgaaataaaacagcgggtcgatactatttgggaacagctcgatattgttaaataa

SEQ ID NO: 1483 - DNA, 1395 bp, Proteus mirabilis
tcgttttcgttggggagggtgaactgttttttatgtcagaggaatgtaatgtctgctaatcaatcagcaaccacaggtaaactggataattattttaagcttaccgcccggggcactacggttcgtaaagagatgatcgccggtttaacaacctttttggcgatggtctattccgttattgtcgtacccagtatgctagggcaagcggggttcccccacacggcggtatttatcgcaacctgtttagtggcaggatttggttctctgttaatgggattgtgggcaaatctacctatggcgattggttgtgccatttcattaacggcgtttaccgcctttagtttggtacttggtcaacatatctctgtacctgttgctttgggggcggtgtttttgatggggtgcctatttaccctattttctttaacagggatcagaacgtggatcttaaaaaatattccgattggtatcgctcatggcgccggtattggtatcgggctatttttacttttgatcgcagccaatagtgttgggttagtggtgaaaaatccattagccggattacctgttgcgatgggagaatttacttctttttcagtattaatgtcattggccggtcttgctgctatttttggtctagaaaaacgtaaagttcccggtggtgtgttattagtcattattgcgatttcgattattggattgatttttgatcctaacgtgaaataccaagggttctttaaaatgccacaattaggcgaagagggccttgcactattatttgccatggatattaaaggcgcattacaaccacttgttttacctagtgtattagctttagtgatgacggctatttttgatgcgacaggaaccattcgcgcagtggcgggacaagctaatttacttgataaacgaggacaaattatcaatggtggtaaagcgttaacttctgattccgtgagcagtatatttgctggggcaattggtgcagcacctgcagcagtatatgttgagtctgcagcgggtactgcagctggtggtaaaacagggctcactgcaactgtggtcggtattctctttttattgatcctctttttatcaccactatcttatttagttcccccctatgcgacagcccctgcattaatgtatgtgggtttattgatgttaggtaatgtcactaagttagatttcagtgattttgtcgatgcgatgtcaggtatggtgtgtgcggtatttatcgtattaacgtgtaatattgttacaggcattatgttgggttttggctgtttagtgattggccgtatttttgccggtgagtggcgtaaacttaatattggtacagttctaattgctattgctttagtggcattttatgccggacactgggcaatttaa

SEQ ID NO: 1484 - DNA, 909 bp, Proteus mirabilis
tcggatttaccgatccagaaaaataagtcagaagaagaaaagaaaaaggataatagaatgtcaacactgactaagaaacttgaaaatgtgcgcttacaaggcaaagggacagagcaacgtctcgcccactatttattagaaaatagcgataatattgccagtatgaatgccgcagaattggcacaaaaagccggtgtcagtagtgcttctgttatccgtttttcccgccaaatggggtatggcggttatcctgaatttaaaattgattatctctcagaggaaaaacaacaaaaaagcagtagtgatattctttatgccaatttagccaaaacagactcgactgagcagattattgctaaaacaggacatctatttactaccgccattcaggattcgatagcgttactggatgcagcgacgatagatctactcgctgagaaaatgatcagcgctaaacggatcgttttatttggtgtgggcgcatctgcgatcgttgcgagcgatatcttccataaactgatccgagtgaataaaaacaccttatttagtgcagatctccatgcgcaacttgcttattcagcgaatttatccgcggatgatttggctattgctgttactgcaagaggtaatactgcggatattaatcgaatgctgaaagcggcaaaacaagaaggctgtatcacagtggctttaacacgttttgggcaagatgaagctacgcgcttagcgaattacacattaccttatttttatgatgagcaacattcacaattgggggtgatcacaccgcaagtattgcaaatggtcgcttttgatgtgctgttttttaaatatatgacactggcaaaaggctcagcggaaaaagcgctattaaaagggcgacaagctgtaatgcaaggaaatcaataa

SEQ ID NO: 1485 - DNA, 933 bp, Proteus mirabilis
cctgtattacctccttctgtgtctgggttattgcggtttctttccttaatcaggagaaacatcatgacaatgagacaggtaaaacaaatttattcagcacctaatccacattgggttggtaatggcttttctatgagcacagtattctcttataaagagaatgcagagcaatatagcccattcttattaatggattatgctgagcctacattatttaagcctgttactaatgcgcgtggtgttgggactcatccccaccgtggattcgaaacggtcactatagcttatcaaggcgaagtgtctcaccatgattctaccggtcatgccggtacaattgctgaaggtgatgtgcagtggatgacagccgcttcaggtattttacataaagaatatcactctgaaaaaatgacgaaagagggaggtatgcttgaagtcgtacaactgtgggttaatttgccaagcgcgtataaaatggcacaaccccgttatcaagcactaaaagcgcaagatattcctcatgtgcaattacctaatgcacagggctatgtccgagtcattgccggtgactatgcaaatacatctggtgttgctatgacctattcccctttaaacttgtgggatgtgcgcttaaatcatgcgggtacttcacactatgctatccctgagggacataatgcgatgctatttgtcgttaaaggtgcgatacatctcaataacagtgatattgtacgtcaacatgaaatcgcaatattagatacccacggtgataccctaacattaggatccatgggagacgctatcgtattaatattaacgggtgagcccattaatgagccagtagtaggacaagggccttttgtcatgaatacacaacaagagttattacaagcttttgatgactatgacaatggtaagtttggtatgatggattag

SEQ ID NO: 1486 - DNA, 333 bp, Proteus mirabilis
aatagaccgttttcaatcccaactaagcaaaaattaatgatgactcttaacaaaaaacaaattcaacacctgaaagggctcgctcatcatctcaatcctgtcgttatgatcggtaacaacgggttgactgaaggcgttcttgcagaaattgaaatcgctctggcacatcatgagcttatcaaagtcaaaatcgcaggcgaagatcgagatgttaaaaacttgatcgtggcagcgattgtgcgtgaaagcggtgcacagaatgtacaagttatcggaaaaatggttgttctttatcgcccttctgaagcgcgtaaaattattttaccgaaataa

SEQ ID NO: 1487 - DNA, 258 bp, Proteus mirabilis
gacgtgaagccattggcctcttgtgttagatttagtttagctttagataagggaggtttttactacttcccaaccaaaagggtagaaagttacaattattttctattcatcgaatatataaagggacaggccctcattaaggctgcctgtgtctttttttgtcttgagaagagtaaagtagaaccttttctctgtgttgttagtataaaaaatcaggatgatacctattttttattaggaatagtattgaggtattaa

SEQ ID NO: 1488 - DNA, 888 bp, Proteus mirabilis
gaaagacagttaattatgtggctactggttattacaacgttgttatgggcggcttcttttagtctgattggtgaatatctcgcaggtcaggttgatagttggatctcagtattgattagagtggtgttagctgccatcgtctttttgcctttcctacgttggaaaggcattcgccttaaagtgattttattgtatatgggagtaggcgcatgccaattgggtattatgtacctgtttgtgttccacgcttataactatttaaccgtagctgagtttttactctttactgtattaacaccactttatgtcaccttaatttatgatctacttgaaagacaacgtttacgttggggctatgcctttagcgcactactggcggtattaggggcggccattattcgttatgatcatcttagtgatgacttctggctgggattattattggttcagttagccaatattttcttcgccataggacaggtaggctataaacgattaatggaaatgcatccacttcctcaacatcacgcattctcttggttttatatcggggcggtggtggttgtgttagtcggctcgttatgttttgccgattggcaaaaaataccgaccacatcgttacagtggggggtattgctttggttaggtattggcgcttctggaataggctattttatgtggaactatggggcgacacaggtagatgctggaacccttgcgattatgaataatatgatggttccagcgggattattagtgaacttctctatttggcaacagcaccctaattggccaagtttcatcataggcgcgagcctgattgttgcatcactttggttccatcggcgttggatacaccaacctgttttacaaaaggcagatgattaa

SEQ ID NO: 1489 - DNA, 183 bp, Proteus mirabilis
atttgttttacctgtctcattgtcatgatgtttctcctgattaaggaaagaaaccgcaataacccagacacagaaggaggtaatacaggttatcgcgatttcttaatgagtatgatcataaattgttcgctctataaacaaaatagggggaatttgttgatggtattcaaaaaaaatgaatga

SEQ ID NO: 1490 - DNA, 444 bp, Proteus mirabilis
attatgtctacgccagactcgatcaaaataattaaacaatatatagccagtcaccatgtgtttaccttatgtacaactcgtgcattaggggatatttggtgcgcgaattgtttctattggttcgatgaaagcaacatgcgacttgtttttctctcagaaaaacatacacgacacgcacaaatgatgcaggaaaatttatttgttgcgggcagtattagtactcaagagctttctgtcgccaatctgcaaggcgttcaattcaccggtacagtgtctttattaaccgctaatgacgacatcagagcaagaaaacagtattgcttacgtttccctgtggcgctagccgccatccatgtgcctttatggcaattacaattgcaagaaattaaaatggtgaataatcagctaggctttggtactaagctcttttggcaacgtcactaa

SEQ ID NO: 1491 - DNA, 642 bp, Proteus mirabilis
aatttggagtttaccttgcaacataaagcttatcatcctgagcatgccgtaatcggcagcacaacgccattagaaatttctgctaatcatgccgtcaatgggcattctatccgtgagatcccagaaaatatgcaaattgcttattttgccatgggctgcttttggggcgttgaacgcctattttggcaacaacccggtgtttatagcaccagtgccggttatagcggtggtgtaacagaaaatcccacctatgagcaagtttgccaaggccgtaccggtcatgcagaggtcgttcgtgtggtatttgatccgacccttatcagctatcaacaattattggctattttttgggagaatcatgacccttcccaaggtatgcgccaaggtaatgatattggtagccaatatcgctcggccatttataccctaaccccagagcaatatgcacaagctattgagtcaaaacaacgttatcaacaagctatcaatagtgaaggggcacataaagagatcaccactgaaatacaacctgccggacctttctattttgctgaagattatcatcagcaatacctatttaaaaaccctcaaggttattgtggacttggtggcattggtatctgttttccaccggcaaactaa

SEQ ID NO: 1492 - DNA, 402 bp, Proteus mirabilis
aaacaggagttctacatgtcttacgaaattaataccgaaaaagcccctgcagcaatcggcccttatgtacaaggtgttgatttaggtaatttagtgatcacatcaggccaattacctgttgatcctgctacgggtgagtttgtgtctgacaatgcggcagagcaagcacgtcaatctttagaaaacgtcaaagcaattattgaaaaagcaggtctaaccgttgctaatatcattaaaacgactgttttcgtaaaagatttaaatgatttcggtactattaatgcagcttatgaagctttctttaaagagcataatgcagcattcccagcacgctcttgtgttgaagttgctcgtttaccgaaagatgccaaagtagaaatcgaagttatcgcgatccgctaa

SEQ ID NO: 1493 - DNA, 276 bp, Proteus mirabilis
gtacgtagtacagaaatagtatcagctaaggtttccccttttttacctaaagaggtgttactaccatctgcaaagccaaccacagacgcccctaaacggtggattgctgtttcaaaagataagcgagtgcgggtggaggcttcaaaaaaacaactggcaatcactttgtcttttaacaattggctattggggtgctgttttaatttgtcagcaacatggagaacagactccagatcgtctcggttcagatcattgatggagataatatgcttatga

SEQ ID NO: 1494 - DNA, 246 bp, Proteus mirabilis
acaaaggtcacaccgataacggattttacattacccgctcttactctttctcccgtttcaccatacgaagcagatagccttaaactcacactattattcgtcacattgcctaatttgaccggtgtattagcaggaataacaccattattatttgatattttaattccaacccctttagcaggagagttagatgatatattggtaaagaccgtattattcacatcagacgttgatcctgttaaatag

SEQ ID NO: 1495 - DNA, 672 bp, Proteus mirabilis
ttgcattacacaaagggtttaaattctaagatggaaaaagccactttttctcatgatattgcttctcaagtgctctatccactgataactgcatcgatggaaacggcacttaatcatgttttatatcaggaaaatgtgcttaaacctgcccgcaatcgtcttgcgggcaaagtcttggcgctttctattaatgagtttcctcaatctatctatttaattttcagcgaacagcaagttgatgtgttaactcaatggaatgatgagactgattgcacgataaaaactaaattattaaccttaattaaactcactgaccgacaaaagttgtctgaattaattaatcgtggtgatattaccattgaaggcgatatgcaggtggtacaaaactggtctgccttgctggatatggcaccctgggagcctgcgcaatatttagcgccttatattggtgatttggctgcagaaggattatcgcttgcagcaagtaaagggctcaaattattcactacactatttggccgacaaaaagcttatttaagagacgctttgattgaagagtggaaaaccgccccctcaacattagagactgtccatttttatgatgaaatagaacaactggcacagcaaacagccgagttagaaaaacggttaagcaccttggagaaaaaataa

SEQ ID NO: 1496 - DNA, 867 bp, Proteus mirabilis
atatatgacactggcaaaaggctcagcggaaaaagcgctattaaaagggcgacaagctgtaatgcaaggaaatcaataatgttatttatcaccatattagctgttggtgcggcgattggcttaattattagcacaacgggggtaggtggtggtgttattgttttacctatattaacgtatttctttggtatgaatgcattaatggcggtggcaaccgcaaatttactttcaatgttgatgaaagtgacatcctcatatatgcatttccgtttggggaatattccctttaaacgagccatgatagtccttgccattatgttgccaagtacttttttagcgagtttactcgtcaattatttaggttcattagcgcaatatcagcagcaagttgagtgggggattaatgcgctggtggtggctgccattattttttctctctttttgtttattcaaagaatgtttttctcttcacctgtgatagctaaacagataaccccattagcgcctcttaatattaaggcactgttattgccggcgattgcagcaggtgttgttttaggtgccacaggggtcggtggtggtgtggtggtgttacctttattattgcgttacgccaatctatcgataaaacaagcgataggtacttcgatttttacgaccaccctattatcaggctcttctgcattagcttatatgcaagatggtcataccgatattcatttagcattgctgctgtttcttggctctttgatctccattcctctatcaaaatggctattaattaaaatgccggatagggtatttcagtatgcaacgttgtttttaattttatgcagcgcttttatgatgttggcgagattgttttaa

SEQ ID NO: 1497 - DNA, 474 bp, Proteus mirabilis
actatgcgcactccttctaagcaagaagacttggttaaagcatttaaagccctgctgaaagaagaaaaattcagttcacaaggcgagattgtaactgcattacaagaagctggttttgataatattaaccagtctaaaatctctcgtatgctaacaaaatttggcgcagtaagaacgcgtaatgccaaaatggagatggtttactgcctgccaacagaacttggtgtacctacagcaagtagcccattgaaaaatttggtacttgatattgaccataaccactcagtagtggttattagaaccagccccggtgccgcacagcttattgcacgtttattagattctttaggtaaagcagaagggatcctcggaagtatcgctggtgatgacactattttttctacacccgcgccaggattctcaacagaagaactacgagatgcgattttaaacctatttgatcaggaattataa

SEQ ID NO: 1498 - DNA, 198 bp, Proteus mirabilis
tttaatctaacttcattatattttaatatatattcatcatctttatttaaaaacataattatattaatagatggcaacataaatatgagcaatattgaaaaaaatgaaataacaagaaaaaaagcaataatgaaaatattttcgctagagattattgaacttaaaaataaatctaaccatcctattttattcaagtag

SEQ ID NO: 1499 - DNA, 729 bp, Proteus mirabilis
cgcagcataacaatgaatatattaatcgttgatgatgagccgcttgctcgtgaaaatttacgttgtttactcgaagaagaaaaagatattcatattattggtgaatgcagtaatgctattgaggcgataggggaaatacatcgtaaaaaacctgatgtggtttttcttgatattcaaatgccacgtattactggcttagaaatggtctcaatgcttgatcctgaacatcgcccttatattgtctttttaacggcatttgaagaatatgctattcaagcattcgaagagcacgcttttgattatttgctcaaaccattagagcaagagcgtttagccaaaacattaagtcgtttacgccaaggcaataaacaaaatattgatttattatcaccacctgaagaacgcttaaagtgcattccttgtactgggcatagccgtatttggctaatgccaatcgatgaagccgtgtttgctacatcacgattaagcggtgtctatgtcaccaataatcaagggcaagaaggttttactgagcttacattacgtactttagaaacacgcactccgctggtacgttgccatcgtcaatatttagtgaatatggattatgtcaatgaaattgtttttggtgataatggacaagcagaacttattttacataataataaacaaattccggtcagtcgacgttaccttaaacccttaaaagaagcgattggcttaatttaa

SEQ ID NO: 1500 - DNA, 759 bp, Proteus mirabilis
cgagtaacaaccgctatgagcgaagatattatttatggtattcacgcagtaaaagcactgcttgagcgtgatccgacacgttttaaagaagtttatgtgttaaaaggacgcgaagatcgtcgtttaatgccggtgatccatgcgctggaagaacaagggattttagttcaagttgctaatcgtcaatggttagataatcaaactgaaggtgcggttcaccaagggataattgctaaggtaaaacctagtcgtcagtaccaagaacaaaatttaccggacttattagctgaagtaggtacaccttttctattagtgttagatggtgtgactgatccacacaacttaggggcatgcttacgtagtgctgatgcggcgggtgttcacgcagtcattgtaccaaaagatcgctcagctcaattaaatgccacggcgaaaaaagtcgcttgtggtgctgcagaaagcgtacctttgatccgtgtaaccaatctggcacgtactttacgcttactacaagaagagaacatctggattgttggcaccgcgggggaagcggatcatacattatatcaaagcaaactcacagggcctttagctttggttatgggggctgaaggtgaaggaatgcgccgtttaacccgcgaacattgtgatgagttaatcagtattcctatggcaggctcagtctcttcattaaatgtctccgtggcaaccggagtttgtttatttgaagcaatgcgtcagcgtatttctgtaaaataa

SEQ ID NO: 1501 - DNA, 1704 bp, Proteus mirabilis
aatagaacaactggcacagcaaacagccgagttagaaaaacggttaagcaccttggagaaaaaataatgctcctcagtgagttaaagcgcctttatcatattattaaagtcttcttatcttatgggcttgatgagttaattcctaaacatcgaattaccttgccggcaagattggggtgccgagcactattttggatcaaaaatcagcatgccgataaaccattaggtgagcgcttacgacttgcattacaaacattagggcctgtttggataaaactgggtcaaatgttatcgactcgacgtgatctttttcctcctcatatcgctgatcagttagcgttactgcaagataaagtagccccttttgatggtaaaaaagcgcgacaatatattgaaaaatcatttggtggccctatcgataaatggtttgatgattttgacgaaacacctcttgcttctgcgtcaattgcacaagtccataccgctacattgaaagaaaatggtaaagaagtggtattaaaggtgatccgtcctgatattcagcctgttattaaagcggatattcgtttgatgtatcggttagcgaatttattgccatttttacccgatgggcgtcggttacggcctaaagaagtgatccgcgaatatgaaaaaacattacttgatgagctaaacctattacgtgaagacgcaaatgccattcaattgcgtcgtaactttgaaaatagctctatgctttatattccggaagtgtattcggattattgccatgaaaatgtaatggtgatggagcgtatttatggtattcctgtttcagatattgatgcgttaaatgcccaaaataccaatatgaagctattggcagagcgtggggttaaagtcttttttactcaagtatttagagacagttttttccatgcagatatgcatccgggtaatgtatttatcagttatgatcatccggaaaatccatactatattggcattgactgtggtattgtcggctcactgaataaagaagataaacgttatttagcggaaaacttcttagcattctttaatcgtgactatcgtcgtgtggctgagttacacgttgattctggttgggtacctgctgataccaatgtagaagattttgaatttgctattcgcacagtgtgtgagccaatctttgaaaaacccttgtcagaaatttcttttgggcatgtgctactgaatctttttaatacggctcgtcgttttaatatggaagtacaaccgcaattggttttactgcaaaaaactttgttgtatgttgaaggcttaggtcgtcagctttatccacagcttgatctttggaaaacggcaaaacctttcttagaagattggctacatagtcaaattggtattactgcgttggtaaatggtatcaaaagtaaggcgccttactggattgaaaagatgcctgaattgcctgaattggtttatgatagcctgaaacaacacaaaaatatgaagttaacgctagaaaaattgacggaacaaataagttcacagagagtcaaacaaagacagtcctattttttattgggtatgggaacaacgctatttttatgcggtagcctgttttttgtttctggttttaaaacattatttagtgtttttatcagtttaggccttctcgcatggatttggggctggtttaaatcaggtaatgcacaataa

SEQ ID NO: 1502 - DNA, 891 bp, Proteus mirabilis
gaaatgaaaacatttctgcgcggttgttctattgctgttttcatctttatttccgggtgcagcactagtccagaatggcgtaagaatgctatttttgctactccactacagccttctttacaacaagaagtgatattggctcgtatagaacaaattctggcgagccgttcattaaccgaagatgaatatgcacagcttttatatgagcgtggtgtgctgtatgatagtctcggtttaagagcattggcgcgcaatgatttttcaatggcgttgtcaatgagaccagatatgctagagatttttaattttctaggtatctattttacgcaagcagcgaattatgatgctgcttatgaagcgtttgattctgttttagagcttgatccaacttacaataatgcgcgttttaatcgtggtatcgctttatactatggtggccgattgaaattggcgcaggatgatctgcaggcgttttatcaggtcgatccaaatgatcccattcgttcgctttggttatatcttgttgaaaaagagatagactctgattctgctaaaaaacagctgaaacagcgatacctacaggcgaataaaacgggacaatggggatggaatatagttgagttttatttaggtgacattagtgaaaaaacattaatggaaaggctaaatgagacgtcaaccgataacacttcgctcgctgagcatcttagtgaaactaacttctatttaggtaaatattacctaagtctgggggacatggatagcgctgaagcgttattcaagctgacggttgccaacaacgcacataactttgttgagcaccgctacgcattgttggaattagcactgttaggccaacaagaagacctagcggaatcggaccagcaatag

SEQ ID NO: 1503 - DNA, 1194 bp, Proteus mirabilis
catcagagaactcgcttaaggagagaagaaatggaaaaggttgtcataattgatggtgttcgcaccccaatgggacgttcaaaaggtggagcatttcgccatgtaagagctgaaaatctctctgcgcaattaatgcaagctttgcttaagcgtaaccctgatattgatcccaatgatattggcgatgtgatttggggctgtgtgcaacaaactttagagcaaggctttaatattgcacgtaatgccgcactattagcagaattaccacataaagttccggcagtaaccgtcaatcgtttatgtggctcttcgatgcaagccttgcatgacggtgctcgccaaattatgttaggagagagccaagttgctttaattggtggcgttgaacatatgggtcatgtaccgatgacctataatgctgactttaacccagcattaaatctttctgtggcaaaggcttcattctcaatggggttaactgcagaaatgttagcaaaatcatttcaaatatctcgcgaagaacaagacaaattcgcctatcgctcacaccatttagccgccctcgcgacccaaaaaggctattttgacaacgaacttgttgccattaatggtcatgatgcagcaggagattttatacgcgtcagcacggatgaggttatccgttataacccaagtcttgatgaattagcacaacttagacccgtgtttgatcccgccacgggctccgtcactgcggggaattcatcggccgtctctgatggggcatccgcgatgtttatcacgagcgaaagttatgctaagcaacatcatttaaaaccccgtgcaattattcgttcgatggcggtaacaggttgtgatccggcaatcatgggatatggtcccgttcctgccactgaaatagcgctaaagaaagcagggttaaccctcagtgatattgatatctttgaacttaacgaagcctttgcagcgcaatccttagcttgcatgaaaaaaatgaatttactcgatagcattgatgacaaaatcaatcttaatggtggtgctattgcacttgggcatccattaggttgttctggtgccagaataaccaccacgctattaaatattatggagcgtaaagatgcacaattaggattagcgacaatgtgtattggattaggccaagggatagcaaccattattgagcgagtttaa

SEQ ID NO: 1504 - DNA, 1311 bp, Proteus mirabilis
gcacgtatgacaattgaaatcctagataaagcagaatatatcagactattgagaaaaaaacttggattaggtccaacagaaatggcaaatcttctaggtatgaatgcgacaggagaaagaactatacgtggttgggaaaatggtgaacatactccaacacctgcaaaatggcaaagcatacttgacttggaaaaatcgttagccaaacattcaaaaaatgcaccattcaaacaaaaatctttagaagaggctgattttacttttattgatttatttgcagggatcggagggatacgtttgccattccaaaatcttaatggacactgtgtattttcatccgaatgggataaattttctcaaagaacgtatttaacgaattatggagaaatgccgaacggagatatcactcaaatctcagcaaaagatattcctgaccatgatatattattaggtggcttcccttgtcaagcattctcacaagctggattaaagcaaggttttaacgatactcgaggaacaatgttttttgaaatacagcgaatacttgcagaaaaaaaaccgaaagcattcctcttagagaatgtaaaacagcttcaagggcacgataaaggacgaacactacaaactataattaacatattacaagggaagcataatcaagctatacctgatgatgttccaatgagtgaagaagcacgtcatgcactctctataaaacttaattattgggttgattttaaaatactacgcgctgcagattttggcatccctcaaaatagagaacgaattttcatcgtaggctatgacagggattattttaaaaatatagactttgatagcctatttaaatggcctattccaccaaaatcagatactcgagttggagatattcttcaaccacaggaagaattagaagccgagatcaaaaaaataggtaaagacaaatatactatttctgaccaactatggaatgggcataaaaaaagaaaagaagagcataagataaaagggaatgggtttggttatacattatttaattccgaaagcgaatatacaaatacaatcagtgctcgctattataaagatggctcagagatcttaattgaccaaagccaccttggtaaaaaccctagaaaattaacgcctagggagtgtgcgaatcttcaaggattccccaaaaactatattgtcgatgctgtatctcaagggcaaatttataaacaatttggtaattctgtgtgtgttaaagtagtagaggctgttgctacaaaaatgattgagacactattagttctttcaaaaaagaattga

SEQ ID NO: 1505 - DNA, 1227 bp, Proteus mirabilis
gatggcaagacttcccataaaggtgccacaaataccaagaatatgaatgtgcatgaatttctttccaatagcatgaagttggtcactattctaaccatcaaaaagcagattagaaacggattaacctttgaatcatgcgattctttggataaacttgccactaataaggaaacttttttcctttttatattttatccattcacattcaggacccacgtcatgaaaacattaggcgaatttatcgtcgagaaacaacaagattttccccatgcaactggcgaattaacggcattactgtcagccattaagcttggggctaaaattattcaccgtgatattaataaagctgggttagtcgatattcttggcactaacggtgtttctaatgttcaaggtgaagcccagatgaaactggatctttacgcgaatgagaaactaaaagcagcacttaaagctcgtggtgaagttgcggggatcggttcggaagaagaagacgatatcgttatctttgaaggtgatcgtgcggaaaatgccaagtatgtggtattaatggatccattggatggttcttctaatatcgatgtaaacgtttccgttggtactattttctctatttaccaccgtattacgcctattggccaaccagtgacactagatgatttcctgcaacccggtaatcgccaagttgctgcgggttatgtcgtttatggctcatctactatgttggtttacactaccggttgtggtgtacatgcctttacttacgatccttctttaggggttttctgtttatctcacgaaagtgttcattttccgcctaccggaaatatgtattcaatcaatgaaggtaactacattaaattcccattaggggtaaaaaaatacatcaagtattgccaagagcaggatgcagcgactaaccgtccttatacaactcgctatattggctctttggttgcggatttccatcgtaacttgctcaaaggggggatttatatttacccaagtacggcaagtcatccaaatggtaaattacgcttactttatgaatgcaatccaatggcattcctcgcggaacaagcgggtggtaaagccagtaatggtaaagatcgtattttagatatcaaaccaacagagttgcaccaacgcatgccattctttgtgggtactaaagcgatggtcgaacaagcagaagcatttatggctcaatatccagacgaagaataa

SEQ ID NO: 1506 - DNA, 777 bp, Proteus mirabilis
gtgatagagaccaaacagcatgaacgtttgcgtcgccttagcgaatgcataaaacgctcaggccgcatccatctcaaagatgccgcgaggatccttgaagtatctgaaatgaccattcgtcgtgatctcagttcagatgttgaaaacccctatccgatgtcactgcttggtggctatattgtcgcgttggcacaacctcatagcaacctaatcacatcgactagtgatattatcaccccggatcaaacccaagaattacatattcctaatcttgctgcgggcatggtgtctgaaggtgatgtactattttttgataatggccaacttattccgacattaattgagcttattcctgagagtttacactttactggtatttgttattcgcaccgcgtttttctggcattaagccgaaagaaaaatgcgactgtactactgtgtggtggcgaatatcgccctaaaagcgactcattttataatcccctccagccttgttaccttgataacataaacccgaaaaaagcctttatttccgcagagggtgtccacctcgattttggtgtttcttgctacaacatcgatgatcttcatatgaaaagaaaagcgatggataaatcgattcgcaagatcttactcaccaaataccatgccttcgatgaaaccgccacaggcaatatgggcgatttagcgcaatttgatgtcgtgatcaccgatagaaaattaacagatgattacgaagcctattgccgaaaaagctcagttaaaattatttattaa

SEQ ID NO: 1507 - DNA, 246 bp, Proteus mirabilis
attctggagactagccatatggcacgttatttccgtcgtcgtaagttctgccgtttcacagcggaaggcgtacaagagattgattataaagacatcgctacgctgaaaaactatatcactgaaagtggtaaaattgtaccaagccgtatcaccggtactcgtgcaaaataccagcgtcagctggctcgtgctatcaagcgcgcgcgctacctgtctttattaccttatactgatcgtcatcagtaa

SEQ ID NO: 1508 - DNA, 1023 bp, Proteus mirabilis
tcaaggaggacaataatcatgcgtaaagttatcgctgttgttgcagttattattttagcgttgttgtactcctcagtatttgtcgtgcaacaatatgaacgcggtattattttacgtttctcgaaagtggtacgtgatggtgaaaataaaccggtcgtttatgaaccgggtattcactttaaaattccatttattgagaatgtgaaaaaactggatgcgcgtatccaaacgatgaatatccagcaagatcgcttcttatcaggtgagaacaaagacttgttagttgactcttatctgaaatggcgtatcagtgattttagtacttactacctagctactggtggtggtaatacgatgcaagcagaaaccttattgcgtcgtaaatttagtgaccgtttacgctctgaaattggtcgtatgagtgtaaaccaaattatcactgattcacgtggtcgtttaaccattgatgtacgtaatgcgttgaatgaaggtacaccttctcgcgataaaagtgatgcagatgatgctattgctattgctgcgaagaaagtggccgaagagaccaaaggtaaagctcctgctatcaatatgaacagtatggcggcattaggtattgaagtgattgatgttcgtatcaaacaaatcaacttaccaatggaagtttctgaagccatttatcaacgtatgcgtgcagagcgtgaagcggttgctcgtcgtcaccgttcacaaggtcaagaagaagcggtgaaaatccgtgctgcggcagataaaacagtgacagaaaccttagctgaatcggagcgtgaatcgttacgtattcgaggtgaaggggatgcgcaagcaactaaactatttgctgatgcattcagtcaagatcctgacttctatgcgtttatccgtagcttacgtgcttatgagaatagctttaataaagacggtaatgacgtcatggtgttaagtccagatagcgatttcttacgctatatgaaagcaccaactaaagcgagagcgattgaagagtaa

SEQ ID NO: 1509 - DNA, 1230 bp, Proteus mirabilis
atactctttgcggacaatctcaaaagtaatcctttctttttactgtccgccaatcacgttattttttatcctttacaatatatggattggaatatggacaaatgtgttcattatttatctgatcgcgtttgttatatcgcctcagataaaacttggattgaaagtaaagcaatccaacaactagtaacaaccgctcaacttcctgaaatggcttatgtcactggcatgccagacttacatcccggtcgtggttatcccattggagcggcttttttttctgttaaccgtttttaccctgctttagtcggtaatgacattggctgtggtatgacactgtttcaaacagaatttaaccatagcaaactcaatttagataaaatagaaaaaaaattgagcgaaatgagtgatatcgcgcccatcgaatggttgatagataatttacctgcagatatgcaaaatcatccatttgctcactcattaggctctattggtggtggaaatcactttgctgaattccaacaaattgaccaagttattaatcaagcattgtttacaaacagtggtattaataaaaaacaattattgctattggtgcatagcggttcacgtggtttagggcaatctattttacgtgctcacacagagcaatttggccatcaaggactggtcgcgaatacagacgctgccaatgactacttacaagcccatgaccatgctcttaattatgctaagctcaatcgccacttgattggccatagaatgatggaacaaattcatacacaaggaacggttattactgatgttaaccataatctggtagagccttgcgaattatataatcaacagggatggttacatcgcaaaggggcgacgcccgcccatcacgatattgtggttattcctggttcacgtggtgatcacagttatctcgttaaacctattatctctgaattaagcctccattctctaccacatggtgcgggtagaaagtggatgcgaactgagtgtaaaggccgtttatcacatcgatttacgccattacagctctcacgcacagcactaggtagccgtattatttgtgctaataaacaattaatttatgaggaagcgcctcaatcgtataaatcaattgaaactgttatagaaagtatgaggagtcttggtttaattgaggttatcgcccgcttaaaaccggttattacttataaaaccagtggggagatagcataa

SEQ ID NO: 1510 - DNA, 327 bp, Proteus mirabilis
aaacgatttgcacacacgcaagtctgtccggcgttacggaatttcgcccccatagcacctgcaaccgctttctcaatatcggcgtcattaaagacaataaatggcgcatttccccctagctccagtgagacttttttcacactgtcagcacattggcgcattaataaacggccaacccctgtagagccagtaaaactcaatttacgcacgcggttgtctgatgtgaatacttcaccgattttaactgcatcaccggtgacaatattaataacaccggcaggtattcctgcttgcgcggctaattcagctaacgcaagggctgtatag

SEQ ID NO: 1511 - DNA, 426 bp, Proteus mirabilis
cgtaataatgcgttgatagttattggagcaagcatgagcttatttaaccaaatcgcaagcctgttgggcggtgagaaaattaatcaattcaaaacagtactcgaatgggtagaaacccaagggggaattgaaggcttggttaaacagtttaatagcgcaggattaagtgaactgatccaatcttggattagcacaggcagtaatttacctattaatgccgagcaaatcgtacaagttttttcatcgccagtgattaatgaattggctgcaaagatcaatatgaataccgctgaagcctctgatatggctgcacaatatttgcccaaattggttgataaactcacgccagaaggtgttatccccaaagagttagatttaatgagcgccggtatggatatgcttaaagcaaaaatctttggtggctaa

SEQ ID NO: 1512 - DNA, 579 bp, Proteus mirabilis
agatgttgtgcttttttactgaaattaaccgaatttaaggtctctattgtgacagtacaagacattattcataccatcactctgtttgtaaaagagcacgaaatatgggctgtgcctatcgtgttcttactcgcatttggtgagtcacttgcctttatctcgttattaatacctgccactgtaatcctattaggcctaggagcattaataggtgaaagtggtctactcttttggccgatttggcttgccgccgccctaggcgctttttttggtgattggatctcctattgggtgggttatcactataaagagggggtaagaaacttatggccgatttctcgctcaccgcagaccttggtaagagggcatcaattttttaatcgctggggtgtttggggggtatttattgggcgattttttgggccttttcgggcaatagtgcctttagttgcgggtatttgtgctatgccacaacgctattttcagttggcgaatttggcttctgcgatgatctgggcatttggtattctggcaccaggggcgtttggtctgcaatggctggcgaaatggataggataa

SEQ ID NO: 1513 - DNA, 489 bp, Proteus mirabilis
cgaccaaccgcatcgatttcatcgataaagatgatacaaggtgctgcttttttagcctgttcaaacatatcacgaacacgagaagcaccgaccccgacaaacatttcaacgaagtcagaaccagaaatagtaaagaaaggtacttttgcttcaccagcaatcgcttttgctaataatgttttacccgtaccaggaggaccaaccattaggatacctttcggaattttaccacctaatttctggaaacgacccggatcacgtaaatactcaactagctcgctgacttcttcttttgcctcatcacaacctgcaacatcagcaaaggttgttttgatttggtcttctgtcaacatgcgagccttactcttaccaaaagacatcgcacctttaccgccaccaccttgcatttggcgcataaagaagatccaaagaccaatcagtaaaagcattgggaaccaagacacaaaaatttgtgttagaaggctttga

SEQ ID NO: 1514 - DNA, 642 bp, Proteus mirabilis
ttggaaaacgcaatggccaataaaaaacgttcggcaagctctagccgctggttacaagaacattttagtgataaatatgttcaacaagcaaagaaaaaagggtttcgctctcgagcttggtttaaattggaagaaattcagcaaagtgataacattttcaaaccaggtatgaccgttgtcgatttaggtgctgctccgggtgggtggtctcaatatgtcgtacagcagttaggaaataaaggtaggatcatcgcatgtgaccttttacctatggatcctatcgttggtgtcgatttccttcaaggcgattttcgtgatgaacttgtattgaaggcattgcttgatagagtaggtgataataaagtccaggttgtcatgtctgacatggctccaaacatgagcggaacacccgcggtcgatattcctcgatccatgtatttagtagagttagcgcttgatatgtgtcgtgatgtgctggctcccgggggaagttttattgtcaaagtgtttcagggagaaggctttgatgagtacctggggcaaatacgctccctgtttacgaaagtgaaagttcgtaaaccagacgcttcgcggtctcgttctcgtgaggtatatattgtagccacagggcgtaaactttag

SEQ ID NO: 1515 - DNA, 534 bp, Proteus mirabilis
tgtatgagcgcgctgttgctgtactgcagtacagatggtcaaactaaaaaaataatgacgcacatagctaatgaactaagacaacagggctatgaatgtgatgtaagagatttaactgctgttcaccatagccttaatttatctgcttataataaagtgttagttggggcatcaattagatatggctattttaataaagtgctggataaatttattacccaacacctttctcaattaaatagtatgccatccgctttcttcggggtgaatcttacggcaagaaaagctgaaaagagtacacccgaaaccaatgcttatatgcgtaagtttttagataagactccatggaagcctagattaacaggtgtttttgcaggcgcgcttctttacccacgttataaatggattgatagagtgatgatccagcttattatgaagatgactaagggtgaaaccgatccaacaaaagaaatcgaatatactgattggaataaagttagcgaatttgcgacaaaattttccaaaatcgagtga

SEQ ID NO: 1516 - DNA, 651 bp, Proteus mirabilis
ttcgtgtatttgttgcttatttttacctcaaaaggcaacctgtacggcaaaaaacgggtattgttaaaaacttttcgctatactacgagccacgtcaaattaatttttcataggaaattttttatgagcctgaatcatgttcctgctggtaaagaactaccagaagatatctatgttgttattgaaattccagccaatgctgatccaatcaaatacgaagttgataaagaaagtggtgcactgttcgttgaccgttttatgtcaacagcgatgttctacccatgcaactacggttacatcaacaacacattatctttagatggtgatccagtagacgttctggttccaactccatacccattgcaaccaggttcagtcattcgttgccgtcctgttggcgtactgaaaatgactgatgaatcaggtgaagatgcaaaactggttgcagtaccacacaccaaactaagtaaagaatacgatcacattaaagatgtgaacgatctacctgaattattaaaagctcaaatcaaacacttcttcgaacattacaaagatttagaatctggtaaatgggtaaaagttgatggttgggaaggcgtagaagcggctaaagctgaaattctgtcttcttttgaacgcgcaaaaaaataa

SEQ ID NO: 1517 - DNA, 321 bp, Proteus mirabilis
actgttatttataccactaacacagcatttaattttatagaaaaaggattaaaaatgatttcaaggaaatctgattggcatcctgccgatattattgccgcactcagaaaacgaggcacaacactggcagccatctctcgccaagctggtttaagctcttcaacactggctaatgcactgtcacgcccttggccaaaaggtgagaaaatcattgctgactttctaggtgtagcgccttcggaaatttggcccagtcgttattttcatcctgaaacaggagaattacttgaacggaagatacgcgacaaaaccaataattaa

SEQ ID NO: 1518 - DNA, 360 bp, Proteus mirabilis
gttttaatttatatgcgaattattgtttatggaagtttacggcgaaatcagggtaaccatcactggatgacctacgcacagctattaggtgagtataaattagcggggtataaactctatgatttagggttttatcctgctgtggttgaaggtgatggtgaaatagaatgtgaagtttatcggatcacgccttccattttgacggagcttgatgaactgaaaaaaaatgatcaagattacaagcgccagttgatatcaacaccttatggtagtgcttggatctatctttatcaaaagccagttgatgggttgcgagaaatcaaaagtggagattggctaaaacgccacgaagaagagtaa

SEQ ID NO: 1519 - DNA, 1386 bp, Proteus mirabilis
tgtgagccttatatgcttaatagtttactcattgtgcttttgctgtgtgccattagcgcctttttttcgctgtctgaaatatcactggcggcctcccgtcgtattaaactcaaacagttggttgacgaaggaaatatcaacgccgctcgtgtattaaaaatgcaagaaacccccggtatgttttttaccgtggtacaaattggtcttaacgccgttgccattttggcgggtattgtcggtgaatctgctttttctcccgcattaaaagatctcttttcccgctttttagaagcacctctcgcgcaacaattaggatcggtctgttcatttattatcgtcacatcgatgtttattctgcttgccgatttaactcctaaacgtatcggcatgatcaagccagaagtcattgcactgaaaattgttaatcctatgcgtttttgtctcgccttattccgccctttagtttggttgtttaatggcatggcagatcttatctttaaactatttaaaatcccgatggtaagaaatgaagatattacatctgatgatatctttgcgattgtcgaagccggtgcagtagcgggggtattacgtaaacaagagcacgaattaattgaaaatgtctttgaattagaatcacgtaccgtaccatcagccatgacaccacgtgaagatgttgtctactttgatcgcgaagagacagaagaagatattaagcataaaattgccactcagccccactctaaattcttagtttgtgaaggggatatagaccatattattggttatgtagattcaaaagagctactcaaccgtgtgatcaatgggcaaagtcttaacctcaaagaaggtgtgcatatccgtaaagcccttattattccggataccttaactttatctgacatgctagaaagctttaaaacctcaggggaagattttgccattattctcaatgaatatgcgatggtgatgggcgttatcaccttaaatgacgtaatgaccactttaatgggcgatctgattggcccaggtcaagaagagcaaatcgtcagtcgtgatgagcattcatggttggttgaaggtggaacacctattgatgatgttatgcgggcattagatattgatgatttcccggattctagcaattacgaaaccattgcagggtttatgatgttccgtttgcgtaagatccccaaacgtactgactatgtgaagtttgcaggttataaatttgaagtggtggatattgataactataaaattgatcaactgcttgtcactaaaattgatgatattccgccagtaaaaccggttttgcaagaagcaatacctgctcctcaaacaacgacagaagtgccatttgagcacgaagagcataaagcctaa

SEQ ID NO: 1520 - DNA, 243 bp, Proteus mirabilis
atgtctcttctcagtctcatccattttataccggtaaacaaaaaacacattctcaagaaggtaatgtggcacgctttaataagcgttttggccgatttgttaattagggaagaaaaaatgcaagtattaagttcattaaagagtgcgaagctgcgccaccctgattgtaaagtggtacgccgtcgtggacgtctgtatgtaatttgcaaatcaaatccacgttttaaagccgttcaggggtaa

SEQ ID NO: 1521 - DNA, 504 bp, Proteus mirabilis
ctaagtcgttattacctaacaatagattgtatgaatatgaaagaatgggttgttacattagaaaatgaagctgcaacagtaaaactagggcattcagtcgcaatggcgacaaataaccaagggcttattatttatttatttggtgatctaggggccgggaaaaccacctttagccgcggatttttacaagctttaggtcatcaaggtcatgttaaaagtccaacatataccttggtagagccttatatgctgacaccacgcccagtctatcatttcgatctttatcgcttagcttcagcggaagagttagaatttatggggatacgtgactattttgcacaagatccactgtgtctcattgaatggccttctcaaggggaagggtttatacctaatgcggatttagagcttcatttaagctatgaaaatgaaggtcgtaaagcccattttattgccctttcacagagagggaatgctgttttatcccgtattcagtctgcataa

SEQ ID NO: 1522 - DNA, 501 bp, Proteus mirabilis
aatgatattctcattactcattatttatcctttaacttctttaactgggagttttacttttcagaggtcattgtgcaattaaccagttttacagattatggattgcgggcgttgatatatatggcttcattgccagaaggcaaaatgacgagcatcaccgaagtgacgcaggtctatggtgtgtcacgtaatcatatggttaagattattaatcagctaagtcatatgggatttgtcgaagcgatacgtggaaaaaatggtggtatacgcttaggtaaacctgccgctgatattattgtcggcgaggtcgttcgtgctttagagccgctttcactggttaactgtagtgctgagttttgtcatatcaccccagcttgtcgattaaaacttgtattaaatcaagcgatagaacagtttttgaaagagctagaccgtcatacactggctgaattggtagaaaacaacagccccttatataaattgttattagaagatgtttga

SEQ ID NO: 1523 - DNA, 945 bp, Proteus mirabilis
ttgaaatactatttcattaagattattacaatgaaagatgatgcattgagtttatgtcttcaaaatgaaagtaaccaagagaccacacaattttctgagctaagtaccttagcgttagtttcgttaattaatagtgccgatatcaccgtggcctatgctgtaaagaaagaattacccgcaatcgcgaaagccgtagacaaaatttgtgaacgtctacgtcaagggggacgcattttttatgtcggcgcaggaacaagtggccgattagcggtattagatagcgcggaatgtccgcctacttttggcgtttctccctcactggtacaagccattattgctggtgggcatgatgctatgcttcaagccgttgagaatattgaagataatcaacaagctgctatcgaagagttgcaacgccgtgaggtaaattctaacgatgtcgttattggtatcgctgccagtggtcgcacgccatttacagtggctgcattacagtatgcaaagcagatcaatgcattaacgctctcaattactacccgcggtaaaggtatgatgagtgaaatagccgatttatccatcgcgccagatgtcggcgccggagtgttaacaggctcgacaagaatgaaaagtggcacggctcaaaaaatgatcttaggtatgctaagtaccagtgtaatgactcgtttaggtaaggtgcataaaaacctgatggtcgatgtggtggccagtaatgaaaaattacagcgacgtgctgaaggtattgtgagtgaagtgtgtgggatcacaacacaaaaagcagcggagttattaaaaatggttaattatcatccgcgaaaagccattttaatgtatgagcttcatctgagtgtagagaaggttgagcaaatgacacaacgctatccttaccactctttacaacaacagttagccctatttaatgaataa

SEQ ID NO: 1524 - DNA, 693 bp, Proteus mirabilis
caatcttctcttaaggaaacgattatgcgtccattagctaattatatcgatcatactctacttgctgcagatacaactgaagcacaaatcaaacaattatgtgctgaagctgttgaacacggtttcttctctgtgtgtattaacacttcttatatccctttagcaagaacttgcctaaccggaagtgatgttaaagtatgctgtgttatcgacttcccatttggtgcaggcctaacagcaaccaaagcatttgaagcggcagaagctattcgccaaggtgctcaagaagtcgatatggttatcaacattggcatgttaaaaagtggtcgttttgattttgtaaaacaagatattgccgcggtaaaagccgcttgcggaaatacaacactaaaagttattctagaaacatgcctattaactgacgacgaagtacgtttagtttgtgaaatgtgttgcgaagtcggtgttgattttgttaaaacatcaactggatacagtacaatgggtgccacagaacaccatgtcgctttaatgcgtcaaactgtcggtgacaaaatgggcgtaaaagcgtcaggtggtgtacgtgatcgccaaacagccttaaagatgatcaaagcgggggcaacacgtattggtgcaagtgccagtgttgcgattgtaacagattcagatgcaccagaatcaaattactaa

SEQ ID NO: 1525 - DNA, 2244 bp, Proteus mirabilis
ttaacattgtattcacactctaattatctggtcataccagtttatactttagggagaatacaaatgctctatcaaagcgaaaatattcaagccgattgggtgaagcaaggtattgttgagctcgttttcaatgctagcggttctattaataaattagatacaaaaacggtggcaatgttaagcgaagcgttaacagtattagaaaacacatctgatctaaaaggggttattttacgttcagaaaaacccgcctttattgttggtgccgatattaccgaatttttatcactttttgatgcaccggttgaagaactgacacaatggctacattttgctaatcatattttcaatcgattagaagatctccccgttcctacagtttctgccattaatggctacgccctaggcggtggctgtgaatgtgtattagcaacggattttcgtattgcatcaccggatttacgcattggtttacccgaaacaaaacttggtattatgccgggttttggtggctctgttcggctacctcgccttattggcgttgataatgccttagaaattattaccgcgggtaaagatattaatgccgaaacagcacttaagaatggcttaattcaagctattgtccctgttgataagctaaaagaaagtgccatttcactgatagagcaagccattgatggcaaatttgactggcaagctgctcgtcaacctaaaactgtggcattaagattaacggaacttgaacataaaatgtcatttgctgtggcaaaaggcatggtgatgaaagtcgcaggccctcattatccagccccaatgaccgccgttaatacgatagaaaaagccgcatttctagatagaaaagcggcacttgaattggaaacagaaaactttgtcaaactgacccgcaccgatgttgccaaagcattagtgggtattttccttaatgatcaatatgtgaaaggcattactaaaaagcgtcatgctagcttaccaaaacaagcggcagtattaggcgcggggatcatgggtggcggaattgcctatcaatctgcactaaaaggcattcctgttaccatgaaagatattaatgccaactcccttgaattgggtatgacagaagcactcagtctgttacaaaaacgtcaagaaaaaggacgtatgagtgccgttgatatggcaaaaaccctcgcctctattcatcctaccctaaactatgccagtgtagctgatgcacaaattgtggtcgaagcggtggttgaaaaccctaaagtaaaagcctctgtacttgctgaaaccgaagcgctccttgctgatcatgctgtacttgcttcgaatacctcaacaatccccatttcgctacttgccaaatcactaacacgccctgaaaatttctgtggaatgcacttctttaatcccgttcaccgcatgcctttagttgagatcattaaaggtgaaaaaaccagcgaagagacgattaatcgcattgtcagttatgctagcaaaatgggtaaaacgccaatcattgttaatgactgcccggggttctttgtcaatcgcgtgctcttcccttatttcgccgggttttctcttttattaagagatggtgctgattttattgctgtagataaagtgatggaaaaagcctttggctggccaatgggtccggcttatttactggatgttgtcggtatcgatacagcgaatcatgctcaagcagtgatggctcaaggtttcccagacagaatgggaagtattgataaagacgttattgcgcttttatatcaacaacaacgctatggtcagaaaaataaccatggtttctatgactacactattgataagcgtggtaaaaaacaaaagcaggtagataacgatattcacagccttattgaacatcatgtcggcaaaaaacaggaatttaaccaagacactattattgctcgtatgatgatcccaatgatcaatgaagttattcgctgcttagatgaaggcattatcgcctcacctgcagaagccgatattgcattagtgtatggtttaggcttccctcctttccgtggtggtgtcttccgttacctcgataccattggattagcacaatttgttgcaaatgcagagcaatactcagagttagggccactttaccaaattcctgagagcttaaaacaaaaagcattacgtaacgaaacctactatccaaagcctgcaaaagtagatgttaacatcagagaactcgcttaa

SEQ ID NO: 1526 - DNA, 549 bp, Proteus mirabilis
atcatggctcttactgatgctaaagtcagggctgctaagcctctggataaatcgtataaattaacagacggtgatggtatgcacttgatggtacatatcaacggctcaaaatattggcgtttacagtatcgctttggcggtaagcaaaaaatgttggcactgggtgtttaccctgatatttcacttgcagaagccagagagaaaagagatacagccagaaagttaattgctaacggatttgatccaagcgaaaaacgcaaagaagtgaaagaagagcaacaaaaagaatttaatacattcgagaaggttgcacgtgattggcatgcaaccaataagaagtggtctgaagggcatagccatcgagtattaaaaagttttgaagacaatatctttgcggctattccacaatggttaaaaatagaatccgttatctttcacaccctcgaccaattatgtcctgactatcacggggtttttggtcgttttgtactttatcaaatcaaggggcttacctttaccctgatttatcggaagagcacatgcttttaa

SEQ ID NO: 1527 - DNA, 738 bp, Proteus mirabilis
agaggttttcaaatggaagtttttttattgagtaatgggaagattgccggggacccacaatggttaagttacgccaaagataatatcgacagcatgattaaaaagcgtggtattcgttctgccgtgcttattgcatatgcggttattcgttctgatcacgaccaacgtgctcgtgaattatcagaagtattaggtattgaagtgacttgtattgaacattttgattcagaagtggaagccattaacaatgctgagtgtattttagttagtggggggaatacgtggttattaaaccaaatgctgcatgagaaaggattagtggttcctatccagcgtgcagttcgtgaacgtaatatcccctatatcggttggagtgcgggttgtaatgttgccactccgactatccgtactacaaatgatatgcctgtgcgctgttctgttgttatgccttcactgggattattccctgtacaaattaacccgcactatattgatgccaccattagtggacatatgggcgaaactcgagatgagcgtattgcggagttttgtgcgatgaacccagacgagatagtggttgccattcgtgaaggtagttacttatatattcagggtgaagagttacgttattacagcgctaaaaatgaaggctttaaaattttccaacatggaaaaacttttccagaacagtttgatacaaaaatgttggcaaaatgggttccatttcgctgtttataa

SEQ ID NO: 1528 - DNA, 1341 bp, Proteus mirabilis
gtggatattcagttgttatacgggatcattggtttattaggcggtgttttggtgggggggatcgccgtttggtggcttatccaacaacgcttagccgaaaaagaaaacctattacgtgaaaattatactcagcttgcggttgcacaacaaaaagcattggtgatcccttctttacaacaacagatagcgcacttagagcaagagttacgtgcacaacgtgaaataattacttctcaagaagccgaattaagggaagtgaccacgcgttgggaagagagccgaatatccgctgaagagaaacagcgtttactgcttaatagtgaacaacgactagccactcagtttgaaaatctggctaaccgcatttttgagcaaagtggacgtaaagcgcaagagcttaatcgtcaaggtttaacccatctcctttctccatttcgagagcaactagagagttttcgtcggcaggtacaagaaggttttggacaagaagcgcgagaaaggcatacactggtacatgaaattcgccaactgcaacaactcaatgtcaaaatggcgcaagaagccgttaatctgactaatgccttaaaaggggataataaaatccaaggcaactggggagaaacggtattagcgcggatcttagagtcatctggtttacgcgaagggcacgagtttgaaactcaagtcagtattcgccatgaaaatggcagtcgttatcaacccgatgtgattgtgcatttaccgcatcgtcgagatgtgattattgatgctaaaatgtcgctgattgcttatgaaagatactttaatagcagtgatgaaaatgaacaaaaacaagcgctgcatgctcatgtgaactctatcagagcgcacattaaaggcttaagtctcaaagattatcataagctaccgggagtgacttcgttagactacgttttaatgtttataccgatagagcctgcttacctcgttgctattggtcattctccagatttattagaagaagcattgaaaaataatataatgttggttgggccatctactttacttgttgctttgcgtacaatagccgcattgtggcgttatgaataccaaagccaaaatgcgcaagaaattgctgatagagcggctaaaatgtatgacaaattaagacttttcgttgatgatatgcaagggctaggtaatagcattcaaaaagcgcaatcgggctatctattagcgatgaaaaaactctctgaaggtcgtggaaaccttatcagccaagcagaaggctttaaatccttaggggttgagataaaaaagaccattgataatgatctggttgaaaaatcagcttctgattga

SEQ ID NO: 1529 - DNA, 1491 bp, Proteus mirabilis
cccagcgctcaatatcaatatatatgttcagagaggtacgaagtgaaaataactgacaatccctatttccgtgaacaaggatatattgacggtatttggtgtgatgcaaaaagcaaagacacggttgaagtgattgatcctgcaacaaatcagcccattggtactgtgccaaatatggcaacagaagaagccaaagcggctgttgatgcagccgccaaagcattaccgacatggcgtgcgttaaccgcacatcaaagaagcactttactgcaacgctggttccaactgatacaggataacaagcgtcaacttgcagaactgatgacgtttgaacaaggtaaacccgtggccgaagcggaaggcgaaatcacctacgcagcctcatttattgagtggtttgctgagcaaggtaaaagaaccaacggtgaaattatcccctccccttcatcagataagcggcttatggtgatcaaacaagggattggtgtttgtgcggctatcacaccttggaacttccctgctgccatgatcacccgtaaagcagccccagcattagcagctgggtgtactatggtgataaaacctgccaacgaaaccccctatacagcccttgcgttagctgaattagccgcgcaagcaggaatacctgccggtgttattaatattgtcaccggtgatgcagttaaaatcggtgaagtattcacatcagacaaccgcgtgcgtaaattgagttttactggctctacaggggttggccgtttattaatgcgccaatgtgctgacagtgtgaaaaaagtctcactggagctagggggaaatgcgccatttattgtctttaatgacgccgatattgagaaagcggttgcaggtgctatgggggcgaaattccgtaacgccggacagacttgcgtgtgtgcaaatcgtttttatatccataaagatgtatatcaacaatttagtgaacgctttgttgctgaggttaaaaaactaaaagtcggtaatggctttaccgaaggcgtgactattgggcctcttattaatcataaggcggtagaaaaatcacaatcactccttgctgataccttacaacgcggtgcgacactgctatgtggtggtgaaagagataaagcaggtgaaaatttctttcagcctaccgtggtcggtaatgtgcctgctgatagtcatattcttgaagaagagatctttggccccgtggcacctttagtcatttttgacaatgaagaagaagtagtacatctagccaataataccatctatggcttagccgcttatttctacagtgaagatccacaacgtatttggcgtgtggctgaaaatctagaatatggcatggtcggtattaacacaggtctaatttccaatgaagtggctcctttcggtggtataaagcagtctggcttaggtcgtgaaggctctgagcatggtattgaggactatatggaaatgaaatacctctgccaaggcctgtaa

SEQ ID NO: 1530 - DNA, 480 bp, Proteus mirabilis
cacatgaatcagatccctatgacagttctcggagcagaaaaattacgcgaagaactggaatatctaaaaagtgttcgtcgcccagaaattaccgcggccattgctgaggcacgggaacatggcgacttaaaagaaaacgcggaatatcacgcagctcgtgaacaacagggtttctgtgaaggccgcattcaagaaattgaagcaaaattatcaaatgcgcaagtcattgatatcactaaaatgacaaataatggacgtattatttttggtgccacggtgacgttactcaatgtggatactgaagaagagcaaaaataccgcattgttggtgatgatgaagcaaacattaaagaaaacttaatttcagtcaactcaccgattgcccgtggattgattggtaaagagttagatgatgtggtggtcattaacaccccaggcggccaagtagagtatgaagttttaaacgtagaatatatttaa

SEQ ID NO: 1531 - DNA, 315 bp, Proteus mirabilis
cctaatacccacggccatagtgcaaagaacaccgaagataaaaagagccaaatcggtataagtgcagatagcgcgcctaaatataccgctaacggaggcttcccttttggcgttcctctgacggcgatactcactcgtacacaagcaattaataatgagtgttgcaataacatcactaacaagcctgggaaaaaaatggcggcaaaactgaccccagggttatacatggcgatagtttcactttggatcggttttaataatatttttgactgtgtcgcactaaaacccgcattttgtaagatacggccgttatag

SEQ ID NO: 1532 - DNA, 213 bp, Proteus mirabilis
caagtagcccaacaattcgggttattgaacgaaaatgcatttagcgatttccttggtagcaacgattattcattcggttctaaacatattaattgcatactgccacgactgatatcgcgtagtttactttcaactttttcactctctactgctggcaatgatagttcaaaagtgactttatcagtatattcactagagaggatcttcccttga

SEQ ID NO: 1533 - DNA, 1416 bp, Proteus mirabilis
aatagtgaccaacttcatgctattggaaagaaattcatgcacattcatattcttggtatttgtggcacctttatgggaagtcttgccatcttagctcgagcgaaagggcataaagtaactggctctgatgcaaatgtttatcctccaatgagcacattattggaaaatcaaggcattgagctaatcgaaggttatgatccacaacaattagaacctgctcctgacatggtgattattggcaatgcgatgactcgagggaatccttgtgttgaagcggtacttgaaaaaggattgccttacacatcagggccacaatggttacatgactatattttacctgagcgttgggttttggccgttgcgggtacccatggtaaaacgactacggcaggtatgctggcttggattttagaagattgtggttatcaacctggttttttaattggtggtgtgccgggtaactttcaagtttcagcccaattaggggaaagcccgttttttgttattgaagctgatgagtatgacagtgctttctttgataaacgttctaaatttgttcattactcgccacgtacgcttatcttaaataatctggaattcgatcacgcggatatttttgatgatttaacggcgattcaaaaacagtttcatcatttagtccgtattgtgccgggcagtggcaaaattatcatgcctgataacgatctgaacttaaaacagaccattggtatgggatgttggagtgaggaagagtacaccggtgagacgggtgattggcaggcgaaaaagatcagtaatgacagtagccactttgcagtgttccataaaggtgagcaagtcggtgaggtttgttggggactttcgggtgaacacaatatgcaaaatggcttaatggccattgtggcagctcaccacgttggtgtattaccggtagatgcatgcgcagcactcaataaatttattaacgcccgtcgtcgtttagagttacggggtgaagtaaatcaagtgagtgtttatgatgactttgcccatcatcctacggcgattttagcaacccttgaagcgctacgtagtaaagttggcggtacagcacgtattattgcggtattagaacctcgctctaatacgatgaagatggggatcagtaaagatgatatcgccccagcattgggacgtgctgatgaagttttcttatttcagccacctaacattcaatggttagtcagtgatattgccgagaagtgtgtacagcctgctcgttggagcacggatattgacacattagtggagatggttgctaaagaagctaaaccgggtgatcatattttgatcatgagcaatggtggctttggtggtatacatgaaaaactcctggcgaaattagccacaccaaaatcatctgtggatcaatattaa

SEQ ID NO: 1534 - DNA, 2154 bp, Proteus mirabilis
ttaaggagccagattgtgaaaaccatagtgataaaacgagacggatgtaaagtctcttttgaccaaacccgcatcagcgatgctatcaaaagagcagccgaagcttgtcagatcactgatgatgattattgtgagtttgtcgctcaatctgtttcacaatctctcgcaggacgttcgaatgtcgatatccgtgagatccaagacgccgttgaaaatcagctgatggctggcgagcacaaagatattgccagagcttatattgaataccgtcatgaccgagatgttgctcgtgagcaacgaggacgattaactcaggaaatccgcggtcttatcgaacagagtgatgtctctatcttgcacgagaatgcgaataaagacagtaaagttatcccaacccaacgcgatttacttgcgggaattgtggctaaacattacgcaaaattacatatcctgccaagagatgtggtactcgctcatgagcgcggtgaaattcattatcatgatctcgattactcaccctttttccctatgtttaactgcatgctgattgatctcaatggtatgttaaccaacggtttcaagatgggtaatgcagaaatagaacagccaaaatccatttcaacagccactgcggtgactgcacagattattgctcaagtcgctagtcatatttatggtggcacgacaatcaaccgtattgatgaagtccttgcaccttttgtcaaagccagttacgacaaacactataaagtggcgcaagaatggcaaatagcggataaagaagcttacgccaacgcacgtacagaaaaagagtgttatgacgcttttcaatctttagaatatgaagttaacactctacatacggctaatggtcaaacgccttttgtgacctttggctttggcctaggcacatcaaaagaagcacgtttaattcaacgctcaatccttgaaaatcgcatggcgggtttaggtaaaaaccgcaaaacggcggttttccccaaactggtttttgctattaaagatggcttaaaccataaatttggtgatcctaactacgacatcaaacaacttgctttagaatgtgcaagcaagcggatgtaccctgatattttaaattacgatcaagtggtaaaagtaaccggctcgtttaaaaccccaatgggttgtcgtagcttcttaggcgtctatgaagaaaatggcgagatgctccacgaagggcgcaataacctaggggtgatcagtttaaacttaccacgtattgctattgaagccaaaggagatgaagccgcattctggtcgctgcttgataaacgtcttgaattggctaaaaaagccttaatgacccgaattgctcgtttagaaaacgtcaaagcacgtgttgcccctattctttatatggaaggtgcttgtggcgtacgtttaaaagcggatgacagtgttgctgaaatttttaaacatggccgggcctccatttcattaggttatatcggtgttcatgaaacgattaatgccttatttggtacgcaaaaacatgtctttgatgatgaaacattgagagctaaagcaatagcaattattcagcgtttacgtgaagcgacagatcaatggaaagcagaaacaggctatggttttagtctttacagtacacctagtgaaaacttatgtgaccgtttttgccgtttagatgcagcggaattcggtattataccgggggtgactgataaaggttattacaccaacagtttccacttagatgtagagaaaaaagtcaatccatatgataagttggattttgaagccccttacccgccattagccaatggtggtttcatatgctatggcgaatatccaaacttacaacataacctaaaagcattagaagacgtttgggattatagctacacccgtgtcccttactacggcacaaacacccctattgatgaatgttatgactgtggttataccggcgaattttcttgtaccagtaaaggttttacctgccctcgatgcggtaatcacaaccctgcaagagtctcggtgatacgccgtgtatgtggctatttaggcagtcctgattcgcgtccatttaatgccggtaaacaagaagaagttaaacgtcgagttaaacatctggctaatggtcagttaggttaa

SEQ ID NO: 1535 - DNA, 249 bp, Proteus mirabilis
cgactgggccaaatttccgaaggcgctacacctagaaagtcagcaatgattttctcaccttttggccaagggcgtgacagtgcattagccagtgttgaagagcttaaaccagcttggcgagagatggctgccagtgttgtgcctcgttttctgagtgcggcaataatatcggcaggatgccaatcagatttccttgaaatcatttttaatcctttttctataaaattaaatgctgtgttagtggtataa

SEQ ID NO: 1536 - DNA, 483 bp, Proteus mirabilis
ccattgggtcttaactggaatttaaaggcttgtagacgtttcatattacctattatattttggtccatgaaaaatgaaactaatattctccgtggcagacattgtatattcctgatgcacgtccatttggtctttgtcacaaaataccggcgaaaaatatttgatcaggatgccattgaaaaattgcgaggctactttgccagtgtttgtgctgattttgatgttgaactggttgaaatggatggggaacgggatcacgttcatttactgattaattacccgccaaaactggcgatatctaatctggttaacagccttaaagaggtatcgagtcgattacttcgacgtgatcgtcctgatattgcccaacgtgattactacaagggggttctttggtcgccgagttatttcgcggggagttgtggtggcgcaccaatatccattatccgccagtacattgagcaacaggaaacaccgagttag

SEQ ID NO: 1537 - DNA, 798 bp, Proteus mirabilis
tttaatgaacattggttttgtcccattgaggagtccgatatgtctgatgtatttcacttaggtttaaccaaaaatgacctacagggtgccactttagcaattgttccaggtgatcctaagcgtgttgaaaaaattgccaaattaatggataacccagttcatctggcctctttacgtgagtacacctcatggcgtggtgaaattgatggaaaagcagtgatcgtttgttctacagggatcggtggtccatcaacctcaattgcagtggaagaattagcacaattaggtattcgtactttcttacgtattggtacaacgggcgctattcaagagcacatcaatgttggtgacatcttagtaaccacagcagcggttcgtttagatggggcaagtttgcactttgcaccaatggaattccctgcagtgtctgactttgaatgtatgaatgcactgtataaagcggctaaagacaatggttcaacggttcacgttggtgttacagcctcttctgataccttctacccaggccaagagcgttacgacacctatactggtcgagtcgttcgtcgttttaaaggctctatgaaagagtggcaagaaatgggtgtgatgaactatgaaatggaatccgctacattattaaccatgtgtgcaagccaaggcttacgtgcaggtatggttgcaggtgttattgttaaccgtactcaacaagagatccccgatgctgaattactgaagaaaactgaaaataatgcattaggtatcgtgattgaagctgctcgcactttaatgaaataa

SEQ ID NO: 1538 - DNA, 1965 bp, Proteus mirabilis
tatgaggttaatcccttgagtgacatggcgaaaaacctgatcctctggttagtcattgcagtcgtattgatgtcattattccagagcttcggacccagcgattcgaatagtcgtaaggtggattactctacctttatcaatgagttaactaataaccagttacgcgaggtcagcataagtggttatgatattaatgtaactaaaacagataactcaaagtacagcacgtatatgcctatgcgtgatgataacctgctgaccactttaatgaaccgtaatgtaaaagtgaccggtgaacccattgaaggtcaaagccttctaacacaaatttttgtgtcttggttcccaatgcttttactgattggtctttggatcttctttatgcgccaaatgcaaggtggtggcggtaaaggtgcgatgtcttttggtaagagtaaggctcgcatgttgacagaagaccaaatcaaaacaacctttgctgatgttgcaggttgtgatgaggcaaaagaagaagtcagcgagctagttgagtatttacgtgatccgggtcgtttccagaaattaggtggtaaaattccgaaaggtatcctaatggttggtcctcctggtacgggtaaaacattattagcaaaagcgattgctggtgaagcaaaagtacctttctttactatttctggttctgacttcgttgaaatgtttgtcggggtcggtgcttctcgtgttcgtgatatgtttgaacaggctaaaaaagcagcaccttgtatcatctttatcgatgaaatcgatgcggttggtcgtcaacgtggtgccggtcttggcggtggtcatgatgaacgtgaacaaacgctgaaccagatgctggtcgaaatggatggttttgaaggcaacgaaggtatcatcgtgattgccgcaactaaccgccctgacgtattagaccctgcattattacgtccaggtcgttttgaccgtcaagtcgtcgtaggtttaccagatgttcgtggtcgtgagcaaattctgaaagtgcatatgcgccgagtgccattatcaccagacgttgatcctgcgatccttgctcgtggtactccgggtttctccggtgctgacttggcaaacttggttaatgaagctgcactatttgctgcacgcggtaacaaacgtgttgtttcaatggtcgagttcgaaaaagcaaaagataagatcatgatgggtgctgaacgccgttcaatggttatgaccgaagaacaaaaagcatcaacggcttatcatgaagcgggacacgctattattggtcgtttagtgcctgaacatgatccggtacataaagtgacgattatccctcgtggacgtgcattaggtgtgactttcttcttacctgaaggtgaccaaatcagtgccagccgtcaaaaactggaaagccaaatttcaacactttatggtggtcgtttagcggaagagatcatttatgggcctgaacatgtttcgacaggggcttctaatgatatcaaagtggcaaccaatattgcgcgtaacatggtgacacagtggggcttctctgaaaaattagggccattactgtatgctgatgaagacggtgaggtgttcttaggtcgttcagttgctaaagcgcaacatatgtcagatgaaacggcacgtactatcgacgaagaaattaaagctatcatcgatcgtaactatacccgtgctcgtcaaatcctgatggacaacctagatattctgcactcaatgaaagatgcattaatgacttatgaaaccattgatgcacctcaaattgatgacttaatgaatcgtcgtgaagttcgtccaccggcaggttgggaaggcaataatggcaatagtggtgcaaataccgctacagcacagccgacacaaacacatgtgacgaatgagccaaataataagtcaggatcagagagtgacacaccttctgataacaatactcattaa

SEQ ID NO: 1539 - DNA, 546 bp, Proteus mirabilis
ataatgactaataatattaagggtattttgacaacactatggttatttttcttatcattatcacctaatgttgcatattctgccgatagcattattcaaataactggttatatgagagataacacctgtgcagttgcaccagaatcacaataccaaactattgatttattaaataatgaagtgaagcggttatataaagtgggagaaacaacaccctttattccttttcatataatactggagccttgtggagaatcagtgattgctgtgaaattctattttaatggtatttcagatagaaataatccttcattattagcgttagatccgatagcaacatctgcttctggtgttggaatacaaatattagatagtgaaaggtcacccattcctattaatccaagtagtgaccaacttaaatggatccccttagttgcaggaaaaagtaacaccgtttttttctatagtcgattaatggcatctgatatgcctgtcttagctggaaaaattaaagccagtgccacttttacactcgagtaccaatag

SEQ ID NO: 1540 - DNA, 480 bp, Proteus mirabilis
ttctttaataaggagcacaccatgactcatgatcacaaactaaaagttgaagctatcaaacgtgggactgttattgatcatattccggcgcaggtgggctttaagatcctatctctatttcgtttaaccgaaacagacgaaagaataacggtaggttttaatcttccttctgaaaacctaggtaaaaaagatttaatcaaaattgaaaatgtctttttaaccgcagagcaagcaaatcgcttagcaatgtatgcccctcaagcgacggttaatattattgatgactaccaagtcgtcaataaaatggcgctaagtttacctgaattactcgaagatgttgtaccctgccctaatagcaactgtattagccataatgagccggtacaaagtagctttcgcgtaaaaaaattcgcgtctgacgtggtattaacctgcaaatattgcgaaaaagaatttgagcgccatgccgttattcgttga

SEQ ID NO: 1541 - DNA, 768 bp, Proteus mirabilis
cgggcaaataatatgactcaacaatctaaggaaacaacagattttggtttccaaaccgttgacaaagatgaaaaacaaaccatggtggccaaggtttttcactctgttgcatctaaatacgatttaatgaatgacttaatgtcttttggcatccatcgtgtctggaaacgctataccattgaggcaagtggtgtaagacgtaatcaacgtgtacttgacttggcaggtggaaccggcgatttaacggcaaaattctctcgtttagtaggagagaatggtgaagtggttttagctgatatcaatgactccatgttaaaaatgggacgtgagaaactgcgtgatcacggtattgttggtaatgtcagttatgtacaagcgaatgcagaagagctgccattccctgatgattactttgactgtatcactatctcgttcggtttacgtaatgtgactgataaagccaaagcgttacgttctatgttccgtgtgctaaaacccggtggacgtctattagtccttgaattctctaaacccgttcttgatccgctaagtaagatttatgatgcttactctttccatatattaccaagaattggtcaagtgattgtgaatgatgcagatagctatcgctatttaaccgaatccattcgcatgcacccagaccaagaaacattaaaaggaatgatggaagaagctgggtttgatcaggtttcctataccaatatgactggaggtatagttgcattacacaaagggtttaaattctaa

SEQ ID NO: 1542 - DNA, 1200 bp, Proteus mirabilis
aaacaaaataatatgttgcaacaaaattatcgtcagtccgagctttttgctattactactattacagtcagtattgcggtgatagggattgttattggattaactattccgatggtggctttacggctaaacttggcggggatcagtgaatctattattggtctgatttcagccgcacctgcgatgggaatgttaatcatctcaccctttgcacgctatattgtgcaatggcttggtaaacgtttagcgatgttattagcaacgattatatcagccattagtctattgcctttaatggggagtttgccattagaattcctgttcccattacgactaatcaccgggattgccagtggtgtgatgatctgtttgggggagacatggatcaatgaacttgtaccggataataagcgaggtcgtattttagcgatttatacgaccgtgtttactatcagccagttgctaggcccttcaattattgcgttatatggcgttgctgataaaacaccgatcttaatcagcgtactgcttcatattatctctatcgtgctatttttaatgatggatcagaaagtgggcgataaattagctaaagactcagaagagtcgcacttttctattcttcgttttattaaagtggcgcctgcgatatgtggtggcattatcttttttgcattttttgatggcacagtgttgtctatgttccctatttatgggctaagtgttggtcatagtgaagcgattgctgccatgatgatcagtgctattttggcgggagatgccataatgcaaatgccatttggttggcttgctgatcatatgaatagaacaaggctataccgaatttgtggtgtcattacattattagcaagcttattattgcccattgctatgccacatactttagttatttggccactattattagtgcttggtgcaacggcgggagccatttataccatcgcattggtacaaattgggcaatacttttcaggaaatgatctaatgatagcaaatgcttcagcggcgatgttatggggcattggtaatctttctggtcccattttagccggtgctatgtctgaaatctctccatctgcgttaccttttttattggtggttatgacgggattatttttaatttcgacgatggatcgctttaacttgcatgtcgacactctaaatcgtcatacatcataa

SEQ ID NO: 1543 - DNA, 2025 bp, Proteus mirabilis
acgtgggataaggtaatggcgattaatttattacctcctcagttagcaaatcagattgcagcaggggaagtcgttgaaagacccgcttctgttgttaaagagttacttgaaaacagcttagatgcgggtgcgacaacaattgatatcgatatcgataaaggtggcgctaagctaattcgtatccgcgataatggatgcggcatttctcgtgatgatttgaagttagcacttgctcgccatgcaacaagcaaaatatcgacactggatgatcttgaagccattatgagcatggggtttcgtggtgaagcgttagccagtatcagctctgtatcacgtttaaccttaacatctcgtaccgcatctcaggaggaggcttggcaagcctacgccgaagggcgtgatatgacagtggcagtcaagccagcagcacatccggtggggagcacagttgaagtgctcgatcttttttataacactcctgcaagacgtaaatttttacgtaccgaaaaaacagagtttggtcatatagatgaagtagtacgtcgtatagccttatcccgctttgatgtgtcaattaatttaacccacaacggtaagcgggtgcgtcaatatcgcgctgcgaaagaaactcatcagcatcatcgtcgtttaagtgctatctgtggtaatcattttgttgatcaagcaatgcaactgacgtgggagcatggtgatctggcaataaaaggctgggtagagcatcctttagctccagtgcaaagcagtgaaatacagtactgttatgtcaatgggcgcatgatgcgcgatagattgattaaccatgctattcgtcaagcatatgaaggttatttgcaaggtgagcagcaaccttcttatgtgctttatttaaccgtcgaccctcatcaagtggatgtcaatgtacatcctgccaaacatgaagtgcgttttcacgaatcgcgcttagtacacgattttatctatcaagctgtcttgagtgtgttaaggcaggttacagaagatacgttatctttagatgaagaggataatggggctttaactgccacaacatttcctgaaaatcgccaagttgcgggagaaaatgttttttcgcagccttatcaagcaccagtaacctcatctacgcaaaaaaagagcacgggagcttaccaaggaagtgcaggaaaagggttaacagatacgcaaaagagtccccaaaaaacgctagatacacgtcagtttggtgagagttatcaacgtacgcaaggcatgctttatcaaaaaatgatgcaagaaagtgcgagcgatgttgaaaataaagaaaaaatacccctatttccccctcgtcccccattgaatttggttgatgttggtcatacaactaataacaatgaaacaaatgtaatttcagtggtgcctcgttctgttaatgccagcgcagcgcaaacagattatacttttggccgggtattggcgatttatcagcagaaatatgcgttaattgaatcttcgcaaggtctagggctgttagcattggaagaagctgattttctgttaaaatgtgcccagttattgccagaaaatgaaaatttgaaaccccaacctttgctagtgcctttaaaagtcacactcagtaaagatgaaattaatacatttaagcagtttcaggcgttaatcagtgattttgggattgttattgacatctctcatggtaaagcgacgatccatgcggtctcgttgccgttgcgacagcaaaatttacctgtattactgacaaagctattagcttatttggcaacagaaaaattatgctctaaacaacaaattgggcattggttagcaaaacagttaagtcatgagtcgggtgtttggtcacaggctcaggcagtaggattattggctgatattgaacgattatgtccacaatatgtcagacagccgtccaaaaacttattacaattaatagaattacaacctgtggtagcggcactgaataatgagcgaagtaaaaacgcaaataaaacctaa

SEQ ID NO: 1544 - DNA, 519 bp, Proteus mirabilis
actgagctcaacttcatgctaatacgtgttgaaattcctgttgatattcctgctattgatgatcttttacgccaatcatttccaacaggcgcagaagccgatttagttggtcacttacgtgaagagggattattaaccttaggtatggtggcaatcaatgacgaaggccggattgttggttatatcggttttacgcctgtagatattgagggaaaagattgccaatgggtaggacttgcgccattagctgtggcgccacaataccgtggtcagggcatcggtcgtcaattgattaatgaagggcttgatagccttaatgagtttggttatggcgctgttgtggtattaggtgagccaacttattatcaaaaatcaggttttataccggcaaaatcacaaggcttgcattgcaaatggccgaatacagaagaagcatttcaattttatgctttagataatggcaatgttgatgatattcacggcttagtgaacttttcgccgttatttgatgaggtttga

SEQ ID NO: 1545 - DNA, 255 bp, Proteus mirabilis
ttcaaaatcaaccgccttcgggtgtgccggttcgagtccggccttcggcaccataagaacatcgagggacgtcaacggacgtctttttttgtatctgaaatccctgttttacaaggcttttcctcactttttagtcttcccaagtatactaaggtcaacccacatcaagtacctgctgttggtatatgtgttggtatctctcgattagataatagtttgtaccaacgcaaggagataaatcatggctcttactga

SEQ ID NO: 1546 - DNA, 456 bp, Proteus mirabilis
aattggatcaataatgacaatagagtgataacgacattgtcagggagagataaaatggcaagagattttagccgtgctcagcgtgtttctcaggaaatgcaaaaagaaatcgccatcattttacagcgcgaagtaaaagatccacgtattggaatggccaccgtatccggtgttgaaatttcacgtgatctggcttacgccaaagtatttgtcacctttttaaacctatcagcaggtgaagaaagcgatgaagaaatggtagaaaatggcttaaaagcccttaacgaagcagcaggctttattcgctctttattaggtaaagcgatgcgcttacgtgttgttcctgagctaacatttgcttatgacaattcattagttgaaggtatgcgtatgtctaaccttgtgtcaaatgttgtcaaagatgatgaaaaacgccgtcataaagaggaagagtaa

SEQ ID NO: 1547 - DNA, 651 bp, Proteus mirabilis
aaatatgacaagagacttacatttagcctgatgaaagcttatttgatccccgctgaaacggtagaattcagtgaagaaataaagaagagccgttttattacatttattgctcatactgaagggattgaggctgccaaagcgtatatccaatcaattaaagcgcagtttcccgatgctcggcatcattgttgggcatttgttgccggaagacctgatgattcacaacagttaggtttttctgatgatggtgaaccaacaggcacggcgggaaaacctattctagcacccctgttagggagtggtatgggagaggtgactgcggttgtggtacgttatttcggcgggatcaaattaggcactggtggattagtacgtgcttatggcagtggggtacagcaggcattaaaacttttgccaacgaaaaccaaaatacctcagcgccgatttcttgtggagtgtgaatattccttggtgtcattacttgagcaagttgttgcagaatatcaagggaagatcctctctagtgaatatactgataaagtcacttttgaactatcattgccagcagtagagagtgaaaaagttgaaagtaaactacgcgatatcagtcgtggcagtatgcaattaatatgtttagaaccgaatgaataa

SEQ ID NO: 1548 - DNA, 600 bp, Proteus mirabilis
atagccgacaaagtcgaattgaataataggacaataacgatgcacaaaataaccttggctgcacttttgcttagcacatctacatgggtatttgcccataatattactgaagaaactctcctaccggcgatctctgtgagtgacaaaggggagcttctttatgatggtgccaaagataaatttagctatcaaaattggaatagcggactacttagtggcaaagtacgcacaattcaacatatcgctggacgcagtaaggctaaagagatgaatgcgccactgattgaagccatcaaacaagccaaatttccacaaaatagttatcagacaaccactatcatcaatactgatgatgctatctttggtactgggccttttgttcgcggtagtgttgaagacagtaaaaaagagtttccttggtcacaatttattgttgatgctgatggtgtagcgcaaaaaggttggggactagaaaaagagagttcagcaattattgtgctggataaacaaggaaaagttcgttttgtcaaagaaggtgtattaagtggtgcagaaataacttccgccattaaccttatcaatgacttaattaaagaatag

SEQ ID NO: 1549 - DNA, 267 bp, Proteus mirabilis
tttatggacaaattaaacgatattactcaactttataataatccaccaaaagatgtaaaacataatatagtcaatcatcgttttacggatatgatgctacaaactaaaactgttgcaacagaagcattagataaattagcttatcttgcaggtattaaaaatgcacctgctgatgataagtatttaaaattaaacaccactagcttagatgcgttactaaaaagtgcgaagtcacttggttatgatatcgaagtcgtcagtctttaa

SEQ ID NO: 1550 - DNA, 1668 bp, Proteus mirabilis
attgtgctaaaaaatttgaatgatgtaatacatcaatgtcgagcgtcttttgataacttaaaccatcgtagtgatatacatatagattcggttttagcattacttttgaagaatgcattagcggaagttgaacctcgatcttcatttgagattcagccattttcaatattattaataaatgagaatggtcttcgtacagatttaccgtcttccctgctttggtatggagcaaccttctgggagttagatgaagcgttgtgtgaatatcagcaaaaaattaaagaactcagagaatttttaaaaaataaagaacatagcagcgcctcgatcaaagattttttaaataagttaccatctgaagaacttaataatgcaactgaaatcgccaatgataccaaattattcttgaaagcgatggagcctagcgatgctacattatttgagcgatttttaacggaccgagactggtggtttcaaccacttaaaaaaacagatcaaatgaatggtaaaacattggatagaggcgatgcatttcaatcatcttttgatttagctgctcgagttattgttgccaattcatctcgacttttaactattgttaaggcgtttacagcatccgaagacttaaggcgttattttgaaactttgagtaaagagccagttaaatatttagatgaagatacttcaagcataatacatttactttctactaaaccagccaaagtaggatgtaactatatctattatggagcaccaggtacaggtaaaagccaccagcttaatgagctaacagaaggtgatagaaaaattgttaccgttttccatcctgatacacaaaattcagattttattggttctttgaagccaacaaatgtaagtggttctattacttatgctttcagacccggcccttttaccacagcattacttgaagcactaaagaatccagagcaaaatgtttatctagttattgaagaaattaatcgagcacctgctgctgcggtatttggcgaattgtttcaactcttagatagagaaaacggggcaagcaagtacgaaattgatttcactgatcctgatatgcaggcttacattaatgatcaacttaaagctgagggtctagatgaacgttcaaaattatcaatacctgcaaatttgtctttacttgcaactatgaatagtagcgaccaagccgttatgcctttggatactgcatttaaaagacgttggtcatttagatatatgaagcttgattttgagaaccctgcagttagttcacaaaaactgcgaattatgactactcagggtgtttattatatcacttggaaagattttgctaataaagtggtcaatcatcaactgaaagaaatgaaagttccagaagatcgcttaatcggcccattttttctcagtagtactgaattatcaaatagtgagacatctaatgaagcaatcagcggaaaactgtttgtgtatctctgggatgatgtattacgtcataagggacggaatatcatttttgataaaaatattggtacatttggtgaattgcatgaacagttcatcgagggtaaaaaacctgttttcagcgaagtaattgaatctctaattatctcgaatggcaacacggctgatgatactacaggggttacagaaggagatgagtaa

SEQ ID NO: 1551 - DNA, 711 bp, Proteus mirabilis
tggattataaaaatgaatagtattctaactttttctaaaataaagcttctttttttaatgctcttaactctatgtgtcattaaccaagcatatgctgctgtatcattaggggcaactagagtcatttattttgcaggtgaaaagcaagtaaaattaccagtaattaataatgatgaaaaacgttatttaatacagtcttggatagaaaatagcgaaggaaagaaagataactcttttgttattacgcctcctctattttctatgcagggtaaaaaagagaatactttaagaattatagatgcaactaacaataaattaccgaaagatagagaaactttattttggttgagtgtaaaatctatccccgctgtagaaaaatcacttgctaatgagaatatgttacaacttgcgattattagtaaaataaaattcttttatagaccaaaagatctcaccatatctccagatgaaaattataaaaaactacaatttaaacgtaataatgacacacttattataaaaaatccgacaccttattttattacgatgactgaattagaacttggtggtaaaaaattagagaatactatggttccaccttttgaagataagtctatctctattccaacatcagcttatgggaaactctcgtttcaaactattaatgattatggtgccatcacaccaaaaacaatcgtcgacgttagataa

SEQ ID NO: 1552 - DNA, 270 bp, Proteus mirabilis
cattacataaagagggcgagtatgaaagaaaatattcatccacaatatcgtactgtcatttttcatgacactagcgtagatgcttattttaaagtgggatcaaccattcaaactgataaaactattgagtatgaggggcaacgctatccttatgtcactttagatgtctcttctcagtctcatccattttataccggtaaacaaaaaacacattctcaagaaggtaatgtggcacgctttaataagcgttttggccgatttgttaattag

SEQ ID NO: 1553 - DNA, 669 bp, Proteus mirabilis
ttatgggtaaaatttcttatggaccttcctacaaaccaaaagattactgaagaagatcggcatctactccgctcttatattccttttctcgataatttggggcaatttctcggtgattattgtgaaatagtgctacatagttttgaggatttacgccattccgttatccacatagttaatggacatgttactggtcgtggattaggtgcccccgtaacaaatattgctttagaaaaactctcaaaatttaatcgaacagatcaaatgtgggaggtttatttcaatacaaaaagtgttcggccatttaaatcatcatctactttaattgtaaataatgcaggtacacctattggtatgatttgtatgaactttgctctcgatatgccattaaatgcattaatagatagttttactgatacaaataatttaaaacatgaaaatttttcacaagatgtgaataatcttgtacagaatcatctagaaccaattaaaaagagagtttatggaaataaaaatattccaagtaaatacaagaacttagagataattaaagaattaaatgaaagtggactttttgaattttcagcaacacataaaatagtatccgccgaattaggcataagctcagcaacaatttataagcatttaagaaatttaagtaagaaataa

SEQ ID NO: 1554 - DNA, 939 bp, Proteus mirabilis
aggaacacaaacaacattaggtgcttaccaccggaaatggcaataataagggataataatatgaaatacgcattaggctctgtactttattattggcaaaaagaaacacttgagacattttatcagcaagcaaaacagagcgatgctgatattatctacttaggcgaaacagtctgtagtaagcgccgtgagactaaaccacaagattggattaatctggccaaagaagtggctaaaagtggtaaacaagtgatcctttctaccttagcactactacaagcgccttctgaactaaaagagatagcaaagctggtggataacggtgaatttttagttgaggctcatgattttggtgtgatcaatatgctttatgagcgtcatttaccttttgtagcaggccatggattaaactgctataacgcttatgcactacgtttattacagaaacaaggcatgatacgttggtgtatgccagttgaactgtctcgtgagtggttaaataatcttttaattcaatgtgaagaattagcgattagagataaatttgaagtagaagtattcgcttatggtcatcttcctttggcttattcagcgcgttgttttactgctcgctcagaaaatcgtgctaaagatgattgtgaaacttgctgtcaaaaatacccacaaggccgtcaggtattgtcacaagaaaaccaacaggtgtttgttttaaatggtattcaaacgcaaagtggctactgttacaatttaggtaatgatttaacctcaatggcaggtttagtcgatatcgtccgtctttcaccgcagtctgatgaagtttttactaccttaaaacaatttcgccaaaatgaacaaggcgcacaccctattaacaccatccatcatcatgattgtaatggttattggcgtaaactggctggtttagaattagttgaataa

SEQ ID NO: 1555 - DNA, 1320 bp, Proteus mirabilis
ataaaaacaaaaagtaacgcgataaaacaatcatccatttatgttatggctgatttattttgttcccttttctttcaccttactcgttatgttgatcataaaatgaaaaaacatctcctaaaatatctcctcattcctgttgcactacttacgctcaatgcctgtagtcaacgagcaacggtaacgccaacgttacccgctaagtttaatcaacataatgtgcctgaattgtcacaatggccaaccaccttatcaccaaaggcgaataatagtcgggagatttttgataagtatgctcagcagatttatcaaaagagtaaccctcaagggatggtgattgtcatgattaacaatacgcaatctcttaatcgtgcttttggtactacaagccccgatagccgtcaaaccccgtcaatgaactcattaatacgtattgcttctattactaaattaatgacgagtgaagtgatgttaaaattacaagatgatggcaagttgttggttactgatcctctgcaaaaatatagttattatggtgtcgatattccattagtgaacaatcaatctcctattcgtctttatcatttagctacccataccagtggttttcctcgtgaacaacccggcggaaaatggggtagaccggtttttatttggccaacccatggcgatcgctggaactggctaaaaaaagcctctttaacaacaccggcgggacaatctgcctcttattctaatctggcttatgatttattagcagatgcattagtgaaagcctctggtaaaaactatcctcaactattaaaacagtatgtgacacaacctgcgggaatgcgtgataccacgttaacgccaagtagcacacaatgtcagcgattattaattggttatagacccagcccttgttctgagactatcgccgccgccggaagtgggggtgtttattctacgcctgcagatatgcaacgttggatgcaaggctttttaaactcaaataatacgatgagaaaagcgacggccagtaaagagcagtctatttattttccgcgccaacgactatcttctattgaagggatggatgttgcagggcgagcggatggcattggcttaggatgggtttatatggcgcctgccaatggtgtgcctgctatttaccaaaaaaccggtggtggcggtggttttaatacctatatggcaaccattcctgaattaaatatcggtgtttttgttgtcatcacccgtaaagctaatggcaccaagtttagtgaagtgactcgaggtacaaatgcccttgtgcgtgctttagcacaaagtttttaa

SEQ ID NO: 1556 - DNA, 303 bp, Proteus mirabilis
gtagcacaaaaaggaaaaaagatggctgatactcaatggtcaatctatattgtcagaaatcgtcttggctctctttataccggaataacaacggatgttgagcgacgatttaatcagcatcaaaatggaactggcgcgaaagcactaagagggaaaggcccattatcattggagttttattgccaagttggcgataggcaacaagcgtctcaacttgaatatcgtttaaaacagttaaaaaaaatacaaaaagaaaagctgatcattgatcagccttcagacgttgcacagtatttagcataa

SEQ ID NO: 1557 - DNA, 651 bp, Proteus mirabilis
cctatgcaaaaaccaatcctttcttgtcttttgattatgggttttttaggtagtgctatgtctgttttggcacatggacatcatcatgaaaaagtacgcacacaagcacaaatagatgctgcgaatgggatttttgaggacaaggacgttctcaatcgctcattaagcgattgggatggcgtatggcaatctgttgaaccctatctgcgtagtggcgaattagatatcgttttgcaaaagaaagcggagacgaagcaagataaaacagtagaacaatatcgagcttactatacacaaggctataaaaccgatgttgatatgattggtattgagaataatatcgtagagtttcatcgtggtgataaagtcgatagctgtgaatatcactatgatggttatcgtattctacattatcaatcgggtaaaaaaggtgttcgctatctgtttagatgtgacgatgccaacagccaagctccacggtttattcagtttagcgatcatattattgcaccagaaaaagcacagcattttcatctatatatgggaaatagttcacaagatgaattacttaaagagctaactaattggccaacctattacccttattcaatgaaaggggaagatattgttcatgaaatgctttatcactaa

SEQ ID NO: 1558 - DNA, 204 bp, Proteus mirabilis
accagaagaaatagtccgttaccatctgtcagcttatatactttatcttcagattttgcagaacgaaccttagtatcggaaagtgccattttaactatcctcgcagccgaattgcgagtacaaaactttatcgaatcgacatatacccgcaaatgtacccacatcattaacttgatgtcggttgagttgagtatacgttggtag

SEQ ID NO: 1559 - DNA, 1266 bp, Proteus mirabilis
aaaataggaaatatgatcatgaataaatggggaaaattatgttttcttattttgggtggtgggactatattcaaactatccagcatgaaagatgtattttatgtgccaatgcaacaagattggggattatctaacacccaaattggttttggctttactatttatgccattattcaaacaatcggattattttcatcattgtatattgccgatcgtttctctaagaaaattttattaccagcgggcttaattggagtaggtttatgtggtgcttatttaagcacattgcctccttttacgggttatttaattgcatttggtgcaatggcatttttcggcgaggttgtttattggcctgttttactaaaatcggtacgtttattaggaaataaagaagaacaaggacgtatgtttggttttctagaagctgggcgaggggttgttgatgttctagtagcttcgggagctctttatatatttgttttatttggtgaaggtaaaacaggtatgcaagcaggattaatttattatacgcttgctacaataatagtaggtataattacatattttattgtggataatgacgataagaaggaaacctcctcagcaagtgaagctaatcgccaagttttggaagggattaaaaatgtcgtaaaatgtcctaacttatggttagcatcaatgagtatcttctttgtttattctgcttactgtgggttaacttattttattccttttttaaaagatatttacgcactaccaatagcccttatcggtgcctatggcattattaatcaatatgcactaaaaatgataggtggtccattaggcggatttttagctgacaaagttgcaaaatcgccaacaatatatctgaaatggacatttttattatctgcgattgcaatggctattttcattatgttgcctcatgactcaatgaatgtctatttaggtatgactgcaacattaggtttcggtgcaatcattttctcgcaaagagctattttctttgcaccaatggatgaaattggaacaccaagacaatatgcaggttcagcgatggcgtttgggtgtattattggttatatgccttccatgtttgcttatgctctctatgggtcattattagataattttgagggcattcaaggatataactatgtatttagtattatggtcacttttagtttgcttggttttatttgtgcaaccatattagctaagcgtattaaaatgataaataacactttaaatatagcttaa

SEQ ID NO: 1560 - DNA, 3819 bp, Proteus mirabilis
gttatgatgaagtggttgaaaaggataacactaacgctacttatcatcattttactggttttaggtgctcttgcatggattttagggacgcaatcagggctacattttgccattaatagtgcagctcgttgggtgccaggtttaaccattaatagtgttaatggcggttggcaagatttacgtttaacgggtgttgagtatcaaatgccgggtgtagacgtcaatgtgggggagttatcactaggcttaaatttaagctgtttgaaggataaacaactgtgtgttgaggccttaggcacacgtgatgttatcgtcaatgtagataccagtgcactccctccagcacaagaaacaccaccttctgagcctttaactgagcttaatgctcctttacctatctatttaaactctctctcattagccaatacgcgtgtacaaattgatgatatggccctatcactcaatgagtttactacggcagcacaatgggaagggcgccaagttaccttaaaaccgacagtcattaatgatttgttggtggcgttaccgaaaacacccgaagacggtagtgttgccgccatggcgcaagatgtaaaagaagttgcagcaacgatgcctcaagcggagcctaaaacaccgcaagagcaggcactagctgacactattaagacaattttcgccaagcctttattagcgcagttacccgaaattattattcctgttgatatcaatgtggaggggatagaaggtaaacagttacaagttagtggtgatacgcctgtgactattaatcaactctcttttcaagccaatacgcaaggtcaacaggttaatctcactaggctcagtattgatgcgccagaaggcaaagccagtttaaacggtcaaattacactggataaacagtggccggttaatctagatatgcaagcgatgcttcgtgagatggcaggattggaagagtttaaagatcagcaagcgacactgtccttacaaggtgcgatacttgatgaattaaaactcgcactctctttaacaggaactgttaccgcaagccttgatgcacaagctgagctcgctaaagcacatcttccactaaaattaaccttagagagccaaaaagtgcgctggcctttaacgggagatgtgcagtatcaacttaatgatactcgactacgtcttaatgggcagacggataattatgatctttcattacgttctaatattgaaggacaagagatcccgccagccaaattgaccctagacgctaaagggaatgaagagaaaatagcactcactcgtttgcgtttagctgcattacaaggtcatgcggatattactggtgtggcagattggagtaaggcgattagctggaatgcattattgactatctctggtattaatacagctaaacaatatcccgatatgccagcgaaattagatggacgtattgctacaacgggtagcctgtatggaggaagttggcaactgcgagtgcctgaaattaccttagatggtaatttaaaaaataatcttattaaggcgcgaggaaacgcctatggtaatgattcggggcaatggaatattcctcaattaaccttaattctaggtaaaaataatctcgatattgcggggcacttaggtgagcagtgggcgcttgatgcgaacatcaatgctccggggttaaatggtttagtgccggggttagcgggcgttattaaagggaaagtgaatgttcgcggtgatattaataagccgaaaattattgctgatatcaatgcacaagggatcaaatggcaagatcagctcagtgttgggtcagttgtcgttaaaggtgacattcagtcagatgacgtgatcagtggcaaactggcaattacggcacgtcagttaaaacaggctgatttgattattcgtcaattaacgctagatgcggccgggacagaaaaacagcataagcttaccttgaaaatggatggggaacccgtatcgggtggcctgacattagccggctcgtttgataaagaaaaacagcagtggcaaggcacacttaacaataccgcatttgatacgcctgtaggcgaatggcgtttaaataaagcgatggcgctaaatttattagcggaaaaacagcaagtgacgattggttcacattgctgggtaaatcctaatgcacaactgtgtgtacctaaagagatcactgtaggtgagagtggtagtgcggcaatcacgttaacacgttttgatttagccatgataaaaccattcttacctcctgaaactgcgctacgcggtgtctttacgggagatgcaacggcaacttggaatgcgaaaggcggattacctaaagcgtcagttaaccttaaaggtcagggcgttggtgtaaaacaaaatgtcgatggtacggtattacctattgattttgatgcagttacgttaaatgcgggcatcaataatggtaaagcgaccttgcaatggttaattagtattgccggtaatggtgactttaaaggccatgtcaatgttgctgatctagaaaaaacacgtcaattatcaggtacggttgatattgataacctgacattagatctgattaagcctttcttgggtaaaggtgaaatagcgcaaggtagtgtaggggcacagctacgtttaggagggaatgcacaatcaccattgctatttgggcagtttggtattaaccagttaaaagtagttggtcactggatcccatttgacattaccaaagggaatgtcgatattcgctttaatggtgcgacttctgatttaagcggtagaatcgaaacaccggaaggttatttaaatctgacggggaatgcggactggcgcaaactagatgagtggcgtgccgtggtggctgcaaatggcaataaactgcgtgtgtcattaccaccaatggttcgtattgatgttaacccagacttagtttttgaagctaatccacatttgcttaaattagatggtcgtattgatatcccttgggctcgtatcgtggtgcaggaattacccgagtctgcggtgtcggcctcttctgatgaagtgatgttggataaagaattacaacctatagcaccaaagcagacttctatacctattcaaagtaatttggcgattaatattggcgatgatgtcacattagatgcctttggattgaaagccagattaacaggggcattaaaagttgctcaaagtaagcaagggttgggattaaatggtcaagtggatattccacgcggggaattcaaagcttatggacaagatttacaagtacgtaaagggcaaatcttgttctcagggccggttgatcagccatacttaaatattgaagcgatacgtaaccctgataatacggcagataatgtcattgctggggttaaagtcaccggacttgcggataagccgaaagtggaaatattctctgagccggccaaaacacaacaagaagcattatcctacttgttaagaggggaaggattagcaagtggtgattctgattcagcacaaatgacagccatgctaataggattaggtgttggacaaagtggacaactcgtaggacgtattggcgaaacctttggtatttctgatttagcgttagatacacaaggtgtaggggatagttcacaagttgtcgtcagtggtaagataaccgatgatttacaagtgaagtatgggatgggtatatttgattcgctagcgacgttaacattacgttatcgcttgatgcccaggttgtatttacaagcagtgtctggtatgaatcaggcaatagatctgctttatcaatttgagttttaa

SEQ ID NO: 1561 - DNA, 1008 bp, Proteus mirabilis
agggaagtgaagatggaattgttgtgcccagcaggtaacttacccgcattaaaagccgctgttgataatggtgcagatgccgtttatatcggcttaaaagatgacaccaatgctcgccattttgctggcttaaacttcacagaaaagaaattgcaagaagccgtcaattacgtacatcgccaccagcgaaaactgcatattgccattaatacttttgctcatcctgatggatttgaacgttggcaaaaagccattgatatggcggctcatttaggtgccgatgcattaattttggccgatattgctatgctagaatacgcagctgaacgctatccacagatagagcgtcatgtatcggtacaggcgtcggccactaatactcaggcaatcgcattttatcaacgcaattttgatgttgcacgtattgtactaccacgcgttctttctattcatcaagtcaaacaattggctcaaagtagtcctgttcctttagaagtctttgcctttggtagtttgtgcatcatggctgaaggacgctgttatctttcctcttatctaactggtgaatcgcctaatactgtcggagcctgttccccagctcgttttgtccgttggcagcaaacaccacaaggtatggaatctcgcctcaatgatgtcttaatagaccgttatgctcctgatgaaaatgcagggtatcctactttatgtaaaggacgttattttgttgataaacactgctatcacgccttagaagagccaaccagcttaaatacgctagcgctactacctgaacttatggctatgaatattgcctctgtcaaaattgaaggtcgccaacgtagcccagcgtatgttactgaagttgcaagagtatggcgtgcagctattgaccaatgtaaaaaagatcctcaaggttttaaaacccaaccgcgttggatgagtgcattaggaaaaatatctgaaggaacacaaacaacattaggtgcttaccaccggaaatggcaataa

SEQ ID NO: 1562 - DNA, 2766 bp, Proteus mirabilis
gcaggaaggaacagaatgacagatgaaacagtaaaatcacttgcagaagagattcagacaccggttgaacgtttggtacagcagtttgctgatgccggtattaagaaaaccgtctctgattctgtctcccaaaaagagaaagaaaccttgctggcttggttgaaccgtgataaagagtcaaccagccaaccagaaaaattaacgttacagcgcaaagtgcgtagtacgttaagtgttcctggtacaggtggcaaaaataaatcagtagccatcgaagtccgcaaaaaacgcacttatgtgaaccgtgatgcagttgaaaaagcacaagcggcagagcaagctcagcgtgaagcggaagaaaaggcgcgtcgcgaagcagaagaaaaagcacagcgcgaagcacaagagaaagcacagcgcgaagctgaagaaaaagcaaaacgtgaagctgaagaagccaagaaaaaggctgaagaaaaggcaaaacgtgaagctgaagaagcaaaacgtgaagcagcggaattagctaagcgcgaagcagcggaaaaagacaaagtgaaacaaaacgagaaaccaaaagctgataaggctgatcaggaaaaagcacgtcgcatagccgaacaggctgaactgaaacgtaaaacagaagaagctcagcgtcgtaaagctgaagaagaagctcgcattgcagcagaaaaagcgcgtcgcttagcggaagaaaatgctgaaaaatggacttcagatacgtcatctgaaacagaaggtactgactatcatgtgacgacatctcgctatgcgcgtgatgcagaagatgaaagtgatgctgaggttgaaggtggccgtggccgtggtcgtgcagcaaaagcccctcgtccaaagaaaaataaccgtcactctgaaaaagcagatcgtgaagaagctcgcgctgctggccgttctaacaagaaaggcaaaggacgtaaaaacagcacattacagcaaggcttcaataagccagcagctgctgtaaaccgcgatgttgtcattggtgagactatttcagttgctgatttagcaaacaaaatggcagtgaaaggttctgaagtcattaaaacaatgatgaaaatgggtgcaatggcaaccatcaatcaagttttagaccaagaaacggcacaactggttgcggaagaaatgggtcacaaagttatcttacgtcgtgaaaacgagttagaagaacaagtgatgaacgaccgtgatactagcgatgaaatggctgtatctcgtgcgcctgtggtgactattatgggtcacgttgaccatggtaaaacctctttactcgactacattcgttcaacgaaagtggcttcaggtgaagcaggtggtattactcagcatattggtgcttatcacgttaaaaccgacaaaggtgaaattaccttcctagatactccaggtcacgccgcatttacttcaatgcgtgcccgtggtgctcaggtaacggatatcgttgttctggttgttgctgctgatgatggtgtgatgccacaaactatcgaagctatccaacacgccaaagcagcaaatgtgcctgttgttgttgccgtgaacaaaattgataaaccagaagctgatcctgatcgtgttaaaactgagctgtctcaatatggcattctgccagaagattggggtggtgagactcagtttatccatgtgtcagcaaaacaaggcttaggtattgacgagttgctggatgctatcttattacaagcggaagttcttgaactgaaagcagtaaaagaaggtatggcaagcggtgttgttatcgaatcttacctcgataaaggccgtggtcctgttgcgactatccttgttcgtgaaggtactttgaataaaggtgatatcgttctgtgtggctttgaatacggtcgtattcgtgcaatgcgtaacgaattaggtaaagaagtacaatctgccggcccatcaatgcctgttgagattttaggtctgtctaatgtaccttctgcgggtgatgaagcaaccgttgttcgtgatgagaaaaaagcgcgtgaagttgccttatatcgtcaaggtaaattccgtgaagtgaaactggctcgtcaacagaaatctaaactggaaaacatgtttgctaacatggaagaaggtaaagtttctgaactgaacatcgtactgaaaacggatgttcaaggaacttgtgaagccatcactgatgcattagttaaactttctacagatgaagttaaactgaaaattatcggttctggcgtgggtggtatcactgaaacagatgcgactttagcggctgcttctgatgctatcattcttggtttcaacgttcgtgctgatgcttctgctcgtcgtattatcgaacaagaaagtgttgatttacgttactactccgttatctatagcttgattgatgaaattaaatcagcaatgagcggtatgttagagcctgaatacaaacaagaaatcatgggtcttgctgaggttcgtgatgtgtttaaatcacctaaattcggcgctatcgcgggttgtatggtggttgaaggtaatatcaaacgtaacaatcctattcgcgtattacgtgataacgtggttatttacgaaggtgagcttgaatcactgcgtcgctttaaagatgacgtcaacgaagtccgtaatggtatggaatgtggtatcggtgtgaaaaactacaacgatgtccgtgttggcgatatgattgaagtgttccaagttatcgaaattaaacgttctatcgattaa

SEQ ID NO: 1563 - DNA, 597 bp, Proteus mirabilis
caatattttgaattggcaatgaacccacaatcaccgaaaaagacaaacgaataccttggtaataaggttaagcagttaagacaatctcgaaacttgtcacttaatgagttatcaagaaaatcaggcatatctaaagcggcattgtccaaattagagtctggcgattctaatcctcgcatcgataccttagaagctatcgcgatagcccttggatttccattaggtgatttatttagttttacccgcgaagaatatcctcgcttagagcgacataagcctatcgttggcgactatgcacaagaatttaaattccgtattggcatcggcaatattactgaaatttggcatattgagatgaagcacggggcaattattaatagcccagcccatgccgacggcacccaagagcatattatggtctattctggcaaactgatgatgcgttttgctaacgatgaaaccgtattattagaaaccggcgatttttacgcctttcatggtaatgcgccacactcttatatttgtgtggaaggccatatgcgcgcatcagttatcatgtctagccccaatcaacaacactatcatcatcgtccttaa

SEQ ID NO: 1564 - DNA, 534 bp, Proteus mirabilis
accgtgtttgacattggttttagtcagctgctattggtcatggtgataggtcttgtttttctggggccagaacgattgcccgtagcagtaaaaacaattgctggctgggtaagggcattacgctctttggcggcgaatgtgcaaaatgagctaactcaagaactaaaacttcaagagcttcaagagagcctgaagaaagtggaagagaaagcgaatttgcaaacattatcccctgagctaaaagcgtcgatggatgagttaaaagaggctgcacagtctttaaaagaaacttatcaagcacctacaacgccaggatctacagagacagagcagtctgtaaaaaccgactctacggaacctacgccttctgatttagcggcactggctgaagcgaatgaagcgaatgacgatgttcaacacagttccaaaacggtaactgaaaatacagaacatgttattaagccagatgttcctgttaccaaaacagtaacagtagagaagaaaacaactgatcaggcaaatggtgagcactaa

SEQ ID NO: 1565 - DNA, 1158 bp, Proteus mirabilis
atatacaacgaagttagcgattttcctgcaaaaagacaagttttcacaggcataactagcgtgattataattcgatatttagctcgggaaacccttaaaagtcagatagccatcttatttatcttgatgcttatcttctttagccaaaagctggttgaaattttaggggctgctgtagaaggtaatattcctacaaaccttgtggtttctctgctgtggctggggatccccgagatggcacagcttattctaccattaagcctttttcttggtcttctgatgacttacagcaaactttatgttgaaagtgagataaccgtcatgaatgcctgtggaataggtaaaaaagcattagtgcaagcagcactattgttgtcattacttactagcgtcttggcggcagggaatgtggtgtggttgataccatggtcgtctgtacatcaagagcaagtgctggaagatgcaaaagccaatccaagcttagcggcattaatggaagggcaatttaaaatgtccagtgaccgtaatatggtgctttatctcggtagcgtaaagggcaaccaattccaagatgttttcttggctcaattgcgtccaacacaaaaccaacgcccatctgttgtggtggcggataaagggtataccaaagagctaccaaacggtaaccaagtcgtggtacttagcgagggtacgcggtatgaaggtacggcggtactacgcgattttcgtattactgattttaccgattaccaagcggtgataggccatcgagagtctactattagccgtaatcgcgtcgaacaaaaaaccatgaatgagttgtggcactcaacagagcctgagtctatcgctgaatttcattggcgtttaaccttaattttctctgtggtgatcatggcgttaatggttgtgccgttaagtgaagtcaacccacgtcaagggcgagtgttaagtatgttgccggcgatgttgctttatttggtgtttttcctattacaaagctccttgcgttcaagcggtgaaaaaggaaaagttgacccacttattgctatgtggacagtgaatgggatttattttgctttagcgctgttattgaatgcgtgggataccttaccaatgcgcaaactacgtgctcgctttaagaaaggagttgcctga

SEQ ID NO: 1566 - DNA, 2163 bp, Proteus mirabilis
atatcatgcgacaataagataaaggatattattttgctgaatcctacagttcgtaaatttcaatacggtcaacataccgttacgttagaaacgggcatgatggctcgccaagcaacggctgctgtaatggttgacatggacggcactgctgtttttgttaccgttgttgctaagaaaaaagtgaaagaaggacaagacttcttcccactcaccgttaactatcaagagcgttcatacgcagctggccgtattccaggaagtttcttccgtcgtgaaggtcgtcctggcgaaggtgaaactttaatcgcgcgtcttatcgaccgccctttacgcccactattcccagaagggttcttaaacgaaatccaagtggttgcgactgtggtttctgttaacccacaagttaacccagatatcgttgctatgattggtgcttctgcagcactgtcattatcaggtgtacctttcaatggtcctatcggtggtgctcgtgttggctttattgatggtcaatatgtactgaacccaaccgttgatgaactgaaaattagtaaattagacttagtggttgcaggtactgcgggtgcggtactgatggttgaatcagaagctgatttattatcagaagaacaaatgttaggtgcagtggtatttggtcatgaacaacaacaagttgtgattgaaaatatcaatgcattagttgccgaagtcggtaaagaaaaatgggattgggcaccagagcctattaaccaatctttacatgatcgtattgctcaattagcacaaactcgtattggtgatgcgtatcgtattactgaaaaacaagagcgttatgagcaaatcgatgctattcgtgatgaagtgatcagcacattattagcagaagatgagtctttagacgaaggcgaaatcattgaaattttctctggtttagagaagaaaattgttcgtgctcgtgtattagcgggtgaacctcgtatcgatggtcgtgaaaaagacatggtacgtgctttagatattcgtacaggtttattaccacgtacacatggctctgcgctatttactcgtggcgaaactcaagcattagtaacagctactttaggtactgcacgtgatgcacaaaccattgatgacatcatgggtgagcataccgataccttcttactgcactacaacttccctccatattctgtcggtgaaacaggtatgatgggttcgccaaaacgtcgtgaaattggtcatggtcgtttagcaaaacgtggtgtattagccgttatgccaacgattgaagaattcccatacacagtacgtgtagtgtctgaaattacagaatccaatggttcatcttcaatggcatctgtttgtggtgcttctttagcactgatggatgcgggtgtaccaattaaagaatctgttgctggtattgcaatgggtctggtaaaagaaggtgaaaacttcgttgttctttctgatattttaggtgatgaagaccatttaggtgatatggactttaaagttgcgggtagccgtaacggagtcagtgcattacaaatggatatcaaaatcgaaggtatcactcgtgaaattatgcaagttgcattaaatcaagcgaaaagcgcacgtctgcatattttaggggtaatggaaagtgcaattagccagcctcgtgcagaaatttctgagtttgcaccacgtattcacactatcaaaatcaatgctgataagatcaaagatgttatcggtaagggtggttcagttatccgtgcattaacggaagaaacgggtaccactatcgaaatcgaagatgatggtacagtgaaaattgcagctactagtggcgaacaagcaaaacaagctatcgctcgtatcgaagagatcacggcagaagtcgaagttggccgtatctataacggtaaagtaacacgtatcgttgatttcggtgcatttgttgctatcggcggtggtaaagaaggtctggtgcatatttctcaaatcgcagacaaacgcgttgagaaagtaagtgattacctgactatgggtcaagaagttccagtgaaagtactggaaattgaccgccaaggccgtatccgcttaagcatgaaagaggctcaagcaacccagcaggaaacagctgaaacttcttctgaagatcctgcaaattaa

SEQ ID NO: 1567 - DNA, 945 bp, Proteus mirabilis
ataatgagcgaagtaaaaacgcaaataaaacctaaagcaatctttctgatggggccaacagcctctggtaaaaccgcattagccattgcgctaagacaaaaactgcccgttgatcttattagtgttgattctgctcttatttatcgtggtatggatattggtactgcgaaaccggatgagacagagcagtcgcttgcaccacatcgtttaattgatattctagatcccgcattaccttattctgccgcagactttcgtaaagatgcgttaaaagcaatggaagaaattacggctgcaggacgaattccactattagtgggcgggactatgctatattttaaagcgttattagaaggcttatcgcctttacccagtgctaatccagaaattcgtgctgaaatcgaaaaaaaagcagccgaacaagggtgggaggcaattcatcacgagctagcatccgtcgatcccgttgcggccaaacggatccatcctaatgatcctcaacgcctttctcgtgcactggaagtttacctgatttcaggtaaatcgatgacagaattaactcaaatatcaggcgaagcattgccttatgatgtttatcagtttgcgattgctccgaaagatagaaatgtacttcatcaacgcattgaagcacgttttaaacagatgttaacgtgtggctttgaagatgaagtaaaatcattataccaacggggcgatctgcatgaagatttaccttctatacgttgtgtcggctatcgccagatgtggtcatatttatccggcgaaatcgactatgatgagatggtttatcgagggatctgcgctacccggcaattagcgaagcgacaaatcacttggttaagaggttggcatgatgttcattggttagatagtgaagattttgaacagtctcttaacactgttttgcaggtagttagtgcatag

SEQ ID NO: 1568 - DNA, 396 bp, Proteus mirabilis
atttgcgtagaattcgcgccctatgtgaatattttaattgtgcactcaaattatacatattgggagtgtgcggaaagcggagtttatatgtacgcggttttccaaagtggtggtaaacaacaccgagtcagcgaaggtcaaacaattcgcttagaaaagcttgaagtagcaactggcgaaactattgagtttgacaccgtcatgatggtcgctgatggcgacaacattcaaattggcgctccaatccttgagggcgttaaagttaaagcggaagtggttgctcacggtcgcggcgagaaagttaaaattgttaagttccgtcgtcgtaaacacagccgtaaacaacagggccaccgtcagtggtttactgatgttaaaatcactggtatcgcttaa

SEQ ID NO: 1569 - DNA, 1524 bp, Proteus mirabilis
tattcaggagaacgcatggagtttaatgtaaaaagcggcagcccagagaaacaacgcagcgcttgtattatcgtgggggtgtttgagcctcgtcgtttatctccgatagcggagcaacttgataaaatcagcgatggttacatcagcgccttattacgccgtggtgaactggaaggtaaagtcggccagtcattgctgctgcaccatgtgccaaatgttctctctgagcgcgttttgctgattggttgtggtaaagagcgtgaattggatgaacgtcagtacaaacaaattattcagaaaacaattaacacgctcaatgaaacagggtcaatggaagcagtttgttttctgactgagctacatgttaaaggccgtaataattactggaaagtacgtcaagcggttgaaactgcaaaagactgcctctatacctttgatcaactgaaaagtaataaaaccgaattacgtcgtccattacgtaaaatggtctttaatgtccctactcgacgtgaattaccaagcggtgaacgtgctattgcccacggcttagctattgcatcagggatcaaagcctgtaaagatttagctaatatgccacctaatatctgtaatgcggcatacttagcctctcaagctcgccaactcgctgactcatccgcgaatgtctctacccgagtcattggtgaagagcagatgaaagagctaaatatgaatgcctatttagcggtcggtcaaggttcacaaaatgaatctttaatgtcgattattgaatataaaggtaatcaagatcctgaatcccgtccaattgtactggttggtaaagggctcacctttgattctggtggtatttcaattaaacctgctgatggcatggatgaaatgaaatacgacatgtgtggtgcagcaacagtatatggtgtgatgcgcgtcgttgctgagttacaactacctattaatgtcatcggtgtattggctggctgtgaaaatatgccgggtggtaaagcctatcgccctggtgatattcttactactatgtcaggccagactgttgaggtattaaatacggatgctgaaggtcgcttagtgctgtgtgatacattaacctacgttgagcgctttgagcctgagttagttattgatatcgccacattaacaggggcttgtatggtggcattaggtcatcattatagtggattaatgtctaaccataacccattagcccatgaattaatgaatgcttcagagcaagcgggcgatcgcgcatggcgcttacctttaggcgaagagttctatgagcaaattgaatctaattttgccgatcttgccaatacgggtggacgtttagggggagccattaccgcaggttgtttcttagcgcgctttgcaagcaaatataactgggcacatttagatatcgcaggtacggcatggcgctctggtaaagcaaaaggtgctacgggtcgcccagtatctttactgtcgcagttcttattaaaccgcgcaggtttgaatagcgacgagtaa

SEQ ID NO: 1570 - DNA, 1341 bp, Proteus mirabilis
ttagtaatggaaaaattgctttctctgtatcaagaacatatcaaaacactacaaaatcgtactcgtgatgctttatctagacaccaccttgataatgtcttgattcactctggtgaacctattggtgttttccttgatgatagtgattacccttttaaagtgaatgcacactttaaagcgtgggtgccagtaactgatgtgccacattgttggttattggttgatggtgtcaataaaccaaaactctggttctattcacctgttgattattggcatagtgttgaagctttaccaagtagctattggacccatgaaattgagctgatccatttaaaaaatgtcgatgatattcaaaaagagctagcaccttttattaataaaaatactgcttatattgggccaaatacacaacgggctgattcattaggtgtcagtcttgataatgttaataaccaatctcttcttaactattatcattattatcgtgcttataaaacgggttatgaactggcatgtatgcgcgaagcgcagaaaatggcagtcaatggacatatcgccgctcgtgaggcattccaagctgagttaagtgaatttgatattaatatggcttatttaatggcaacaggacatcgggacacagatgtaccttatggcaatattgttgcattaaatgaacatgctgctgttttgcattacaccaaattagatcatcaatcgccagatgaatatcgtagtttccttattgatgcgggagcagagtataatgggtatgctgcggatattacgcgtacttattcagcgaaagaaaatcatgaatttactgctttagtcaaagatatgaatgatgcgcaacaggcattgatagcgacaatgaaagcgggagtacgctacagcgaatatcatattcaaatgcatcaacgtattgccggattattacataaatacggtatcgttaagggaattagcgaagaagagatggtgagtgaaggattaacaactcccttcttaccacatggattaggccatgcgctaggtttacaagttcatgatgcgggtggatttatgcaggatgataaagggactcatttagctgcgccagccatgtatcctttcttacgttgtacacgtattgtagagccgggaatggtacttaccattgagccaggattctattttattgattcgttattagcaccttggcgtgaagggaaatatcgtagtcattttgattggcatttgattgaacacttcaagccttttggtggcattcgtattgaagataatattattattcacgataacaaaattgaaaatatgacaagagacttacatttagcctga

SEQ ID NO: 1571 - DNA, 417 bp, Proteus mirabilis
atccgtaaggagcaatatcaaatgcgtcattacgaaatcgtttttatggttcacccagaccagagcgaacaagttcctggtatgatcgaacgttataaaaccgctatcactaatgctaatggtcagatccaccgtctcgaagactggggtcgtcgtcaactggcttatccaatcaacaaactgcacaaagcacactacgttctgatgaacgttgaagctccgcaagaagtgattgatgaactggaaactactttccgcttcaatgatgccgtgctccgcaacatgatcatgcgtactaaacacgcagtgactgaagcttcaccaatggttaaagcaaaagacgaacgtcgtcgcgatgttgctgaagatcttgatgaagaagaagttgatgatgtagcagaggattctgaagagtaa

SEQ ID NO: 1572 - DNA, 981 bp, Proteus mirabilis
gaattcgaggaagaaattatgaaactaggtattgaaacagagtcctatcacctattttttcagcagggtgtaatggatgtttttgattttataaataaagcaactgaattagggctggatggggtcgaattaaatatcattcctgatgaaggattacacccagaatttggtgtgttaacaagtgatagccctgaatatttagcaaaagtacgtcaggcaattgaagataaaaatctttattgtgaattagatacacgttttacaacaccaaaggcattaacaaaagcaattgatatcgctcgaggaattggtgctgatgtgatacgtacttatatgtttcgtcgaggacaatacaatccgaaacaataccctaaaattattcaagatattaagtctattgttccattattaaaaaaatatcgtatacgtcttgcaatagaaaatcatgaagatgaaacggctgatgaaatcttaaatattgtaaaagatattgattctatttgggttggtgcacattgtgatattggtaatggcatgatggcgtgggaagatcctatagtaacagtgagcaaattagcaccttatacatatagcactcattttaaagatcatattgttacacatgatgatgaaacactggtaattacaggaatgcctcttggtgaagggagtattgatatcgatgaatgttttcgtttattagttgaacattcgcctgtaacacgtattaacttagaaaactgttttccctatacatctcattttgctagagataaaggaacggggggagtatttgaattaagtggaagctttgaagttaaatcaccaccttttgatacgcaattaattaaccccttggaatattattatccagctaaaatttctcctgttgcattaaaaacattaatggacgcacaagagcgttgtgtacaagtttctgttaataaattaaaagaactaagaaaaaaatattgttattaa

SEQ ID NO: 1573 - DNA, 468 bp, Proteus mirabilis
cttgtagaggataaggtaatgcaaattattctgcttgataaagtagcgaatctgggtagcctgggtgatcaggttaacgtaaaatcgggctatgctcgtaactatttaatcccacagggtaaagctgtttctgcgactaagaaaaacatcgagtttttcgaagcgcgtcgtgctgagttagaagctaaattagctgaaactttagcagcagctgaagctcgtgcagcgaaaatcactgcactgggatctgtcactatcagctctaaagcgggtgacgaaggtaaactgtttggttcaatcggtacacgtgacatcgctgatgcagtaactgcagctggcgttgaaatttgtaagagcgaagttcgcctgccaaacggcgttctgcgtacaactggtgaccacgaagttcacttccaagttcacagtgacgtattcgctgaactgaatgtaatcatcgttgctgaataa

SEQ ID NO: 1574 - DNA, 381 bp, Proteus mirabilis
tatatatcactttatctggatataaaaaggttttttatgataggtgcattaaacttaagtccttcatgtgtgaaaactttgtcagcggtagaagcccttccttctagctcaaatcagcatgaattgaatggtgtttctcaattaaggagtatattaggccgagaaagaaaaacttttcctgttaaattttctcttaggggagaagatggatatgtagaatctttagttacttggtatgatgctagagaaaatcatgaatctcgttctgaataccgtctttatttccaaaccaatacagtgatggatcaagctagagcgggtagcacattagtttttggaattggtagtgatgataaattttgggcagaactaattttatag

SEQ ID NO: 1575 - DNA, 288 bp, Proteus mirabilis
tttatgtcactacaatcacaacctatcgcactagaacttattgttcgtaaccatcccggtgtgatgacccatatttgtgggctatttgcgcgtcgtgcatttaacgtcgatggtattttatgtttaccaatgaaaaacagcgataaaagtcgtatttggttattagtacaaaaagatgaacgcttaatgcagatggtgagtcaagtggaaaaacttgaggacgtaaaagaagtgcgttttagtgatgatctgcgcgtttttgaacagatggaaagttatttaaattaa

SEQ ID NO: 1576 - DNA, 1095 bp, Proteus mirabilis
gaaaggagttgcctgatgtttggtgtattagataaatatatcgggcgtacgattttgcaatcgattttgatgacgctatttttactggtatcactgtctggcattatcaaattcgtcgatcagctgcgcaaagtagggcaaggtgattttacgaccttagatgcggggatttatgcggttttaaatatcctcaaagatgtgcaaatcttctttccgatggcggccttattaggggctttattagggctaggggcattagcgacacgcagtgagctggtggtgatgcaggcatcgggttttactcgtttgcaaattgccggctccgtgatgaaaaccgcgatcccattagtactgttaacggtattaattggcgagtggggggcaccgcaaggtgaacaatatgcacgtaattaccgtgcagaaaagatcatgggtaactctttagtgtccactaaccgtggaatgtgggctaaagatggtaatcaatttatctatattaaccgtattaaaagccaaaatgagatgcaaggcattacgctgtataatttcgataataatcgaaaacttgaaactgtgcgttatgcatccagtgccacttatgatccagataaaaaagtgtggttactgaaacaagttgagcaatctgatcttacttcgccacaaaaaatcacgggtaaaaaacaggtatctttagagtggcagactcgcctaacacctgaaaaactgagtgttgtggcattagatccagatgccttatccataagtggcttatatcaatatgtaaaatacctcaaacagagtgggcaagaatcagccaactatgagctgaacttctggaaaaaaatctttgcgcctatttctgttgcggtgatgatgctaatggcgctgtcatttatttttggcccattacgtactgtacctatggggctgcgtgtggtaacaggaatagcctttggttttctgttctatattgtgaatgaagtttcaggccgattaagtttggtatatggcattcctgccgtagtggccgccttagttcctggtatgctctttttagtattaagtttatggttattaatgaggcgtaatcgctaa

SEQ ID NO: 1577 - DNA, 1341 bp, Proteus mirabilis
gtagggagactttacctatgtttttcctgtttttataaagtccatgaggtttcgcctttgtttgatcgttatgaaggtggcgaattagccgttttagtgcacgttttcttttcgcaagaaaaggatattgatgacttgcaagagtttgaatctttggtgacatctgccggtgtaaaaccagttcaaattattacagggagccgtagagcgcctcactccaaatattatgtgggagaaggtaaagcggaagaaatcgcagaagcagtaaaagcgagtggtgcagatgtggtgttatttaatcacgcactctcaccggcacaagaacgaaatctggaaagactttgtgaatgtcgtgtggttgatcgcacgggagttatcctcgatatttttgctcaacgagcaagaactcacgaaggaaagctacaggtagaactcgctcagttacgtcatttatcaacccgtttagttcgagggtggacacacttagaacgacaaaaaggggggattggattacgtggccctggcgaaacacagcttgaaacggaccgacgtttgctcagaggcaaaattagtcaaattctaatgcgtctaggcaaagttgaacgtcagcgtgaacaaggacgacaagcgcgaagtaaagctgatattccaacgttatctctggtgggttacaccaatgcgggtaagtcgagtttattcaatcgtataacctgtgctgatgtgtatgctgctgatcagttgtttgcgacactggatcctaccttaagacgaattcaggtcgatgatgttggtaccgtggtgttagctgatacggttggttttatccgacatctacctcatgatctggtggcggcatttaaggcaacgctacaagaaacacgtgaagcgacattgcttcttcatgttattgatgccgctgatagccgttttgaagagaacattcatgcagttgaaaatgtattagaagagattgatgctcacgagataccgacactgtatgtgatgaataaaattgatcttcttgaggacttcaccccaagaattgatcgaaatgaagataatttacctgttagggtttgggtttctgcacaaacaggtgaaggtattcctctgttatatcaggcgttgacagagcgcctttcaggtgagatcgcacacgttgaattgcgtttaccgccagaagaagcagggcgattacgtagccgtttttatcaattacaggctattgagcgtgaatggattgaaaaagacggtaaagttgggctaatcacccgaatgcctatggtagactggcatcgactttgcaagcaggagcctactttattggattacgtggtctga

SEQ ID NO: 1578 - DNA, 198 bp, Proteus mirabilis
cataccgcatggtttgtcggtctttatcatctaaaatgtgaactggctcaaattatattattaaacgaacaaacaagccctcatcctatgcagatgatggctttcaaactgatcaaagaaatgttcgtcagctattgctggtccgattccgctaggtcttcttgttggcctaacagtgctaattccaacaatgcgtag

SEQ ID NO: 1579 - DNA, 1278 bp, Proteus mirabilis
aacatggcgtggaatcagcccggtaacaacggacaagaccgcgacccgtgggggaaccgaaacggcggtaataataacggcgacgggaactctaacggtaatcaaggaggtcgggatcgcaaagcatcagatctcgatgatttgttccggaaactgagtgcaaaacttggcggtttcggtggtaaaaaaggaggaaacacctcttctgggcagaatggcggacctcgtggtaatgctggaaacgtattagtttctcttgcattaggtgcggtggttgtcgtttgggctgccagtggtttttataccattaaagaagccgaacaaggtgttgtgactcgtttcggtaaattttaccaaatcgtcgagcctggtttaaactggaaaccgactttcattgatgaagttcagcctgtcaacgtaaaaactatccgtgatttaactacgggtggcatgatgttgacatcagatgaaaacatggttcaagttgagataaacgttcaatatgttgtctcagatccagaagcatttctctttaatgtcacaacgccaatgaacagcctaggacaagcgacagacagtgccgtccgtggtgtcattggtcgttcagaaatggaaaagatcctgacatcgaaccgctcagaaattcgtgatcaaacccgtcaagaattagaagagacgatccgcccttataaaatggggatctccattgtggacgtcaacttccaagttgctcgcccaccagaagcggtcaaagcggcattcgatgacgtaattgcggcacgagaagaagagcagaaaaccattcgtcaggctgaggcttataaaaacgaagtgttaccattagcgaaaggtaacgcacaacgtatgattgaagaagcaaccgcttataaaacgagtgtggtgatgaaagcagaaggtgaggtggcgagtttcgccaaaatcttacctgaatatcgcgcagcaccggaaattactcgtgagcgtctgtatattgaaacaatggaaaaagtgttgtcgaaaacacgtaaagtcattgccaatgacaaaggtaacagtatgttggttctgcctttagagcaaatgttacgccagcaaccaaaagcgccaacgtcagttaatagtgtcacagaggtacctgcgcgtatttcaacccctacgccaagtaccaacacaacacctactcagaaaccagcaacaacttatggtaacggtggatatggtagcaataatagtggtggttatggtcagccttatggctctaatcaaggaggacaataa

SEQ ID NO: 1580 - DNA, 1452 bp, Proteus mirabilis
atgcattttcgttcaataacccgaattgttgggctacttgttattttattctctgtcacgatgatcatccccggtatcgttgcgttgatctatcgggatggtgcaggacgagcatttagtcagacatttattgtcgctcttattattgggctaatgttgtggatccccaatcgaaacaataaaagtgatctaaaacccaaagaaggttttcttattgtggttttattttggacagtgttaggcagcgtaggggcattgccttttattttttcggaacaacctcatctatcgattaccgatgccttttttgaatctttttccggattaacaaccacaggggctacgacacttgttgggttggatagcttacctaaagcgattttattttatcgccaaatgctgcaatggttagggggaatggggatcatcgtattagcggtggcaattcttccactgttaggcgttgggggaatgcagctttatcgggcagaaatgcccgggcctttgaaagacaataaaatgcgcccaaggatcgcagaaactgcgaaagcattgtggctgatttatgtcttactcactattatttgtgcccttgcgttgtggattgcgggtatggacgtgtttgatgctatctcgcatagtttttctaccattgcaatcggtggattttctacccatgatgcaagcattggctattttaatagtccaacaattaacgtcattattggtgtttttctattaatttcagggtgtaactttgctttacacttttcggttttaacagggcgaagcctcaatatttattggcgtgatcctgaatttcgcatgtttatctttatacagctcggattagtgattatttgtagccttattctatggctctattcggtatatgactctggatggacaacaattaatcaagcttttttccaagttgtttcaatggcaacaaccgcagggtttgcaacagatagttttgcccaatggccaacttttttacctctgttgctgttgtgctctgcctttatcgggggctgtgctggttcaacgggggggggattaaaagtaatccgtatcttactgctatttttacaaggctctcgtgaattaaaacgtcttgtacaccctaatgcggtttatacgattaaactaggacatcgagcattaccagagcgtattatagaagcggtttggggctttttctcagcatatgctttagtgtttattattagcttaatgctgttaatagcgacaggtgttgatgagttttctgctttttctgctattgctacaacacttaataatttgggtccaggattaggtattgttgctgataactttacaacaatgaatccagccgctaagtggatacttgttgtcaccatgttatttggccgattagaagttttcacattattggttttatttacaccaacattttggcgtgattaa

SEQ ID NO: 1581 - DNA, 1173 bp, Proteus mirabilis
ctattatttcggttgctcatgtcatcactcgatcttcatcaccttgctcaaaatataaaacgttggggaactgaactaggattccaacaaacaggaatttgcgatactgatttatcgctcgaagagcctcgtttacaagcttggttagataaacagtatcatggtgaaatggcatggatggctaaatatggcatgactcgagcaagaccccatgaattggtgccgggcacattgcgtgtgatcagcgtcagaatgaactatttgccaacagatgccgcttttgctcgtacccttaataatccagagcaaggctatattagccgttatgcattaggtagagattatcacaaagtattaagacaacgccttaaaaaattaggtgaaaaaattacgcaatattgccaacagtttgaatatcaaggtattgttaattttcgcccttttgttgattcagcgccgataatggaacgaccattggccgtgaaagctggccttgggtgggttggtaaacactcacttgttatcaataatcaggccggctcttggttttttctcggtgaattattaattaatttacctttgcctattgattctcccgttgaagagcaatgcggtaaatgtgtagcttgcatgaccacttgcccaacaggcgccatcgtagagccttacaccattgatgctcgtcgctgtatttcttacctaacgattgaacttgaaggcgctattcctgaagaatttcgccctttgatgggcaatcgtatctatggttgtgatgattgccaattaatttgcccatggaatcgtttttcttcgctcacagaggaagatgatttttctccgcgccgtgccttacatacaccagaattgctggatctattccaatggagtgaagaaaaatttctgcgtattacagaaggttcaccgatccgacgaattggctatttacgttggctaagaaatattagtgttgcgttaggcaatgccccttatcaggacaaaattgtactggccttgcaagagcgctttggtttaggggaggttttagatgaacatttgcactgggctatcgcccaacagaaagccaaaagagaagaaaaaacactaaaaatacagacttcacaacaaaaacgtctagtaagggcaataactaagggcctacctcgtgatgcttag

SEQ ID NO: 1582 - DNA, 207 bp, Proteus mirabilis
gtgctactacggcgacgtggtacattttcgttattaccgccctcgctcaccatttacctgaacaatttgcttaatccattagagcaagagcgtttagccaaaacattaagtcgtttacgccaaggcaataaacaaaatattgatttattatcgccaccagaagaacgcttaaagtgcattccttgtactaggtatagccgtatttag

SEQ ID NO: 1583 - DNA, 2928 bp, Proteus mirabilis
caatggctacgccgccaacctattgaatacgtaaagaatatggaaaataaatccgcaccgaaagagccatcgctcgatacaacttataatccgacagagattgaacaacctctgtatcaacattgggaaaaaaatggctactttaaagccaatggtgatacatccaaagaaagcttttgtattgtgatcccaccacctaatgtgacaggtagcctgcacatgggtcatgctttccaacaaaccatcatggacaccatgatccgctatcaacgtatgcagggtaaaaataccttgtggcaagcgggtactgaccatgcaggtatcgcaacacagatggttgttgagcgtaagattgctgctgaagaaggtaaaaaccgccatgattatggccgtgatgctttcatcgataaaatttgggagtggaaagcagagtccggcggtaatatctctaaccaaatgcgccgtttaggtaactccgtagattgggatcgcgaacgctttaccatggatgaaggtttatctaaagcagtaaaagaagccttcgttcgtttacacaaagaagatcttatctatcgtggcaaacgtcttgttaactgggatcctaaattacacactgccatttccgatctcgaagttgaaaaccgcgaagtaaaaggctcaatgtggcatctgcgttatccattagctgatggcgttaaaacggcagagggtaaagattatctgattgttgccacgactcgtcctgaaacactgttaggtgatactggcgttgcggttaacccagaagatccacgttataaagatctgattggtaaagaggttattctacctttaatgaaccgtcgtattcctattttagcggatgaacacgcggatatggaaaaaggcaccggttgtgtaaaaatcacccctgcccatgactttaatgactatgaagtaggtcgtcgccatcaactaccaatgattaatatcatggattttgatggcaacattcgtgttagcgcagaagtattagacactaacggtgttgaatctgatgtatatagcacagagatcccgaaagcctaccaaggtatggaacgttttgcagcacgtaaagctattgttgctgaatttgaacgtttaggattattagaagagatcaaacctcacgatttaacggtaccttacggtgatcgtggtggtgtggttattgaacctttattaactgaccaatggtatgtccgtgcagcacctttagcgaaacctgcggtagaagcggttaaaaatggcgatattcaatttgtacctaaacagtacgaaaacatgtacttctcttggatgaatgatattcaagattggtgtatttctcgtcaactgtggtggggtcatcgtatcccggcttggtatgataacgaaggtcatgtttatgtcggtcgtgacgaagaagaagtgcgtcgtgaaaataacattgctgccgatgtagcattacgccaagatgaagacgtactcgatacgtggttctcttctgcactgtggacattttcaaccttaggctggccagaaaacaccgaagcactgaaaacattccatccaacgaatgtattagtgagcggtttcgatattatcttcttctggattgcccgcatgatcatgatgaccatgcactttattaaagatgatgaaggtaaaccacaggttccatttaaaaccgtttatatgacaggccttatccgtgatgaagaaggtcagaaaatgtcaaaatctaaaggtaacgtacttgatcctttagatatgattgacggtatcacattagataaactgttagaaaaacgcactggtaatatgatgcagccacaaatggctgagcgtattgctaaacgcaccaaaaaagagttcccagaaggtattgaagcacatggtactgatgctctgcgctttactttagcggcgttagcttctacagggcgtgatattaactgggatatgaaacgtctgtcaggttaccgtaatttctgtaacaaattatggaatgccagtcgttttgtgctgatgaatacagaagatcaagactgtggctatcaaggtggtgagatgacattctcattggctgatcgctggatcttagctgaattcaataacaccataaaagcctatcgtgaagcgttagataattatcgctttgatatcgctgccggtattttatacgaattcacttggaaccaattctgtgactggtatcttgagttatcaaaaccggcggttcataaaggtaatgatgctcaaaaacgtgctgctcgtcataccttgattgaagtattagagggtctgttacgtcttgctcatccaattattccatttattacagaaactatctggcaacgcgttaaagaggtgaaaggcattgaaggcgaaaccatcatgcttcaagctttccctgaatttgatgcgtcattagtcgacgagcaagcacttaacgatctggaatggatcaaagaggttatcgtcgcagttcgtaatatccgtgcagaaatgaatattgcgccaggtaaaccactggatgttattttacgtggtgcggatgaaacggctaaacgtcgcgtcagtgataacattggtttcttaaaagcaatgggtcgcttagcggatattcgcccattagcggaaggtgaagaagcaccattatcggtaactaaactggtgagcggtgcagagctgttgatcccaatggccggctttattgataaagatgcagagcttgcccgtttagataaagagcttgaaaaagtagagaaagatatcactacattagacagcaaattatcaaacgaaggctttgttaatcgcgcacctgaggctgttgtcgccaaagagcgtgagcgtttagcatcttgtttaaatgctaaagagaagctgattgcccaaaaagtctctattgctgcgttataa

SEQ ID NO: 1584 - DNA, 318 bp, Proteus mirabilis
ctctaccaacgtatactcaactcaaccgacatcaagttaatgatgtgggtacatttgcgggtatatgtcgattcgataaagttttgtactcgcaattcggctgcgaggatagttaaaatggcactttccgatactaaggttcgttctgcaaaatctgaagataaagtatataagctgacagatggtaacggactatttcttctggttcactccaatggttctaaatattggcgcttttgttatcgctttggcggtaaagaaaagatgttagtatttggcgtgataagttatttttacagattattgataatgatctga

SEQ ID NO: 1585 - DNA, 1338 bp, Proteus mirabilis
atgagcgaacgtaaatactttggaacagacggtatccgtggaaaagtaggtgacagccctattacacctgattttgtattaaagctaggctgggctgcaggtaaagtacttgcacgtcacggctcacgtaaaatcattatcggtaaagatactcgtatttctggttatatgttggaatcggctctagaagcaggccttgctgctgcgggattatccgcttcatttacaggcccgatgccaaccccggcggtcgcttatttaacccgtactttcagagcagaagctggcatagtgatttctgcttctcataatccctattatgataatggcatcaaattcttctccattgatggtacaaaactacctgatgaagtagaagaagccattgaagcggaaatggaaaaaccgatcacttgtgtagagtccgcagaattagggcgtgcgaatcgcattgttgatgccgcaggccgttatattgaattttgtaaaggtacgttccctaacgaaaataatttaaatgggttaaaagttgttgtggattgtgcccatggtgcaacttaccatattgcgcctaatgtttttcgtgaactcggggctgaggttatcactattggttgtgagcctacgggcatcaatatcaatgacgaatgtggtgcaacagatgtacgtatgttgcaaaaacgcgtgttagaagagggtgccgacgttggtttagcctttgatggtgatggtgaccgtattattatggttgatcataaaggcctaaaagtagatggtgaccaaattctctatatcattgcgcgagaagcattgcgtcaaggtcaactacgtggtggtgccgtcggtacactaatgagtaatatggggttagagattgccttaaaacagcttggtattccttttgtgagagccaaagtgggtgaccgctatgtacttgagaaattgcaagaaaaaggctggcgtttaggggcggaaaactcgggtcatattattttacttgataagacaacaacgggtgatggtattgttgctggtctgcaagtattaagcgcaatggttcgtaaccatatgagcttgcatgatctatgcagtggcatgaaattattaccacaaattttggtgaatgttcgttttacgggaaatcacgatcctctacaatccacagaagttcagcaagtcgcaaaagaagttgaggcggagcttggtggtaagggacgcgttttattacgtaaatcaggaacagaaccattaattcgagtgatggttgaaggcgaaaatgaagagcaagtcacagcgatggcgaatcgtattgctgatgcagtaaaacatgttggctaa

SEQ ID NO: 1586 - DNA, 2307 bp, Proteus mirabilis
acatctagacggctaaaaacaggattttttattatgacaattcgcaatcacacattaggtttcccacgtattggcttaaatagagagctaaaaaaggcacaagagagctattgggctggtaatatttctcaggcagaacttctggcagttggtaaagaattacgcgctcgtcattggcaacagcaagctaatgcaggagtcgaattattacccgttggcgattttgcttggtacgaccaagtcttgggtactagtctcctattaggcaatataccgccacgccatcgtaatgaagatggtcgcctagatcttgatactctatttcgagtggcgagaggcagagcaccaacgggtaaacctgcggccgcctcagaaatgacaaaatggtttaatactaactatcactatatcgtgccagaatttcagcaaggacaatcatttacactggcgtggcaacagctactggatgaagtcgatgaggctttagcattaggccataatgtgaaaccggtacttttggggccgatcacctacttatggttaggaaaagttaaaggacctgagtttgatagattgtcactgttagacgctattttacctgtttatcagcaagtattgagtcagttacagcaaaaaggtatcgagtgggtacaaattgatgagcctgcactggttcttgatttacccattgagtggcaaaatgcttatcaagttgcttatcaagcattgactggacaggttaaactattattgactacctattttgatggtattactcatcatcttgatattattaaaaacttaccggtaaatgggctacatattgatctatgtgcaggacaggacgcattgcaagttatacaccaagcattgcctaaagactgggtgttatcgttaggggtcattaatggtcgcaacgtctggaaagcggatctaactacccgttatcaacaagtagttgcattaaaaggtaagcgtccattatggattggcacatcatgctctttgttgcatagtccaattgatttaagtgcggagactaagcttgatgatgaagtgaaaagctggtttgcctttgcggtgcaaaaatgtgcagaagtggcgttactcgcaaaagcattaaatgcaccagaaggtgaatatgacgaacaacttgcccaatacagtgcccccattcgtcaacgtgaacactctagtcgtgtacataatgcaaaagtggccgcacgcttgcaggcgattaatgcacaagacagtgaaagaacatcgccttatcaacaacgagctaaagtgcaacgcgctcggtttaatctccctctgtggccaacgacaaccataggttcattcccacaaactaccgagatccgcacagtacgtttagactttaaaaaagggcgtattgataccactgcttatcgcactaatattagcgagcatattaagcaagccatagatgaacaagagcgcttagggcttgatgtgttggttcatggtgaagctgagcgtaatgacatggttgaatattttggcgagcattttgaaggttatgtctttactcaaaatggctgggtacaaagctacggctcccgctgcgtaaaaccgccggtgatcattggtgatattagccgtcctgcaccgattacggtagattgggcaacttatgctcaatcattaaccgataagccagttaagggtatgttaactgggccggtgactattttatgttggtctttcccgcgtgaggatgtcagccgtgaaactatcgctaaacaaattgcgttagcgttacgtgatgaggtggatgatttacaaaaagccggtatcggtattattcagatagatgagcctgcattacgcgaaggattaccgttacgtcgtgatgagtggcaagcatacctagattgggctgttgatgcctttaagctcagtgcagctatcgctgatgatgagacacaaattcatacacatatgtgttattgcgagtttaatgacattatggaggcgattgctgcattggatgcggatgtgatcaccattgaaacatcacgctcagatatggagttattagaagcctttgaacattttgattatccaaatgaaattggtcctggggtatacgatattcattcgcctaatgtaccgaatgtagaatggattgtagggttgttaagaaaagcgcaatcgcgtatccctgcggaacgtttatgggtaaatccagattgtggtttaaaaacgcgggggtggagtgaaacccgtgcagcattggcaaatatggttgaagcggctaaatatttacgccagaacgtataa

SEQ ID NO: 1587 - DNA, 1329 bp, Proteus mirabilis
tcaaatatttttcgccggtattttgtgacaaagaccaaatggacgtgcatcaggaatatacaatgtctgccacggagaatattagtttcatttttcatggaccaaaatataataggtaatatgaaacgtctacaagcctttaaattccagttaagacccaatggtcagcaagagcgtgagatgagacgctttgcaggggcttgtcgttttgttttcaatcgggcattagcacgtcagaatgagaattacgaagcagggaataaatacattccctatacaaaaatggcttcatggctcattgagtggaaatctgacacagagacacaatggttgaaggaagccccatcacaaccgttacaacagtcacttaaagatttggaacgggcttacaagaattttttccagcagcgtaccgcttttcctcgattcaagaaacgcggtaaaaatgacgcttttcgctacccgcagggcgtgaagctcgatcaaaccaatagtcgtatatcattgccaaagttgggatggatgcgctaccgcaacagtcgtgaagtcgtcggagaagtgagaaacgtcacggtcagtcagtcatgcggtaaatggtacgtcagcattcagactgagtatgaagcgacagaaccacaacctgaatcaacctcaatagtcgggcttgatgcaggcgttacaaaacttgccacgctttcagacggtacggtatacccgcccgtcagcagttttaaagtaaaccagcgaaagctggcaaggcttcaacggaaattaagccgtaaaatcaaattcagtgccaactggcaaaaacaaaagcgcaaaattcaacgtctgcattctcatattgccaatataaggaaagactcccttcacaaagtcaccagcgaaatcagcaaaaaccacgcaatgattgtcattgaggacttaaaggtcagtaacatgtctaaatcggcaaaaggtacgacagaacggcctggacggaacgtaaaagctaaatctggtttaaaccgctcaatactggagcagggctggtatgaaatgcgccgacagcttgagtacaagcagctctggcgaggtggtcaggtactggcaataccaccggcctacaccagtcagaagtgcgcttactgtggtcatacagcaaaggaaaaccgccagtcacaaagtcaattcgagtgccttgaatgtggatatacagcgaatgctgatatcaacggggcacgtaacattttagcggcaggacatgccgtgcttgcctgtggagggagggtgcagtcaggccgcccgtcgaagcaggaacccgccgaggtgattcagacatcagtctga

SEQ ID NO: 1588 - DNA, 312 bp, Proteus mirabilis
actttttttagacttaatttagtcttattgattgaggtagatatgcgttactcagaacaaatcaaaccaattagttatttaaaagctaatgtcgccgaagtgatgactaaactcactgaatctggtgcaccgatgattattactcaaaatggcgaagcaaaagcggttattcaggatattacctcttatgaagagacacaggaaacattagccttacttaaaatattggcgttaggtcagcaacaagttgaagcaggtgaagtaaaagatataaaaagcgtggttcagcgtttaaaaagtaaaaggaaataa

SEQ ID NO: 1589 - DNA, 2550 bp, Proteus mirabilis
attgttattagaagatgtttgagtcgacaatttcatcattctgatagcttggaggtcataatgtccaaagatccttttcaggatagagaagccgaaaaatacgcctctccaattgctagtcgtgaatttattttagaagaaatgaagaaacgtccggccccgatgagccgtgaagatatcgcgcaggcattgaaaatttcaggtgaagaaaatctggaagcattacgtcgtcgtttacgggctatggaacgagatggtcagttagtttttactcgacgtcagtgttatgccttacctgaacgcctcgatctttggaaaggtaaagttatcggtcaccgtgacggctatggttttttacgtgcggaaggccaaaaggatgatctctatctttcacaagatgaaatgaaaaaaaccatgcatggtgatgtgattttagcgcaacccctaggcatggatagaaaagggcgtcgagaaggtcgcgtcgttcgtgttcttgaacccagaaacagccaaattgttgggcgctattttattgagtcaggtatgggatttgtagtacctgacgatagccgtttaagttttgatattcttatccctaaagaagatatcatgggcgcacgtatggggaatgtggtggtggttgaagttaccacaagaccaacacggcgtactcaagcggtaggacgcattgttgaaattttaggtgaaactatggggacgggaattgcggtagaaattgcactacgcacccatgaaattcctcatacttggccacctaaagtagaaaaagaaatcgctgatttaaaagaggatgtgccagagtcagcgaaacaaggtcgcgttgatttgcgtgatctccctttaattaccattgatggtgaagatgcgcgagactttgatgatgccgtttattgccagcgtaaaaaaggcgggggctggcgtttatgggtagcaattgcagatgtgagctattatgtacgccctcaaactgcattagacacagaagcgcgtagccgaggcaattcggtctatttcccatctcaagttgtccctatgctgccagaagtactgtcgaatggattatgttcattaaatccacaagtcgaccgtttatgtatggtttgtgaaatgaccgtttctgagcaggggcgcctttcatcttataaattctatgaagccgtaatgagctctcacgcgcgaatgacttacaccaaagtatggaaaatcattcaaggtgatgaagagttacgtgagcactaccaaccgatcgtaaaagatattgagcacctttatgagctatatcaagccctcgataaggcgcgtgaacagcgtggtgccattggttttgaatcggaagaagcgaaatttattttcaatgcagaacgtcgtatcgatcgtatcgaaccggttgtacgtaatgatgcacataaattaattgaagagtgcatgattttagccaatattgcggcggcgcgttttgttgagaaaaatgaagagcctgcgttatatcgtgtgcatgataaacccaaagaagagagcgtaatgaatttacgttcggtatttaatgaactgggtttaacgttaccgggaggattaacaccggagccaggcgattatgcgcgagtcatgaaagaagtcgaagagcgtccagatcacgaaatgctacaaaccatggtattgcgctccatgaaacaggcgatttacgatcctgaaaatcgaggtcactttggtttagcattaaaatcttatgctcactttacttcacccatccgtcgttatcctgacttagcattacatcgtgctattaaataccagatagcgaaacagcaaggccatggctcacagcgctggacaccaacgggtggctatcatagtgatatggataccatgcttcagttaggggaacactgctctttaactgaacgtcgggcggatgaagcaacccgtgatgtggctgattggctgaaatgtgatttcatgcttgatcaaataggtcagcaatttaccggtattattaccagtgtcactggtttcggtttctttgtgcgcttaaacgatctatttattgatggtcttgttcatgtatccacattaaataatgattactatcaatttgataatgttggacagcgtttaattggtgagtcatccggtcaggtgtatcgtctgggtgatgaagttgaagtgaaagttgaagcggtcagtatggatgaacgtactattgacttctcattgatttcaacaacacgtaaagcacgtaaccccgggaaaacagcacgtgttcgtgcgttaaaagggggaaaagacaagaaaaatgcgagcagtagtaagtctcgtcgtcgtgatgccagcaaagacaaaaactttgaacctgatagtgcctttaggaaaggtaaatcaagtaaagaaaaacagagtaaagataaagtcattaaagagaaaattgcgaaggacaaggcgagtactaaacgtaaaaaagcctctgcacaaaccaaaaagatagaggcgaaattaaaagccaaacgtgcggcgaaacgcactaaagcgtag

SEQ ID NO: 1590 - DNA, 333 bp, Proteus mirabilis
agagtaattagtgttgtgacggctaatcgattagtgctaacaggcactgtgtgcaaagcattgatacgaaaagttagccctgctgggatcccgcattgccaatttgtgattgagcatcgttcaacacaagaagaagcgggattaaaaagacaatcatggtgcagaatgcccattattgccagtgggaaagcgttacaaactgatactcacagtataacggtcggtagcaaagttaccgtttcaggattcattagtagccatcaggcgagaaatggattgtttaaactggtattgcatgccgaacagattgaattgatagattctggagactag

SEQ ID NO: 1591 - DNA, 954 bp, Proteus mirabilis
ttaaattatagaaaaaacattatgataagctataaaaaaacaatgcgttttttattgtatttaagctgcggtttattttcaaacccagtactatcatttacttgtaaagtcgcttcaacgggacaaattgttggtgatggtgctgctaatatacgcgttaatttaacgcctcgagttgaagtaaaccagaatttggtagtggatttatctcaacaaattctttgtaaaaatgattcttatggtggacctagagatccaatagacgttgaccatgttaatttagttagtggaacgacttttggaggcgcgctgaataattttgacggctctttattatggtataacagttattatcctattcctctttattacgatacaaaagttattaatattaaagacagaaattttatcccactaaatcttagattgtatttgaaaagtattggtgctgcgggagggaagcaaataaataagggggatttaattgcaaaaatagaaatgtacaaaattgcagattgggatggtgggcaccctcgtttttttacatggaatatttacgcattaaatgatgttattatgcctactgggggctgtgatctttctagtagaaatgtcacgattaatcttcctgaatatccgggtaatgcgcaacctattcctttatctattttttgtcctagacaacaaaatatttcttactatttaacaggatcaacgtctgatgtgaataatacggtctttaccaatatatcatctaactctcctgctaaaggggttggaattaaaatatcaaataataatggtgttattcctgctaatacaccggtcaaattaggcaatgtgacgaataatagtgtgagtttaaggctatctgcttcgtatggtgaaacgggagaaagagtaagagcgggtaatgtaaaatccgttatcggtgtgacctttgtttatgagtag

SEQ ID NO: 1592 - DNA, 303 bp, Proteus mirabilis
ggaaaacatagaatggctaaggggcaatctttgcaagatccttttctgaacgcattacgtcgtgaaagggtccctgtttcaatctatttggtaaacggcattaaattacagggtcagatcgaatcttttgaccaatttgttattctgctgaaaaacactgttagtcagatggtatacaaacatgctatctctaccgtagtaccttctcgtcctgtttctcatcatagcaatacaggtaccaaccaagcgggtacaaactacagtggcggtaacgcgactcagcaggatgatgttgcagaataa

SEQ ID NO: 1593 - DNA, 687 bp, Proteus mirabilis
aaagaattcagggagcaggtaaggatcatggttcgtgctagtatggcaacaagaaataaaaaagaggttacaattagtgatagtgattcacagttcaatcatgaggtgaatatgggcaaattcccaggcttacatcgtcgagcaatcgttgttattgccattattttgttagtcgtttttttctggccaacaagtgaaaataccaccccacctcaaccctcatcttcgacacaagatcttcctgtgcctgtagcaccttctgtctcaaatgaaacacaaaatgtccctaatacactaccaccagcacaagatagtctaaatgctgagcaagagacagaagacttaccagaagaaggtgaagccaataataccaataacaatacgccagtaaacacaacgcctcaagcaccgtcaaccgcgactgaaaattggcaaacttataccattaaagaggggcaaacccttgcacaactatttagagataatcagttgcttgtcaatgatgcgtttactatggcgaaatcagaaggcccacaaaagccgttaagccagttacgcgccggacaaaccattcgtttacaacgaggttcacaaggtgaagtgagtatgcttgaagtgactgacaataccggtactgttattaccttcactcgactcagtgatggtagttattatcgtacgccatag

SEQ ID NO: 1594 - DNA, 1710 bp, Proteus mirabilis
aaaggacacagaacaatgggtgctcaacaagataatgccacaggaaaaaccttcactggtgcgcaattaattgtttatttactggaacggcaaggtatcactacggttgcggggatccccggcggagccgctcttcctttgtatgatgcattaagccaaagtcagtctattcgccatattttgacacgtcatgaacaaggggcgggttttattgcccaaggtatggctagagcaaatggtcagcctgcggtgtgtattgcctcaagtggaccgggggcgacaaacttagttacagccattgctgatgcaaaattagactcaattcctttggtttgcattacggggcaagtctcttctgccatgattgggactgatgcgtttcaagaagttgatacctatgggatgtctattcctattaccaaacacaactatttagtccgcgatatcgcacagttgccggaaattatctgtgatgcgtttcgtttggcaatgtcaggtcgccctggacctgtatgggttgatgtacctaaagatattcaacaagcgactatcaccttagatcaattgccaccgataccacaaaaagatgcagccccagcctttaataccgatttggtgatccaagccgcgcaaatgattaaccaagcgaaaaatcctgtgctttatttagggggcggtattattagctctgaagcgtgtaaagaagcgattgagttggcggagaaaaatagcctacccaccacgatgacgttaatgggattaggtttaatgccaccaacacacccgctatatttagggatgttaggtatgcatgcggcacggagtaccaactttattttagaagaagccgatctgctgatcgtattgggggcgcgatttgatgatagggcaattggtaaagcagaaaagttttgccccaatgcgaagatcatccatgttgatattgatagggcagagataagtaagatcaaacgtcctgatattgccattcatgcagatgctaaagcggtgctgtcgctgttattacctttaattaatattaatcagcgcaacgaatggatagatagagttaataccttaaaacaagaatatcccttagaaatgaaaaactcacacaatattcttagcggttacggcatcgtacttgctgcggcaaattgtgttgatgatgaagcgattattaccaccgatgtagggcagcatcagatgtgggttgctcaagcttatccactgaatcgaccgcgccaatggttaacatcaggaggcttggggacgatgggatttgggttgccggcagcgataggggccgcattggcagagccaaataaaaagatcctctgtttttcaggggatggtagcatcatgatgaatattcaggagttagcaacagccgctgagcatcagttagatgtaaagattattttgataaataatcaagcattagggttagtacaccaacaacaaacactcttttttgatgagcgtatttatgccgcagcctacccttatcaaacggattttattcgtattgctcaaggatttgggttggatacttgtgatttaaatcaagaagcagatcctcaggcagcgttacaagcggcaattgctaaacctgggccttgtttaattcatgccatgattgatattaacgaaaaagtatttccaatggttccgccgggggcggcaaatatcgagatgataggagcttaa

SEQ ID NO: 1595 - DNA, 1851 bp, Proteus mirabilis
atgaggcacagtgacatgactactgaaaccgatatgacttttgctgatctaggtttatcagcacctattttgactgcactgaatgatttaggctacgagaagccttctccaattcagcaacaatgtattcctttccttttagatggcaatgatgttctaggtatggcacaaaccggtagtggtaaaaccgctgcgtttagcttaccgttattacacaatctagatgaatcattaaaagcaccacaaattttagtgttagcaccaacccgtgaacttgcggttcaggttgccgaagccattgaagatttttctaaacatttaccaaaagtgaatgtcgttgctctgtatggcggccaacgctatgacgttcaactacgtgcattacgccaagggccacaagttgttgtgggtacaccgggtcgtttattagatcacttaaaccgtggcaccttagatttatctaaactaaaaggtttagtattagatgaagctgatgaaatgttacgtatgggctttattgaagatgttgagaatatcttaagtaagatcccagcagagcaccagaccgcattattctctgcgacgatgccagaagctatccgtcgtattacacgtcgctttatgaatgatccaaaagaagtacgtattcaaagcagtgtaactacacgcccagatattagccaaagctattggatgacttatggtgcacgtaaaaatgaagcattaatccgtttcttagaagcagaagatttcgatgcagctattattttcgttcgtacaaaaaatgcgaccttagaagtagcagaaaccttagagcgtaatggctataacagtgcggcattgaatggtgacatgaatcagtctctgcgtgagcaaacattagagcgtctgaaaaacggccgtttagatatccttattgcaacggatgttgctgcgcgtggtctggatgttgaccgtatcagcttggttgtcaactatgatatccctatggattcagagtcttatgtacaccgtattggccgtactggccgtgcaggtcgtgcgggtcgtgcaattctatttgttgataatcgtgagcgccgtttactgcgcaatatcgagcgcacgatgaagatgtctattcctgaagttgagttaccaaacgcagagctgattagtcagcgtcgtcaggaaaaatttgctcagcaaatcgctcaacagttagaaacaagtaaccttgaccaatatcgtgcattgttaccaaaattagcgccacaaggtgaagaagcgttagatatggaaacattggcggcggtattactgaaaatggctcaaggtgagcgtgcacttattctgccacctgatccagtacgtcgtcctcgtcgtgaatttaacgatcgtgacgatcgccgtaacgatcgcgaacgttctccacgtcgtgagcgccgtgatgcgggtgaaatggatctctatcgtattgaagtgggtcgtgatgatggggttgaggttcgtcatattgttggtgctattgccaacgaaggcgatatcagtagccgttatattggtaatatcaaattatatggctctcactcaaccattgagttaccaaaagggatgccaggcgatttattaagccacttcactcgtactcgcattatgaataaaccattgaatatgcagttagtgggtgatgcacaaccttaccgtgagcgccgtaatagcagccgtcgtgatggtcagccacaaggtggtcgtcgctttagtaaaggcgatcaaccaccacgccgtggtaatggcgagcgtggtaacttccgtggtcgcggtaataacgaaaacgcaccacgtcgccgtagtagctctcataatcaataa

SEQ ID NO: 1596 - DNA, 390 bp, Proteus mirabilis
aaaggaataagcttgatggaacccatttatattaaagtttatattaatcgcatcgaagttcgtgatcttcacaccaaaaaagaattttctgtagaacgtcattttactcatagtcgaatgttaattggcgatttttaccctgctattgaagcgatacgaacagcacttactcaaataggtattaacccattatcctttttttgtcgaaaaagaaatgtggtaattcatcctttagaacgtaccgaagatggattatcccaagtagaaattcgattattcaatgaagtcattgccggtgggttgaataacaaatacaaaaaaatcgttattagtgcaaaactcacaccacttatggatgcagaggtgattgaattaatcaataaatcataa

SEQ ID NO: 1597 - DNA, 1062 bp, Proteus mirabilis
ccggtcgtaagcgctctcttttttccaaaaagctattttttaaaacccctctcattgaggggttttttttggtctgtagaaaaacacatatcgcaccatttatcgtatcatcaaaggagaactctaatgactaatccgctctatcataagcatattatctccatcaatgatctgaaccgagacgatctggagtctgttctccatgttgctgacaaattaaaacagcaccccaatagccaattgttaaaagacaaagtgattgccagttgtttttttgaagcctccacccgcactcgcttatcttttgaaacagcaatccaccgtttaggggcgtctgtggttggctttgcagatggtagtaacacctctttaggtaaaaaaggggaaaccttagctgatactatttctgtactacgtacttatgctgatgccattgttattcgtcatcctcaagaaggtgcggcacgtttggcctctgaatttgctggggatatccccgttattaatgctggggacggtgccaaccaacacccaagccaaacgttactagacttgtttaccattaaagaaacacaaggccgattagataacctcaatatcgcgatggtaggtgatttaaaatatggtcgcacagtacactcactagcccaagcattagccaaatttacaggaaatcacctctattttattgccccaaaagtgctggccatgccagagcatatcttgcatttactcgaagagcatggtgttgaatatagtcagcatgaaactgtagatgaagtgatgtcagagctagatatcctgtatatgactcgggtacaaaaagagcgccttgatccttctgaatatgccaatgtcaaagcccaatttatcttaaccagtgctgatctggtgaatgtaaaagataatcttaagatattacaccccctgccacgtatcgatgaaattaccaccgatgttgataacaccccttatgcttactatttccaacaagcaggtaatggtatttacgcgcgtcaggcactacttgccttagttctaaataaaaacttagttctttaa

SEQ ID NO: 1598 - DNA, 552 bp, Proteus mirabilis
atgttaaggagtccgaaagtgtttaataaaattcgcacccgcctagttaaagatggccctcgtttcttgcgttaccctttgcaaatcacgccatttgctttgcaacgtgatattttagaacagtttttaagttggcaattccgcgaagcattagctgagggggatttacacttcttagaagataaatggctaaaggtagaaattaaagatttacatttgcagtggtttatcagtgtttgtgatgataaattaatcgtaagccgttctgaaaaagaagatgtaagttttagtggtaatgctaacgatcttattttaattgccgcgcgtaaagaagatccggacaccttgttttttcaacgacgcttacaaattgagggcgatacagaacttgggttatatgttaagaacctaatggatgcaattgagttagactctatgccatctgtattgcgttttggtttactacaattggctgattttgtgaaaagtggccttcaagatgaagttgaagacaccgcacacagccatgaactgagctcaacttcatgctaa

SEQ ID NO: 1599 - DNA, 825 bp, Proteus mirabilis
ggtcttgatggtcttaacaatacaacaatgagaagaggcattatgactgatatcttacaaacacatccttcggtgttgcctttaacaggtgggattaactttcgtgatctagggggaaaaaagctcagtaatggcggtattatcaaacccggcttactctttcgctccggttcactggatagattaacggataccgatcaagcgcttcttattgataaaaatctttttcaaatcttagactatcgtgacacaggtgaaattgttgataagccggatcgagtatgggaaggggcacaatattaccatgctccagccaatccattatcgaaagaagtgtcagctaaccttgaaaaactcaccccagaaatattggaacagtttgatgctaaagcatttatgtttcagctatataaattactacctattaataatccggcttataaacagttggcaacgttgttgaagcaaccagaaaaaggcggtgtcatacaacattgtgcagtaggtaaagatagaacgggggtgggctctgctttagttctatttgccttaggggcctcattagatgtggtgatggaagattacttactcaccaatgaaacattagcgcctttccgcgcttatcttttagaagagcatgctaaaacactgagtgaaaatgtggtgaataaatttgcgtatgtttattcagtacaagaagagttcctgcaaacagcccttgccagtattaatcaacactatggcaatatcgatacttggcttgaaaaagatattggcttggatgcgcaaagtagagaaagcttacaaaactattttctcgaatag

SEQ ID NO: 1600 - DNA, 219 bp, Proteus mirabilis
aagcgagtcggcccttcgcaccataagaacatcaagagacgtcaacagacgtctttttttgtatctaaaatccctgttttacaaggctttcctcgcattttaactctaccaacgtatactcaactcaaccgacatcaagttaatgatgtgggtacatttgcgggtatatgtcgattcgataaagttttgtactcgcaattcggctgcgaggatagttaa

SEQ ID NO: 1601 - DNA, 1383 bp, Proteus mirabilis
actctagcaggcacaattatggctaataaaatagaacatctcgacaccttagcatcagaaatagaaaaacaggctggtgggtttagcaatatcgcaaccttaacacattgtatgacccgtattcgtttgatcttaaaagatagttcgctatttaataccgaagcattaaaacaagtcgaaggtgtcaaaggcgtggtatttaatggcgagcaacatcaagtcatagtaggaatgggaacggccgccaaagtttattcaatcatgaataaacgtatgcaaaaaaacacagataatagcgaagaaacccctgcgtcaacaccagtgaaaaaagggttttctattcgtcgtatgctaaatacgttggcggctatttttgttcctactatcccagcattaattggctgtggtttaattatggggctaattaatattatccgtttagtggctcccggattagttgatcagtttcctgaactctttaagctatttaaactgatcggaagcaccgtatttgcttatctctctattatgataggtataaatacggctaaagagttaggggcttcaacctccataggtgctgttatggcgggattattagccatgccgggactggctgatatcacattatttggtgagaaattacagcctaatagtggcgggatcttcgcggtcttaatggtggtggtattctcttcaaaattagaactatggtttcgcagtattgtaaaagagagtcttgatcttattttaaccccctttgtcactattttagtttctgcgttagtggcaattatggtattccaacctattggtcattatctgaatcaactattagcgcaaggcgtctccttatcactattaaatcatggtggcggtgcggttgtgacaggcgcagcgttagggggtagtttcttattcttattactaaccggtctacaccaaggtttaataccgatccacactgaaattttaaatacctttgggttaaattacctattccctattttagcaatgggcggaatggggcaagtaggctcttgtttctgggtttatttacgtactaaaaaccaacgcttaaagaaaacgttaatgggtgcgttgcctgtcggaattttcggcgtgggtgagcctttattatttggtgtctctttacctttaggtaagccctttattgcaggttgtattggcggggctgcgggtggtgcattaatggcttattttcaggttgggatcattattccatttggtactgctgggttatcattaatttcactggtgggggatgggcaaatcatcaaattccttatcgcagtattgggggcttgggttgtcggttttattgccagtatattaatcggatttaccgatccagaaaaataa

SEQ ID NO: 1602 - DNA, 1665 bp, Proteus mirabilis
gcatgtaagggtagcatggaaattttctttactattttaattttaatattggtagtttctgtttcaggtgtcattaccaaagttattccttttcgcattccattaccattaatccagattgtgatcggggcacttttggcttggcctcagtttggtttacatgtcacctttgatcctgaactcttcttagttttactgatccctcctttactttttgttgatggatggaaaacccccacacgtgaatttatccaaaatggtcgagagatctttatccttgtgctggttttggtgatggtgacagtagtaggtattggttaccttatttactggataatgcctagtattccacttatttctgctttcgcgctcgccgcggttctctcgccaactgatgcggtggcattatcctcgattgtcggtaaggggcgaataccgaagcggatcatgggggttttagaaggcgaagccttaatgaatgatgcttcgggtctggtggcgctgaaatttgccgttgctgtggctatgggcacgatgatatttaccgtgggtggcgcaacctttgagttttttaaagtggcaataggcggtttattagcgggtattgcggtaacgttagtctatagtaaatctctgcgattgatgagccgttggagtggtgatgatcctgccactcaaattgtctttatgttgctgttgccttttgcttcttatttgattgctgaacatattggcttttccgggatccttgctgccgtggccgcaggtatgactatcagtaaatcaggtgtgatccgcaatgcaccattggcgatgcgcttgcgtgcagatagtgtctggtcaatgttagagtttgtctttaacggactggtctttattatgctgggtttacagcttcctgttatttggacaagctcggttattcaagctgatctcgatcctgaagttgaagtatggatgctgtttgccgccgtctttgttatctattttgcgttactgattttacgttttacatggttatggctaatgaagaaaatcagccatctctttatgaaaaaacatccccttgatttcgccacttatacgacgagagaattatggctatcttcttttgccggggtacgtggtgctatcaccttagccggtgcgctctctataccgctatttttaactgatggcagtactttccctgggcgctatcagataatctttattgcggcaggggtgatcctattatccattttggtcggtattatttcattacctttcttactaaaagggattaaagctaccgataaagaagcggataaaaatgaagtacgttatgccaagaaagtcatggcagaagtcgctattgttagcctcaataaaatggaagagcgtttagctgcaagtacagaagagcaactagatgcggaagaaattaatgaagtagcttctcgagttgccggctatttaagacgacgtaccgcggatcaggacgagatgatgcacaatatgttggtggaagatctggaaagacgttttcgcctaacggcattgcgtgcagagcgtggtgagctttatcacttacgtgcaacgcgtaaaattagtaacgaaacactacaacttttgcttcatgaattagatttaatggaagcgctgttagttgagaaagacagttaa

SEQ ID NO: 1603 - DNA, 633 bp, Proteus mirabilis
aaccagtggggagatagcataatgttattacaattttcttcagcacaaggccccgaagaatgctgtatagcggtagaaaaaacattgaattattttctaaccgtcacagagcagcggcaagttgatgtgataattcttgagcaagagccatctcgttatggtttaaagtcagtattagtatcgcttaaaggtgcagaggctaaagctatcgcacaacaatggtcaggcactgtgcaatggcaatgtacaagtactttaagacctaaacataaacgcaaaaattggtttatcggtatcgcttattttgacccaccacaagaaatccaagacaccgaaattttatttgaaaccatgcgtgccaatggccccggaggacaacatgttaataaaacgagttcagctgtcagagcgacgcatattgcaacaggcattagcgtcaagatccagtctcagcgaagccaacatgctaataaaaaattagcgaaacagcttattgcttggtatctaactcattatctatcccaacagcaagcttcatttaataaccagagacacctagctcatcaccgagtgatccgtggtaatgcaactcattgtttttatggacgtgagtttttaccaataacgaaataa

SEQ ID NO: 1604 - DNA, 276 bp, Proteus mirabilis
ctatcacggggtttttggtcgttttgtactttatcaaatcaaggggcttacctttaccctgatttatcggaagagcacatgcttttaatcaactctcataataggcatgaatcgcaggtttctcctcaagtgatgggtattgtcgtgtgtttattggtttctagtgtgtggtcatttaaaacagaaagagaggtgatgtgcgaacgtttttatcaactacaggattttgcttcacagcaccctgaagcagaggctatcttctacctaattgattaa

SEQ ID NO: 1605 - DNA, 936 bp, Proteus mirabilis
ggtgagaggggcactatggatatcgcagtgattggttcaaatatggtggatttgatcacctatatagataggatgccaaaagagggagaaacccttgaggcgccagcatttaagattggttgcggcgggaaaggggcaaatcaagcggttgccgctgcaaaattaaattctaaggtgatgatgttaaccaaagtgggggatgatattttcgcagataacaccatcatgaatttagagtcttatggtattaatactcgttatgttgaaaaagtgcccggaaccaccagtggtgttgcacctatttttgtcacctctcaatcatccaatagtattttgatcgtaaaaggcgcgaatcagcatctatctgctgaagatatcgatagagctgcggtgagtttaaaaaaatgtcgtatgattgtgctgcaattagaaatcccgcttgaaacggtctatcacgcgattgagttcggtaataaacatcatattccagtattgtttaatccggcaccagcatcgaaagctttagatctcactatcgccgcacaatgtgatttttttgtccccaatgagacagagctggaaattttaacgggtatgccaattaatacgttggatgaaattcgagaagcagcctattttttactcgaaaaagggtttaaaaatatcattgttacattaggtgaaaaaggggcgttatgggtgaatggggaaattgagaaatatatccccgccattgaagttaatgccgttgataccagcggtgctggagatgcttttattggctgtttttctcattactatgtgcataccggcaatattgaagaagcgttaaataaagcggttatgttttcgggtttaagtgtcacaggaaaaggcactcaatcttcttatcctagtattgaagaatttagcgaatttttaagctcagcaaaatag

SEQ ID NO: 1606 - DNA, 1023 bp, Proteus mirabilis
tcattttttattaattataacgcgctcattggcgagccaaagtcgaaaaacatgaatttagaatctattataaaactcacatccgctgatatggctgcggtaaatgacgcaattctttaccagcttaattcagatgtttctttgataaaccagcttggttactacatcattagcggtggtggtaaaaggatccgcccaatgatcgctgttctgaccggccgagctttggattatcaaggggacaaacatatctctgtcgccgctttaattgaatttattcataccgcaacattattgcacgacgatgttgttgatgaatccgatatgcgtagaggcaaacaaacagctaatgctgtgtttggtaatgctgcaagcgtgctggtaggtgactttatttatacacgatcttttcagatgatgacggatcttgattccatgcgcgtgctaaagctgatgtctagcgcaaccaatgtgatcgctgaaggtgaagtattacaattaatgaattgtaacgatcctgacattactgaagatgactatatgcaagttatctacagtaaaaccgcccgtttatttgaagctgcctctcatgcgtcagccatcctctgcggagccactccagagcaagagaaagctttccaagattatggtcgttatcttggtactgcattccagctgattgacgatttactggattatgatgcagataatacccaattaggtaaaaataccggtgacgatctggatgaaggtaaacctactttgcctttacttcatgccatgcaccatggtaacgaaacagaatcacaactcattcgtcaagccattgaaaaaggtaacggccgtcatttactcgacactgtgttaaaaacgatgaaacagtgtggctcactggaatatacccgccaaaaagcggaagaagaagccgataaagccattgaggcgttagcgattattcctgattcatcttacaaagatgcattaattggccttgcgcacgttgctgtgcaacgacaatcgtaa

SEQ ID NO: 1607 - DNA, 1185 bp, Proteus mirabilis
gctatttttataaaggatcaagattttatttttataggagctagtatgaagcgttatcataaagtaattacattatttctaacatcatctacatttatatcatttttagcattgatggctaattggttctacttgaataaaataggatggttagatttatttttaagttcaataatctctagcgaaaatattttcattattgctttttttcttgttatttcatttttttcaatattgctcatatttatgttgccatctattaatataattatgtttttaaataaagatgatgaatatatattaaaatataatgaagttagattaaattatgtgaaaatttttcttataatagcaacagtggctaacttattttttatagtttcgttattttttagtaatgactattatagcttgtatctcaaattatttttactttttgttttagtttttacaggatgggctctttattatagaggtcttaaaaaaatagtaagtcaagatttatcattcaaaaaatcatcgaaagctagatggaaaaaaatagaaatatatgtgctaattccatttatacttttgttaatattggctttttactcattctctttttatatggtaacaaaagggcttaaatctaatggtgagagtgcttggatacaagctgtatatttattttttatttttgaatttattatcgttaactctgttattccttgttttatctatttcagaggtatgaatgaaaaaagttggttttcaattattacttctatttcaggctgtttagttttattcattttcattatatcaatgcttatcccatctatcccttctataattataaatgcaacaatgaaactttcaggtataaagaatgaaagcccgcgcacatatgttgtggataacaaggaatatcctgaagaattgtttgaattagacttatggaacaaacggactataaaagatagcaatagatttactattgagggtgtatctatgtattcatttggagaaactaatttagtatgtccaaaagatatagtcacgccttatggaaatagtttatcgaattatttttttgataaaaaagaagatgacaaagttagtaatgaattaaagagattagcggaaacctgtattccatttgataaaaaatctcttaaaaatatcggaatgtcaaaaaactag

SEQ ID NO: 1608 - DNA, 1803 bp, Proteus mirabilis
gttattcttataccaaattttattactccacgaatagcctcattttatctacgtttttttaatttattaaataaacacagaaaatggtacacacaacttatgtacgaatttgatttaattttgctgttattacagcaaatgtgcgtttatctcattattgcgtggtttctcagcaaaacgccgctatttacgcctcttttacaagtgactatcaaacttccacataaattaatgtgctatgtgattttctccattttctgcattatgggcacctattttggattgcatattaatgactctattgctaatacccgtgctattggctccgtattaggcggattattaggtggcccgtatgtaggctttctcgttggcttcacgggtggcttacaccgctattccctcggcggaatgacagcgttaagttgtatggtatccactatcgcagaaggattaattggtggattagttcatcgttattatgtaaaacatggacaaatgcaccgcatatttaatccttggacagcggctaccgtcaccttttttgccgaaataatacagatgagtattattttattactcgctcgtccttttgatgaagcactttctttagtaaaaaatattgccgctcctatgattgtagcaaatacaataggtgctgcgatgtttattaggatattacaagatagacgtgccatttttgaaaaatataccagtgctttctccgctcaagcattaaaaattgcggtttgcactgaaggtattttacgtaaaggctttaaccaagataatagtactcgtgttgcaaaagttatctaccaagaattaaaagtcagtgctgtcgccattacggatagagataaactactcgcttttattggtattggcgctgatcatcatttgccaggtacaccgatttcctcagaacaatctaaacaagccattaataataacgaagtcgtgtatgcggacggcaatgagacaccttatcgatgtaccctttctccacattgtaaattaggctcgacactggttattcctttacgaggagaaaataatcgcgttattggcaccataaagctctatgaagcaaagaatcgcttatttagctccattaatagaaccttaggagaagggatcgccagtctattatcagcacaaattcttgccggacaatacgaaagaaataaacaatcactattagaatcagaaattaaattactacacgcacaagtcaatccccactttttatttaatgcattaaatacattacaagccgttattcgtcgtgatagtgatcaagcaaaacagttagtgcaatttctgtcagctttttttcgtaagaatttaaaaagacccgaagcgatagtgacactcagtgatgaaattgaacacgtcacggcttatttacaaattgaaaaagcgcgctttcaagaaagtttacagatagatattcagatacctgaacatttagccactgcgcgccttcctgcattttcgcttcagcctatggttgagaatgcaattaaacatggaacatcacagttattaggtatcggaaagattacaattagagcgcatcaagaagaccacttaatagtgatcgaaattagtgataatgcagggctttatcattcgcaaggcgcatcacatcagctcggtttaggaatgagacttgtcgataagcggattaaattacgctatggtgatctatatggtgtacttgtggagtgtcagcctgataactataccaaaataaaaatctgtttacccttagaaaaaaatatggataacgcagcataa

SEQ ID NO: 1609 - DNA, 372 bp, Proteus mirabilis
gagatcattatgaaagagaaaaattcagatggaataacacaaaaagatgaactctattcgctagataaagctggtattaattatatagaacttaatataactaaaagccatttctatgacttaaataataattttcatcaattagaatcctttgtaaactgggataatggaaatagcacattgattactgatgttttattgcatcaaaaacctaatactgataataataaaatttctcaacaattaatgaacaatattatcaatgagatggctagtttttcttctttaggaaatagtgagtccatcccaataaatcaatttataaattcaattgaaagtacagtttcattaataccaaatctattgagataa

SEQ ID NO: 1610 - DNA, 402 bp, Proteus mirabilis
ttagtattcttaattcttctttttatgacaatatttaatatgaaatttgtttttttacctttaatttcaatcgttttaataactgggtgtagtagtaaatgggagccaaaaggggtacccgattacacattacaagaagcaaagttaatttgtgatttggatgcgaatacacgttaccctattcgtaaagaggtactacaacacaccgtttatcgtgatgtagaaaaaacctgccgtaaagacgacaaagagcgttgtggggataaaaagacctatacagaacgtgttccgatgacagaaagctatgtagcagatattaatcaagaagatagaaaaacattctatacctcatgtatgtctttaaaaggttgggaacaaaaaaattactacttttggcaataa

SEQ ID NO: 1611 - DNA, 1023 bp, Proteus mirabilis
gataacgctatcagtgagtgttctacttcactattaaggtctaatcgttatatgaaaaaaagagccatctatcttattttattaatgctaatacttattgcattagccgttcttttccgcgcgcataatcaatatttattactgcaaggtgaagtggatgcacctgaagttattgtggcctctaaagccaaaggacgtgttatagagcgtcatattgagcggggtgatgatgttaaagcggggcaattgatgatcaccttagatagcccagaactcaatgctcaagtggctgcactggaagcggcaaaagcccaagctcaagctcaattagatctctctattcacggtacaagagaagaaagcattcgcaatttacaagcgatcttatctcaggcgcaagcacaagccaccaatgcaacgaaagattaccaacgtcttagtgcggtcgccaataaaggttatgtctctgccaatgagcttgatagtgctcgtagtcgtcgagatgttgccgtgcagcaagccaaagccgctcaagctgaattagatgaagcgaaaaacggtgatcgtattgaattacgtgagaaataccgagccgcactacaacaagcagagcagcaattaattgagctgaaagttcagcaacaagatttacaggtaaaagctccggttgacggcgaagtggggcctattcctgcggaagtgggtgagctttttaatgccaatagcccattagctacgttaattcgtctccctgaagcctattttgtatataacttgcgtgaagatattttagccgatatccgcaaaggcgatcgcatcaccatcactgttcctgcgttaggcgataaagaagtggaagcagaagttcgctatattgctcctatgggagattacgcaacgaaaagagcgacgcgtgcaacaggagatttcgacttaaaaacctttgaagttcgactgtatccaacgtcacaaattgaaggactacgtcctggtatgagcgcattatggcgttgggataagtaa

SEQ ID NO: 1612 - DNA, 267 bp, Proteus mirabilis
ggggcgtatatgatgatcaatacagtggtagggaaaagaatacaaaatagaagaaaagaattaaatatatcaagttcgaaaattgcattacagttagggatgacagagcaatattatctaaaattagaaaatggttatactaagataaccgttgatgaattaatatgtattgcgattattttgaaagtgtcaccacaaagtttattactaaaatcaactgttagtcagcaaaatagggatagccaattaaataattattatcactaa

SEQ ID NO: 1613 - DNA, 2619 bp, Proteus mirabilis
aagagtgatattatgtcattttcaacaggtataaatagcttaagcggcataaaaataaataacgtaaaattatttatttttatacttgcgctactattttcagttgactcaaagtctgaggaggagttttattataacccctatttcttatcagataacccggagtctgtcgctgatctatcttcttttgagaaaggattagaagtacctgaaggtaattatctggttgatatttacttaaatgacatattcttaaaaacccaatatatcaattttattgagaataaagggcagctatcaccatgtatcacaaaagcagagctaaaaagttggaatgttaatttaaatctcataacggatgaacaaaataaagataaaaataatgagctcgatgaacattgtcagtcacttacttcattaatttctcaagccacagcaaattttgatgttggttcacaaaagctcaatctcactatacctcaagtatatttagtcaatcagtctcgaggctttattccaccagagttatgggatgatggtattgtggctggatttattacctatattttaaatgggagtaaaactcgcaacgatggtagcccagatactcattttactcatctcaatttacaaagtgggatcaatcttgggccatggcgtcttcgtgataactctatttattcttatgattctattaataaatcaagttggaaacatctgaatacttatatagaacgtggtattaataaattatattctcgtcttattattggtgatagctacacacaaagtgaagttttcgacagcatcaactttagaggctttcaactgtcatctgatgaagttatgttaccggatagccaaagaggttttgctccgattattcgaggtgtcgcccggactaatgccgaggttactatacagcaaaatggttatgtgatttaccgtaactcttttccaccgggtccttttgttattgatgatctctattcaacaagtaacagtggcgatttagaggtaaccattaccgagtctgatggttcaacacaaacctttactgtgccatattcatcagtccctttattacaaagggaagggcataccaaatattcagtgactgtaggtagttaccgttcgggtaatgatgagcaggagcggccttattttttacaaggatcagtgatccacggcttacctgcgggttggaccatttatggaggaacccagttatccaaaaattaccaagcggcaagtattggggtaggtaaaaatattgggcgttttggggctttatcatttgatattaccgaagcgagatcaatactacccgatgactctacacaccgtgggcaatcgatacgtattctttataataaatctatcaatgaattaggcacaagggtgcaacttgccggttataaatatgcgacgagtggtttttatactttagcagagactacttataaaaaaatgagaggaaattatatacaaacggaggatggtgttgttgaagttagtggattgccacaaagttactacgatcttatttataataaaaggcaaaggatacaactcaatattactcaaaaaataggtgatcaatctacgttatatattattggtactaatcagcgttattggaattctaaaaaacaagataatcaattacagataggccttaatactattattaaaggtattaatttaggcctaaattatagcttatctaaaacatcatggaatgatagtaaagatcagatgctagcatttaatactagtattccttttagtaactttatgcgttctgataatgattctatatggcaaaatgcgagtttaagtactaactcctcgcataacatgaagaaacgttttaacaatactatcggattaaacggtacattattggaagataaaaacttaagttacaatattcaaacaggttattctcatgaagaagaatcggactcaacaggatatgcctcattaagttataacggttcttatatgaatagcaatataggttataactataccgatacatcacatcaaataaattatggtatgagtggcagtattttagctcactcaggtggtataacacttagtcagcctatatatcaaacagcggtgttagttaaagtacctgaagttaaaaatataaaattagaaaacaatagtggcatcacgacagatagtaatggttatgcggttttaccttatgtttctgaatataaagaaaaccgtattgcattggataccaattcattctctaacaatattgaaatagataatgcggtgaaaagcgtagttcctactcgtggggccattagtgcgatcacatttgagcctagtgttgggataaaagcaattacgacattaacccataaagggaaaccagtacctttcggggctatcgttgattcaggtaataatactgggattgtggcagatgaaggaaaagtttatttaacagggttatcaccttcagggcaattaaaagtgaattggggtagtaagaaagagcaacaatgcttagtaaattacacattaccaccacaagatccagataaactttatgttgaatatagtgcagagtgccaccctattaaggaataa

SEQ ID NO: 1614 - DNA, 264 bp, Proteus mirabilis
ttggagttcatcatgaaaaaatctacattaatcgctgcaacattagctttaagtgctatttcattcggttcaatcgctgctgacagcgtagcaactagccatacctctactggtgagtatatcacaattacaggtaacgatactttagatggcttaacaactaaaattgcacaaatcgcaaaagatgaaggcgcaactggttataaagttatcggtgctacaggtgacgattatctgactgtaaatgcggaaatttatcgttaa

SEQ ID NO: 1615 - DNA, 963 bp, Proteus mirabilis
aggtttctcatgatagaaataaaacacttaaaaacgatattggcacttaagcaaacaggctctcttgccaatgcggcaaatcagttacatcaaacacaatccgcgctctctcaccagtttagtgaattagagcatcgtcttggttatcgtatttttgtccgtaaaagccaaccactacgatttacaccacaaggcgaagtgttattaagattagcgcaagaagtcctacccattgtgcgccgagcgatagaagagtgtaatgagctgggtaatgctcatttaaatattgctattgaatgccatagctgtattcaatggttaacacccgcattacagcaataccgtcaaacatggccggatgtgaatgtcgacttccattcaggtgtcacttttgatcctcaaccggctttattacaacgagaattagatgttgtactcacttctgatatcttggataaccaacgcctgcactataccgcgttgtttgattatgaagttaagcttgtgttgtctcctgatcacccgctggctaatcgcttacatattcaaccacaagatttgatctcagaaacactgtttatctatcctgtccaaagagagcgttttgatatttggcgtcattttttacagcccgcagggatcacgccacattttaaacatgtagataacaccttacttcttattcaaatggtggcagcaggaatgggtatagcggcactgccgcactgggccgtagagaattttgaaaaacaaggattagtggtcacaaagaccttaggagaaggattatggagccggctatatgcagctaaccgtacaggtgagcaacatcaaccggcaatacgagagtttatacgcttagcaggtcaacatgccgttaatcatctgccttttgtaaaacaggttggtgtatccaacgccgatggaaccaaagtgatgcaacaatcaggctcgcgcctatga

SEQ ID NO: 1616 - DNA, 504 bp, Proteus mirabilis
agcagactcatagaagggtattgcaatgcaatacccttctattatcgggatatcatgaaaaacgccacgttttatttaatggaacatccatcaatacatcaagatttacaagcccatgaatggcttgcttgtcaacttgccgcagaacattggcgtttaggcaaacgggttttgctcgtctgtgattcacagccacaagctgaattgttggatgaagcactatgggcaagagagccacatcaatttgtgcctcataacctagcaggtgaagggcctcgttatggtgcgcctgttgaattatgttggccgggcaaacggggcaatgccccgcgtgatctcctgattaatttgcagtcacaatttgcagactttgccacagctttccatgaagtgatagacttcgtacctatcgatgaacaattaaaacagttggcgcgagaacgatataaaatttatcgtagcgtcggctttactttgacaatggctacgccgccaacctattga

SEQ ID NO: 1617 - DNA, 426 bp, Proteus mirabilis
gatgagatcatgaaaaaagaatggtatacagcaaaagaattagtagggcttgcagggttacctaattctccacaaggggtcaatttaatggcacgccgtgaaggatgggaaaatcgccgtaagcgtggagtacaaggtaaagccgttgagtactcggttaaaagcctccctgaagaggtggtgagtgtgttagcggcgcatgagcctcctgcagaatatttatctaagcgtcaggatgcctttcttatctgggtggaagcttattatcagctaacaaaatcagagcgtgaaaaaatcgtaaaatttgttttacgagaaggtctcgctaagttaattagctatattgatgctgacaatcaagaagagatcgaacgagaaaatgaagaagtggttcaaaaattaaaaagccccccagagtcgacatag

SEQ ID NO: 1618 - DNA, 231 bp, Proteus mirabilis
gttaatcccatatgggttcatccgatagtgcaggtccaaagagcccctgctttggtccgtagacattatgcggtattagccaccgtttccagtagttatccccctctatcgggcagatccccatacattactcacccgtccgccgctcgtcagcaagaaagcaagctttctcctgttaccgctcgacttgcatgtgttaggcctgccgccagcgttcaatctgagccatga

SEQ ID NO: 1619 - DNA, 261 bp, Proteus mirabilis
ataaaagtcttatctttaaataaaaagccctctattaaaatagatttatttatactgatgattaattcattattattttattacggcgacgttttactctctttttatttatacgctttcctttcatcttgttatgttttatttctctttaaccattttcccttgttaattttgttaatacgtctttactcgcatttagtgtttagctgtcgatttgatgagattatattaagttttatttgtatgtttcacaacaattaa

SEQ ID NO: 1620 - DNA, 711 bp, Proteus mirabilis
aggaacaacatggcgatactgaactgtaaagtctcactcgttgagccgataacagatacggtgtatcgggtaagattattacctgatggcccatttgattttcaggctggacaataccttttagcggttatggatgagcgagataagcgcccattctctattgcctctattcccgaaaataaagactttattgagcttcatattggcgcgtcagatctgaatctttacgcaatggctgtgctcgatcttattttagaaactcaacaattaaagattgatattccccatggtaatgcgtggtttagacaacagagccaacgtcctttgttgcttatcgcaggaggaacaggattttcttatactcactctatcttgctagcggcattacaagaaaatcctcaacgtgcgataacgctttattggggaggacgagagcaggtgcatctttatgatcttaatgagttgcaggatttaacggaaaagtatccctcattatcagtcgtacctgttgttgaacaacctgatgatgcttggcgtggtagaaaagggactgtattaacggcaattagtgaagattttggcgatttatcatcctatgatatttatatcgcaggacgttttgaaatggctaaaatagcgcgagatcgtttttgtaatgagcgtaatgctgatagagaacgcttatttagtgatgcttttgagtttatttaa

SEQ ID NO: 1621 - DNA, 753 bp, Proteus mirabilis
gtgaggtgcattatgttagaacaagtcagcgaattagcccgccaagcgggtcaggcgataatgcaaatttatcaacaatcagcgccaattgaagtacaggaaaagagtgaccattcaccggttactgcagcagatttagccgcccatcaaattattaagcaaggacttgccagtattgcgccagatattcctcaattatctgaagaagatcctcctgcgtgggaagaacgtcgccattggcaacgttattggctgattgatcccctcgatggtaccaaagagtttatcaataaaaatggtgagtttacggttaatattgcgttgattgaacagggtgtgccggtattaggcgttgtgtatgcaccagtacaaaatattctctactcagcagccaataaacaggcatggaaagaaacctgtggtcagcgtttaccaataaaagtcagccgtgctgaaccccccgtgattgttattagtcgttctcatcaagatgatgaattaaaagaatatttatcgcaattgggtgagcaccaaacggtggctgttggatcttcattaaaattttgtctagtggcagaaggaaaagctcagctttatcctcgttttggacctactcatacatgggatactgcagcaggacacgctattgcgatagccgcaggggcacatgttaccgattggaaaggggtgacacttgattattcaccgagagaatcactgataaatcctggttttagagtttctattttctaa

SEQ ID NO: 1622 - DNA, 867 bp, Proteus mirabilis
tattttttaatattgctatactgcacaaaacttaattttatggatatagatattgtgcaaaatggtattcacctgtcagaaaaaatattaaatgcatttcctactcgagctttaacattatctccattaaaaggggatggcggtttattccgtaccttatttttagtgattgcaatgttagggatgacagtatttagtgcttatcaaattcctaatattgtttatgattatcaaattagtaaaaaccccgtgtttattgatgccgatgttgatggctcttgccgttcaaaactatttgttttaaccaattgtagtgttgacttacgttataaaggtaacgaggtttcacgaaattttacttttcttgattttggcaataaagatatattggttgagccagtagcagatgaaaacgatctgactaaaatgaccgtcgatgtggcaattgataatatttggttacgcttaattagtgcattagtttttactgcattatttgctttttgcgtgatcttttttatttatcgtcaaatgatcagcaataaagttaaaaaagcattgctttcagtcggcaccaaacctttaaaattaacggctatccctgctaaggtcgttgtgagtaataaacaatttattgctacctataaaaccaatgttgccggaaaagagacttcaattacttattcaggtaataagaaaacgccacccattacattagaaatggaaggcaaaacttatgttttggcggtgtacgagccacaacaaaatattccttatgtattagatgttcctttagctcgaattcaagcaacagaagaagaaaaacaacgttttcatgaggcattaatagaggaaggtattctctaa

SEQ ID NO: 1623 - DNA, 927 bp, Proteus mirabilis
gtattattaataatggcggggataaatagcatgggtgcaggccacgagcacggtgatgtcaaagcgctacctgaatcacgtctgttaattgcttttgcattaacaggctcttttatggtgattgagtttattggtggctacttaacagaaagtttagccttgatttctgatgcaatgcatatgatgacagatgcatttgcactcttacttgctcttatcgcgatccacgcaggtagaaaagcagcagatctattcagaacttatggctatgctcgttttgaaatattggctgctgcgatgaatgcactgatcttaatggcggtggctttttatattctttatgaggcttatcaacgactctcttcccctcctgacattcagtctatgggtatgcttgttgtggcaatcgcagggcttatcattaattttatctcaatgaaaatgctcaccagtgcaaaagatgaaagcttaaacgttaaaggggcttatcttgaagtgtgggcggatatgttaggctcagtgggcgtcattattggagcagtaattatttggctaaccggttggcaattagttgattcaattattgcggtattaatcggctttatggtctttccgcgcacgtggatcttattaaaagagtgcctgaatattttattagaaggcgtgcctaaaggcattaatttaactgaggtaacagacaccattaataataccgcaggggtggctagctcccatgatttgcatttatgggcactgacgcaaagcaagttgatcctcagtggtcatattgtctatcaacccaatgtagatagtgaaacattacgacttgctattgataagcaactacgtgaacaatttcatatcaatcatattaccttacagatggaaagcgaggataaacaacatctggaagataatcatcattaa

SEQ ID NO: 1624 - DNA, 762 bp, Proteus mirabilis
gataatataatgaaaatatttaatatattattttttggtttattaattattagtaattcctcaatcggagatgaataccctattatcacagagaaaatgttaaactcaggatataacaaattagagttgcagtatgatcctcaattacctttgattacaccttaccctgaaaataaagagcttgtttatcctcttattgaaaaggctaaaaaaaataacaattctaatgatagctatcttattgcttccattttctttgttggttgtactaatttaaaatataaaattactcatgaaagtgataaaaaccagtgcgaattatcacgtaatttcttaaaaaaaacattagcattgaaccctaaacatggagcagctctattctatcaagccgttatttttgaaaatggttatggtgttgaaaaagatataaacaaagcaattaaatactatgacaaagcatgtcgaataaaaggaaacaaagtgattattgcttgtgaaaatcttttttctatctatctgcatggtaacaaaggtgttcctcaagatttaaacaaggccaaagaatatgcaaaatggattgctgaaaatgggagccaaaaatatcaagaatatataaaacgttgggattacattttattttctcttgaattaagtttaaaactaaaagaatgtaaaaaaagtgggataaatgcatctatatgtatccgcaaaagcaataatgcactcttggaatatgccaataaaatgtacccaattgagtaa

SEQ ID NO: 1625 - DNA, 342 bp, Proteus mirabilis
aaggaaataatcgtaatggcgtcctataaagtggtaatgacgaaagatgccgaaacagacttagaggacatcaataactatattgccgaccacgacagcatagataatgcagattatgtattagatgagctgcttaaggtcactaatacacaggctaactttcctatgaaaggcagtattccaaaggaattacaaagtttaggtattcgtgaatatcagcaaatcttttttaaaccttatcgtgtcatctatcacacaatagcaaaacaagtggttatctttattattgcggatggcagacgagacatgcaagccctgcttactcggcgacttttagggtaa

SEQ ID NO: 1626 - DNA, 1155 bp, Proteus mirabilis
gggcgaataatgagagtaaaggcagcttggcgtggttttaatagcgcattctcacgagaaacccatatggcagtgcgaagcccagtgttccactggctaagctggctgtttccattaatgttattcacattaattagtgctaacttttcagaaggtactttgctgaacttgccagtttccgttatcaataatgataatagtccactatcaaaaacgttgatccgagatttaaatgcaggctctcatgcaaaattaagtgcgctagatacaaatccgcgaaccgccttagagcagttaggaagtgcaaaagattacgctattttaatgatcccccgccattttgaaaaagatgtattagcaggcaaacagccgacaacccgaatgtattacaatgggttgtattatgctgcgggtagctatgctatacaggattttagcgggttaattgccgagcttaatgctcaatatcgcactgttttagcgcaagagatgaataagccagtgccgcctttagccaaagtaacactctcttatgacagcctgtttaatgctagtggtagttatatctactatcaacaatttgctgcaaccattcatatgctgcaactctttgttgtcacctgcacgatttactccttatcacggggtaatatgctattaaacctaaaacctttcacttttgccctaataggtaaattagcaccttatacgctgtttttcttaacattattaatggttgaattagcggcgttagtgcatttttcaggggcaaaagtcaatggtaatccgctttatatgatattggtggggttcttttatatcatcgcggcacaaagtattgggttgctgttgtttacatttaccaatagtgcgataaccgcatacagtatgataggtatgctagtgagtatcgccttagctttttcagggatggcggtgcctgaactgtcgatgatattacctgctcgaatcatttctaatctagagccgttaacgcacgccttaaatgctatgtttgatatcttcttaagggaagtttcgttacaaggtattctttatgtgtgcacgcttttgttgatttatccttttgcgattgcgcttttagttcgcaaacgcatctttaaaagattggaattacaggtaggtgtcgtatga

SEQ ID NO: 1627 - DNA, 618 bp, Proteus mirabilis
aaaatcgtaattaaatgtgtttattattttctaggaattaaggtaatttatatgaaacttaattatttgaaactttttgtgatctctgcattatctgtaggttctgtttttgctgtttcagctgaagatcctgtaggaaatggacctgtaaccgtgaatggtggcgaaatattttttaaaggtgaattagtaaatgcagcatgtgctgttgactcttcatctgatggccaaatagttaaattaggtcaagtgagaactgcaaaattagcgaaagctggtgattttagcgaaaatactaattttactatccaattaaatgattgtgactctaaagtagctagtactgcaaaagttgcttttacaggggtttctgctgcaggacaagatgacgtattagcagtatcttcttcttctgctggtggtgctaaaaatgtcggtattcaaattttagatagtaagagtgcaccaatgtcttttgacggcgctggattcggtaatgcaactaaattacatgatggaaaaaatattattccattccaagcaagatattatgctttaggtgcaactgaacctggtatcgcaaacgcgaacgcaacctttgctgtccaatacgaataa

SEQ ID NO: 1628 - DNA, 357 bp, Proteus mirabilis
agaaacgtaatgaaaaaagagtggtatacggcaatggaattgacgggtataggtggattacctaaatcaccacaaggtgtaaatgcaaaagctaaacgtgaatcttggttaaaacaaaagagaactaataaacaaggaaatggcgttgaatatcattactcttgtttaccagaagaaactttaattgctctggagctttatgaaccattagcacattacaaactaaataaagaggagccactcgttatctgggtgaaagcattccaacaacttaatgatggtgaacaaaaaacagtaacagagctgatcttgcgggatggtattagaagttttttagaaaagatcgtcaaagattaa

SEQ ID NO: 1629 - DNA, 246 bp, Proteus mirabilis
attgaagtaatacacattgaattaactggaggatatatgcctttaagtgataataaatatgtaagcttttctgaagatcatgaactgaactaccatttaaaaaaatggggtaaaaagcaatcgaaagccaatcgagatcaactcgtgaagctaggcagtgaattgaaaaagaaacttggtgttaaacatctccaacatactgaaatagatgcagagatagaaaaaaatctttcattatttgagtaa

SEQ ID NO: 1630 - DNA, 522 bp, Proteus mirabilis
agagaatcaatgatgaaatataaatggcgaggagtaaaaaacgtaatatttgctattttatgctgcaatacttcattcgctatggctgcagatgcaacaattactgttaatggaagtgtaatagcaaggccttgtgaaacaatcacaaaaacagccaatgtggacatgggcgacctatatacattcgattttatgatcccaggctctacctctaaatggtatcccgttgatttggaattaagaaattgtcctattggtacaacttctattgaagcgacattcaccggtcttgatgatagtactggatactatagaaatcagggctcagctaaaaatcttcatttagaattacaagatactgcaggtaataaattaagaaacggttcaaaaaaagtggttgaagttagtgagtattcgtttgctgcaatttttcctttacgagtaagagccatctctgtgaatggtagacctacacagggatcagtacaggcaataattaatgttacctatgtatttatgtaa

SEQ ID NO: 1631 - DNA, 1305 bp, Proteus mirabilis
aaggaggcaatagtgaataaggatattaatgaacttaataaagatattaatattgtcggattacattggattgaacgctggcgagtgaataatggaaaacatcagtcttatgttattcctttcgcaacaacctatcctattaatattgtttatcacggtaaaagcgaatttaaatatgggcagtatggcattcatcttggccagcaagatacactcacctttttaggtgataaaaaacaaaagatactggctaaatttattgattgtcgtaaaaactcaccgacatttaaatcagaattaagtttggagataaccccatcatccgcaagaacacttattattcccccaggagttgctcatactttttcccatctagaaaatgtttttaccttaaatagctactctctttttttacctactattgagcaattagcaaatgaaacattaaattggtcacctaataatgatgtgataaatctgccggaagatatcgatattaatgagattgaaggctatgagccgatgacagaagaagcttcggcgctggtctactatcgagttgctgagatacaacagcagtggttaagccaacatcgatttttacactctgaaactcgtaaaattcgcttagataatggcgatgaaattaatgtaaggttgcgagagaaaatagccgatgttcaaaaacagtcattacctacatccactattttaggtgttgaatttcgtgaaatggcgaccctgcatacgggcaaagagagtggcattgtcccattaacgcgacaatcccctatgtatctagtcgaacatggtcaggaggcttatgatttcgactcttatggattacatttagggcaagaagatcatttaacttttttaggaaatacctcgggtaaaatcactattaagctggtggatatgcgtgaagattcgcctacgctattttatgaagatgaaatggtttttgatccggcacccaatattgaattagtgatcccctgtggtgttgcccatgccttatttaatatggcgaatatcattactgtgaatcgacctgttatctatttggacgaagaaaaagaatatattccgggtcatgacgtgattgattggaaaatcgctaataaaaattatcaagcttatcgtgttaataaaatagcagcagatttaacctattatcaatttcttgtttctaaacaacaagcgttaatgaaacataagcccacccatcataccccaaaatcgattattgtttatgatgaaaataatcagcctattaaagtattaattaaagaaaaggtgtaa

SEQ ID NO: 1632 - DNA, 354 bp, Proteus mirabilis
gtaacgcaaatgtatacagcactcattgttattcttatcattgcagcaacagggctggttggtctgatcctgttacagcagggtaaaggtgctgatatgggcgcttcttttggtgcaggtgcttccggtacagtatttggttcaagcggttcagcaaatttcatgacccgtatgaccgctgttttagcaacagtgtttattgtactttgccttattttaggtaatttaagtgccaataaaactgttcgtgaagacagtaagtggatgtctatcgagcagactgcagaagaagcgaaaaaagctgagcaattagcagcgcctgtagcaccagcaaacacagatattccgcagtaa

SEQ ID NO: 1633 - DNA, 195 bp, Proteus mirabilis
cattctaaaattaaaaaggaatttcttatgaaaaactttgtcaaaattgcacttattgcttcttttgttaccgtaatgactggttgtactggtagtgtttacaacaaagaaaaagattgtaactacgactatttattacacccagcagtatctatctctaaaattatcggcggttgcggcgatactaataaataa

SEQ ID NO: 1634 - DNA, 414 bp, Proteus mirabilis
tatataaaaatagttatcaaatattggagtgatctcatgattattaatactacatcagcaccagaagctattggtccttattcacaagcaattaaagttgaaaatcatatttatatttcaggttgttgcccattcaatactcatgatggttctgttatgggaaatgatattgaaacacaaacattaaaagctatgaataatttaaaagctattatagaagctgccggtgcatcaatggatgatattgttaaaacgacttgttttattaaagatataaaagattttcctatttttaataatatttattcttctttttttacatcaggaaaatacccagctcgttcatgtgtggaagtttctcgtctacctaaagatgttttaattgaaatagaagctatcgcttataaaaaatag

SEQ ID NO: 1635 - DNA, 1416 bp, Proteus mirabilis
gctatgaaaatgaaggtcgtaaagcccattttattgccctttcacagagagggaatgctgttttatcccgtattcagtctgcataaaggaatattgattatgtcgagtctcatcactattgtgagccaatgtcagcgttatattgccacctttttgttggttgttctgtcactttttgtggtgcaaatagcacaagccgctacggtaacagaagtgaaggccgaaaatggggatgtggctacaacacttacattttcgtttagtggtgggaaaccaagctatagatattactcactgaaaaatccagataggttagtgatggattttaagcaaggtagccaaataacgggtttacctgtgacattaaatcgtcagcaattagcacagaaaattcgcacgacacaatcaaaagatagccaatatcaaagtatggtggtagagcttgccaaaccagtggtggtgacggagcgcttattaaatagcaatggtgaatataagttagtacttactatcaaacctattaatgctcgacaaaataacaatacatcaacgacggtcagtgtagtggcgttatcagcaaacaaagccacaaatacggtggctaatcaacagatggcgcctttagtgagtacacctaagcaacccgttgcacctgtagtaccagtaaagcctcgcacaacctcgaataagcccgcatcgagcgatcggcaaataattattgcgattgacgcagggcatggtggtcaagatcccggcgctattgggcaaaaaggtaatcgtgaaaaagatgttaccttaagagtggcaaaaaaattagaagcgattttgcgtaatgatcctatgttcaaacccgttttaacccgcaatggcgactattttatttctgttgctggacgctctgaagtggcccgtaagcaaggtgccaatatgttagtgtctattcatgccgactctgcacctaatcgcagtgcgcgcggggcatctgtttgggtattgtcaaatcgtcgcgcgaatagtgaattaggtaaatggcttgaacaaagcgaaaaacaatcagagcttctcggtggcgctggtgatgcactcgcagaaggggttgatccctatttaagccaagcagtattagatttacaatttggtaattcacagcgtgtaggctatgacgttgcggtagcggtgttatctgaacttagaaaagtaggatcattacataaaaaaacaccagagcacgccagcttaggggttttacgttcacctgatattccgtctattttagtcgaaacaggttttattagtcatgccgctgaggaacaattgctgatttcagatgcttaccaagagaaattagccgcttcaatctatgccggattaaaaaattactttctcgctcatcccttacagaatgggccaaaataa

SEQ ID NO: 1636 - DNA, 1308 bp, Proteus mirabilis
ttatctcgaatggcaacacggctgatgatactacaggggttacagaaggagatgagtaaccttcaattttacagagatcgttctatcatcagtcagttacctgatgaattgtcttgtaagatgcgtgaaatggggttaatcgctccagatcattataaggttcgtttttgtggtttcttttcttggtctgggactacagcagttttcttgccagtaaacagcgtgttaacagataataaagagttagccgctcattatttgttccagtcattaaatcgttactattcagacaaattgacaggtatacaagatactgatggtgatacattgattgggggaaatttaatttttacttcaatcagtatatttgaagactacataacaaatggtttatatgtcaggaggcataaaattcagtcggttaataaaggcaaaacaaactggtcccgtacagtatctcgacatatgccatttatatccaactcatctcctgtttatttagagcttgaatcatctcagataaagaatatatcagatagtgaaaccgctaggatccatgctgcaatcattagagacattaagaaaaaatttggtgtgcttataaatggtgaagagattcattttgatgtaaatctagaggaaatgcctgtcccctccggcgaccaagaaactcaactcgctcatttaaatcgtgaactcactttaagttattctgaacgagatattaatttaatcagattattaaaacagtatattgaaaacatggatggtacgaacaataatatactgatagtaggcactcgtcattttcagaatgtgtgggagagcatgctacataaagtgctactcggagaaaaagcatacaatcaaaaattacctgttccttattatctacaaaactctaaatatcatgaggttgcagaaaaagggcaaagagccgatatagttattagtgacaagtctaatcaacgagttgcagttgttgatgctaaatattataccgctttgacaccaaaagatgctcctggttggcctgatttagttaaacaatttttttatgaaaaagcagtcaaatctacagtaaataatggtgtgaaagttacaactcattttgtatttcctggagtagaacaaaaattaatatcagttcatgttgggaaaagaggacaagggggaactgatttatttattgctgaattagaataccctgttatttattgccattattgcgagccaatatctgtgatgaaagcctatatcaatcataaaatttgttatgagtttagaaaacaaatttttgaggtttga

SEQ ID NO: 1637 - DNA, 1194 bp, Proteus mirabilis
aagattggaattacaggtaggtgtcgtatgatgcagatgtatttccaaacatttaagcgtgttttattaggcatgttagaaaaaccgatgtggatgttattattggtttctctttgcattatgagtttagtctacgctaaacctgtattgtgggatctgcctgtggcggtgatcaatcaagatcatagccccgccagttatgcccttatccgctcattagatgccacacctaaattaagcttaaagggatatgataatttagatgaagctcgtcatgacatgataatgcgtgaactgtttgccattattatcattccaacagattttgaaaaaaaactgcttaatggcaaaaatgttaccgttcctgtgtatggagatgcgaccaaccgccttgctagtggacaaattcagcaagaattaatgcaggcgtatcagcaattattagataactataacggccgtatcttacaaaatgcgggttttagtgcgacacagtcaaaaatattattaaaaccgatccaaagtgaaactatcgccatgtataaccctggggtcagttttgccgccatttttttcccaggcttgttagtgatgttattgcaacactcattattaattgcttgtgtacgagtgagtatcgccgtcagaggaacgccaaaagggaagcctccgttagcggtatatttaggcgcgctatctgcacttataccgatttggctctttttatcttcggtgttctttgcactatggccgtgggtattaggctatcgtcaagaagcaccactttatcaaatttggatgttgaccttcccattcttattagcggtattaggattaggtaagttgatcaccgaatgcttgcgcagtgttgagatgatttacttaacattggcatttgtgacgacaccagtattctatatttcgggaactatttggccattacaagctatgccagattgggtattggcaatatcctctgcattaccttctacatgggctgtaaatgctatggccggaattaaccagatgggattatcattccaaagcatcctaggggatatcgtgatgatgctggttttaggcgtgatatataccattttgggggtgttagtggggatgttgcgcaatggtgagttaaggaaaattactcatcaatttaagcattgggcgagacattaccaccgttcaaagtaa

SEQ ID NO: 1638 - DNA, 207 bp, Proteus mirabilis
acatcaatgatattaataaaaacagttgattataagtacgcttcaccttttagggtgattgcgttgctaaaacagtttaaccagaggagaaatatatcactattctcctcttttcttttttctgcgaacactagaatgtctttttatgacatttttgctaaaaaagtatttttttttcttgattcttaccctaaaagcaccagataa

SEQ ID NO: 1639 - DNA, 837 bp, Proteus mirabilis
ggattgatgatgagtcgattagcctcacgctttgggcgtgccaacagtattcgtcgtgaccggccattaacgatggaagaattattttgtaccgtacccagtgttttctctgaagaaaaacatgagtcgagaagtgaccgttatacctatattcccactattaccttattggatagtttacaaaaagaaggattctatccgttctttgcttgtcaaacacgagtaagagacaacagtcgaaagatgcacaccaaacacatgcttaggttacggcgacatgaccaaatcaccggtattcaagtccctgaaattattttgttgaatagtcatgatggctcaagcagttatcaaatgttgccgagcttatttagagccgtttgtcaaaatggtttggtttgcggagattccttcggcgaagtgcgtgtaccgcacaaaggtgatgttgtaggaaaagtaattgaaggagcctataaggtattggaaacctttgattcggtggcagaaaagcgcgaacagatgcagtcactattgttaccgccaccagcacaacaagccttggcacaagcagctttaacttatcgttttggtgaggaacatcaaccgattaccgaggaacaagtattacaacctcgtcgttgggaagataagaaagatgatctgtggactgtgtaccaacgtttgcaggagaatttaatcaaggggggattgtctgggaaaaatgcaaaaggcaaacgtgctcgcacgcgttcggtgaatggtattgatggtgatatcaaatttaataaggcactgtgggtgatgacagaaaagatgtatgagtgttttcgaatatcttga

SEQ ID NO: 1640 - DNA, 1068 bp, Proteus mirabilis
gggttgatgatgaatatttattgtattaaattgaatataaattcaattataggatacttatctatgaaccctttctaccaaagatcatttttacgtttgctcgacttctcatcagcagaaatacaacaattactggctttatcattagaactcaaacaagcaaaaaaatcaggccatgaacagcagtatctcacaggaaaaaatattgcactgatttttgaaaaagattccacccgtacccgttgtgcctttgaagtggccgcctttgatcaaggtgcgaaggtgacctatctcggcggaggaagccaaatcggtcataaagaatcgataaaagataccgctcgcgtgttaggacgtatgtatgatggtattcaatatcgtggttatggccaaaaaacagtagaaatgctggcaaaatatgctgatgtaccggtttggaatggattaaccgatgagtttcaccccacacaattattagcggatttgctcactattactgaacatcaaacaaaaccattatcagaaaccatttttgcttatcttggtgatgctcgtaacaatatgggcaataccctactcgaagcggctgccttaacaggaatggatttacgcctagtcgcaccaaaagcgtgttggccacaagcagaattaatcgctgaatgccaaaatatcgctcagcaaaatggggggaaaattaccttaactgaaaatgtcgcagaaggcgttaaaaacgccgattttctctacacggatgtgtgggtatctatgggagagccaaaagatgtttggaaagagcgtattacgttactcaaaccttatcaggttaatatggatgtaatcaaactaacgggtaatccagacgttaaattcctgcattgtttaccggcttttcatgatgaagagacaacaatggggcaagcattagcggaagaatttggcttatatggtggttttgaagtcactaacgaggtttttgaatcaaaacacagtattgtgtttgatgaagcagaaaatcgtctacacacgattaaagcggttatggtggcgaccttagcaaatcctttttaa

SEQ ID NO: 1641 - DNA, 504 bp, Proteus mirabilis
atgcatcagatagaaatacgacatggtgagcctgaagatgctatagcaatacagcaattgtatacacatccagacttatatatttgtacttgtcagttcccttatccatcagtcactatgtggaaaaaaaggctaattgaattttctgaacaaaatattccacattttgttgcttcttttgacggtcaaatcgcaggtcatttggcgttgatcatcgacaatcatcctcgtcgtcggcatatcgtcagctttggtattggtgttggtgctgagttttcaggaaaaggtataggtaaagcactcattaatacggcaattgattatgcttttaattggttggctgcaacacgtatcgagctagaagtttatgctgataatgaaagaggacttcatttgtataaaaaattaggttttgaagtggaaggcattcgtcgtaatgcagccttcagagaaggtaaatattgtgatgttgtgatgatggctcagctaaaaaatatcgaataa

SEQ ID NO: 1642 - DNA, 630 bp, Proteus mirabilis
tcaattaagatgttttcagtggccctcagtgctactttcaatgaagaagttcctttccggtgctctctcaatacattatcaaaaaatattctactaataagtaaaacgatgagtgcaactatgactgcaaaccctaatgcaacacaaaatattattatcagagccattgaaaaaagagataacgccggcattgcacgcgttattcgagaagtttccgccgagcatggcttaacagcggataaaggatttgcagtagctgatccgattttagataccttattcgaagtttatcatcaacctcgcagcgcttactgggtggtagaaatggatggcgaaattgttggtggtggtggtgtcgcacctcttgcaggtggcgatggggagacttgtgaattacagaaaatgtatctctcttctaagttacgaggaaaaggaattgcgaaaaaaattgttcagcaatctcttgagtttggtaagcaacaaggctttagtcgctgctacttagaaactactgatattttaaaagcagcaattggtctatatgaaaaattaggctttgagtttattgataaagcattaggtaatacaggccacagcgactgtgaaattcgtatgctgaaatcactttga

SEQ ID NO: 1643 - DNA, 210 bp, Proteus mirabilis
aagatgaagatcttcaatcgctataacccagaaaaaattgctctctacgttaagacgttatttcgtggacggttttatatcaaaggaatgggcgcatttgagttcgattacggtaaaattttattgccgaaaataaaagataagctgcattttaatgtgatgagtgaagttaaccagcaggtggttttactcaaagctgaaatgggctaa

SEQ ID NO: 1644 - DNA, 297 bp, Proteus mirabilis
aaattttacttttattggagttttattatgtctctaagtactgaagcgaaagcaaagatcgttgctgaattcggtcgtgatgctaacgatactggctcaagcgaagttcagatcgcactgctgactgcagaaatcaaccacctgcaaggtcacttttcagagcacaaaaaagatcaccacagccgtcgtggtctgctgcgtaaagtttccagccgtcgtaatctgctggactacctgaaacgtaaagatgtagctcgttatactgcactgattgaacgtttaggtctgcgtcgctaa

SEQ ID NO: 1645 - DNA, 474 bp, Proteus mirabilis
gttaatactgtgaattaccatcaatattaccctgttgatgttgtcaatggcccaggaacacgttgcaccctgtttgttgcagggtgcgtacaccaatgtcgtggttgctataataaatcaacttggtcactaacatctggcaagccgtttacccaagaagtggaagatcagatcattgctgatttacaagacactcgtattaaacgacaaggactatcactttccggtggtgatcccctgcacccccaaaatctttctgctatattaaaattggtaaaacgtgttaaaacgcaatgccctgagaaagatatttgggtttggacaggctatttattggctgacttaaccccagagcaacaagaagtcgttagctatattaacgtactgattgacggcaaattcgtacaagaactttatgatcccgcattactgtggcgcggtagtagtaatcaggtgatccataaattgaagtaa

SEQ ID NO: 1646 - DNA, 672 bp, Proteus mirabilis
cttaccactgttattcttggcactaactttcataaaaacaggtattttttcatgtcaaaaccatcatttgattctattgaatcgcaggcaagttacggtattggtctgcaagtcggtcaacaactgactgaatcaggtctccaaggattagagccagcagcactgcttgccggcttgactgacgcgttagaaggcaatactccttctgtacctgttgaaacgttacacaatgctttacgtactatgcatgagcgtgctgaagcagttcgtcaagagcgtcaagcagcactggcagaagcaggtaaagtattcttagcagaaaatgtaaaaaaagaaggcgtgcaggttacggaatctggtttacagtacaaagtactgaaagcaggagatggcgctattccagctcgtactgatcatgttcgtgtgcattatactggtcgtttaatcgatggtacggtatttgatagctcagtacagcgtggtcagccagcagaattccctgttaatggggtgattgcaggatggattgaagcattaactttgatgccagtaggttctaaatgggaattatatattccttaccaattagcttatggtgaacgtggtgcgggggcggctattcctccttttgcaacattagttttcgaagtagaactattagaaattttataa

SEQ ID NO: 1647 - DNA, 879 bp, Proteus mirabilis
aatacccatgtatactcaaaaaatcctacaacagaaaattctaatatcacgatctggcgtaaaggtgataacagagcgccccataaaccactgttactcttattagcgctttccgagtaccgcaaaggccatccacgactatttaattatggtaatgaaattcatcaacagttattagaattattgatgaattttggcccatctcgccgtgagcattatccaaatctgcctttctggcgattagttcgcgatggtttttgggagttgcaactaccaaaagagagcgatctatcaaaagataataagcaaccatcgaaaaataaattaattcagcaaaatgtgttaggtggatttgaccaagaaagctatcagcttcttataaaaaagccaagtttaatcaataagctagcacaacagattttaagtgaacacttccctgataatgttcaagaagttattgctaaccgtcttgattttcccctacaagaaattcgccaaaaccgagatcccacttttagaaaaaatatcttacgtgcttacaattatcagtgtgctatatgtggttataatctacgttatgatagcgccgtggttggcctagaagccgctcatataaaatggaagcaattcggcggcccatgtactatcaataatgggttggcattatgcacattacaccactctgcctttgatatgggcgcaatcagtattgatgataatatgaaattattagtttctagcggtgtgaatggtaatcaaatggtagagcaattattttggcaattttcaaataaggtaattagcctacctaaaaacacaaaagagtatccgaaagacacatttatccattggcatcgtgagcaagtgtttaagctatag

SEQ ID NO: 1648 - DNA, 501 bp, Proteus mirabilis
ctatggagtgtttattccccctgtgggagaataaccaagatatctttcagactattgcggagcggaattatggcggacagcaaagagctagcagaacaacgtgaagaaacacgtcttattattgaagaattactcgaagatggcagtgatcccgatgcactgtacgcaattgaacaccacatttcatgtgaaaattttgaaacgttagaaaaagcggctgttgaagtttttaaattaggttatgaagtcaccgagcctgaagaaattgaaattgaatcaggtgagatcttagtctgctttgatgcggttagtgaaagtggtctaaatgctgaactgattgatgcgcaagtagaacagttaatgaatttagcggaaaaaatgggtgtctattacgacggctggggaacttattttgaagatcccgacgctgagtacgatgacgaagatggcgaaaatgaagatgacgaaagcgagtctgataagtcatcacgcctgcactaa

SEQ ID NO: 1649 - DNA, 1203 bp, Proteus mirabilis
agaaaaggtgtaacctctattatgcgtattgtctttttctatatgctttttttggtattaagtgcagatggtctaatggtttttttgacacctgttattgtttatcaattaacaacaagcattgaatatgcgggattgacatacgctttatggtggttaccacgtatttttttaataccgcttattggtcaatatattgatggtctaggtgtccgtcctgtttctgttatttccgatagctgtaaaataatcggttgtttatttttattaatagtagatttttcctctgatttagttattgcaattagttttggattagtgggtagcttaatttctattggtaattcacagacactgatttcatatgaaaaaattattgccttgatgagtcgccataaagaacatcatattaatataatgtctcgaatggattttttgggcatgatcatcggcccattaatcggcatgttatttattgattatggttaccattatttactgattattccctgtctattttatttcattaacgccgtgttctttttgttcttttacctagtaccaaaacagcgccaatctgccactcagttacatagcctaacagagacattacaggtgacgaaaaggatagtggtgatttttacgtctcctattttggttttttctattttaattgctatcggcaataatatgtttgatggattaattgagtcgagtggggcggcgttgatcgaccaatcgatgaatttacccattaaatattatggctttattgatatttctgcggggatctgtggcgtgataggaacttatttatatggttatctaacccattatttaaatcgaaaattattaatgtctctatcaatttgtatcatcacaataagttcttttctattggttatttttcaacatgatatcacggcttttattctcttttatgccctatccattattggtaaggttttttcagggaatattttacggatgttaaggatagaaattattcctgtgacacaattagccagcatttcctcactgattatattgtttaatcaactgattttgcctattgttgggggattgctctttttctctacagggaatatttcgacagtatatatattgatgataatcgctatggcgatcaccttggtgggtggcgtaatgcttattatgcggttaaaccataaaaagagataa

SEQ ID NO: 1650 - DNA, 192 bp, Proteus mirabilis
cgtcttaacgtagagagcaattttttctgggttatagcgattgaagatcttcatctttcagttagtctcccatgctcagttgtgaatttaatcagtcataaagaccgatctttatataccaaatttaaagacctaattataagtactaggttccatttatttaaatttcttatctatttttacacttattga

SEQ ID NO: 1651 - DNA, 1752 bp, Proteus mirabilis
ggagaaaacgtgccgagatactccgttatctacgttctctgtctgtcttctataacgtcttttgcttatggggcaaatttacgtttaaaagtagaaggtttagaagggcaactcgaaaagaatgtacgagtccagctatcaaacataacaacagaagaagttgcaccagacgggcgttttcgtgcgcgtgttgaaaaggcaattaaagagggcctacggcctttaggttattatcagccaacggtcactttctcttatcaagaaaatacccctccgacacgccctgtattaacagcaaaggttgagcttggtattcccgtactgttaaaaggggtcaatattgtactggaagggggagctaaaacagatgaacaatatgccaaagtgattaaagaaaacactccccctcttgatagtgtgttaaatcatgccgaatatgaaaaattaaaaggctcgttaacagggcttgctattcgtcgtggttactttgatgcagatatggaaaaaagccagctcggtgtctctttagataatcacgcctcttattgggattttgtctttaatagtggtgaacgttaccgttttggtaaagtgaattatactggctcacaaattcgtgaagactacctacaaaatattgtgccttttaaagaaggggaatattactcttctgaagatttggcagagtttaatcgacgcttagctgccacaggatggtttaattcggcggttgtcacacctaatatcgctaaagcacgtagtgaaggcaattatttgctaccaatggatgccgttgttacccctcgttcacgtaactatatggagctagggggcggttttgccacagatgtcggacctcgattaaatatgcagtgggataaaccttggataaattctaggggccatagtttaacatcgaatatgagtatttctaagcctgagcaatctattggtgctaattataaaattccattaaaagttaacccattagaacaatattatggcattcaaggcggctataaacgtacagatttaaatgatactcgttcggataccaccacactgaacgtttctcgtaactgggatatgtcaacgggatggcaatacagtattaatacccgctggagtctgagccactttacccaaggtgatgttaccaatacaaccatgttgctttatcctggtgcgaatgcaagtcgcgtacgccaacggggtggcatgatgccttattggggggatagccaacgttattcagtcgattattccaataaaatatggggatctgatgttgaatttctcgccctacaagctcagcaagtgtggatacgcacaccttgggaaggccaccgttttgtggtcagagggacgtttggctggattgaaacgaatcaatttgagaaagtaccacccgaattacgtttctttgctggtggcgatagaagtattaggggttataaataccaaagtatttcaccggaagatagcaaaggtaaattaacaggggcatcaagaatgctaacgggatctgttgaataccaatataacgtaactggaaattggtggggagccgtatttgttgatagtggtgaagccgttaacgattttacgaaaagtgattttaaaacaggtgcgggtgcgggggttcgttgggcatctccagtagggcctgtaaagtttgatttagccgttccagtcaatagtggtgaagagcgtaaattacagttttatattgggttaggagctgagttatga

SEQ ID NO: 1652 - DNA, 789 bp, Proteus mirabilis
aacatggcagtaaatgatacccaaccgctgatcagccatttaatagaactgcgtaagcgtctaatgtacagcttagtttcagttctagtggtttttctggctttggtttatttttctaacgatatctatcaattaatctcggcacctttacttgataagttgccgcaggggtcaaatatgagtgcgactgatgttgcctcaacttttttgacgccgattaaattgactattatggtatccgtttttgcttctgttcctgtgatcctttatcaggtatgggcttttatcgcaccagcactgtataaacatgaacgtcgcttaatgttaccgttactggtttcaagtaccgtattattttatctcggtatggcgtttgcgtattttgttgtgtttccacttgcatttggtttctttgtgaatactaccccagaaggggttaactttattccagatatcagtaagtatttaagtttcgtaatgacgctgtttatggcgtttggggccgcatttgaagttcctattgcgatcatcttgctgtgctggagtggtgtcacaacacctgatgcattaaagaaaaaacgtccttatatcttagtgggtgcttttgttattggcatggtattaacgccacctgatgttttttctcaaacattattagcaataccgatgtatttattgtttgagattggtgtcttggtgtcccgtttttatgtcaataatggcagaagaaaaacaccagaagaagaagctgaagaggctgaggcgcaagcaacagaacagcagaaataa

SEQ ID NO: 1653 - DNA, 969 bp, Proteus mirabilis
agaggaagagtaatggggcgtcgtcgtaaagggcgtgagattaacggcgtattattgcttgataagcctcaagatatttcatcgaatgacgctttgcaaaaagtacgccgcatgtttaatgcaagcaaagcggggcataccggcgctttagatcctttagcgacaggtatgcttcctatctgtttaggtgaagcgacaaagttttcacagtttttattggattcagataaacgctatcgagtgatcgccaaattaggtgaaagaacagatacctctgatgctcatggacaagtgatccagcaacgacctgtacagtttaaccagcaagcgctcgatgctgcgttagagagttttcgtggtgaaacattgcaaattccttcaatgtattcagcccttaagcatcaaggtaaaccactttatgaatatgcaagacaaggtattgaagttgagcgagaagcaagacccattatcgtgtatgaattgcaatttattcgctgggaagacgatgagttagaactagaaattcattgttctaaaggtacctatattcgcactatcattgatgatctgggtgagaaattaaactgtggtgcccatgtgattttcttacgtcgtttagaagtcgcagattatccgaaagagtgtatggtgacgcttgagcaattgcgtgcaatcattgatgatgctcagcaacaagatgagtcaccatttcctgcgttagatgccttattattgcctatggatactgcggttgcacatttccctgtggtgcatttaaccgccattatggcgggttacttaaaactggggcaaccggttcgggtaaatcacaccttggatgaaggggaatgggtcagagtcaccgaaggcgatgagaaaaaatttattggccttgcgatcatcaaagatggtctagttgcaccgaaaagattagtcgtggattatcacgcactcaataaccctgaatag

SEQ ID NO: 1654 - DNA, 1332 bp, Proteus mirabilis
aatccttttttaagcaaccgagtgtattttgaaatgagtaataacgttgtcgtattaggcacccaatggggtgacgaaggcaaaggcaagatcgtcgacttgctgacagaacgtgctaagtatgttgttcgttaccaaggcggacataacgcaggtcacaccctagtcattgacggtgaaaaaaccgttctccacttaatcccatcaggcattcttcgtgaaaatgttgtcagcatcatcgcaaacggtgtcgtattatcgccagaagcactgatgaaagaaatgacacagctcgaagagcgtggtattcctgttcgttcacgtctactgctgtcagaagcttgcccattaattctgccttatcacattgcattagataacgcccgtgaaaaggcgcgtggtgagaaagcgattggtactacgggtcgtggtattggtcctgcttatgaagataaagtcgcacgccgtggtttacgtgttggtgatctatttgataaaaaagcattcgctcagaagcttaaagagatcatcgaataccataatttccaactggttaattattacaaagttgagcctgttgattaccaaaaaaccttagacgatatcatggcgatcgctgatatcttaactgggatggttgttgacgtttctgacttactttacaaagcaacacaaaaaggtgagttagtgatgtttgaaggggcgcaaggtactctattagatatcgatcacggtacttatccgtatgttacctcttcaaataccaccgcaggtggtgttgcaacaggttccggcttaggtcctcgttatgttggttatgtattaggtatcattaaagcctattctacccgtgttggtgcaggtccattccctacagaattatttgacgaaaccggcgatttcctgcgtgaaaaaggccaagagttcggtgcaacaacaggtcgtagtcgccgcactggttggttagatattattgctatccgccgtgctgttcaaatcaactcattgtcaggcttctgcatgaccaaacttgatgtcttagatggtctgaaagaagttaaagtgtgtgtaggttatcgcttaccaaatggcgaagtgattgaaactacaccattagcagcagatgattgggaaggtattgagcctatttatgaatctatgcctggctggaacgaaagcactttcggcgttaaagataaagcacagttaccacaagccgcgttaaattatattaaacgcgttgaagagttaactggtgtgcctgttgatattgtttctacaggtccagatcgttcagaaacgattattctccgtcatccatttgatgcataa

SEQ ID NO: 1655 - DNA, 1020 bp, Proteus mirabilis
ttgttttctttactaggtgtgttgcgtaatagtgagtatatcaaaggcgttccactatctcgtaaactaaggagtatcagaatgaaagtagcagttctcggtgcagcgggtggtattggtcaggcactggcacttcttcttaaaaatcagcttccagctggtagtgaactctctttatatgatatcgctccggttacaccgggtgttgcagcggacttaagtcatatacctactcaagtaagggtaaaaggttttgctggcgaagatccttctcctgcattaaaagatgcagatgttgttttaatttctgccggtgttgcccgtaaaccgggtatggatcgctctgatcttttcaatgtaaatgcagggatcgtgcgtaatcttattgaaaaagttgcacaaaactgccctaaggcgcttattggtatcattactaatccagtcaatactacggttgctatcgctgctgaagtactgaaaaaagccggtgtttatgataaaaaacgcctatttggtgtgacaacactagatattatccgtgcgaatacttttgttgctgaattaaaaggcaaagatccacaaacaacgaatgttccggtcattggtggacactcaggtgtcactattcttcctttgctatctcaagtagccggtgtgtcatttactgatgaagaagttgctgcattaacaaaacgtattcaaaatgcggggactgaggttgttgaagctaaagcaggtggcggatcagccacattatcaatgggacaagcagctgcgcgctttggtctttcattgatccgtgctttaaatggcgaaaaagatgttattgaatgcacctataccgaaggcgatggtgaacatgcccgtttctttgcacaacctgttcgtttaggtaagaatggtgttgaagaatatctaccaatcggtcaattaagtgattttgaaaaacaatctcttaatggcatgttggatgtattgaaaaaagatataattcttggcgaagaatttattaataaataa

SEQ ID NO: 1656 - DNA, 207 bp, Proteus mirabilis
aatgtattatttaaatattattatacgttctggcgtaaatatttagccgcttcaaccatatttgccaatgctgcacgggtttcactccacccccgcgtttttaaaccacaatctggatttacccataaacgttccgcagggatacgcgattgcgcttttcttaacaaccctacaatccattctacattcggtacattaggcgaatga

SEQ ID NO: 1657 - DNA, 207 bp, Proteus mirabilis
ttaaacatatttctgtacttcttctataaaataagattttatacgactatattaataaactttcgcattcgctattattcagccattcacttattatctaaaatacccatgtatactcaaaaaatcctacaacagaaaattctaatatcacgatctggcgtaaaggtgataacagagcgccccataaaccactgttactcttattag

SEQ ID NO: 1658 - DNA, 1569 bp, Proteus mirabilis
gtaatattttctgataatcagataatcacacgtgttaccgtttacttttgccctcattgccctttagtattagcctctggcaatcaacactatagcgttaagcttatagttacggatagagaaattatgcgcttattacctatattccgcggaatattttataccttgagtctgttaagcttttcaaccctcgccattcctgttgaaaaatatatagaacttttgcctgatggcactcaagtcggtttaatcacccaaactgttggcgcatcctcccctaacctaacttataatgataatcaattatctttgccagccagcacacaaaaagtggtcacagctttagccgccctattgcaattagggggcgattatcaatttaccaccacaatggaaacggaaggtaagataaaaaacaatcaactagagggtgatttaattttccgttttagtggtgatcctacgctaactcgccagcaattacgagcaatggttgccgtattaaaacaatccggcgtcacaaaaataacgggaaatttattaattgatacctctgctttctccagccatgacaaagcgccgggatgggtttggaatgatatgacccaatgctttagtgccccaccaagtgccgctattgtagataaaaattgtttttccgtcttactgcaaagtggtcaaaaagaaggtgatatcgccaccatacgtaaagcgtctttttatcctgtcacggttttaagcgaagttgaaacctatgaaaaaggctcaacacgaacccgcttttgcgaattagacgtcacggtgagagatttaaatacttatgtgataacaggctgcattcctaaacgtgaagaagccatgccgctgatgttttccattcaagatggtgcgcactgggcaggtatattgctaaaagaagagttacaacgtgcagatattgagctggacggttatgtcaaacgccgctcccaacctaaagcccctgttactgttttagcacaaacacaatctaaaccgttacacactttattgacgacgatgttaaaagagtctgacaatatgattgcagatgccgtatttagaactattggtcgtgaatattatggtgtagctggcacttggcgttcaggggcggatgccactcgtgctattttaaaacaaaaagcgggcattgatttagctaatacaattatggtggatggatctgggctttcccgccataacctgatagcccccgcaaccatgatgcaagtattacaatatgtcggacaacatgatagtgagttaaattttatcagtatgcttcctcttgctggtcatgatggtacattgcaatatcgtggtggttttactgaagcgggcgtcaacggtaaagtttccgctaaaacaggttcactcaagggagtgtataatctagctggctttatgaccacagccaatggacagaaagtagcatttgtacaatttatttctgcctactctccccctacacaaaatcgcaatgctggacgcgcctatttggttcgttttgaaacgaatttatataaagatatctataacaataaatag

SEQ ID NO: 1659 - DNA, 534 bp, Proteus mirabilis
agccccgaatttcggggttttttgttatcagagaatagaatactgggctataagccctttttttatgccttgggggtgggtttgtccacattagagcaaaaattaacagcgatggtttcagcaccagtagaagcattaggctttgaatttgttggtcttgagtttattcgtggtcgagtatcaacattgcgtatctatattgatagtgaagaaggtatcactgttgatgattgtgctgatgttagccaccaggtcagtgctgtgctggatgttgaagatccaattcaaacattttataaccttgagatctcatctcctggtttagaaagacctttattcactacaacgcattatgagcaatttatcggcgaagaagtcgccgttgtattacgaattgcgatgcaaaaccgccgtaaatggcagggcattattaagtctgtcgctggcgaaatgatcacggttactgtggatggtaaagacgaagtgttcgcactgagcaacatccagaaagctaacctggtaccccacttttaa

SEQ ID NO: 1660 - DNA, 219 bp, Proteus mirabilis
tatcagcattcgctgtatatccacattcaaggcactcgaattgactttgtgactggcggttttcctttgctgtatgaccacagtaagcgcacttctgactggtgtaggccggtggtattgccagtacctgaccacctcgccagagctgcttgtactcaagctgtcggcgcatttcataccagccctgctccagtattgagcggtttaaaccagatttag

SEQ ID NO: 1661 - DNA, 300 bp, Proteus mirabilis
gcaacttgttcaatgaatattgaaaaactgcctcttagtataatccaattacttgaaattggcagtgtcattagaacaagtcgcctagatgtttctcccctgagaaaacagaatattgatcagaaagtcaaaatcttatccgcgtcgagagtccattgtgctaagtccaccaatgtcccaagttcagcaccatccactaaaggtaattcactgataccacgagtatctgtacaggttttgcataacttaacagggacgttttgtgccgttaaaatttctaacatttgttggaggttgtaa

SEQ ID NO: 1662 - DNA, 648 bp, Proteus mirabilis
aaaacattctcgatcatacggaatttattcgttaaattagattatataggtcttaacgtgcttgatagaataaaagtctgctttacagagagtattcaaactcaaattgcagcagcagaagcgttacccgatgccatttccagagctgccatgatgatggttcaatctttgttaaacggacataaaatattaagctgtggcaacggtagctcagcagcaacggctcaacgctttgctgctagtatgatccatcgttttgaaacagagcgcccaagtttaccggcattatctttaaataccgacagtgttgtgatgaccgccattatgggaaatcagcaacatgatgaaatttatgccaaacaagtacgggcattagggcaagcaggtgatgtactgttagctatttccactcatggtaatagcagaagcattattaaagctgttgaagccgctgttactcgagatatgaccattgttgcactgactggctatgatggcggtgagcttgctggattattaggccctcaagatgtggagatcaggatcccctctcagcgtacagtcagaatacaggaagtgcagatgttaacggtcaattgtctctgcgacttaattgataatacattattcccacatcaggatgactaa

SEQ ID NO: 1663 - DNA, 1671 bp, Proteus mirabilis
gagggcatctctatgatgagcggttcaccagtgacagaaacagatgtcattattatcggcggtggagctacgggggcaggcatggcaagagactgtgctcgtcgtggattacgctgtatcctactggaaagacacgatatcgcaaccggtgcaaccggtcgaaaccatggtttattacatagtggcgcacgctatgcagtgaccgatccggaatcagcgcgtgagtgtatagaagaaaacatgatcttaaaacgggtcgctcgtcattgtgttgaaaaaacggatggcctttttattactctccctgaagattcgttagaattccaacaaacctttattcaatcttgccaagcggcaggtattgatgctcaagccatttcacctgaagaagctattcgcttagagccttcggtgaatcctaatcttattggtgcggttaaagtacctgatggtacggttgatccttttcgcttaacggcggccaatatgttagatgcacgtgaacatggcgcgcaagtactcacttatcatgaagtgatgggcttgatccgtgaaggcgatcgtgtgaaaggtgtacgtgtttatgatcatcaatctaaaaatatgtatgagatccgcgcacaaatagtggccaatgcgggaggaatatggggacaaaaaattgcagaatatggtgatttaaaagtccgcatgttcccagcaaaaggggcattactgattttaggacaccgtatcaataatatggtgatcaaccgctgtcgtaagcctgcggatgccgatattttagtgcctggcgataccatctcattaataggaaccacctcaactcgcgttccttatgatgaaatcgacaatatgtatgtcacccctgaagaggttgatatcctgatccgcgaaggttcgatgctggcacctaaactggctcaaactcgtattttacgtgcttatgccggtgtacgtcctttagtggccagcgacgatgatccttctggccgtaatgtaagccgcggtattgtattacttgaccacgcacaacgggatggactcgagggctttatcaccataaccggtggtaaattaatgacttaccgattaatggctgaatgggccacaaacaagatctgtgagaaattaaatatttcagcaaaatgtaccacggctgaagagccattgcctggctctcgccaatcggcagagcaagcattgcgtagtgtggtgtcgttaccggcgccaattcgaggctcagcggtttatcgtcatggcgatttagccaataaattattgagtaatgagcgtattgataaaagcttagtgtgtgaatgtgaagcggtcacggccggtgaagttcgttatgcagtgaattctttaaccgtgaataatttgctcgatttacgccgtcgtactcgtgtgggaatgggaacttgccaaggtgagttatgtgcttgtcgcgcagcaggattattaaatcgtttacaagtcacaacgcctcatggctccgaacaacaacttgctcattttctaaatgaacgttggaaaggtattcgtcctatcgcatggggtaatgcgttacgtgaaagtgagtttaccagttgggtgtaccaaggtttatgtggcttagatgccgatatgattgataaaacagcttcagtggaggccgatgatgaaatttga

SEQ ID NO: 1664 - DNA, 753 bp, Proteus mirabilis
tgcgcatcctctcctgatgagagaaaatcatacgttttattgggttccctcaccccaatcactaaaaaggtacaatttatgtataggtttacctcccgccaaaaagcggcggcgctattatggctttcgttatttcatatattgataattacttctagtaactatcttgttcaattgcctatttctatttttggcttccataccacatggggtgcatttacttttccatttattttcttagcgacagatttaactgttcgtatctatggagcccctctggcaagacgcattattactgccgttatgataccggcattagctatttcctacctaatatcaacactctttttccaaggaagttggcaaggttttgcctcactcaatgattttaatatcatggtggcaagaatagcgacagcaagctttatggcgtatgtgttagggcaaattatggatgtttctgtctttaatcgtttaagacagcaacaaaaatggtgggtagcaccaagtgcagcgatgtttcttggtaatttcttagatactgttgccttcttttttattgccttttatcgcagtacagatgcgtttatggcggccaattgggtcgaaatagcgctcgtggattacacttttaaattgacgatttgtatgctgtttttcttaccggcctatggcgtattattgaactttattttgcgctatttttttgcacaagaaaatcaacaacaaagctatgctcaaatccgtccttag

SEQ ID NO: 1665 - DNA, 249 bp, Proteus mirabilis
acatacgcctctcctcgttcaacaaagtacagttttatcaattaccgatactttacagcttggagtagagtccagagtcaagataaacagagcgtattgattgtcaaaaagtgcggatttgttaaatcaattaatcccttgtttctattgataaagaaacaagggatcagggttttacagaaaaagggctctaacaataaagaagtgaccaataaagtaacaggcacttaccagtcctttagaggctga

SEQ ID NO: 1666 - DNA, 729 bp, Proteus mirabilis
ttaatcgactcgaaaagtaccgcgatgataaaatacagaacagcacaacagtgtggcaaagcggactatggctggctacaagctcgctacacattctcctttggccactatttcgatcctcattttttagactatggcacattaagagtactgaaccaagaagtgctcgcaccaaattctgagtttaaagcaaaaacctatcctcatgtggatgtcgtcaacctgatcttaagaggtgaagcgacttatcttgataatatggggcgaacacttaccgccaaacaaaacgagtgtttattaatttcgcctcataatacagaaacttacattgaaagaaatagtagtccagataccccattaactcgtattcaattatggctaaacgcgtgtccacaacaagagagcatcgcttcacaaaaattagctttaaatgaagatttaaaatatcaattattggcttccccatcaggggataatggcagtttgatgctaaggcaaaatatctggctctatcatattaatttagcgcaaggggatgaaataaccttgccgatacagggtcagaaaggctatttgcaatctatcaaaggcggtgtccatttccaaacctcagagcaagagcttggggaaatccgttgtggtgatggtgcttttattcaagatagcaatatgctagcgctaagatgtcaaaaggcttttcgtggtctttttattgatatcgtttcttaa

SEQ ID NO: 1667 - DNA, 2064 bp, Proteus mirabilis
catgctagattgcaataccgaaaagttttttctaagaaaaataacaaaaataggttaactatgagccaacaaaatgaaatcacaccaaaaaaaattaggatgaaaattaatcctcccgtattttacacctccgcaatacttattatgctcgtcgtagggttttcagcgctgtttcctgaactcgctaatgacaagctagggcaccttcaggaaaaccttttcaccaacgcgagctggttttatattttagccgtagcattggttttgctgagtgtgacttatttagggctatcgcgctttggcgaaataaaattaggccctgatcatgctcgtccacattttagctattttgcttggttcgcgatgctgttttcagcaggtatgggtattgggctgatgttctttggtgtcgcagaacccgttatgcactatttaatgccacccacaggggatgcgcagacgattgaagccgccaaagaagctatgcgtttgactttcttccactggggattacatgcttgggctatttacgccatcgtggcattaattctggcgttttttagctaccgccatggcttgccattaacgttacgttccgccctttatcctatcattggcgaccgtatttatggccctattgggcatgcggtagatatttttgctgtgatgggcaccgtatttggtgtcgcaacttcactgggttttggtgttctacaagttaatgccggtttaaaccatctattcgatattccaattaatccaaccgtgcaagtggttttaattgttgttatcaccgggcttgctactatttcagttgtctctggattagaaaaaggtatccgttttttatccgagcttaaccttggtttagccgttattcttcttttattagtcattattcttggccctactgtattgattttaaaatcgtttgttgaaaatacagggggctatttatcagaaatagtgagtaaaacgtttaatctttatgcctacgagccaaaatcaagtgattggttaggtggatggacactgctttattggggctggtggttatcgtggtcgccttttgtcggtatgtttattgcacggatctcccgtggtcgtactattcgtgagtttgttgtcggcgtactctttgttccagctggctttaccttactttggatgactgtctttggtaataccgctatctatttaattaaagataaaggtgctgaagttcttgcgaatatagtacaacaagatgtgtcattagcactgtttgaattcttaaattattttccattctcatcagtgctttcctttgtcgcaatgctgatggtcattgtcttttttgtcacctcagcagactccggtgcaatggtggttgataccctagcgtcaggaggagattcagaaacccctgtatggcaacgtatcttctgggctgcattaatgggtatttcagccattaccttgttattggcaggaggtttatcagcattacaaactgtcaccattgccagtgcgttaccatttgccatcgtgctattggcatcaatttatggattaattaaggcattgcgagtggatgtttataagcgagatagccaacagatgacgactatcgccccaccggctagccgtaatcctattccttggcaacgtcgattaagaaatattgcttattttcctaaacgttcacatgtaaaacgttttatggaagaagtcgttaatccttccatggaaatggtgtcggctgaattaagcaaacaaggtattcaatgctatatccatgacgaagaagaagatcgcatcggctttgaagtggacttaggtgaggatatgaacttcttttatgaagtacgattacgattctatactcaacccgctttcgcgctagccggcttaacagatgaagaaaaagatgaagagcataaatactatcgcgctgaaattcatctcaaagaaggtgggcaagattacgatgtcatgggctggacaaaagaacaaattattcatgacattctcgatcagtatgaaaaacatattcacttcttacacgtattaggtaaaaggtaa

SEQ ID NO: 1668 - DNA, 393 bp, Proteus mirabilis
gagattttatctgcgatatcaaataaatcgatagccgctaatgtatcaccaccgccagcgatagagaaagcatcactatcagcaatcgctttagcaatcacttcagtacctttacggaagttagggaattcaaagacacccacagggccattccacagaatggttttggcgtttttcaggatttcagctaaacgttcagccgtcacatcaccgatatctaatacttgttcatcatctttgatgtcatttgctgatttcagtacagctggcgctgtttctgagaattctgtcgcgacacggacatctgttggtactggaatatcgcatttttccattaattttttcgcatcgtcaacaaggtctgcttcatataatgaacgacctacagaatga

SEQ ID NO: 1669 - DNA, 630 bp, Proteus mirabilis
ccacccttatctgctgagaaaacggcagaattacttaatcgagacactatcatgataaaaaatttactttgtgccgtgtttgcgctcacaatgctggcaggatgtgcaacaccaagcaataaattatcgattgagccagtgatgtctgtaccaccatcagatccaactatgcgcccaattacacttagtatcaccagccaagataaacgaccttcgaaaaacttagcggaaatgagtcgtaatggtaagttagaggttttagtccccacacgtgatttagcttttctaatgcaagaaatcgttcaaaaacagatgatggcacgtggctatacttttggctctccagccgcagctgacgtaattgtggtgataaataaactgaacgcagatattagtgaaggaagtctacgccataatattagtgctaaagcagatatttccgttgttgtcagcatgcctaatggtagcacaaacactaaaacctatcgtactagctacaatgtacaaggcccatttggcgcatccaatgataaaatagcggcagcgattaataatgttttatctgagcttgtcagtgatatggcaaaagatccttccgtcagccaatacatcaaatctaacgctcgttaa

SEQ ID NO: 1670 - DNA, 192 bp, Proteus mirabilis
attaacgcatcttcattgagctcacctaatgttgcaacaacaggcaaacgaccaataaattcagggatcaaaccaaatttaatcagatcttctggttcaacttgcgctaataactccccttcactcgctttctcattttggcttttcacttctgcaccaaaaccaatacctgaatgggtatttagacgttga

SEQ ID NO: 1671 - DNA, 216 bp, Proteus mirabilis
aggacgggattttacggtgctttggataatcaatcaatgatcaatgcactaaagaaaattgcagcacaacacgaaactgaaaattttgaagatggctcgacaggacgagcatatcgcaaagcagcctttatttttaataagggagactctcttttttcaacccatccttcgattgaaaatagaatagcagtgctcgaaggaaaaaagaccttttaa

SEQ ID NO: 1672 - DNA, 498 bp, Proteus mirabilis
ggtgggggattattcagaaaatgcgtatgtaggagaagcattatgcaagaagggcaaaagcgtaaaacatcgtccatgagcattctcgctattgctggcgttgagccatatcaggaaaaaccgggcgaagagtacatgaacgaagcccaattagcgcattttaagctaatacttgaatcttggcgcaatcagctcagggatgaagtcaaccgtaccgtcactcatatgcaagatgaggcggccaacttccccgatcctgttgaccgtgctgcacaagaagaagaattcagtcttgagctgcgtaaccgtgatcgtgaacgtaaactcattaagaaaattgagaaaacactgaagaaagttgaagatgatgacttcggcttttgtgagtcttgcggtgttgaaatcggcatccgccgtttagaagctcgtccaacagccgatctctgtatcgactgtaaaacattagctgaaatccgtgaaaaacagatggctggctaa

SEQ ID NO: 1673 - DNA, 1047 bp, Proteus mirabilis
cacaacatgtcatttttaaaaaaactaccgggaattctgttttgtgcactaattggtgggttattaacattatctggtctaccgatggcgttgatgtttgggccaatcgtcgtggttattattgcttatcgttttaaatggcagctctctgttcctaagcatacactgacttttatccaactgaccttaggcacctctgttggattgatgtttaaccaagtacatttagggagtgcggataatttagtgcttcttttgattatcctcgttatttgtttagccattcaatttgttgtcagtttcttatggtttcatcgtcatattggttggacaaaagaagaggctatgttaggcgctgtacctggcgcgatggcggctattcttgctttaacagatcataccaaaacaccaccacaaaaaattgttatttctcatactattcgtttaatcgtattgattattatggctggatttattgttggctcagataaagcaacccttacggagtttacattacctgaaatgacactgttgtcatcgatgtggttattattaattgtcgcgttagggctagtatctgggcttttattacagaaaattcattttccagcaccgtttatgttgacatcattaggcagtgcaatattggtacaatcttttgtcagtgagccgattgcttttccaatgctattaaatgaactcagtatggtgttaattgggatgaatattggcgcacattttgtggtttttccttttgcttcgttaattaaaaatgctttttcctctgtgcaggtggtcattatcaacgttattttaacggtgatcgttgcattgagcgcagcttatttaacaggggctccctggacaacgctggtattagcttgggcaccgggaagtatggaagcaatgacatttgccgcgatcactatgaatgtcgatgcggcttttgtgatgtcgaatcatatattgcgcatgttgatcattcaaagtattccttctattgccttgttttacagtgaacgaaagcagaaaagaaaacgtgagtaa

SEQ ID NO: 1674 - DNA, 636 bp, Proteus mirabilis
atattaatgtctgatacacatcatcgtcctatattagatattggactatcaagactagagtttctgcgaatatccggtaaaggactggcagggatcaccatagcacccgcactactttctcttttaggttgtaagcaagaagaaatagacagtggcgttattcaactgacaaccacacctaaaggtgtattagtgactaatcgtgcccgttgcactggctgtcatcgttgtgaaacagcatgtacaacatggaatgatggtagcgttggatctttcttctcccgtactaaaatccatcgtcatttctattttggtgataaaggcattggctctggagggggcttatatggcgacttaaactttaccactgatacttgtcgccaatgcaaaacacccgagtgtatgaacgtctgcccagtaaaagctatccgttatcaagaagagtttggctgtattgtcgttgatactcgtcgttgtatcggctgtgccgcttgtacaacagcttgcccgtggatgatggcaaccgtcaatccacaaacgaaaaaatccggtaaatgtaatttatgtggtgaatgcgcttcagcatgcccaacaggggcattgcacattattgaatggaaagaaattaccgtttga

SEQ ID NO: 1675 - DNA, 2373 bp, Proteus mirabilis
aactgtactttgttgaacgaggagaggcgtatgtctaaacacgctcatcaacacgataaccataaacataccgatgcttgctgttcaagctctcaatgctgctctaatcaggcagataatagtagtatgcactcacatactgaaagtggacacactcatagcaaaatcgataagagtgatcccgaatgtgaagaagaacatgatcatgcccatggctgttgtgacagcaacgcccctgtctctaatgtagagcctgaaaaaattgcacagcaacgttttagttggaaagtgcaaggaatggattgcccaagctgcgcgcaaaagatagagacagcagtactgaaagtggtcggcgttaaacaagcgaagatcttgtttgccactgaaaaactggttgtcgatgccgataccgatttacgtactgatgtgattagtgccgttaaaagtgccggttttgaactatttgatatctcatcagcgggatctcagcctcctgcaaaacaaagcctcttaaaagagagctcattcgtcattatcttagcgattttaatggcgataagttggggtgccgagtttattgatccacaagcaggtcgcgctgcctttattgcaacgacattaatcgggttattccctattgtaaaaaaatcactacgactcattcgtagtggtaccccattcgcgattgaaaccttgatgagtgttgcggctattggggcactgtttattaatgccaccgaagaagcggcaatggtaattttgctgtttatgattggcgaaatgcttgagtcttatgctgcgggtcgtgcacgccgcggagtcagcgcattaatggctcttgtacctgaagaagcggtagtaataaaagagggtaaaaaacagacagtccctgtagctcaattgcgccccggcgatattattgaaattgcaccaggtgcgcgcttacccacagatgccgaattaattactgcttttgcaagttttgatgaaagcgcattaacgggtgaatctgtgccggtcgaacgtttacagggtgaaaaagtcgctgctggctgtttatctgttgatcgctcggtgcaaatgaaagtggtctctgaacaggggcaaaatgccatcgaccgtattttacaactgatcgaagaagcggaagagcgtaaagcgcccattgaacgttttgttgaccgtttcagtcgctattacacaccactgattatgctgttttccgcattagtgatcattattccacctttgttattcgctcaaccttgggaaacctggttctaccgcggtttaacactgttattaattggttgtccttgtgctctggttatttcaacaccagccgccattacatcagcactggcagcagcaacaaaacgaggtgccttaattaaaggtggtgcagcacttgaacaactgggcacagtcaataccgttgctctagataaaacaggcacattaacagagggtaaacctcaagtcactgatgtcatagcaaatgcaggctttaatgagaaagagctactgatgttggcttcttctgtagaagttggctctcatcaccctctcgcaaaagccattattaataaagcacaagagcaacaaattgatgttgtggaagccgataatcgcaaggctttagcgggtaaagggattgaaggttatttaaataatcagcatattctggtcagtgccccaacacaattatcagaaaccacaccattatctacacaatggcaacaacaagtcgctcgtcttgaagatgaaggcaaaaccgttgtcgtggtattaaaagaagatcagttcattggtgtgattgcgatgcaagatacattgcgcaacgatgctatcgaatcaatgaaagtgttgaaatcgatgaatatcaatgccgtgatgttaaccggtgataacccaagagcagcggctgcgattgcacaaaaactgagtatggatttccgtgcaggattgctccctgaagataaagtcacctcagtgatggaaatcagtcaaacacataacacaatgatggtgggtgatggtattaatgatgcaccagcaatgaaagcggctaccattggtgttgcgatgggaagtggtacagatgtcgccttagaaactgccgacgcagcattaacccataatcgtttaactggcttacccgaaattattcagctatctcgtgcaacacgtaaaattatccgtgaaaacattaccatagcattgggtttaaaagcgatattcttagttaccagtttattcggtattactggactttgggttgccgtattggctgactcaggagcaacagctttagtgaccgccaatgccgtaagactattaaaagttaaactaaaatctcctcaccaagattaa

SEQ ID NO: 1676 - DNA, 210 bp, Proteus mirabilis
aaaagtgggtctgcgcaaagcacgtcgtcgtccacagttctcaaaacgttaatttgttatcttttagatatcaatttgatgttgaaaaacccgtctttacaggcgggtttttttatttttaaaattgttttgaaaatgtggtgttgtggccgaaaaaagcatggattaaaagcagatcaaaaatacgtttttttagagtttaatccttaa

SEQ ID NO: 1677 - DNA, 747 bp, Proteus mirabilis
gtttttttgttacaagaaacatttaaatatgtgatggcgattggtgtttacacctataaatgggtaactagtaatctactacaaatggagaaagatatgaaatcaattgcggtaattttaagtggttgtggtgtctttgatggcagtgaaattcacgaatcagtgctcacaatgcttgctttaagccaaaataaagctgaggttcattatttttcacctaatgattttcaacctactgtaattaatcatattactggagaagaaaaagcagaaaaaaggaatatgatggaggaggcttcacgtatttctcgtgggaaaatatcgcctttatcagatgctaaggctgaaaactttgatgcggtaattatccccggaggttttggtgcagcaaagaacttatgtaatttcgccacgaaaggtgttcagtgtgaaattaaccaacagctcttaacttttgttcaaaagatgcatcaacagaaaaaaccattaggtttaatgtgtatcgcccccgttatgttaccaaagatgttaaatgccccagtaaaattaaccattggtaatgatgcaaaaacggcagaaatgatcaccgaaatgggagggatacatattaattgtcctgtcgacgaaatagtggttgatgatgagtatcgggttgtgaccacccccgcatatatgctggcagagtcgatagcacaagctcaggtgggaattgagaagctggttaaaaaagtactagaaatggcataa

SEQ ID NO: 1678 - DNA, 183 bp, Proteus mirabilis
atcatcgctccaatcccagcaatcagtagcagattcgttaatgaagatcctattgctgtacctatcgctatctcgggtaaattgtggatggccgcgtcggttgcaacaaaaagctccggcaatgaagtacccattcccacaataacaataccgataacggcaggagggagctttaatgattga

SEQ ID NO: 1679 - DNA, 2325 bp, Proteus mirabilis
gagaaactgttcatgagtagaaagaaaaaaccagtaaagaaaaccaatagaaggcgttcttggttttggttatttgttaaaatcgccattgtggttgcggttttagtcggcatctatggtgtttatttatattcccaaattaaagagcgccttgacggtaatgtatgggaattgcctgctgccgtttatggacgtactgtcaatttagaacctggcatgaactatagccaaaaagagatggtaagcttactggaaggtatgcagtatcgccatgtcaataaaatcacccgtcctggggaatttgtggttaaaaatggcactatagagatgttacgtcgaccgtttgattttccagatggtcgcgaagagcaaattttagcgaaattgacctttgaacaaaactcattggtgagtatcaccaatatgaataaccagcgtcaatttggtttcttccgcctcgatcctaagcttatcactatgatgcaatcggctaatggtgaacagcgtctattcttagcaagagataaatttcctcaactattagtcgatacattaattgctacggaagatcgccgtttttatgagcatgatggcatcagtatttattctattggtcgtgcggtgttagcgaactttaccgcaggtagagcggtacaagggggaagtactttaacgcagcaattagtaaagaacttattcctaaccaatgaaagaacgctaaaaagaaagcttaatgaagcctatatggcgattattatggatgcgagctatagcaaagatcgtattttagagctgtatcttaatgaggtgttcttagggcaaagtggtgatgagcaaattcgtggttttccactggctagcctttactattttggtcgacctgttgatgaactaagtcttgatcaacaagcattattggttggaatggtgaaaggggcttctgcatacaatccatggcgcaatcctaaggctgcattagagcgccgtaatgtggtactaaaattattacagacccagcaaattatcgatcaagagctttatgatgtattaagcgcacgtcctttaggggtaaaacctcgtagcgaagcgctaacgccacaaccggcatttatgcagttagttcgtcaagagctacaaactaaattaggtgatcaggttaaagatttatcggggactaaaatttttacaacgcttgatcctgtttcacaagatgcagcggaaaaagcggtagaaacgggagttgctgatttacgtaaaacacgcaaaatcaacgatctcgaaggcgcgatggtcgttgtagatcgcctcagtggtgaggttagggcgttagtgggcggttcacaaccacaatatgccggttttaatcgtgccatgtccgctcgtcgttcaattggctcattagcaaaaccggcaacttatttaaccgcattaagtgagcctgagcgttttcgtttaaatacctggttggcggatgaacctatttcagtgcctattccgggaggaaaaccatggcaaccacgtaactacgatcgtggttataaagggcgattaatgttggtggatgctcttgctacatcacgtaatgtaccaacggttaatcttggtttagaagtcgggttagaccaagtgatcaaaacgtggatcaaactaggtgccccagcagaaaatttagaaaaagtaccggctatgttgcttggtgcactaaacttaactccaatggaagtggcgcaaactttccaaacaatcggaagtttaggtaatcgcgctaaattatcggcattgcgctccgttatcaaccaagatggtacggtgctttatcaaagctacccgcaagcagaaacaacggtttctccacaagcggcatatatgacactgtttggtatgcaacaggtggttaattcaggtacagcagcacgagcattaaaacctaagtttggtcaatataaccttgcaggtaaaaccggaaccaccaacgacttacgtgatagctggtttgcgggtattgatggtaaagaagtcactattgcatggatgggacgtgataataatggcccaactaacttaacaggatcgacaggggcattgatcctttatcgtcattatttagaaaatcaaacaccattaacattaaatccacctgtaccagaagatatagcacagatgtcgattaatgctgaaggtaactttgtttgttatggtggcggcgtgcgtacattacctgtgtggacagcagatcctgatagcctctgtacaccgttaccacaagagagcggcgacgacgatagtgcggcacctaaatggttacgcgatctgttttctgagtaa

SEQ ID NO: 1680 - DNA, 1860 bp, Proteus mirabilis
ttggggctgttgccgaataccatctgtcattggcggggcaaatccctattaacgctaaaattcgttttaacccaattactttatttcaagaatattgataggagtatgccactcatgataacaactaaccaaaagcaacgagtgaagcatcgagtgttgattgctaacagaggtgaaatcgcagttcgtattattcgtgcttgtcaggattatggtgcaacgtccattgctatttatgcagatgatgatatagatgcattacatgtgcgccttgcagatgaagcctatggtttaaagggtaactcaccgaaagaaagttatttagcgattgataaaatcattgaaattgcccataaaagtaaagccaccatgatccacccaggttatggcttcctttctgagcgagctgatttcgctaaagcggtacagcaagcgggactcctttggattggcccagatccgcagactatcgaagtattaggggataaagttcaagcgcgtaaaattgcacaatccgtaggtgcaccattggtgaatggtaccgctgatccggttagtgatgctaaagaggttctggattttgcgaaacagtatggcttgcctatcgccattaaagcggcatttggtggtggtggacgaggcctaaaaattgcccatcatatggcagaaattgaagagctttaccattcagcggtaagagaagcagtaaccgcatttggtcgtggtgaatgctatgttgagcaatttcttgataagcctcgccatattgaggcacaaattattgctgataaattaggccatgtcgtggtagttggtacacgagattgttcattacagcgccgtaatcaaaaacttattgaagaggcccctgccccttatttaactgatgaacaacggcaacgtattcatcaatcagcaaaaaatatttgcgctaaagcaggttatatcggtgcggggacggtagaattcttattgagtgcgaacgggacaatctctttccttgaagtgaatacacgtctacaagtagagcatccggtgactgaagaaacagccggtattgatttagtgattgaacaattgcgtattgctgagggattaccgttaagtattaatgaaacccctgagcctcgtggccatagttttgagtttaggatcaatgcagaagatccggcaaaaggttttttacccacccccggtttaattagccaatttagtcaaccggctgggccgggcgttcgtgttgatagtggtgtggcggaaaatgaccaagtatcacgtcaatttgattcaatgatggcaaaacttattgtgacaggggctagtcgtgaacaagccattgcgagagcgcgacgagctttagctgaatttaacatcgcaggcgtagccagtgtattaccttttcatcgcgaaatgatggaacatcctgattttattgataacttcagtgttcatactcgttggattgaaagcgattttcaagcaaaaaacagtcattttcctcgtagtataccagcagaaaatgaaccactagtacgtacctttattgaaatagatggtcgtcgtcatcaattagcgctacccgcacaattactttcactctcggccgttatacccacggctattagcgagcacaaagagtgtcaggtgcgggaaaatgcggtcactgcaccgatttcagggatattacatagttggttattatccgatggtgataaagtcaatcaaggggatgttattgccattatggaggcgatgaaaatggaagtacaggtagttgctacctgtcatggtgtattgcagcaaaaggcgaaagccggtgactatttttcagcagacagtctattagctgagattaactag

SEQ ID NO: 1681 - DNA, 1032 bp, Proteus mirabilis
ttaaggacttttaatatggtttttagcaaagtaactgatttaattggtaatactcctatcattcgattaccgctgctgcaatcggatacgcgtctttatatcaaagtggagaaaaataatcccggaggcagtatgaaagatcgcatggcgagaaatatggttgttgcggcactgaaatctggaaagatcaagcctggtagtacaattgtggagtcgtcatcaggaaatactggcattgggttggcaatcgctgctatcgaatttgggcttcgatttatcgcggtggtcgatcaccatgctgcccaagataaaattgctatcatgcgcgctttgggtgctgagatccgctacgttaaaggcgactatggtgaaaatgaagttgctgttgtggaacgccaacgtatggcggctgaaatcgccaatgaaattcccggcgctatctttatgaatcaatcagataatgcagccaatgcgggaggatatgcagatctggtacgtgaacttattagtcagataggcaaaattgatgcgtgggttggatgtgtaggtacgggtggctctatgacagggatagcccatggattaagggttcataatccagaacttgtaaccattgccgtagagccggaaggctccatcgtattcggaaaacccggtaaaccatactatcaatcaggtacaggcaccccacaaggcgatacagtggggttagtgttggattacagttgtattgattatggcgaacaagtctctgatgtatgtgcttttgaaacggctcgttaccttgctcgtcgttttggtttactggtcggtggctctacagggggagtggtatataaagcgctggagttgattaataacagtacaatttgcggaaatgttgcacttgctatggctgatggtggtgaaaaatatctgcagacgatttttaatgacacatggcttaaagagcgaaatctaatatcggagtcagtctgggaacaacttgataattggttttctttgccaacttgtttgggggatcgcagatga

SEQ ID NO: 1682 - DNA, 468 bp, Proteus mirabilis
aatttattcccatatatatctccattaattataaaattaagaaatatagaaaattctcttttggtaaaaggatttagtatgaatagttttaactcaataaaaaaaccaacttatttctatctacctgatggtaaaattgttataaattatatgtatggttggcctaaacaaccacatagtaatatcaccaaaataacatatatattccctgattatgataaaaaaagaaattactcaaataaaaaatattcagtaacagaaaaagatagaatagaatcaataaaacataccgctaaagtatatgaattgacctatcttaaggaaaaaaaagaaaaagaaatcgcttcattaaaatattatagaaataaatattcaataagtaaaatagctgaattagaaaaagatatagaggatatagaaaatagtattaataaaaataagaatagtatacatccttattttttataa

SEQ ID NO: 1683 - DNA, 1362 bp, Proteus mirabilis
aaagtgatgttctccttaggaaaatggttctcaatgaataatacagatcaggtaaaacagctggaagaggcagtttctcttgcactggagatcgccgcaaaacagtgtgacggtgcagaagttgcaattaataaatcaacaggcataagcgttagtacacgctatggtgaagtagaaaatgttgaatttaatagtgatggtgcattagggatcaccgtctatcagcaacaacgtaaagggagtgcatcttctacagatttaagtcctgatgcgattaaacgtgcagtacaagcggctgtagatattgcgcgctacacttctgttgatccttatgcagggcctgctgataaagccctgttagccttcgatgccccttttcttgatctctaccacccaacagacataacagcagataaagcgattgagctagcgtctcgtgcggagcaagctgcattagacagtgatagccgtatcgtcaataccgaagggggaagctttaatagtcatagtggaactcgtgtctttggtaacagccttggtttattaaaaagctactcttcatctcgttattcaatgtcgagttgcgttatcgctcgtgagggtgaggatatggagcgcgattatgcctataccattagtcgccgttttgaggcgttacaatctcctgaatgggtaggacaagagtgtgcacgccgtaccttatctcgtctagctccccgtaaattatccaccatgaaagcgcctgttcttttctcagcggaagtagcaacggggatcttcggtcatttagtggcagccatcagtggtagcatgatctaccgtgagtcatcttgtttgttagatagcttaggaaaacagattttccctcaatggttaaatattcaagagcgtccacatattgtggggggattagcatcaacgccttttgatagtgaaggggtacgcacatcagatgcagatattattaaagatggggtactgcaagagtggctccttactagctattccgcaagaaaattagggttaaaaagcaatggacatgcggggggcattcataactggcgtatcccagggcaaggtctctcctttgatgagttgttaaaagagatgggcacagggcttgtggtcactgagttaatgggacaaggggttagcacggtgacaggggattattcccgtggtgcgagcggtttctgggtcgaaaatggtgaaattcagtatccagtgagtgaagtgactattgccggtaacttgaaagagatgtgggcgaatattgccacaataggtgatgatattgaaacccgcagtaatattcagtgtggatcactactattaccagaaatgagtatcgcaggtcagtag

SEQ ID NO: 1684 - DNA, 657 bp, Proteus mirabilis
aatataatcccaagaggaagcgagagtatgtttaaacgcttattaatggtcgcattattggtgataacaccttttgcgatggcggtcgataaaaccaatccttatgctttgatggaagatgccgcgcaaaaaacctttgataaattaaaaactgagcaaccagaaatccgtaaaaatccagaactgttacgtgagattgttcaacaagagttgttaccttatgtacatatcaaatatgccggagcattagtgttggggccttattatcgtaatgcaacgccggctcagcgtgatgcttactttgccgcttttaaagattatcttgcacaagtatatggtcaagcattagcaatgtatgaagggcaagaatatcgcattgaacctgccaaaccttttgcggataaatcaaacttgactattcgtgtcactattattgataaaaatggtcgaccaccagtacgccttgattttcaatggcgcaagaacagtaaaacgggtgaatggcaagcctatgatatgattgccgaaggcgttagcatgatcaccaccaaacaaaatgagtggtctgatattttaagtgcgaaaggggttgatggtttaactaagcaattagaaattagtgccaaaacaccgattacattagatgagaaaaaatag

SEQ ID NO: 1685 - DNA, 2502 bp, Proteus mirabilis
aaaatcgtgttttggctacaattttctgaatgttcaccacttcgtcaatgtatttttaaggtatcattctctagattcaatctattggagttttcaatgaaattgctcaaagggcttgcccaatattatgtagatttaatgatgaggctagggttaatccgcttctcattactgttagcatccgcattggttgtattagcgatggtcgtacagatggccgtgacattcctacttgccggtgatgtcactagtatcgatctggtacgctctatcttctttggtttgattattaccccttgggctgtctattttctttccgtggtggtagagcaacttgaagaatcacgacgtcgtttatcgcggatggtcgataaattaggcgtaatgcgacagcgagacttagagctgaattcacaattaaaagagaatattgagcaattaaatttagagatccaagagcgtgaaaaagtagaaaaagcccatcttgaactattggaaaaactcaaaagtgaaatgaagcgtcgtgaattgacgcaaattgaactagagcaacaatcttccttgttacgctccttcttagatgcctcgccagatctggtctactatcgcaacgaagataatgaattttctggttgtaaccgtgctacagagctattgaccggtaaaagtgaaaagcaattaattggcttaacacctctggatgtgtatgacgaagatatcgccgtcaaagtgatggaaaccgatgagaaagtctttcgccataatgtgtcactcacttatgagcagtggttggtgtatccggatgggcgtaaagcgtgttttgagttacgcaaagtgcccttttatgaccgaattggtaagcgtcacggcttaatgggctttggacgtgacattacagagcgtaagcgctatcaagacgcgttagaaaatgctagccgtgataagaccacctttatttctacaatcagccatgagctacgtacgccgcttaatgggattgtggggttaagtcgtattttattggataccgaattatcaccagaacagctcaactacttaaaaactatccatgtcagtgccataacgttaggtaatatttttaatgatgtgattgaaatggataaaattgagcgcagaaagatccagcttgataatcaacctatcgactttactgaatttatctctgatttagaaaacctatcgggattattagtccaacctaaagggttaaaattcaccttagaagcgcaagaaacgttaccgcataaaattaccaccgatgggactcgtttgcgtcaaatcttatggaacttaattggtaatgcggtgaaatttacccaagaaggggaaattaaagtacgtatttggcaagaagcgcctgataagttgttctttgaggtgaaagatagtggtattggtatccctcaaggtgaacttgagaaaatctttgccatgtactatcaggtcaacgacagtcaaggtggacgttctgcaacgggaacaggtattggtcttgctgtctcaaaacgcttagcacagcatatgggaggcgatattcatgtggagagtgagttaggacatggttctatctttacgctttccattgtcgctcctgcgattaaagagcaaagtgattttgaagaggatgatgaattattgcttcctgcccttaatatcttactggttgaggatattgagctaaatgttatcgtagcatgttcagtattagaaaaattaggcaacacggtagatgtggcgatgactgggcaagaggctttgcaaatgtttaagccgggtgaatatgacttagtattgttagacattcaattacctgatatgaccggatttgatatttcaagaaaattacgtcaagagtttgatagcagtgaattgccgccattgattgccttaaccgccaatgtcttaaaagacaaaaaagagtatttagacgctggaatgaatgatgtgctcagtaaaccgctttctgtggatgcgttgacagccattattaataaattctggggagatgaagcggtttccgtgacatcgagtgagtcacctcaattgttgagtaaaaatgaagagttactcgatatcgacatgctgaatcaatacatcgaacttgtcggacctcaattaatcacggatggtttagatgtttttgaaaagatgatgccaagttacctgtctgtccttgaatctaatctgacggcacgagatcaaaagggcatcactgaggaaggacataaaatcaaaggcgcggcaggctctataggtttaaaacatttacagcaactggcaaaacagatccaatctccagaattacctgcatggtgggataatgttcaggaatgggtagatgagttagaaagagattggagaaaggatgtagaaagtttaagaaactggtggcagacgctagaaaaaaataaccccaaccgaaggttggggtgcgcgaatactgcgccaacaccagggaaacttttctactcgcttttttga

SEQ ID NO: 1686 - DNA, 189 bp, Proteus mirabilis
ccagaaaccccatatagtttcctatatggggttctgtttttattattaatttttgttgttacttactacccttcctgtcttactactctttatatctatttactacttatactctttagccattatttttttcagttaatgggttggcaactaaacgctcatcttcggctatgcagaccgttgcggtaa

SEQ ID NO: 1687 - DNA, 240 bp, Proteus mirabilis
cgattggtgttcctttctccaatcctcataaaaacacctacggcacaatacaaagtattgcgccgtaggtttatgtttatagctcggtttttattgtgtttagaaaacgagtttcctactcaatttcactatttttgcttctgcttcaacttcggtaaaacagagttaagcaataaatatcccacaacagcagccatggttgagccaactaaaatacccagtttagagtatgtattatag

SEQ ID NO: 1688 - DNA, 1014 bp, Proteus mirabilis
tatacgcgcccttgcagtcacagtttggccctcttttcatctatgcgaatcggacagtatcagttaaaaaattgcctcattgcagctccaatggctggcgttacagaccgaccttttcggtcactttgctatgacatgggtgcggggatgacagtttctgaaatgctttcttctaatcctcaggtttggaagacagacaagtctcggttacggatggtacatagcgatgaattggggatccgctccgtacaaattgcgggaagtgaccctgttgatatggctacagctgcgaaaataaacgtagaaggtggcgctcagattatcgacattaatatgggttgtccggcaaaaaaggtgaataaaaagttagcaggctcggcattgctgcgttatccggatttagtcgcagagatcctttctgcggtggtcaatgcggttgatgtacctgttacactcaagatccgtacaggatggtcacctgatgaacgaaactgtgtagagattgccaaattggctgaagattgtggtattgcggctctcaccattcatggacgtacgcgcgagtgtttgttcaaaggtgaagctgaatacgacagtattcggacagttaagcagagtgtctctattcccattattgcgaatggagacataactgacccgctaaaagccagagcagtgcttgactacactggagccgatgctttaatgatcggtcgcgctgctcagggaagaccctggatctttcgggaaatccagcactatctggacacaggtgaactgttgcctcctctgccgattgcaaaggtgcaacaaataatgcaaaagcatgtgcgtgaattgcacgacttttacggtcaaggcaaaggaactcgcattgcacgcaagcatgtctcttggtatctcaaggaacatgcccctgatgaccagtttcggcgctccttcaacgccatagaggatgccagcgaacagctggaggcgttggaagcatatttcgaaaattttttgcgtaaataa

SEQ ID NO: 1689 - DNA, 345 bp, Proteus mirabilis
acgttaatacccaagatgacaatgtgtattaggcatttagtgccattattaataaaccaactttgttttggtggtttggttacagcattggctcgttatcttcaagctgacacaaattatgagcgttggcgctttcacatcaataatatcatcctccaattaatacttcttgatacaataactcagactattcgcactgtgatgacgatgtttattcacataaaagagaagttatttgcgtataattctatcactatagctgatggccataagcaaggaacaatattgatggagcacattttcttacctcgtcaaccgttgctgtcaggcaagattattcgttaa

SEQ ID NO: 1690 - DNA, 240 bp, Proteus mirabilis
ttacgctcaccccaaacttgtagttgctcaaccgccgctgcacggaaggtatctcctgcagctaacatcaccgatttaccttcagcttggtattggcgggctaacttaccgatagtggtcgttttaccgaccccattaactccgaccattaaaatgacaaaaggttttttaccttcaatatttaatggtttatccactttatttaaaatatcgcccatctcttcacgcaacttaccataa

SEQ ID NO: 1691 - DNA, 636 bp, Proteus mirabilis
atgttatcacccgtcgggcttttggtcattcaccaaatcacactcccggcttactctgcaacaggaatttttattatggcaaagcagccagaagagtggcactacctcaatcctgaatttgacaatacaccgttagaagaggaagaagaggaagagatcatttgggtcagcaaaagtgaaattaaacgtgatgctgaagcgttaaagaaattaggcaccgaacttgttgagttaagtgctcaagagcttgaacgtgttcctcttgatgaaaaactactcgcttcaattaaattggcgcaaaaggtacaacgcgaagcgcgtcgtcgccaaattcaatatatcggtaagttactccgtaatgttgatgaagagccgatccgccaagcactagataaactaaaaaatcgccataatcagcaaattttagtgttacataaactagaagatctgcgtacacgtctgattgacggtggtaatgaagtgattgaggaagtggtagcgctttatcctatggccgatcgccagcaattacgcacacttattcgtaatgctaaaaaagagaaagaagccaataaaccgccaaaatcattccgcttattgtttcaatatctaaaagatctctcagagtcagcttaa

SEQ ID NO: 1692 - DNA, 1341 bp, Proteus mirabilis
tctatggaaccgacactatgggtactaggtactctgattataagtatcttgctcattgtttttactataataaaacttaagtttcatccatttttagcactactacttgccagtttttttgtcggtatggcaatgaaaatgaacccattagaaatggtcagtgcaattgaaaatgggattgggggaacgctgggatttttagccgccattattggtttgggtactattctcggtaaaatgatggaaatatcgggggcggcagagcgcatcggtatcaccttacaaaaatgccgttggttatcaccggatgttattatggtattggtgggactgatttgtggtattaccctgtttgttgaagtaggggtagtgctacttattccattagcattctctattgctaaaaaaacaaacacctcattattaaaactcgccatccctttatgtactgcattaatggccgtgcattgtattgttcctccacaccctgcagcgctttttgtcactaatgagttaggggccgatatgggaacggtgatcgttgccggtcttgctgttggattattagcctcattagtgggcgggcctcttttcttaaaagtattgggtgagcgcttaccttttaaaaccgtaccagaagcattttctgatatggaaattcgtcaagaaaaagatttaccttcacttggggcgacattatttacggttttattacctattgttctgatgctgattaagaccgccgcagagcttaatatggaaaaaggcacttcggtttatattgcattacaatttattggtaacccgattacggcaatgtttattgctgcttttgttgcttactatattttaggtattcgccgtaatatgggcatgagtaccctattgaaaaaaacagaagatagttttagctctattgccaatattttgttaattattggtgctgggggcgcatttaacggcattttaaaagggagtggtttaagcgattcattggcggtgatcctctctaatttggatatgcatcctattttattagcttggctagtagcgattattctgcatgcagcagtaggatcagcaacggttgctatgatgggggcgaccgctatcgttgcaccattaatgccaatgtatccagatattagccctgaaattattacattggcaattggctctggggctattggctgtacgattgtcacagactccctattttggttagtaaaacagtattgtaatgccacattaagcgaaactttccgtttttatagtatcgcgacctttattgcttcatttgtggcattagggggcacttttatgctttcttttgtcatataa

SEQ ID NO: 1693 - DNA, 1182 bp, Proteus mirabilis
tatatcgctttttttatacgcggagaacatgacgtgaaagagataaaaatagttatcgccccagatccttttaaagagagcttaagtgccaaagaggtggcagaggcgattaaacaaggcttttcacgttatttacctgatgctgattattgttgtattcctatggccgacggcggtgaaggtacagtaacgtcattagttgatgctacccatggtcgttttatcacaacgccagtttgtgatccattaggtaaacaggtaacagccacttggggagtgttaggcgataatactactgccgtgattgaaatggcacaggcatcaggtcttcatcttatcccttcatctcaacgcaatcccaatttaacgacgagttatggtaccggcgagttaatttgtgccgcactagatttgggggttaaaaagatcattttaggcttaggaggaagtgccacaaatgacggcggtgcaggtatgatgcaagcgctcggtcttggtcttaaagataagtctggaacatctttgccttttggtggacatgcattaagtcaacttcattctatagatatcaatcaactacatccaaaacttgcctctgttgatatagagaccgcctgtgatgtaactaatccattatgtggcgaattgggggcttcaaaagtctttggcccgcaaaaaggggcgacagaacaagatattgcgcaactggatagcgcactacaccattttggtacttatcttgagaaaatgacacaacgcactcttatcaatattgcaggaagtggtgcagcaggaggattggctctgcctttgctggcatttacgcaagcaacactttcatcaggtattgatttggttgctaacgctgttgaattagaaaaacagttaatcgatgcagatttggtcataactggcgaagggcgaatggacagccaatcagcgcaaggtaaaaccccgataggtgttgctaaattagctaaaaaataccatcgcccagtgattgcgttagttggtggttatttaccggattatgatgtggttcatcagcagggtattgatgcggttttctctatcatgcctggtgttgccactttacaacaagcctttgataatgctaagcaaaacttacaggaaaccgcttataatatagcgaggctttatgctttatcattgcataaataa

SEQ ID NO: 1694 - DNA, 216 bp, Proteus mirabilis
gttaacgctttcaattttctaattaatttcttgtttttcatactgttaaatttaaccgcaatatttcaaaataaccttttagttttaaaatccattaaaaataatttattggttttttattctgaaaaatcatcgttattgaataataaaagttataatattgtatattttttgtacttatatgtaaatttatggttatttgtttttttgttataa

SEQ ID NO: 1695 - DNA, 615 bp, Proteus mirabilis
ttaattgcgtttatcgccaatataacggctatatataacaaacagcaggagaatatgatgaaccgtttcatcattgcagaccctaaaaagtgtattggttgccatacctgtgaagtagcatgtgttgtttcacatcagcaagcttcccaagataatttagcaatcgaccaaattagtgagcaaaatttccaaccacgcattcatgtggtgaaaggcttttcaattagtaccgcagttgtctgccatcaatgtgaagatgctccttgtgccaatgtctgtcctaatggtgccattattcataataaagattattactatgtcgatcaggataaatgcattggttgtaaaacctgtgtcttggcttgtccttatggcactatggaagtggtttctcgtccagttatgcgtaaattaaccgctctcaatacgattgaagcatttaaagctgaagccaataaatgtgatttatgtcatcaccgtgctgaaggtcctgcttgtgttgaggtctgcccaacacaggcattagtctgtattgatagagatgcacttgaagatatggttaaagagcgtcgtcgtaaagcggcttttgaaacaggcgctgatttattgttctaa

SEQ ID NO: 1696 - DNA, 1113 bp, Proteus mirabilis
actagtgcgcctgttttttatgaaagtagtcgtttaattatgcgtgtatccgattttagatttgacctgcctgagtccttaattgctcactatcctcacccccaacgtagtgggtgccgattattatccctagaggggaaaacgggcaatttatctcacggtgtctttacggatgtattagataaactcaatgccggtgatttacttgtatttaataatactagagtgatccccgcgcgtatttatggtcgtaaagcctccggtggcaagatagaagtattagtggagcgtatgctagatgaacatcgtgtgttagcccatgttcgtgcatcaaaatcacccaaagagggcgcatcactgattttaggggaagacgaaagtgtacaagcaaccatgattgcacgccatgatacactatttgaaatccgttttgatgatgaaagagatgtgctgactattttaaatagtatcggtcatatgcctcttcctccttatattgatcgtccagatgaaagatccgataaagagctttatcaaacggtctataatgagcgtcccggtgcagtagctgcacccacagccggattgcattttgatgagccgttattagaagcgttacgtaacaaaggcgttgagatggcctttgtcactttgcatgttggtgctggcactttccagcctgttcgtgtggataatatcgaagaacacactatgcattccgagtatgcagaagtccctcaagaggtggtagatgccgtgcttgcttgtaaggcacgaggtaatcgagtgattgccgtgggtacaacgtctgttcgctctttagagagtgcggctaaagcagccaaagatgcattaattgctcctttttttgatgatacgcaaatttttatttatccaggttaccaatatcaagttattgatgctttgataactaacttccatttgccagaatcaaccttaattatgctggtttctgcatttgctggttataaaaataccatgaatgcttataacgtagcggttgaacagaagtatcgttttttcagttatggtgatgcgatgtttattacgcgtaatcctttagctatcaatgaaaaagtgggtgaagagtag

SEQ ID NO: 1697 - DNA, 1914 bp, Proteus mirabilis
ttgtttaagccttatttctttgggagaaaaatgatggagacggtagagaaaaagagtattgcagggcaacaaactgctatacaaacagatttttcaacacgtaatgcccttgctcgtatcattcgctgtctttttgcagaaaaattattggatgataataaactgcaagttttcaatgatgaaaataacgttaagtacccgctttctgatgggatacatatccttcaatttaatcaaacgaccgtttttcctgcaaataccgttattaatcgcggtgatattatccttaaatcaatggatggccgccaccgaatggtgcaatcccatgaagaacttatggggatactgaaaaatgaacttagtttcacccctacaacggagggaatgacaaaattcaataaagatgtagcaaacagtatccataatgatcgattagctagagcacatcggtcaaagtggcgggatacgatttctaatgagatggcacaagagggaacatcttgttttattgaatggataactcgtcattacagtcggcgtgatggtgcaacttttctcgatcagtggggcgctcttgaaggtcattcttattacccaacttggaagtctagacccggtttaagcgatgatgatattgtcgcactatcagctgaatttggtgcacgagttaatctgcgtatcgcagccatacaaaccgatatggtttattgtgagaagatgcctcatattcaggatatccatcaatggttttcatcggcttttccaaccgtttggaataaatggtgtgagtggcttacaagtcaatatcaaaacccacaaaaatggttacctattcctctgcatccttggcatcttgaacactggatcattgcgcatttctcaaaagaaatagatgaaggcattcttctaccattaggccctcaacttgagaccgcggcatccatgtcgtttagaaccatgcttcctaccgcatctagatcaccctttatcaaattacctgttgctatctggatgactagcgaaatgcgcagccttcaagccaaatctattcatatggggccacgtattagtacgattattgaggatattttgcgggtggataaggattttgatggcaagctggactttttccgagaagaagtggcgtggcattttcgtcataacgtgcgtatggatgacgctgaaggtaagtttctctcggttgtatttcgtgatacgcaagcatgggaaagaaacgataatttaatcgctatcacagttgcatcattatttactgagctcccacataaaccccaaccccttattagcgagctgatcgcattatcaggcgacttacctgaaacatggtttcgtaattataccaaagtcatactgaaacccgttttagcgatgtatttaatttatggcattgcccttgaggcacaccaacaaaatacgcaagttttatttgatgattccggtcgtgcggtcaccatgcttattcgtgattttggtgatggacgcagttgggctccagcactgcgtcagcaaggatatgagcttcaaccttatatctggcccggcattttacccacggtgtttgaagatgatattgaacctgtcagaaccttcgttgtagatgcttgtcttgtcagccatttacatgaaattgcgctttgtttaactcaactttatgacatccctgatacccgcatatggactgtgatcggcgaagagcttgaacttgtgtttaaagcacttcaacccagagtagaggcggatttttggcacaaagagcgtgaacattttctccaccacccttggtatacccgctcattaatgagcatgcatttacagcaatatactgattaccgtcttcagcatggacttaacaacccgttagctggtgaacaagtagataactctaagatctga

SEQ ID NO: 1698 - DNA, 1140 bp, Proteus mirabilis
tgcaaagagcctttgttaaaggctttgttgatacggagaaataatatgactaccgtaacactgactaatttagaaaaacgttatcctaatggttatcaagcaatttccacgctcaatctctctattgagcaaggcgaaatggtggttttagtagggcctagtggttgtggaaaatcaacactactgcgcatgatagcgggattagaaaccatcacagatggcgatttactgattgataatcgacgcgtaaatgaacatgagcctagtgagcgagatattgcgatggtttttcaaaattatgccctctacccacatatgtctgtctatgacaatatggcgtatggtttgcgtaatcgaaaaatccccaaagctgaaatcatagcccgagtcgatcgcgctgctcatatgctagaaataagccatttactggatagaaaacctaaagagctttctggtggtcaacgccaacgcgttgccatgggcagagcgattgtccgtgatcccaaagtcttcttatttgatgaaccgctctctaaccttgatgccaaactacgcgtacaaatgcgtcttgaaatcaaaaagcttcagcaaaaattagccactacttctgtttatgtcactcatgatcaagtggaagccatgaccttggcggataaattagtagtactaaaccaaggtcatatagaacaagttggctcccccttagagatttatgaaagcccagcttctgtatttgtggcaacatttatgggatcaccggcgatgaatattttaaccactcatatcaatcgcggtattattgaaattgcggatggtcatcttgctatttctgcccactcattacctaatggtgagatccaactaggattacgtcctgaacatttgctcataaatcaacaaaatccactgtttcatgctaatgtcgattttattgaagctttaggggctgatgttttaatttacgccaccacttgtgaccaacaatctattgttattcgagccgcaaacgatcatggtgttaatgtgggtaatagaataggtgttgctatttatccagaaaatctacatttttttgatcgacaaacccaaaaacggattgaacgtcctaccatgttgttaagtgaacgattagtctcttaa

SEQ ID NO: 1699 - DNA, 1362 bp, Proteus mirabilis
cgaggcaggcccatgctagaaaaaatcctcattgccaaccgtggtgaaattgcactgcgtatcctaagagcttgtaaggaacttgggatcaaagcagtcgccgttcactccacggcagaccgtgatttaaaacacgttctgctggcagacgagactatctgtattggtcccgctgcttcagcaaaaagttacttaaatattccggcaattattgccgcggcagagataagtggcgcgcaagccattcacccaggatatggcttcctgtctgaaaatgccgattttgccgaacaagttgaacgctcaggctttatttttattggccctaaagcggaaaccattcgcctaatgggtgataaagtttccgctattgaagcgatgaaaaaagccggtgttccttgtgtaccaggctcagatggcccattaggtaacgatacagccaaaaatatcgaaatcgccaaacgcattggttaccctgttatcatcaaagcatcaggtggtggcggtggtcgcggtatgcgtgttgttcgctcagaaaaagacttagcgcaagcaatctccatgacccgtgcggaagccaaagcggcatttagcaacgatatggtctatatggaaaagtaccttgaaaatccacgccacgtcgaaattcaggtgatggccgatggacaaggtaatgctatctatttagctgaacgtgactgctcaatgcaacgtcgccaccaaaaagtggttgaagaagcaccagcaccgggtattacccctgagatccgtaaaaatatcggtgaacgctgtgcaaatgcctgtattgaaattggctaccgcggtgcgggtacgtttgaattcctctatgaaaatggcgaattctactttatcgaaatgaatacccgtattcaggttgagcatcctgttactgagatgatcaccggtgttgaccttatcaaagagcaactgcgtattgcatcaggcttaccattatcagtcacgcaagatcaaattcacgttcatggacatgctattgagtgccgtatcaacgcagaagatccaaaaaccttcttgccaagcccgggaaccatcactcgtttccactcaccaggcggatttggtgtacgttgggaatcacatatttacgcaggttacaccgttccaccacactatgattcaatgattggtaaattgatcacttacggtgaaacacgtgaaattgcgatttctcgtatgaaaaatgcgttggcagaacttattattgacggcattaaaaccaatattgagctacaccaattcattatgaatgatgagcaattccaaaaaggtggtactaatattcactacctagaaaaacgcctaggtttaactgaaaattaa

SEQ ID NO: 1700 - DNA, 1335 bp, Proteus mirabilis
cggagcaagttgcacaattacgtaacgtgctcaatattgatgtctattattactataaagaagcatatggtgaaaaataaaactctgtttaaatcactcctcacaatccccgttaaccaccataaacgtacaacgttaaaatggttaggcggtagtttactgcttgccagtatgggcgcaaatgccatcgaaaaaagcaagtgttcaccaacacttcgttatcaacgtgctattaactacttaggaaaacatcaagctggggttatcacgccagaacaaaagcatgcttcatttattgcacttgatttaacagtaacaacccctgaggaagtagaaaaaattttccgaacgttaacacagcggattgcttttttaacacaatctcgtgaacttaaagaaagtcataatcctcaccttccccccgcaggatccggtattttaggtagccaattatatcctgatgaattaaccatcacagtggcgttaggggatagtttttttgataatcggtttggttttcaagctcataaacccaaacgccttgaagcaatgaaacccttccccaacgatcgcttagatcctaaatggtgtggcggtgatctgttacttcagctttgtgccaatagtcaagaaagtatcatttatgcattaagagatattttaaaatatctttctgggcaagtgcatgcacgatggaaaatagatggttttctacctgctcgtgatattgataatcaacaaacgccaattaatttatttggttttaaagatggcacaggtaatgcccctgccactgacactcatttaatggatgatttagtgtggatcaccgataaacaaaatgaaccgcagtggtgcttaggaggtagctatcaagcggtgagacttattcgttttgccttggaattttgggatagaacacctcttgaagatcaggagaataactttggtcgtcatcgtgcaacaggcgcgccgataggtatgaagcaagaaatggactcacctgaatttgagcaagatcctcatggcgacaggatactctttgattcccatatgagacgagctgaacccagaacccccgaacgttatagcgccaaactgcgtcgtcgcagttatagctactcattagggctaacgccgtcaggacaattagatatggggcttgtctttgtctcatttcagaataaccttaaaaaaggctttattgatacgcaaaagcgtttaaatggtgaaccgttagagcgctatataaaaccttttggtgggggttattacttcgtattacccggcgtcacacaagcaagcgatatattagctaaaggactatttacttaa

SEQ ID NO: 1701 - DNA, 951 bp, Proteus mirabilis
cagaaaaagttagctaatatcaatttaactgaaacatcaggagtgaacatgcagttctcaagtgaacatatcgcgatatttttagccgttatggataaaggctctttttctgcggctgcgcgttcattaaaacgtgttccttctgcggtcagtatggcgattgctaatatggaggctgaattaggttatgcgctgtttgagcgttcatcgagagagccacggccaacagaaaaagctaaagcacttgaacctcacgccagaatgattgctgagcaattaaagctattacaggttcatgcacaagagctttcaatggatctggaaagtatattaaatattggcgtcgcggcagatattaatcccgactatttattaccggcattatctgagttaacacagcgttaccccttactaaaagtgaatgtagtaaccgcggcacaagatgacattattgagatgctgcacgcacgtaaaatccaattatgtctcgtgtatggtgggttatacgtcaatggcgatgaacaatttcaatatttgggctctgagtcattagttgccacaatttcggcaagtcatattgcacttgctcaccctgcaggggtatttattgaagatttagtgaatgtaagacagataatgatagccagccatactcaagagataagagatgtacgctctttagtggcgactaattactggcaaacagataactttcaaatggcattaggtatggttgaagcggggatgggctgggggaatttaccttattcgctgatttatacgcagttacaaaagggaaaattaaaacaactgcaatttaaaaatactaaaaatgaattgcgcttaccagtacatgcaatgtggttaaaaggcgagtcactacaaaaaggggcaaaggaattggtggagttaatgaatattcaccaacccattgtgcccaattttgattaa

SEQ ID NO: 1702 - DNA, 321 bp, Proteus mirabilis
ttaaaggagttactcatgtcacaccaacgttcaaatgaagatctgcgtagtgaattaaaatctctggctgatactctagaagaagttctgaactcctcggcagataaatcaaaagaggaattacaaagtttacgagaaaaagctgaatatgcgctacgtggctctcgtgcaaaactcagtgatgcaggtagagaaatcgtcgataacactaaagaaatggcgggtaaagcggacaactatgtgcgtgaaaacccatggacaggtgttggtattggcgcggcagtaggtgtcgtactcggtgttctactttcgaaacgttaa

SEQ ID NO: 1703 - DNA, 555 bp, Proteus mirabilis
caagttatcaccaaattatcagtaagagattattcttatagcaggggtagattattactattttttgtaggggcatatgttaaaggagtatttatgttagataagattgaccgaaaactattaacgctattacaggaagattcaagcctctcactgaatactttggcagaggcggttaacctaacctcaacaccttgctggaaacgattgaaaagactcgaggatgaagggtatattcgtaaacgtgttgcattactcgacagcgaaaaaattgggcttggcttaacagttattgttatgataagaacacagcaacataatagcgagtggtatgaacaatttgtatcattcgttaagcaaatgccagaagtactgacattctatcgaatggcgggtgagtgtgattatctaatgcatgttgaagttgtagacatgaaaagttatgaccaattttacaaacgcatggttaacggcgttcctgggcttattgacgtaacttctaactttgcaatggaaaaaattaaatacacaacggcaatgccgatacctgaataa

SEQ ID NO: 1704 - DNA, 465 bp, Proteus mirabilis
aaaattaccacaagagcctatcgttcgtggtttatggggtctaaccatcgtcgtgactgtcgttattctggcagtggcgctaattgtttaacccaggaggaaataatgaatcagaatcaacttcctaagcgctctgatgaacctattttctggggattatttggtgcaggtggtatgtggagtgcgattgtctctccagcaattattatcctgctcggtattctaatcccgatgggtattgcgccagaagcatttacttacgatcgtatcatggcatttagccaaggttttattggtcgtattttcttactgctaatgattattctgccagtttggtgtgcattacaccgtattcaccatacgttgcacgattttaaagtgcatgtacctgctagtaattgggtattttatggtgctgcagcaattattagtgttatcgcaattattggtgtttttacactataa

SEQ ID NO: 1705 - DNA, 1848 bp, Proteus mirabilis
ttgttaaccacattaatactagcgtatacacacctactttcacttatctctattgaaactaacccactgttattaatggatataatcatgattactataaaaaaaatgcacctgctgttacttaccacacttttttcacctgcactctatgccgcctatgagccagcggttgaagcacaacaaggtatggtggtctcttcacaacatttagcctcacaagtagggaaagatattttacaaaaaggagggaatgccattgatgcagctgttgctgttggctatgcacaagctgtggtaaatgcttgttgtggaaatattggcggtggtggctttatgaccatacaccttgctgatggcaccaatacctttattaattttcgagaaacggcgcctacggcagcgtctaaaaatatgtatttagataaagacggtaacttgattaaagaggcaagcctatacggctatcttgcctcaggggtgccgggtacagtgaaagggcttgatgcagcattagaaaaatatggcactctttcacgccaagaagtgatggctcccgctattaaactagccagagaaggctatattttaacccgtgctgatactgacgtattagacaccaccacagagcgatttaaacaagatcctgaatcagcaaaaattttcttaaagcctgatggaacaccatggcagcctggcgatcgcctcattcaaacagacttagccaatacacttgaacttatcgccaaccaaggtgctgatgctttctatcaaggggaaatccctaaaaaagtagaacaagcttcaaaacagcataatgggttattaaccaaagaagattttgcgaacttcactattaccgaaacacctcccattacctgtacttatcgaggttatgaatttatctctgctcctcctcccagttcagggggcgtcactatttgccaaacactgaatattttagaaggctacgatctgaaatcgatgggttttaactctgccgaatatgttcacacgctcacagaagctatgcgtcatgcttatatggatagaaacacctttcttggcgatccgcaatttataaacaatccaacagaaaagttattaagtaaagcctacgccgcagagcttcgccaacaaattacaccgaataaagccaccccatcagaaaaagtacaacccggtattgcacctcatgaaagccctgaaaccacacattattcggtgattgataaagatggtaatgccgtttcaaccacttacaccatcaatggtcgttttggtgctgtcgttatcgccccggggactggctttttcctcaataatgagatggatgattttacaactaaagttggcgagaaaaatctttatggcttagtacaaggtgaacgaaatagtattgccccattaaaacgtccactatcctcaatgagtccaaccattgtgactaaagatggcaaaccctttcttgtattaggctcaccgggaggctctcgtattatctcaatcaccttacaaacggcacttaatattattgagtttggtatgtccccccaagaagccgtcaatagccctcgaattcatcatcaatggctacctgatgaggtttattatgaacaacgaggattatcaaaagataccttagaaaaactttctgccatgggatataaaatggtcgaacaaacgccatggggcgcggctgaattgattatggtcggccttccaggagaacaaggagtgatccctgcttcgtcaggtaatgattctgctgtttcaggggcgatacgcgaaggttatctttatggttcaaatgatgttcgacgtccagcaggtaaagccgtgggctactaa

SEQ ID NO: 1706 - DNA, 1998 bp, Proteus mirabilis
aaaatgaccactcgtaaaacccttgcaaatgcgatccgttttttaagcatggatgcagtgcaaaaagccaaatcagggcaccctggtgcacctatgggcatggctgatattgcagaagtattatggcgtgattttttaaatcataatccaactaatcctcactgggcagatcgtgaccgttttgttttatctaacggccatgcttcaatgctgatttatagcttattacatctgtctggttatcaagtttctttagatgatctaaaaaatttccgtcagctgcattctaaaacaccgggtcacccagaatatggttataccccaggtgttgaaactaccacgggtcctttaggtcaagggattgctaacgcagtaggttttgcgatcgcagaacgcacattagcggctcaatttaaccgtcctggtcacgatatcgtagatcactacacctacgcctttatgggtgatggttgtatgatggaaggtatctctcacgaagtatgctctttagcaggtactttacagttaggtaaactgattgcattttacgatgacaatggcatttctattgatggtaaagtacatggttggtttactgataatactgctgaacgtttcgaagcgtatggctggcatgttattagtggtattgatggtcatgatgcagcgagtattaaagctgcgattgaaaccgcacaacaaattactgataagccttcactgttaatttgcaaaaccaccattggttttggttctcctcataaagcaggcactgccgattctcacggttcaccattaggtgatgcagaaattgcagaaactcgtaaagctttgggctgggagtatggtccttttgaaattccacaagagatctacaaagagtgggatgctaaagaagctggtaaagcaaaagaagctgcgtgggacgctaaatttgctgagtatgcagcacaattccctgaattagcagctgaatttaaacgtcgtatgtctggcgaattacctgcaaattgggaaaaagagtcaacagcctttattgaacagttgcaacataacccagcgagtattgctagccgtaaagcatcacaaaatacattagaagcgtttggtaaagttttacctgagtttatgggtggctctgctgaccttgcaccaagtaacttaactatgtggtctggctctaaagcattaaatgaagataaagccggtaactacatccattatggtgttcgcgaattcggtatgtctgccattatgaatggtattgcattacacggtggttttgttccttacggcgctaccttcctgatgtttatggaatatgcacgtaatgcggtacgtatggctgcactgatgaaaatccgcagtatctttgtttatacccatgactctatcggtttaggtgaagatggtcctactcaccaacctgttgagcaaatggcaagtctgcgtgtaacaccaaatatgagtacatggcgcccatgtgaccaagttgaatcagcagtagcatggaaatacgctgttgagcgtaaagatggtccaactgcgctcatcttctctcgtcaaaaccttgctcaacagccacgtactccagagcaactggctaatatcgagaagggtggttatatcctgaaagattgtgacggtacacctgaacttatctttattgctacgggttctgaagttgaattagctgttaatgcttacgatcaattaacagcagaaggccgtaaagtccgtgtggtttcaatgccagcaacagatgcatttgataaacaagatgctgattatcgtgaaacagtattacctgcagcggttaaagctcgtgttgctattgaagcgggtatcgcggattactggtttaaatatgttggtcttgatggtgtgattgtcggtatgcatagcttcggtgaatctgctcctgcaaacgaactgtttgctgagtttggttttactgttgaaaatgtggttacacaggcaaaaactctacttaaataa

SEQ ID NO: 1707 - DNA, 498 bp, Proteus mirabilis
aggggcaacacgatgaataaattgcaatctatttgtctgattatattactaaattctacagcagtaatggcggccgactcgcctaatttaaaattattcggaacattattagtgccacctccttgtgttatcagcaatgacgaacgaattgaggttttttttggtaagaacgtcggtattaataaagttgatggtattaactataccgaatcggtgaattataccttggtatgcgacgctaatttaaaaggctgggatttgggattatcaattatcggacctaaaacccagtttgatgaggcggcattgcaaaccaatattccagatttaggtattcatttaactcaagatggtaagccttttaagctaaatgagcgtattgcgatttcaccagattcgcctccggttattcaagctgttccagtaaaaagaccgggaagtacattgcctgaaggggcatttgaagtctcagccaccttattagcagaataccaatag

SEQ ID NO: 1708 - DNA, 1653 bp, Proteus mirabilis
actttcaggttcagcatgaaaacgaattatatttttgtgaccggcggggtcgtatcctctctgggtaaaggcattgccgcagcctctttagcggctatactagaagcccgtggactcaatgtcaccatgatgaagttagatccgtatattaacgtcgatcctggtacgatgagcccaattcaacacggagaagtcttcgtcactgacgatggagctgaaactgatcttgacttaggccattacgagcgctttattcgcacgaaaatgacgcgtcgtaataactttacgaccggccgtgtatactcagaagtgctacgcaaagagcgtcgtggtgactatcttggtgctactatccaagttattcctcatatcactaatgaaatcaaagaacgcatcatccgtggcggtgaaggtcatgatgtcgtgttagttgaagttggtggtactgtcggtgatatcgaatcacttcctttcttagaagctatccgtcaaatggcggcggaagtagggcgtgagcatactttctatctgcacttaacattagtgccttatttagcggcttcgggtgaagtaaaaaccaaaccaacgcaacactctgtaaaagagttactctcgattggtattcaaccagatgcattaatttgtcgctcagatcgcgttattccagctaatgaacgcgccaaaattgcactgttttgtaatgttcccgagaaagcggttatctcattaaaagatgtcgattccatttataaaatccctgcactcttgaaatcgcaaggattagatgattatatctgtaaacgattcagcttagattgcccagtggcaaatctgtctgaatgggaacaggttatctacgaagaagccaaccctgaaggcgaagttaccattggtatggttggtaaatatgttgaattaccagatgcctataaatcagtgattgaagcattaaaacatggtggtttcaaaagccgtgttgcggtaaatatcaaattaattgattctcaagatgtggaaactcgtggtgtagaaatcctaaaagggttagacgcaatcttagttccaggtggttttggtgaacgtggtgttgagggcaaaattatggcagctcgatatgcacgtgaaaataaaatcccttatttaggcatctgtttaggtatgcaggtggctatgattgaatttgcacgcaatgttgccaatatggaagatgctaactccacagagtttgcacctgattgtaaatacccagttattgcgcttattactgaatggcgtgatgagaatggcaatcttgaagtgcgtacagaaaatagtgacttaggtggaacaatgcgccttggtgcacaaccttgtcatttaagtggcgatagtttagtgcgtactctgtatggtaaaaataccattacagagcgtcatcgtcatcgttatgaagtgaataatctactgttaaaacgtatcgaagatgcgggtttacgtattgcaggtcgttcagttgataacaagctggtggaaattattgaaaatccaaatcatccttggtttgttgcttgtcaattccaccctgagtttacctcaacgccacgtgacggccatccgttatttgctggctttgtgaaagcagcctttgactaccaaaaaggcttgctaaaatag

SEQ ID NO: 1709 - DNA, 843 bp, Proteus mirabilis
agattgaggttttacatgtttatatttaaacgatttccggcgatatttatcttaatagcggggcttttctcagcacctgcgatggcctctattttttcttatataacagaatcaacagggacaccttctaacgccacttacacttatgttattgagcgttgggatccagaaacctcaggaatattaaatccttgttatggttggcctgtgtgttatgtcacagtgaaccataaacatacagtaaatggtactgggggaaatcctgcatttcagattgctcgaattgaaaaactacgtactttagctgaagttcgtgatgtagtacttaaaaatagatcattccctattgaagggcaaaccacccacagagggccttcattaaactctaatcaagagtgtgtgggattattttatcaaccgaattcaagtggtatatcacctcgaggaaaactcttaccatgttcactatgcggtatcgcaccaccaccagtgggtgcttgtaaaatatctgaaggtgcggtgaaccttaactatggtgatattgatgaagctagtttaagtggtgctaagcgctctgaaacaatcaatgtaacctgtaatttagcaatgaaagtgttggttatcgcatctggctctgatagtgggcgggtacctctgcgtgcagataagagtttatatgctgatttatatctaaacaattatcctggtgaaaaaggcgttacggtaaatgttccagcaggcggttcagcgccagtctctgtgagttcaacgctacgcacgaatggacgggtagctcctggtcgtttctccggttccggttcaattattttaaccatgccttaa

SEQ ID NO: 1710 - DNA, 207 bp, Proteus mirabilis
agaagcctaacattgtcgctatttttccaagctatcccacaggaaagctctcaaattgttattcagcacgtatatatacgcgctaactccatttttttacacgtcgagtgggggccgttgttgcgggtgaatctggccacaaatgtttgggatatcgccccttcatctctttttgtacttgtgtatagcttccggcccaaaaagtag

SEQ ID NO: 1711 - DNA, 939 bp, Proteus mirabilis
ttaacgctaacttattataagaatataaataatccatggagcatattacctatgaatgacctgcttacgaataaaattaataaaataaaagaagaatataaaaataataaatatgtttttattccacaaaaaatagttattgatttaataaaacaattaggtgcaacagagaaagatatagatacactcatagaatatggtgattatctcgcgcaagatcccacattgtcgtttcgtcactctcgcaccggacgctaccttttcgataatgaggctaaaaccatttcacgactagagtatcaaccttttgtcctcactgaagaagatggctttattcgtgaagatagcggtgcacaaagacactttcgagcaattgacgatcgctggcaaagcaataccgcttaccaagcattattaaaattgaaaatgctcctgattgaaggaaatcgatttacaccacgccgcttaaccgatcaacaatcccctaaatcaatttcaacggtatttcatttaagactcattgctgaacctaattcgttaagtgagctttctattgaaggggtgcataaagatggtgttgatcacaccatgattgtcatgatgaataaaaataatgtaaaaaataattccggcgcattacgtgttcattctcatcaagaagcaataggtacaccttggcaagatattaatcctaataatgttctctatgagcataataatgcccaatatctggatatattgttaattgcggataatgagttaaatcatagtggtacacctatttttacgcatgacaatcaccactttgcttatcaggattttattgtcttattatcccgttatccaaccgtagatactcatccatcacatcagtttgattcaacccaattacatcccgatttaccactaacgttacatttaaataagcaagtagcctaa

SEQ ID NO: 1712 - DNA, 270 bp, Proteus mirabilis
atcaaaataactattgagggaattatgctaattactatttcaccagctaaaacactggatttcgaatcgcctttagcaacaacgcagttcacccagcctgaattgctaaaatattcccaacaacttattacagaatgtcgaaaactgtcgtccagtgatatcgcaagcttaatgaaaatcagtgataaattggcaggactaaatggcggctcgcttttggtgaatggcaacctgactttacacccgataatgcgcgacaagccattttag

SEQ ID NO: 1713 - DNA, 651 bp, Proteus mirabilis
cttaaagcaacaaaaaagagttgttcactggctttctgttgcattttaacggcatattgcatagattctatcgtttcgttttttattatggcactgattatgactgctaacgcgcaacaactgcaatttattaaagacagcattgaaaccattcctgattaccctaaagaagggatcttattccgtgatattacgacattactggataatcccgcggcatatcaggcaacgattgatttattagttgagcactatcaaggtcagggtatcactaaagttgtaggtaccgaagcccgcgggttcttatttggtgccccagttgctttacgtttaggtgtgggttttgtgccagtgcgtaaaaaaggtaaattgcctcgtgagacgcttagtgaaacttatgatctagagtacggtacagatacattagagatccataaagacagcattacggataaagataaagtattaatggttgatgacttattagcaactggtggtactatcgaagcgactgctcgtcttattcgtcgtttaggtggaactgtaacagaagctgcatttattatctgtttacctgatttaggcggtattgagcgtctagaaaaagaagggatccatagcttcacattagttaatttcccagggcattaa

SEQ ID NO: 1714 - DNA, 1578 bp, Proteus mirabilis
atcatgcaaacaaaaaaacagggaggaagtcgttttctacgcacagtggaatggcttggaaatgcactcccccatcccgttattttatttattattttaattgctattttacttgtatcttcagcggttggtgaatacttcggcgttacagtacaagatccacgaccagaaggcgctaaagggcgcgctgaagatggttatattcatattatcagtttacttgatgctgatggtatacgacgtattcttgctaatattgttaccaattttacagggtttgctcctttaggaaccgtactggtggctttactcggtgtcggaatagctgaacgagcgggattattatcagccgttatgcgtttagtggttatgaaagctccacgcaaaatgaccacattagccattgtatttgcaggtattatgtcaaatactgcagctgaattaggatatgttgtcttgatcccgctatcggcaattattttccattcgctaggtcgtcatccattagcggggattgctgctgcgtttgcgggagtatctggcggatattcagctaacttactgttagggactatcgatccattattatcaggtattacacaacaagcagcacgcattattgacccaagctatattgttggtgcggaagcaaactggtactttatgtttgtcagcacctttttaattacatttttaggctacatcatcacagaaaaaatcgttgagcctcagttagggccttataatggtaatgaattagatgatgaagaaactgatctaaaaaatgctgcgcaagttacccctcttgagaaaaaagcactatgggcagcaacaggaacatttattgtgatggccatcattctggcattcactgtcgtacctgaaaatggcatattaagaaaccaagaaacaggtttaattggtaactcaccattcttaaaatccattgttgtattcattttcttattttttgctatccccggtattgtttatggttggatagctaagactatgcgttcagataaagatattgtcgatgccatggcaaactctatgagcacattaggtctttatttagtaattattttctttgctgctcaatttgtggctttttttggctggacaaatatagggcaagtgatcgctgttaaaggtgcggctttacttaatagtattgatatgccaagtgggttgctatttttgggctttattttaatttgcgcctttatcaatttaatgattggttcagcttccgcgcaatgggcagtaacggcgcctatttttgttcctatgttaatgctggcaggttatgcaccagaaactattcaagcagcttatcgtataggtgattcggtgacgaatattattacgccaatgatgagttactttggtttaatcttagcggttgccacaaaatataagaaagatacgggtattggaactatgatctcgatgatgttgccatattctattatcttcttaattggttggtcactgttattctacctttgggtatttgttttccacttacctgtagggcctggatcgccaatttattattcaccgcatgcgggataa

SEQ ID NO: 1715 - DNA, 636 bp, Proteus mirabilis
aacattaaaacacgccaaaattcacgcttaaacgatatatatcagaaaaatatggctaagaaaccacaaaaaacgccgatgggacaaatcagaataatcggaggtaaatggcgtggtcggaaacttcctgtgcttgatagccaaggattacgtcccaccaccgatagagtcaaagaaacactgtttaattggcttatgcccgttattcaggacgctcgttgcttagattgctttgccggcagtggtgggctaggtattgaagcactctctcgctatgcaaaagaaacgacattcattgagttcgaccgtaaagtcgcgcaacaaattactgctaatttagcgctgcttggcgctgataatgggcatgttattcaagatagtgcgttaaattatctagctaaacaaggtacggcatatgatgtggtgtttttagatcctccttttcatcaaggtatgttggcaaacaccctgcaattattagaaaataaccaatggttagccgaaggttgttatatttatattgaagaagaagtaaacgcacaggtttattctttaccagaaaattggcgattacatagagaaaaaatcgcaggccaagtcgcctatcgtctctatattcgcaatttatctgcttaa

SEQ ID NO: 1716 - DNA, 504 bp, Proteus mirabilis
tggcgggggttacgcttaatagaaggtattagtatgagtatgcagatcctcaataatagtgcggtattgctgaatttcaccttaaaattggcagacggctctgttgctgaatctacacaagcacatggaaaaccggcgttatttcgtcttggtgatgaaagcttatcgcctgctttagaagcagagttggtaggacttaaagaaggggaaaagaaaaccttcacgcttgcgggggagcatatttttggtaaatataatcctgatcttattcaatactttatgccttctgattttgcgcaatccggtattcctgaaacaggtaccattatgctgtttacggcaatgaatggtaatgaaatgccaggaattgtgcaggaagtgacggaagattctgttactgtcgattttaatcatccattagcgttacaagatgtcacatttgatattgaagtcgtcagtattgatccacaggaggaaacaacaaatgcaaatattgctggctaa

SEQ ID NO: 1717 - DNA, 1713 bp, Proteus mirabilis
gcaatgaaaacaataaaacaatttttctatttggtttcacctttttgggggcggcgtaccgccctttactgctggttcctattaattctctctttaacgttaaccctctcatccgtttggtttaacgtcaaaatgaatgaatggaatggcagcttctataacgccctacaacaactcgatgggcaagccttatataaactgcttcaacagtttgtgattattattgccggattaattaccgtagtcgtgatgggtgatttcttacgccaaaaaatgatcattcgctggcgtgaaggtatgacagagcaagtgcttgagcgctggctatcaaaaaatagtaaacactatatgttgcggttaacctcgcaagagccagacaaccccgaccaacgaattgctgaagatattcgtttactgattgaatcgacaatgcgcttaacagtgacctttttacattcactgttaacgcttatctcttttgccactattttatggtcactctctggtgcgctctctttctctttagcaggcaaagagtggaatataccgggttatatgttctgggcctgtattatttatacccttatcgggatcaccatcacccagctcattggttctccattacgtaaaatcaatatggataaacagcgtaaagaggcagattaccgtactgcgcttatcacacgtaaacaacatggtgatgctattgctggtcaacggggtgaaatgagcgatcgtcatgaactgatgggacgctttttaggggtgatccgcaactggaataaccttatccgttatgaaagaaaccttgctttctttactgtgggttatcagcaagccacggcaatggcgccaattatttttgctttgccaaaattcctcgccggcgaattaatgctagggggattaatgcagttacgacaagccttctccagtgttgctggggcattaagctggtttattttctcctataaagagattgccgcatggcaggcaacggttacccgtctttatcattttgtggtgttgttagagcatgatcaccaacctgagatcaccgagttagatgataaacaaactaagctgacagccaatttatcgctatttatgcaagacgatagattattaattaacaatattcacttttctctcaaagcgggtgaattggcggtaattgaaggtagctcaggtatcgggaaatcaacactgttacgtgcgttaagcggccactggccttattttaaaggagatattcaacgggtaaccaatatcagttggctcccacaacgtatgtatctgcctgttgcccgcttagatagcttattggcttatccttgccaagcatctcagttctcacaacaagagtaccaagaagtgcttcattgggtggggctagataaaataaaaaatcagctttcactggaaacagattggacaacacgcttatccggtggtgaacaacaacgtcttatctttgcccgtttattactcaataaacccgatcttattttattagatgaaaccacatccgctcttgatgaacaaaatgccctacatatgttgttattacttaaacagcatctaccaacctcgggcattgtcttagtcagtcatcagcgtttcactcacgctattgccgagcaagtaatttcattacaagcgccgactgcgtcctcctctcaatcagctggagttactgaatatgtatcgtaa

SEQ ID NO: 1718 - DNA, 1341 bp, Proteus mirabilis
aagagaatgacgatgaccacgatagatataaataaattaaaaaatgattatccactggtacgtgatttagtggatttaaaagaggtggtttggtttaaccccaatgttacctcaactgaccagggacttccttatgtaggtttaacgcaaaatgatgtgatggatgcacaggcaagattacaacgttttgcaccttatttaatgaaagcctttccagaaaccgcatcaactgaggggatcatcgaatcagccgttgtggatatccctcaaatgaaaggggcactagaaaagcgctataacacccttattgagggacaattgcgtttgaaaaaggacagccacttacctatttctggttcaattaaagcgcgcggggggatttatgaagtgctcactcacgctgaaaaattagccatagaggccgggcttctaaccacagaggataattatgaaaaattattttctgatgaattccgcaaattttttagccaatacagtattgccgtcggctccacgggtaacttaggaatgtcgattggcattatgagtgcaaaactgggctttagcgttagtgttcatatgtctgcggatgctcgtcaatggaaaaaagacaagctacgcgctcatggtgttaatgttgtggaatatgagcaagattacagtattgcggttgaacaaggacgtaaagaggcagaaaaaaatcctcgttgtttctttattgatgatgaaaattcaaaaacattattcttgggttatgccgtcgctggattacgtttaaaacatcaatttgaaacgcttaatattccggtcgatagtgaacatcctctgtttgtctatctgccatgtggtgtaggtggagggcctggtggtgtcgcttttgggttaaaactggcatttggtgatgcagtacattgtctatttgctgagccaacccattctccttgtatgttacttggggtgtatacccagttacatgatggtatttctgttcaagaagtgggtatcgacaatattactgctgctgatggtttggcggtaggtagagcctctggctttgttggacgggcaatggagcgtttgattgatggctattacaccattgatgatcaagagttatataacttattgagcttgttaaacaaagaagaagggatccagctagagccttccgctttagcaggaatgacaggggctattcatgtttctcaagctaaagactatctacaaggtttattacttgatagtcaaaaaatgcacaatgcgacgcatttagtatgggcgacggggggcggtatggtgccaactgatgaaatgcaaaaatatcttgcgcaaggggaatag

SEQ ID NO: 1719 - DNA, 480 bp, Proteus mirabilis
gtgaataagacaatgaacaacgatacaaagatgaatattagcgacgtacttactctggcatgtacacataacaatgtgcattgcacaagtaaaaaacgcgcgttagaaattatcagtgagaatgcagctcaagcactgaatttaccagagacactgatttttgaggctttattaacgcgtgaaaaagtcggtacaacagggattgggggtggattggctatccctcatgggcgtattgaaagtgatgaaactgaaaaagttgttggtgtgtttcttcacctaagcgagcctattgccttcgacgctattgataatcaacctgtcgatttgttgtttgcattactcgttcctgcaacacaatgtaaggaacatttacacacactgtctttgattgcaaaacagttggctgacaaaaatttatgtcgccgactacgctccgcacaaagtgatgaagagctttatcagattatcacagaataa

SEQ ID NO: 1720 - DNA, 561 bp, Proteus mirabilis
acaccagagactatgactagcgataaatcattagcacaaaaaatcagttgtgcctaccaatcaacctatggtcagcttgtacgttttttccaaaaacgcacgggtaatcaccatgatgcggatgatttgtctcaagatgtgtttacactatggctaaatcgaaaagaacaaactcctgtccaagagcagcgtgcttttttatttaaaatagcgaaccacgttttgatcgatcattggaggaaaaaccaaaaacaaaaaaatatctatcaagaagattatcaattagaagatgcggtacagacctatacgacagagcttgatcccgggcacgtccttgagcatcaacagcgtttagatttactgacacaagctattgatactcttcctccccgccgtcgagaagcttttattctttatcgctttgatggattatcacaaagcgaaattgcagaacaaatggaaatttcgataagcatggtagagaaacatattgccgcagcactattacattgtaaaagatatgtcgatgcaggacaggagaaatgcactaatgacgagtaa

SEQ ID NO: 1721 - DNA, 624 bp, Proteus mirabilis
attggcaggactaaatggcggctcgcttttggtgaatggcaacctgactttacacccgataatgcgcgacaagccattttagcgttcaaaggtgatgtttataccggaatgcaagccgctgaacttttcacagatgacgactttcaatttgcacaacagcatttacgtatcctttccggtttatatggcgtattgcgcccactcgatttaatgcaaccttaccgcttagagatgggcataaaactgaacaataaaaaaggcagtgatctataccagttttggggtaacataattactgaaacgttaaataacgcccttgaagctcaaggggataatatcttggttaatttagcctctgatgaatattttaaatcagtcaacccaaaaaaactcaatgcggaaattattaaacctgtttttcttgatgagaaaaatggcaaatataaagtgattagtttttatgctaaaaaagcaagaggtttaatgagccgttttattattcaagaaagattaagtgataaggcacaacttaaagaatttaatctagagggttatcaatttaatgccgccgagtctgaaggcaatacccttgtctttaaacgtgcagaacatctagcaaaataa

SEQ ID NO: 1722 - DNA, 825 bp, Proteus mirabilis
tatcattttgcgtcatcgcgggagaatataatgaatacgggattgaatgctgggttgcgtattgaaaagctttctacgggatatgcgaagcgagaaatcattaaagaattaacggtctcactgcttccacgagggaaaattactgttcttttggggcctaatggcagtggtaaatcgacattgttaagggcgcttgctgggcttaatagcgcacaaggaaagctttttcttggtgatgatgaattactctccctctctttttctaaacgagcagagcaggtggtttatttgccacaaactctacctgcgggtgttcatttgagtgtcttggagtcaattctggttgcaagacgagctttaggtgaacatcgttctcattcagcgaatgatgaagttatagatatattagaacaactgggaatttcacatttagctatgcgatatcttgatgagttatccggtggacagaaacaattggtggggcttgctcaatcactaattcgacgaccaagtttattattgctagatgaaccacttagcgcactcgatcttaattatcagtttcatgtgatggaattaatcgcgagagaaaccaagaaacgtaatatgattactgtggttgttgttcacgatattaatattgcattacgccatggagagtatgtattaatgcttaaaaatggggagttagttgccaatggtttaccaactgaggtgatcacaccagaaatactcgccgatgtttatcgcgttagcgcccgtattgaacgatgctctagaggccatccacaggtattaattgatgggaggataaatgatatatag

SEQ ID NO: 1723 - DNA, 213 bp, Proteus mirabilis
  unsure (163): Identity of nucleotide at the above locations are unknown.
atattgattgccaacaaacagcagaagcgttgctatacgcaagaagccgaatcgttatcgcttcacgcattgccaaccttatctcccctattgattgtgtcaccccttgaattttgcacacctaatacattattaatggatgccaaccatgctcgcgctcttnggtttggcgctaaactcttgttttcattcagatcaaatagatactgttaa

SEQ ID NO: 1724 - DNA, 417 bp, Proteus mirabilis
aaaggagttgccatggtttgggtttatgcactgattggattagttgttggtcttattatcggcgcactggcaatgcgttatggtaataaaaccatgcgccaacaagatgctataaaagcagaattagatactaaaaaagaagaacttgatacatatcgcaacgagcttgtcagccactttgctcgaagtgctgaactactggacaatatggcgaaagactaccgccaactttatcaacacatggcaaaaagctccaatgagttaatgccagacatgcctgttcaagataacccatttaattatcggttaagtgaatcagaggcagccaatgatcaatccccgatcaaaatgccgccacgggattattccgaaggggcatctggattatttagacctaccgataaaaaagatgattaa

SEQ ID NO: 1725 - DNA, 825 bp, Proteus mirabilis
attatgtctgcaacagaacttcgtcttgcggtagtgggggctggagggcgtatggggcgccagctgatccaagcgattaatcagcaacaaggtgtggtattaggtgctgcttttgaacgtactaattcttcattgataggggctgatgcaggagagttagcgggaattggtcatatcggtatcactgttactgataatttattagctcaagtcgggcaatttgatattttaatcgattttacgcgtccagagggtacgttgtctcatctggcattttgtgttgagcatcataaaggcatgattattggaactaccggttttgatgaagaaggtaaaaaagccattaattgtgcagcacaaactattcctattgtctttgctgctaactttagtgttggcgttaatttagtgcttaaattattagagaaggcagctaaagtgatgggatcttatagtgatattgaaattgtagaagctcaccatcgtcataaggttgatgcaccatctggtacggccttagcgatgggcgagtcgattgcagagactttaggtcgagatctgaaagattgtgcggtttatcaacgagttggacatacaggagaacgtgatcctcgcagtattggctttgcgactattcgtgcaggggatattgtgggtgaacacactgctatttttgcagatattggtgagcgagtagagattagccataaggcctcgagtcgaatgacctttgcaaatggcgcggttaagtcagctatttggctaagtgaaaaaaaatcgggtctttataatatgaaagatgtgctttctttagaagaattgtga

SEQ ID NO: 1726 - DNA, 201 bp, Proteus mirabilis
aattgtgctgcatttggcatgatatttattgcactcatacgttatctcccccttgtacatgaggtccaacacgtcgataaagatgcggttttcctactccatcaagttgatagagatagtagtcatgtgtttttagccattgctgaatttgtgggctatcttctctaccaaagagtagggcgttttgtgggcaagcgctga

SEQ ID NO: 1727 - DNA, 243 bp, Proteus mirabilis
atgtattatttccataataatcaacaagggtatcatctccatcaccaccaaagagtttatcattacctttatttccatagaggtaatcattacccatactaccatggagaatatcattacccataccaccatggagaatatcatcacctatacctccatagagataatcattgcctatatcaccatagagaatatcattacccataccaccatagaggtgatcattacccaaaccacccttga

SEQ ID NO: 1728 - DNA, 972 bp, Proteus mirabilis
tccaattatttccacggtattgagccagttatggagctaattcgcggtatacagaatattcgagcacaacatcatggttgtgttctaacaattggcaattttgatggtgtccatcgcggtcatcaggcattattaaaacacttgaagcaagaagcatcacgtcgtggcctacctactgttgtgatgacatttgaacctcaacctctggagttttttttgccagagaaagcacctgctcgtctaacgcgcctacgcgataagataaaatatttggcagagtgtggtattgattacctgttatgtgtcaaatttgataagcaatttgcagcacaaacaccggaagagtttgtttcatcactcttagttgataaattaggtgtgaagtttttagccattggcgatgattttcgttttggtaaaaatagggcaggtgattttcattttttacaacaagccggtgctcgatacggatttgaggtggcaaataccgaaagttattgtgacaaaggattacgtattagcagtacggcggtacgagaagccttattcaatgacgatttagcattagctgaatcattgcttggacacccttatagcgtttgtggacgcgtggtacatggtaatcaattaggcagaactattggttttccaaccgccaatattcccatgaaacgcttagtggcacctgttgctggtgtttatgcggttgatgtttatttagccgaccatcaatcgcctttagcgggggtggctaatattggcagtcgtcctaccgtaaaaggtaagggtgtacaattagaagttcatttaatcgacgttaatatggatttatatggacgtcgtattgatgttgtgttacgaaagaaattacgtaatgaacagcgatttgcatcattggatgcgttgaaacagcaaatcgcaaatgatgtggctgctgctagggattttttattgcagcggtcggagtcataa

SEQ ID NO: 1729 - DNA, 930 bp, Proteus mirabilis
tcaaattatttgatagagataagtataatgagtaaagataaagccattacattggaatctctacgagtgatggatgccattgatcgtagaggaagttttgctgccgccgctgatgagctaaatcgcgtcccatcagcactcagttataccatgcagaaattagaagaagatttggatgttgtgctatttgaccgttcaggacatcgaactaaatttactaatgtgggaagaatgttacttgaaagagggcgtattcttcttgaagctgcagataaattaacttctgatgctgaagcgctagctcgcggttgggagccacatattacgattgtgtgtgaagcattaacacccgcatctcgcttattcccgttagttgaaaaattagctgaaaaatccaatacacaactctctttagtcaccgaagtgcttgctggagcatgggaaagcttggaaagtggtaaatgtgatattgttatttcaccggatatgcattttcgttcttcatcagaaatcaatttccgccctttatataataccaccagtgtctatgttgccagccctgatcaccctatccataatgaacctgaaccacttgcagaagaaactcgcttaaaatatcgcggtattgctatcgccgataccgcaagagaacgacctgttttaactgtactgttattagataaacagcgtcgtttaacggtgagttcgattgaagataaacgtcgagcattaattgccggtttaggggttgctactatgcctattgatttaattgaagatgatttaaaagaggggcgtttacgtgtggttggccctgaatatcatcatgaaaataatattattatggcgtggcgcagagacagtatgggagaagctaaatcctggtgtttacgcgaaattcctaaactctttgccacggataaaaaatag

SEQ ID NO: 1730 - DNA, 585 bp, Proteus mirabilis
gcttgttatgcgttcataaggataaagatgaatacaatgatagagacctgctacggtgcagtaagcaagcaaataatgcaaaaagcagaaaaagtccaattgctgatttgcgatgttgatggtgtgatgtctgacggacttatttatatgggcaataacggtgaagagttgaaagcgtttaatgtccgtgatggctatggcattcgttgtttacttacatcgggtattgaggtcgctatcattacgggtcgtcaatctaagcttttagaagatagagccaaaacacttggcattacatatctttaccaaggacagcataataagcttttggcgtatcaacaactgttagatacactaaaccttaaaccagaacagacagcctatattggcgatgatctgattgatttaccggtaatggaaaaagtaggactgtcagttgccgttgctgatgcccatccattactcacacctcgtgccgactatgttacccatattttaggtggacgcggtgcagtacgagaattatgtgatttgatcctattagcccaaggtcgacttgaagaagctaaaggtttatcgatttaa

SEQ ID NO: 1731 - DNA, 336 bp, Proteus mirabilis
cgatgcaatgcgcataaaacaaatagagatcgaataggggttgttatgtgccttggtattccaggtcaagttgttgaagtgggaaaaaccatcactgaaaatgcattggtcgatgtttgtggtgttaagcgtgaagtgaatatcgcattagtttgtgaaggcgagcctgatacgatgattggcaagtgggtattagtgcatgtaggttttgccatgagtatcgttaacgaacaagaagcacaagaaacccttaacgcattgatggcgatgggggaagtcgaagacgatgtgagtgcttttctctatggtgaggaaagtacagctaaacgtgcttga

SEQ ID NO: 1732 - DNA, 801 bp, Proteus mirabilis
cgtatgagtgcaataaatatcatgccaaatgcagcacaatttcaagcctcactcaaacagtatgtcttaatctatacaccggactatttaccactttggttaattgttgccggcgtattatttgtcggcatgctacttgtactcgcacttcatggttttttacgttaccgctttgccacaccccatggagagcatcatcaagaagagaaactctatctttactcaaaagcggtacgtttatggcattggagtaatgcaactttatttatcttactccttctcagtggcgggattaaccatttcgccctactctcggcacatgacacggcgttactcgtcaatgtgcatgaaatttgtggttatctactcttagtatgctggttgtcctttgtattaattaatcttgttggtggcaatggtaaattttaccgtattgacagtaaaaactggttgcaacgagtattaatgcaaacgcgtttttatctttacggcattattaaaggggaagatcatccttttccagccactcccaaggttaaatttaatccactgcaacaaatggcttatttaggtgtgatgtatgcattagtaccattacttttaatcactgggatcttactgcaaaatcccatgtttatccctgctgatgctgtgctatttaaagcttggttattaataattcaccaaatactagccgtgtgtagtgtcttttttatctttggtcacctttacctgtgtaccaccggaagaacgccattccaaacctttcgcagtatggttgacggctaccatagacactaa

SEQ ID NO: 1733 - DNA, 1455 bp, Proteus mirabilis
gtcatcctcgccgttcagtcgctgaattacgcgttcaggcacaataggagaaaaatgatgggtcagaatgtgtatcaatttatcgacttaaatcgcgttgaaccgactaaaaaaccgttagctgtgcgtaaaattgagtttgtcgagatttatgaggcattttctgctgagcaagcctctgcacaagccgatcgctgtttagactgtggtaatccttattgtgaatggaaatgcccagtgcataactatatccctaattggctaaaattagccaatgaaggacgaataatagaagcagcagagctttctcatcaaaccaatagcttaccggaaatctgtggtcgtgtttgtccacaagaccgattatgcgaaggcgcttgtacgttaaatgatgaatttggtgcggtcactattggtaatatagaacgctatatcaatgataccgcctttgcgctgggctggcgcccttccttgtctcaagtcaccatgacagataaaaaagtcgccattattggtgcaggccctgcgggattggcttgtgctgatgtgctgatccgccaaggagtaaaacccgtagtctatgataaacaccctgaaatcggtggattactcactttcggtattccctcttttaaacttgaaaaatcgctgatggtaagacgacgcgagttatttagcgaaatgggaataaccttttgtcttaatacagaaataggcaaagatatctcactaaaaacactgacggagcaatatgatgctgttttccttggcttgggtacttatcaaagtttgagtggtcattttgcccatgagaacgcaatgggggtttataatgccttaccttatttaattggtaatactcgccatttaatgggttatgcagaagatccccaatcaccttatatcgacctcaataaaaagcacgtggtggtgttagggggtggggatacggcgatggattgtgtacgaaccgctattcgccaaggtgccactaaagtaacttgtgtttatcgtcgcgatgaaaataatatgcccggctctaaacgtgaagtaaaaaatgccaaagaagaaggtggcgaatttttatttaatcgtcaaccccttgatattgaagtagatgctaataataacgtcatcggtgttcgtgtaataaaaacacaaaccaacggggaattaaaatatatagaaggcagcgaacatatattatccgcagatgcggttattcttgcatttggttttaaacctgcacactatccgtggttagatgaaaataatattcaatacgcatcatcgggtagaattattattaatgatgatccactattacctttgcaaacgaccaatcctaaggtgtttgctggaggtgatattgtaagaggctccgatctggtggtcaccgcgatagcacaaggaagagaagcagcggaagggatcttgcgttatttatcttgttaa

SEQ ID NO: 1734 - DNA, 303 bp, Proteus mirabilis
tcagtttacgcaaagaagttaatttgttggtcattttgtttatctcatctactaggtaaatctgtttgcagtcacctgcggatatctattgataataacatggactgctcacactacaagatgcttagattcatcgaaagcaattatttgaatgccaaacgatttcgcaaaacaaaagtagcaaaaaacagaataacaactcaggctgaatcgtttaatatgtctattttatggcacattggtgaaagtattgttttttcctattattatgatttaacttatctaccaaacaatttgctatag

SEQ ID NO: 1735 - DNA, 864 bp, Proteus mirabilis
aggagtcacgctatgctaattattgaaacaacgcttatcttacgccgcgaaattaagcgactaaaacaagaaggtaaacgcattgcattggttccgaccatgggcaacctgcatcaaggtcacctaaaactgatagaagaagcgcgtattcatgctgatgtggttatcgcctctatttttgttaatccaatgcaattcgatagagaagccgatttagcaaactatccacgaaccctacaagaagattgcgagttactgcgcgataaacatgttgatattgtctttgccccatcagcgaaagagatgtacccaaatgggatggaaaaccaaacgattgttgaggttccagtactttcttctgtgttagaaggcgctagtcgcccaggacatttccgcggtgtaacaaccgttgtaagtaaactattcaaccttgtacagcctgatgtcgcgctatttggtgaaaaagattatcaacaactgcagatcataaaaaaaatggtcagtgatttatgttttgatatcagtattattccagtccctattgtgcgtgataaaacaggattggcatttagctctcgaaatcgtttgttatcagataatgaaaaacaacaagcccctgtgctttatcaagctatgcaacagatagccgagcaattaaaatcgggaaaccttgatgttaaccaactattacaaactgccaaagcaacccttgaacagcaaggctttcgtgctgatgaatgttttatttgtgatgcacaaacactagcaccacttagcgaagagagccgatgtgccgttattttaatggcagcttggttgggtaacactcgtttaatcgatagccaacaagttagcttagtctaa

SEQ ID NO: 1736 - DNA, 924 bp, Proteus mirabilis
ttgagtaacgcaactttatgtacggatgcgttccgtcaaaaattacattctgcacatcagcgtgttgatgaagcactcaaccaagcgctacaaacgttgcctttttctgatatgccactcagccaagcaatgcgctacggagcactcttgggggggaaacgtttacgcccatttctcgtttatgcggtaggagaaatgtttaacgtacctgttgctaatcttgatgtgccagcagccgctattgagtgtattcatgcatattcactgatccatgacgacttacctgcaatggacaatgatgatttacgtcgaggaaaacccacttgtcatattgagtttggcgaagccaatgccattttagcgggtgatgcattacaaaccttggcctttgaaattttagccaaaaatgcgatgcctgatgtcgccattgccgatcgcgtagccatgattgctgaattagccacagccagtggtttagcgggtatgtgtggtggacaggcacttgatcttgatgccgaagataaatcaattgatcttgtcgctcttgagaaaattcatttacataaaacaggtgcgttaattcgtgcagcggttcgcctaggggcacttagcgcagggcaaaaagggcacgatgtgttacctgcactggataaatatgcccactctataggcttggctttccaagttcaggatgacattttagatgttattgggagcactgaagagactggaaagcgacagggaagtgatcaagaagctggaaaaagtacttatccggctctacttggtttagcacaagcacaaaagaaagcacaggaattgtataacgaagcattggatgccttagcgtttcttgaacaatacgagtacgatacctctacgctaaaacaattagcgaattttatcgtagaacggaaaaactaa

SEQ ID NO: 1737 - DNA, 207 bp, Proteus mirabilis
atcaatatagcaacaggccgaatagcatgcttttttctcttttctcgcttctctaaacaaacggttttgaatgatctaaccataaattatccaaccctgatccatttaatagtattccagcttaaagcgcagcgtcgtacggtaattccccgcttttggcgtatcgttatttttgactattcgagcttggtacagcaatgccattga

SEQ ID NO: 1738 - DNA, 717 bp, Proteus mirabilis
acgatgaaagcagcgcgttcgggaaaaccaatttgtatgccaagctcttggcgtaatattccttggggagaatattaccgcatggcaattgaattgcgattacaaaattggtggccgaaaatatacggttttcatatgcttaaattaggtcaacttagtgctgaactcgatactaaatccagtatggtctcacatcaagttaacgtgactacaacgacgacaaacacagatgttatggcgtctctcaattatctgccatttgaaaataaatcggttgatgtctgtcttatggctcatgttttagattacagtgcagatcctcattggttattaagagaagccgatcgtgtattagtggatgacggttggatcatcctatcaagttttaatcctatcagcctattaggtataggaaaatgtacgcctattttacggcataaacagccctattattgtcggatgttttcacttcgacgccaagttgattggctaagtgtgcttaattatgaagtgataacacaacagaacttccagattatgccattttcccgtcccgtaaaacgtgatggtaaccgctatcatgtcgggggatgtttaaatttaatattagcgcgtaaaagaacacttcctttaacacccaccgcgatgaagtttgcattaccgcgtatgagtgtaaaaggcagagttttaggcgctacacgtaatcgacctgattaa

SEQ ID NO: 1739 - DNA, 732 bp, Proteus mirabilis
cactttatggcgctgttaaaagctgaaaatttagcaaaagcatacaaagggcgcaccgttgtcggtgatgtgagcctcaatgttaactccggtgagattgttggcttacttggccctaacggtgcgggaaaaaccaccaccttttatatggtggtaggtattgtcgcccgtgatgcgggtagcattactatcgacgatgaagatattaccttactcccgttacatgagcgtgcgcgtaagggtattggttatttgccacaagaagcctctatttttagacgcttaagcgtttatgacaatatcatgggaattttagaaatacgccatgatttaacggccgaacaacgaaaagatcgtgcagaagagctacttgaagagtttaatgtcagtcacttacgtaatagtttagggcaatctttatcagggggtgaacgccgtcgtgtagagatagcacgggcgctagcggcaaatcctaaatttattttattggatgagccttttgccggtgttgaccctatttccgttttagatattaagaaaattatccaacatctacgcgattatggcttgggcgtattaattaccgaccataatgtacgcgaaaccttagatgtgtgtgaacgtgcttatatcgtcagtcaaggacaccttattgcccatggttcaccagaagaaattttggcaaatgagcaagttaaacgtgtttacttaggtgaaggcttccgcctgtga

SEQ ID NO: 1740 - DNA, 1143 bp, Proteus mirabilis
tccagaatggcgaaaagagatttttacgaagtactcgggttaagtaaaacagccgatgaaaaagagatcaaacgtgcttataagcgtttagcgatgaaatatcacccagatcgtaatcaaggtgataaagattcggaatctaaatttaaagaaattaaagaagcttacgaagttcttagcgatccacaaaaacgtgcggcctatgatcaatatggtcatgctgcctttgaacaaggtggttttggtggtcaaggcggtggcggctttggtggcgctgactttagcgatatctttggtgatgtatttggcgatatttttggtggtggtcgtcgtcaacaacgtgctgcacgcggctcagatttgcaatacaacatggacttaacgctagaagaagctgttcgtggtattaccaaagagatccgcattccaaccttagaaacctgtgataaatgccacggtagtggggcaaaagaaggcacatcagcggaaacttgctcaacatgtcatggggcaggtcaggttcatttacgtcaaggtttcttcaccgttcaacaaccatgccctacttgtcatggtcgcggtaaagtaattaaagagccttgctctaaatgtcatggtgatggccgtgttgagcgttataaaaccttatcagttaaaatcccggcgggagtggataccggtgatcgtattcgtttaagtggtgaaggtgaagcgggtgagcaaggcgcaccggcgggcgatctgtatgtacaggttcatgttcgtcagcaccatatatttgaacgagatggtaataacctctattgcgaagtacctattaactttgcggttgcagcattagggggagaaattgaggtgccaactctcgatggtcgtgtgaaactaaaaattccagcagaaacacaaactggcaaaatgttccgcatgaaaggcaaaggtgttaaatctgtacgtagccatggtgtcggtgatttaatgtgccgtgttgttgttgaaacgccagtgaaactgaatgaaaaacaaaagcagcttatggaacagctaggtgaatcatttggtggtaaaggtggtgaaaaaaatacaccgcgctctaagagtttcttagatggagtaaaaaaattctttgatgatttaaccaaataa

SEQ ID NO: 1741 - DNA, 1524 bp, Proteus mirabilis
ctttctgaggccaatatggaagcattacttgaattaaaaaatattgataaatcatttccaggcgtaaaagcattatctggtgcgacgttacgaatttatcctggccgagtgatggcacttgttggtgaaaatggcgcaggtaaatccacactaatgaaagtgctaacaggtatctaccaaaaagacgcaggtgaaattatttatcaaggggaacgttgctcttttaatggtcctaagtcttctcaagaagccggaataggtattatccatcaagaactcaatcttatccctgaattaaccattgcagaaaatatctttttaggtcgcgagtttacccgtgcatttggtgccattgattggaaaaaaatgtatgcagaagcggataaattacttgctcgcttaaaccttccttatcgcagtcatcgcttagtttctgaattatccattggtgatcagcaaatggttgaaattgccaaagtactcagttttggctctaaagtgattattatggatgaaccgacagatgcattgacagacaccgaaactcgctctctgtttagtgtgataactgaattaagaaatcaaggttgtggcattgtctatatctcacatcgattaaaagaaatttttgatatttgtgatgatgtaactgtgttgcgcgatggtcaatttattggcgaaaagcccgtttcttcattacaagaagagacacttattgaaatgatggtaggccgtaaattagaagatcaataccctcgcatccatattcctgcaggaaaaactaaacttaatgtctctcacttaagtggtgcagatatacatgatgtcagcttctccctacatgaaaatgaaattttaggtatttcagggttaatgggcgcaggccgtactgaattaatgaaaatgatttacggtgcattgccaaaaacacaaggtagcgtggcgttagaaggtaaaatttgtcagatcaaaaagcctgcagatgcacttgcccaaggtattgtttatatctctgaagacagaaaacgcgatggtttagtgctaggtatgtcagtaaaagagaatatgtcactgacggcgctaccttattttagtcgcactatggggatcttaaatcataaagaagagcaattaactgtcagtgactttattaaattgttcaacataaaaaccccgtccatcaatcagatcattggttttttatcaggcggtaatcagcaaaaagtcgctattgctcgcggactaatgactcgtcctaaagtgcttattcttgatgagcctacccgcggtgtcgatgtgggggcgaaaaaagagatttaccaattaattaataagtttaaacaagagggattaagcatcattttgatctcttcagaaatgccagaggtaatgggaatgagtgaccgcattttagttatgcatgaaggtcgtatcagcggtgagttttctgccaataatgtcacacaagagatgctaatggcggcggctgttggtaaacaatatggtgctacagtaggagtttga

SEQ ID NO: 1742 - DNA, 1638 bp, Proteus mirabilis
ttttttagggcaatcggtggtgtcatgaaattaagcagtaacaatgctgaaactatggagagccttcgcagtgagcggaatcaatatcgtatacttgtcgatattacaaattctgtattagcgcatctagacatggatggcctcatttctgaagtatctaaagaaatacatcgttttttcggacttaatcatattagtctgatgttatgtcgtacttcatcacaaaatagtcatgaaggtattctttattctagtcgttatcagacaggaaaatctgtcattcgtcaacaacgtaagttcagtagcgccaataacaaagccgaagaaattattcatcaaaacaaacccgttttaatcgatatcaataaagaagatcaagacgatgttttgattaaacgtctcgtaaaacaaaatatgcagacggctttgttattgccactggcttttaaccgtaaaccgctaggtttattaatcctagcgcatgaaataagtagtgtttttactgaagaaacttgtcaattattgcaacaaattgccgcgcgcatcgggattgcaattgaaaatgccgccgcttatgaagagataactcaccttaaagatagccttaagaacgaaaatatttggcttaatgaacaaataaatagaaatggtagttttagcgagattatttatcaaagcgatgccatgcataatgtactagaacaaattgagttagtcgctcaaagtgacagtactgtacttatcttaggcgaaacaggtactggtaaagagttaattgcacgagcgatccatcgtttaagtcatcgtaaaaataagacgatgataaaaatgaattgtgcagcagtaccttccggtctgttagaaagtgatctttttggacatgataaaggcgcttttacgggtgcaacacatgcccatgtgggtcgatttgaaatggcagataaaagtacgctttttctcgatgaaattggcgatatgcccattgaattacagccaaaactattacgggttctccaagagcgtgaaattgaaagattaggtggtaataaagttattcctgtggatgtacgcttaattgcagcgaccaataaagatttatgtgaactgacggatgaaggggaatttcgagaagatctctattatcgtctgaatgtttttcctattattatcccgccattacgggagcgacctgaagatatccccttattggcaaaatattttacgcaaaaaattgcccgccgcatggatagaaaaatagactgtattccaacacatgctttggagcaattaacccattatccttggccgggaaatgtacgagagcttgaaaatattattgagcgcgcggttattttaactcgaggctctacgctaaatttgcaactaaaagagttaaatatcaataaaccatctcgtttaaaacaagtgctttcgcaaccatcagccatagaaaaaaagatgcaaactagcgcacctgaaagtgatgatgaagagcgtgagcggataatacaagcccttagagaaactaacggtgtagtggctggtgccagaggtgcggcattaaaattaggattaaaaagaaccaccttattatcacgtatgcaacgcttaggtatttccattcctgaaattctttag

SEQ ID NO: 1743 - DNA, 1602 bp, Proteus mirabilis
ccgcttaattttttaattattagatttaattattcgaggtgtcatatttttaaccgagtagcgcatttctgccgtaatttgctaggacgacaaacaacatcgtcagatacagaatcggtagcgagtgaaaggcctgtcactgcatctgaccgacctaaaaaagaaacacaaacgactgtgcgtcggcgtcctgccctatccgcagaccgtccccgtaagaacaaaagtaataacgaaaaggcgaacgggagtgatttgccaatgactgtgatcccaagagatcaacacccgatttcgcgtaaagacatcagtgataacgcactaaaagttctttatcgtctgaataattcaggctttcaggcttatttagtgggtggtggtgtacgcgatctattattagggaaaaaaccaaaagactttgatattgctaccaatgcaacgccagaagaagtccgtcgattatttcgtaatagccgcttagtaggtcgacgctttcgtctagcgcatattatgtttggccccgaagtgattgaagtcgctactttccgtggctctcatgaagatcatgaaacatccgatcgcaatcagtcacaacaagcacaaagcggtatgttgctacgcgacaatatcttcggatcgattgaagaagatgccattcgtcgtgattttaccttaaatagtctctattacggcgtcgatgattttgctgtacgtgattatgtggggggcttggctgatcttaaatcaggtactattcgtttaattggctctcctgaaactcgctatcgtgaagatccggttcggatgctaagagctatccgctttgccagtaaactggatatgcgtatcgcaccggaaactgcagagccaattagccaattagcaccactattacgtaatattccttcagcacgcctatttgaagaatcgctgaaattattacaaacaggacatggttataaaacctatcggttaatgcgccatttccaacttttagagcctctttttccattagttgcctcaaggatcactgagcagcaagataccccaatggaaagaatgatcgaacaggtgctaaagaataccgactatcgtattagtaaagaaatgcgcgtaaatccggcattcttatttgcagcaatgctatggtatcccttagtggagcatgccgaaaaactggctcaagaaagtggactgtcttattacgatgctttctcaatggcgatgaatgatattttagatgagcaatgtcgtactattgcgatccctaaacgtatcaccaccacgatgcgtgatatttggcaattacagcagcgtttacctaagcgtcaagggcgccgagccaataaactgcttgagcatcctaaattccgtgcagcatttgatctactggaattacgcgctaatgtacaaagaaatcctgatctggaagcattagccgcttggtgggctgattttcagatttcaaacaatacacaacaacgctctatggtctctgaattaggtccaggcccggtacgtaaaaggacacgtcctcgtaaacgtcctcgtcaccctaatgcaaaaaataatgcaccaagacaagagaacaaacatgagtaa

SEQ ID NO: 1744 - DNA, 339 bp, Proteus mirabilis
tggattaatttatttaaccaccgatcattaccgtaccatgcaaagagttgcaccttaatgaaacagattatttttgatttcagcacattggcggatcgagatgctttttatcatcagtttgctcagcaatttcaattggatgaagcatttggtaataatcttgatgcgttatgggatgtattaacaggagaaattgaattgcctgttaatattgttttcagacatgcaccgcatcattcccgcaccttccagcccattattgagataatgcaagaagcgcaagagacgctcggtaaagacctatttcgctttcattgtgaacataaaaaagccaagtag

SEQ ID NO: 1745 - DNA, 858 bp, Proteus mirabilis
cgtataaattttgtttatgcagacaggcttaaggacgttttattcatgaacgcacaaccagacaatttaattgaagtgcgcaatatgaactttactcgcggtagcagaaagattttttcgcaaatcaatctggatgtgcctagaggaaaagtgactgcaataatggggccttcagggataggtaaaaccaccttattacgcttgatggggggacaaattctgcctgatagtggtgatatttggtttgatggtgacaatattcctaagttatcacgctctgctttatatcagtcaagaaaaaaaatgagtatgctttttcaatcaggcgccctttttactgatatgaatgtatttgaaaatgtcgccttcccattaagagagcatactaatttacccgaggcgttaattcacactaccgtgatgatgaagttagaagcggtagggttaagaggggcagctaatttaatgccatctgaattatcggggggaatggcgcgcagagccgctttagcaagagcgatagcccttgatccagatttaatcatgtttgacgagccattcgttggacaagatcccattaccatgggggtattagtaaaactgattgatgaattaaaccatgcattaggggtcacttgtgtggtggtgtctcatgatgtccctgaagtactgagtattgccgattatgcatatattattgcagaacagaaaatcattgctcagggaagtgcaaaagagctacaggaaaatccagacagacaagtaagacagtttttagatggtattgctgatggacctgtacctttccgttttcctgcggggaactatcaggatgatctattaggacgaggtaattag

SEQ ID NO: 1746 - DNA, 885 bp, Proteus mirabilis
ctaattttttattgtattattaataataagcaatatcatttgtgtttgtattatgcctataattcattagaaagaaaatcagaggcaagaattatgagtagtatgtcggcgacttttccacgccgttggtccttttctattggtggattaactgccagtattgtgtttcatgtcaccttggttgttgttgctataggttggataacgacgaaagatgagcaatatgcggttttacctccagcaatgacgatgcaagtggggctttatcaattggcaaaagcagaacctaaagaggttcctgttgggcctgaacaggtgatgtcagttccagaagctgccgagccagagccgatgaaagagcaacttgatgtgcctaaaatgcctgtagtcgaacagggaacttatcagcgagttgcggaaaagccaaaggtgaaacccgtggttaagcctaagcctgtcgtggtaaaagtgcctgatgatcttcccgtttctcaagcgccagcagataccacaaccgccccgttatcgggtgagaacgcgaccagtagtgctgattttaccagtaccgcttcatcatctcgcagtggccaaatggggtgggaaagtttagtccatagccatattgatatgtataaacgttaccctcgtgcagcattacgttttaaagcgacgggagtgacacaagttgaaatttcgctcaatgcaaaaggtgagttattagatgtgagtatacaaacctcgtctggtaatcgtatccttgataaagaagcgattaacactattaaacgggcatcgccatttccggcacctgaaagccaccgtttagttaacggctctttctcatttattgcacccttgagctttgactatcggcaaagtagttaa

SEQ ID NO: 1747 - DNA, 1698 bp, Proteus mirabilis
aatctcttttataatcaaagggtaattatagtggctcaatacgtttatagtatgttgcgtgtcgggaaagttgttccccctaagcgacatatccttaaaaacatctcactcagcttctttccgggcgcgaaaattggtgtgcttggtctaaacggtgccggtaaatcaaccttactgcgtatcatggccggtatcgataccgatatcgaaggtgaagcacgtccacaaccgggtctaaaaattggctacttgccacaagagccaaaattaaacccacaacaaacggttcgtgaagccgttgaagaagcggtaagcgaagtcaaaaatgcactcaatcgtcttgatgaagtgtatgcagcttatgctgatcctgatgctgattttgaccaactggcaaaagagcaaggtcagctagaagcgattattcaatctcacgatggtcataatcttgataaccaattagagcgtgcagcagaagcactacgtttaccagattgggatgccaaaattgaacatctttctggtggtgaacgtcgccgtgtggctatctgtcgtttactgttagaaaagccagatatgctgttgttagatgaaccgactaaccacttggatgctgagtctgttgcttggttagaacgcttcttacatgattatgaaggcactgttgtggcgattacccacgaccgttacttccttgataatgtcgcaggatggatcttagaacttgaccgcggtgaaggtattccgtgggaaggtaactactcctcttggttagagcaaaaagatgcgcgtcttgaacaagaagcagccactgaagccgctcgccataaatcaattcaaaaagaacttgagtggatccgccaaaatcctaaaggtcgtcaggctaaaggtaaagctcgtcttgctcgctttgaagaactcaatagcgttgattaccaaaaacgtaatgaaaccagtgagctatttattccacctggacctcgtttaggggataaagtgctagaagtgagtcacctcactaaatcttatggtgatcgcgttctgattgatgatttaagtttctccattcctaaaggcgctatcgtcggtattatcggtccaaatggtgccggtaaatcaacgctgttccgtatgatctcaggtcaagaacaacccgattcaggaaccgtgactttaggggagaccgtgaaactggcctctgttgatcagttccgcgatagtatggatgacagcaaaacggtttgggaagaagtttctggtggtcaagatattatgcgcattggtaactttgaaatcccaagtcgcgcttatgtgggccgctttaactttaaaggcgttgaccaaggtaaacgcgttggcgaactgtccggaggtgagcgtggacgtttacaccttgcgaaacttctccaagtcggcggtaatatgttgctgctcgatgaaccaaccaatgatctggatgttgaaacgctacgcgccttagaaaatgcgctattagaattcccaggttgtgctatggtcatttcccatgaccgttggttcctagaccgtatcgccactcatatcatcgattatcaagatgaaggtaaagtcgaattctttgaaggtaactttactgaatatgaagagtataaaaaacggacattaggtaacgaagctatccaacctcgtcgcatgaaatataaacgcatcactaagtaa

SEQ ID NO: 1748 - DNA, 681 bp, Proteus mirabilis
gaagccttttatatggaaatcgtaagagagctgttcttggcgctttggcatcaagattacgaaaccttagcgaatccctcactgctttggattatttacattttattattcagcatactattcctagaaaacggagtactacccgcagctttcttaccaggagacagcttattaattttagtgggtgtgttaattgctaaaggaaccatggattttccattaaccttacttattctaacggcaggtgctagcttaggttgttggctgggttatctgcaagggaagtggcttggtaacacccgacttgtacgaagttggttatcacatttaccagaacactaccaccaacgagcccatggacttttccatcgacatggcttggcagcattacttattggtcgttttctcgcttttgttagaacattattgccgactattgccggccttgctggcttacaaaacggtcgttttcaagtttttaattggctaagtggtctgttatgggttggtattttaaccaccttaggctatttattaggaaatagtccgttattccgccaatatgagcatcatttaatgaattttctgatgctactgcctgtttgtttattagtgattggcctaatcgggagtgtatgggtcgtcattaagaagaaaagtaaacagagtaatcaaccgtaa

SEQ ID NO: 1749 - DNA, 1194 bp, Proteus mirabilis
aatgtgatttattattctctggagggcgttttgattaaatcagctatactggttctagaagatgggaccgaattccacggcaggtcgataggcgcagaaggcgctgctatcggtgaagtcgtttttaatacttccatgaccggttaccaagaaatattaaccgacccttcttactcccaacaaattgttactctcacctatcctcatattggcaatactggcgttaattcctcagatgaagaatcagcaactatccatgctcaagggttaattattcgcgatttacccctagtgatgagtaattatcgtgccgaagagagcttagccgattaccttaaacgtcatcagattgtggcgatagctgatattgatacacgtaaattgacgcgattattgagagaaaaaggcgcacaaaacggttgtattatcgcaggcactcatcttgatgctaaacaagcgcttgaaaaagcaaaagcgtttccaggattaaaaggaatggatttggcgaaaacggtgacagtgaaacaaccttatcaatggacacaaggcagttggacattaacaggggagttgcccgccactcaatcaccacaagatctccctttacatgtggtggcctatgattttggtgtgaaacgtaatattttacgtatgctggtggatagaggctgtcgagtaacagtggttccagcacaaacctcagcccaagaagtgttagcgctctcacctgatggcatttttctctctaatggtccgggggatccagagccctgtgattatgcaattgacgccatccaaactttcttaactaccgatattccagtatttggtatctgcttagggcaccaattattagccttggcgagtggtgcaaaaaccgtaaaaatgaaatttggtcatcatggtggcaatcatcccgttaaagatttagataataacagtgtgatgatcaccgcccaaaaccacggctttgctgttgatgaagcatcgttacctgattgtttaagagtgacacataaatcactatttgatggttctctacaaggtattcatcgcacagataaagctgcatttagtttccaaggtcacccagaagcgagcccagggccgcatgatgcggcgccgctttttgatcactttattgaacttattgagcaatatcgtcaaaacctgcaatcagtgacaaacaaataa

SEQ ID NO: 1750 - DNA, 1587 bp, Proteus mirabilis
ccaagagtttatcatttatcgcaaaaacacgatataacgcagcgaattcgtttcatcgataccagaaagaggatagaaatgatcgattttaaactgaagttaaattatcaacgcaaatataacagcagtgatatcgatattgatgatgaaatgcagatctcgcgccaatttgaaagcgatcgcgggcgtattattaattcagcggcgatccgtcggttacaacaaaaaacacaggtatttccattagagcaaaattcggcggtacgaagtcgattaacccattcgctggaagtacaacaaataggccgttatatcgctaagcaaataatcggcgaactaaaaaagcataataaattagaagaatatggcttaaatgaacggattgatagcgttgaaagtttaattgaaatggcgtgtttaatgcacgatattggcaatcctccttttggtcatttcggtgaagctgcaattaaacattggtttcgtaaggtgttagcacctgatgcttccatagaatttgataattgtccttttttacctattcgctattcagcagaccgacatttaaatgaattaaaacagactttgcgtcaagacttatgccatttcgaaggcaatgctcaggcaattcgcatggcgcatcacttgttaaaactcaatttaacctatgcgcaaattggctgtgttttaaaatatacacgcccagcttattggcaaggtgctacgccgaaagaatttagctatttaatgaaaaaaccaggttattactggtctgaagctgaatttgttaaggaagtacaagagaaacttgcaatgaaagatttttgtcgttttccactgacttatattatggaagcggcagatgatatttcttattgtattgctgatttagatgatgcggtagaaaaaggtatttttgatatcaatcgattagtgcagttattaaaaaatgcatggagtgaaagtggtgcggtaacagaaggtgatctgtttgatatcactgttaatcgagcttttaagaaagttgatcaaaatgaagctaagcgtagcatgcaagatcaattttttatgtatttgcgcgtctatattaccggaaaactagtaccttacaccgcctatcgctttatcaagaacttacctcaagtttatgagggcagctttaaccacgctttacttgaaggaaagagtgctgaacatcgtttattggcaacgttaaaacgagtggcgcaaaagtgggtatttagtcaccccgaagttgaagagcttgaaatgaagggctatcgagtgatcagtgggttattggatatttataagccattgcttttattatcgaccgatgattttctaagactacataaatataatgaacatcctcattatgttattgagacgcgtttatatcataagctttcgattaaacataagcttgcttataatgaagcattagaaaaaatttacgatattaatagtgaagagggaaaaaccttagagttttattatcgtacaagattgatacaagattatatcagtggtatgaccgaccattatgcatatgaagaatatagaaaattaatggtatgtgattaa

SEQ ID NO: 1751 - DNA, 861 bp, Proteus mirabilis
cttgaggtttatatgcttatacctaagcgccaattaatcttttacttatttactagcatgttgatatatccagcttcctctatagccgctattttttcttatattacagaatcaaaaccagtaggtaatgaggggacaggggctgattacacttttattatccaacgttgggatcccgagccaccaacggctttaaatccttgttataaaaaaaaaccttgttatataaccataaatcatcgtcatcagcctaaccagtctggaggttcagcgaccagaactattttaagtgatgggcataaatatcgaagaatggaagatctacgtattgctgttatgaaagaattaggaggattcccttatggcccaggagttgccattcatcgatatgttgatacatcaaccatacaagagtgcgttggtatattttatcagccaaatgcttatggttttgctgaagatggctatttattaccgggttctatttgtgcaattgctccccctcctgttggacattgtgatgtgttagcccattctgttgagttggattacggcaatgtgggggaaaatgaattagacaatgcggttcgttctcaaactgtgaatgtgacgtgtaatcgtgatgtctctttacaggttgttgcaacaggaatgaataatcgtcaagtcccactacgtaatgacaatagcttatatgctgatttatatattaatgataaatctggcgaagagggagaggctatctttgtcgctaaaggcaaaatggtttctatacaagtgagttctaaattgagaaccaatggacatgttgctccagggtatttttctggctctggcgcgttgattctaacgttaccataa

SEQ ID NO: 1752 - DNA, 339 bp, Proteus mirabilis
ataagaaattttcttctcaattgtagtaagatgatcactattattcagctaacatgctttatcatcaaaaatattatggctaaaaaaacgacatcaattaaccaagacaccacgcaaactccaagttttgaagcttcgatgcaagaacttgagcaaatagttaaccgcttagaatcaggtgaattacctttagaagaggcccttaatgagttcgaacatggtgttcgtttagctcgtgtgggacaaaaaacattacaagatgctgaacaacgtgttcgcatcttactcaaagaggatgatgacgctacacctgatgattttatccaagaggctgaataa

SEQ ID NO: 1753 - DNA, 285 bp, Proteus mirabilis
catttttattattttaataaatttaaaagccatagtacttcgcggtactatggctttttgttttattacgcagcaaatgtgtgtttcatcttgtcgagagcccgcttataccatcggttgttttctttctatctatctatgcaagttctgctacaccaacaaattgttaacactcttagcgaggcgtttttagattttgtggcacatttttctgctattgtgccaaaaacacattattactttgtctttgtcagtatcaagcatcaatttgctaccaatatttaa

SEQ ID NO: 1754 - DNA, 519 bp, Proteus mirabilis
ttttggtattattttttaaaatattttttccaaggaaacaaaatgacaaaacagcaagtaaccacacaggaattgcttaatggtttaagtgaattgttgcacttaaaagaagcgaataatgatgaaggtcataagaaagtattagcagagaaggggttagaaaattattcactcacagagcttcatgtgatccattgtattggtgaagagagtatgcgtaacctcacaacgatcagtgattatatggcaatgacacgtggggccgtctcaaaaatttgtcgtcgcttacagagtaaaggcgctattgagaaaataaaattagcggataaccaaaaagagatattttttattttaactactgaaggggaaaagctgtttcacactcatgaattgttacatcaacaatctcaggcaaaatggataaccttatttgaacagtatgatcaaaatgaaaggctggcaattaaacgctttttagctgatgttgcaaatcgttttcgccacaagaaaaaagcataa

SEQ ID NO: 1755 - DNA, 402 bp, Proteus mirabilis
atatacagttatttttacaaaaaggagatgattaaaatggataaaaaaacactatcagcatttatggcatcaatatgtttaacattaggtttagggttatcaccactctcttatgccgatgatatatcgccttcaacatcaaccatgttgattgaaaaaggggatcaaaaagagagtgctatcagtgaggtaaacgctagtgcacaaggaaagttggatattaatagtgcaacacttgatgaattaatgacgctaaaagggatcggaaaagcaaaagcgcaagccattatcgattatcgagaaaaagtggggcgttttgcttcttttgatgatctcgccaaggtctttggtattggtatgaagcttattgaacaaaataaagatctaattattatcaactaa

SEQ ID NO: 1756 - DNA, 618 bp, Proteus mirabilis
gatgccattctaatgcaaactagccctcttcttgaatcattaatggaagcgttgcgttgtttacccggcgtcgggccaaaatcagcgcaacgaatggcttttcatctgcttcaacgtgatagaagcggaggaatgcgacttgcacaagcattaacgcgtgcaatgtctgaaattggtcactgttgtgattgtcgaacatttactgaagaagagcgttgtacgatctgtgctaatgctcgacgtcagcaaaatggtcagatatgcgtagtggaaagcccggcagatattcatgctatcgagcagacagggcagtttgcaggtcgatactttgtattaatgggacatctatctccgctagatggcattggtcccatggatattggcttagatagacttgaagagcgtctaagccaagagcctatatcagaagtgattttagccaccaatcctacggtggaaggtgaagctacagcaaactatattgctgagatatgcgctcaatatgatattgctgctagcagaatagcacatggcgtgcctgttggtggtgaattagaaatggtggatggtaccacgttgtcacactctatcgcgggacgccagaagatccactattaa

SEQ ID NO: 1757 - DNA, 1068 bp, Proteus mirabilis
caaaaccttttgacaataatgttttttatcagccctgtcttattggttttttctttatttttcactcattgttggaaaactgatggcatgttgattactttgtctcttctcattgttgggttgatgttattagtctatgcatcagaccgactggtgtatggtgcaagtgtgtttgctcaatcattaaagctccctcctgccgttatcggtattgttattgtgggaatgggtacttcattgccggagctttttgttgcaaccgacgcggccatccacaatttacccgagatagcgataggtacagcaataggatcttcattaacgaatctgctactgattgctgggattggagcgatgatttatcccatgaatatccaatctgcggtactaaaaaaagaacttcctttgatgattatagtcatcttattagcaggactggtggtttctaatagtcatctagggttgagagaaggctgtttactttttttcatcggcttcgcctctctttttctaatgataaaaatgctccataaaaccctaacacaagtgcgccatgtgttaccgctagagacactttcacgttttgaattacaaactaatccacgtaattctgttgccctattttgggtggtaattgcattactgataatccctgttgcaacaagaatgatcattgataatgtttttatcatcatgcaacagtatcatctcagcggttttttagttggactaaccttgctatctattggcaccagtttacctgaattagcaacgaccgttgtggcagccttaagacgtgaaaatgaactggctctaggcaatattattggcgctaatatttttaatctcacctttgtgctaggcatgcccgcattactctctcctagcacatttaatatgcaagcattctattttagttttactgtgctggtggtcgcgggcctacttttctcactcttttcattggggcgcaaacagcggctaaaccgtggaaaggggattttcttattagtttgttttattgtttatattacggtgttgtgcgttgcacattctctcttaacctaa

SEQ ID NO: 1758 - DNA, 660 bp, Proteus mirabilis
aagagttctctatataagaataaggaagatattatgagttggccttttctcgctgtcttattttctgggtggctttatatcgatgccgcgtatcgtggccctaattggcaacgatggctattccgtcctattacactactactattactcctttgggcatggcaagtccctgagcatagcattaatagttatcttattgtcggcgctttattagcaacattactttctgatgtattaaaaatgtttgaaggtaagtatttactaccttctttagccttgttattcctaagttatattctctacctaattagttttgccttaccattacaaatctctttttatcttcctttgcttggttttgttatcgttgccgcaattatcgtgttagccatcatctggactaaactggataaatttgccattcctgtattactgactttattagcggcttttgcgatgttttgggttgcaggagagaaattcttctacctgagcaacgactacaacttttctatcatgataggctcactcttgttagtaattgcttactctatttggcttatcaaccgtttccgcttctctttttcagcctctaaaggactggtaagtgcctgttactttattggtcacttctttattgttagagccctttttctgtaa

SEQ ID NO: 1759 - DNA, 222 bp, Proteus mirabilis
cggattgattttgtcttttttagatatcagagtcaacaagaatatttattagttatttatgtaacatgttgttttaatttgattaattttaaaaaaatactaccagtaaggtatagaggtgagggaaaattctgctactatagcggtgggtgcttggatcgttttggttcaagcattgcgctagagccaaaaagacaaaagccccgaattttattttcataa

SEQ ID NO: 1760 - DNA, 1149 bp, Proteus mirabilis
aaatcatcatatcaggagagatatatggccttggggaataatgttttttcccaacatggtattaaccgacgcgattttatgaaattgtgcgcagcgttatcagctaccatgggattaagcggcaaagcagccgcgcaaatgtcacaagcaatgacatcacctgaacgtccacctgttatttggattggtgctcaagagtgtacaggttgtacggaatctttattacgtgcgactcacccaacacttgaaaaccttgttctggatgttatcgcacttgaatatcacgaagtgctctcttccgcttttggttatcaagcagaagaaaacaaacataatgcgatggagaaatacaaaggtaaatacgtccttgttgtcgacggttctatccctgacaaagatggcggtatttactgtatggtggcaggcaaacctattcttgagcatatcaaagaagccgctgaaggtgcggcggcaattattgctatcggttcttgttctgcatggggtggtgtgccagcttctggaggtaaccctactggcgctaaatcactggaagctattttaccgggtaaaacagttatcaatattccagggtgtccaccaaacccacataacttcttagctacagttgcacatattattacctttaattcattacctaagttagatagcaaaaacagaccgctatttgcatatgagcgtctaatacatgaaaactgtgaacgccgtcctcattttgatgcgggtcgttttgctaaagaatttggtgatgaaggacaccgccaaggctggtgtttataccatttaggttgtaaaggacctgaaacttacggtaactgcccaacattagaattttgcgatattggtggaggaatttggcctgttggtattggtcacccttgctatggctgtaatgaagagggtgtcggatttacgaaaggtattttccaacttgcgaatgtttatcagccaacaccaaaagcacaagtacccgatgttaacgccaaagaaggtggtggtgtttcttatggtgcagcaggcttattaggtgcagttgttggtgctgttgctggggtaagtgtgatggctgtgcgtcaattaggccgtgacaaaaataccacaggagcctcacaggaggataaacggtga

SEQ ID NO: 1761 - DNA, 729 bp, Proteus mirabilis
tatataaaatatcaactcaataacctctcgcttttaatactagttatgcgagatatcatcgatatgttttggatacattctctggagagaaacatgaacaaaaaattactggcatctttaattctagcaggtcttgttaccattacagcaggttgtgatgattcatcgaaaaaagtggatgaaggtattgataaagcaaaagagacagcaacccaagtaaatgaaacggctcaagacaaagcaaaagaattaacagatcaagctaaagaaaaagccgctgatttaaaagagagtgcatcagcgacagctgacgaattaaaacaagatgcggccaagctaaaagagcaagctgaagataaagctgcagagcttaaagcacaagccgatcaaaaaaccgatgcattaaaagagagcattgcacaaaaaacagatgaactaaaagattctgcaagtgcaaaagcagatgaaatcaaacaaagtttaaataatgaaagtgacaaactggctggtaaagcagaagaagtgaaacaaaacgctaataccactgcagataacttaaaacaaaatgctagcgacaaagcagcgcaactaaaagaagatgcggctaaaaccagtgatgatgtaaaacagcaagcgcaagatactaaagataaagcgcttgataaagccgatgagctaaacgatcaagcaaagcaaaaaattgattctctaaaggctgataataaataa

SEQ ID NO: 1762 - DNA, 522 bp, Proteus mirabilis
aatataaaatatgaagatgatagattttttttaatggtcaaggaaacttttaaaggtaataacccaataagagcaattatcataagatacttagaacacctttttactaatctgaacgatgatgaaatgaataatcttaaaaccctattaagaggtgtattccttacatctggggcactagtaacaacaggaggagttcgtgtttacatagccacagccgcatctgaacttatatataatacggtactaagaaatgccattgcccacaagttaattagaggtggtggaaatatagcaatggcttttgtgggagggtatggcatcatagagatggcttctcaagcaaaggaaagattacgctatagcaatcctactctgtattatgaccttgttttaatgaatttagaaatggggtattttatagtagaaccaaatatatcaaaatggttatatatgataggatctgaaaagaaaagtgttgatgaagtttatcgagcaataaatggattaatttataattaa

SEQ ID NO: 1763 - DNA, 678 bp, Proteus mirabilis
gaaatggaatattatctgcttgtggttatcaagtttattattggttttacaataattttggctcatatgaatatttcagggaagacacaactctctcaactaactcccattgattttattggtaattttgttttaggggggattatgggaggggttatttacacagatgcaatcccgctttaccaatatgttattgtctttttgataggtgtattttttatttcttttctcaattatatcagtaaaaaatttaattttttccgagcagtagcgataggtaatccgatcccgattattaaaaagggaagatttattatggaaaacattactgagaagaaaaataagattgatattcttaatatcacttctaggttacatgcccaaggaattcattcttttcaagaagttaattatgctcaaattgaacctgatggacaaataacggtggtgtgtgatggtgctaaaatgccctctatcattattatgaaagatggtgttatccgaacttctgaacttgagcagatagaacgagatgaaaattggttaaacgaagagatgaaaaaacaacatatagataacccagaagatgtttttttagccgaattttgggatggtaaagtcaatttcattttgcaagacggtaagatcaaacacgatttcattccgactgctgagtag

SEQ ID NO: 1764 - DNA, 702 bp, Proteus mirabilis
ttcgctagatatgggagcacaaaaatgaattacgttaatatgttgttttttgatatctacccctatattgctggtgctgtttttcttatcggtagttggttacgttatgattatggtcaatatacatggcgtgcaggctccagtcagatgttagacaagaaaaacatgcgacttgcttcgaacttattccatattggtattatcggcatttttgcaggtcattttctggggatgttaacgccacactggatgtatcaatcttttctaccaattgaatataaacaaattatggcgatggttggtggtggtacttgtggtgtgttaatgctgattggcggcattatgctgttaaaacgtcgtttgacgaatgcacgagtaagagcaacatcgtcatttggtgacatcatgatcttaaccttgctggttgtccaagttgcactcggcttactgactatcccattctctgcacagcatatggatggtagtgagatgatgaagctggtggcatgggcgcaagctattgtgacattccatggcggtgcttcggcaaatcttgaaggtgttgcacttatttttaaattgcacatattcctaggtatgacgatttttttattgttcccattctgccgtttagttcatatttggagcgtgccaattgagtatctaacgcgccgttaccaaattgttcgtaatcgacactaa

SEQ ID NO: 1765 - DNA, 546 bp, Proteus mirabilis
ctcattatgtatcatgtcattgcagccactacgaatccagcaaaaatcaacgcgatcaaactcgcctttgagcaagtgttcggtaaagatacctttgatattgaagatattaatgtcgatagccgcgttccacagcaacctattggaaatacagaaacgagaactggcgcacgccaacgtgtgatggccgcaagacaagtacgtccagaagctgacttttgggtaggtgttgaagcgggtattgaagacgatatgacttttgcttggattgttatcgaacacgagcaaattcgcggtgaatctcgctcagccagtttaatgctaccggaacagattttaaaaggcgttcgtgaaggtcgtgaacttggcgatgaaatggcatttttaaccaagattgataatattaagcaaaaaggtggcgctattggttattttactgatggtttattaagtcgcacttctgtttaccaacaagcgattgtattagctttagtgcccgtcactcatgatatttataaacaacttaacaaaaaagatgatgaatga

SEQ ID NO: 1766 - DNA, 1749 bp, Proteus mirabilis
ggcgtggctctattttcacagctcagttggtattttatcagcgaatggcgtcgttatgtcggtgctattttcttattgatggttatcgccgttctacaagtgatccctccgaaaatcgtcgggattattgttgatggtgttgatagccatagcctgtcttttcagcaaattatggggtggatcgggatcatggtattgatcgcccttgctgtctatttattacgttatatttggcgactgtggttatttggtgcttcttaccaactggcggtgaaattacgtatgcaaatctatcgccaacttagccttcaatcatcggctttttatcaacgctatcgcacgggtgatttaatcgcacgtaccactaatgatgttgataaagtcgtttttgccgcaggggaaggggtgttaacccttgttgactctatggtaatgggacttgcggtgttagtgatgatgagtattcagttaagttggcaattgacacttatctcattgttacctatgccattaatggcaatattaattaaacgctatggcgataaactacatcaccgctttaaaagtgcacaagcactattttcttcattgaataatcaagcgcaagaaagtttaagtagtattcgtatgatcaaatctttcggtcttgaacagcaacatgcttcacgttttgaaacggttgcaaaagagacgggtcgacaaaatatgcgagtggcaaaagtcgatgcattgtttgaccccacgatttttatggcaattggttttgctaacttacttgctgtggcgggaggaagttattttgttctcaatggcacgatgacattgggagaattaaccagttttgtaatgtatttagggcaaatgatttggcctatgttagcactggcatggatgtttaatattgttgagcgtggtagtgcggcttatagcaggatcaatgcattacttaatgagcaaccggctatggttgatggtcaattatcaccaatgcatcaaaaaggaactttagcggtagatattaaagcgtttcattaccccaaacagcaagttgatgtactaaaaaacattcattttacactctctcctggtgagatgttgggtatttgcggtatgactggggcggggaaaagcactttgttagcgctgatccagcgcttatatgatgtcagtgaaggggatattcgttttcaatctgtccccctttaccaattaaaattggatgaatggcggggaagacttgctgttgtcaaccaaacaccgtttcttttttcggatacgattgccggaaatatagccttaggacgccctgatgctaccaaagaagagatagaggcagtagccaaaatcgccaatattcacgatgatattttaaatttacccgaaggatatctgactcaagttggtgaaaaaggggtcatgctctcggggggacaaaagcaacgtatttccattgctagagctttactgttagatgcggaaatcttgttattagatgatgcgttatcagccgttgatggacaaactgaataccagatcttacaaaatctggctcaatggcgtaaagagaaaaccattattattagtgctcaccgtttatctgcactggttgatgcaacaaatatattggtattaaaacaaggcgaaatcatagagcaaggtactcatcaaacacttattgcaatgccaggttggtatcaagatatgtaccattatcaacaactcgaggccgcattagatgacgataaataa

SEQ ID NO: 1767 - DNA, 285 bp, Proteus mirabilis
ataaaaaagtatgatttatttaaggataaaaatagtttatttttgatttctatatggaattacggtgatggatatttagaagaaggaaaatacgatcgattatgttttactgaaattaaaagtaacaaaaaatgtatagaaaaagataaagtgatgtcaataatgtattctttaaatgaagaggaaattaggataggtaattctgcatatattaaagataaaaatggttcttttataaagaaagacaaggatgctaatacaactatcactgcaattcttgattga

SEQ ID NO: 1768 - DNA, 993 bp, Proteus mirabilis
aataaatggtacaaaaaaatgaccggatttgattttcagcaagcaggtaaaaaggttcttcaaattgaacaagaaggattagctgagttagcacaatatatcaatgacgatttttctcttgcctgtgaaaaaatctttcactgtcagggaagagtgattgttatgggcatgggaaaatcaggtcatattgggcataaaattgccgccacctttgccagtaccggcaccccttctttttttgttcaccccggtgaagccagtcatggcgatttaggtatggtgacagaaaaagacattgtgctggcaatttcaaattcaggtgaagccagtgaaattctcgcccttatccctgtcctcaagcgtaaacagatccttttaatttgtatgacacgctcacctcaaagtacaatggggaaagctgctgatattcatctttgtataaaagtccctaaagaagcttgtccgttaggtttagcccctaccaccagcacgacggcaacactggtgatgggagatgccttagctatcgctttattgcgcgctcgaggttttacggcggaagactttgcactatcgcatcccggtggtgcattggggcgcaaattattgcttcatgtcagtgatttaatgaataaagaggatgatattccacgcgtcagcaaagaagcgacattacgcgaagcactggtagagatcacccgtaaaaaattaggtatgaccgttatctgtgatgataatatgttgattaacggtatttttactgatggtgatttgcgtcgtatctttgatttaggtattgatcttaataatgccaaaatatcagatgtaatgacgaaaggcggaattcggatttccccagatagcttagcggtagaagcgcttaatttaatgcaagcaaaacatatcacttcactgttagtcactgaaccagatagtgatattttattaggtgttttacatatgcacgatttattgcaagctggggttgtttaa

SEQ ID NO: 1769 - DNA, 1311 bp, Proteus mirabilis
ttcagtaggtatacagcgtacagcaaaataaaaaagagagttctacagatggataaatttagagtacaagggcctacctgcttatccggtgaggtcactatttcaggcgcaaaaaatgctgcactaccaattctgttcgctgctatccttgccgaagagccagtagaattaaccaatgttcctaagctaaaagatattgataccaccattaagttacttaatcgtttaggtactaaagtcgaacgcaacggctctgtttttgttgatgctcgtcatatcaacgaattttgtgctccctatgaattagttaaaacgatgcgtgcctctatttgggcattagggccattagttgcacgtttcggacgtggtcaggtttctttgccgggtggttgtgcgattggtgcgcgcccagttgatctgcatattacaggtttagagcagcttggtgcggaaattacgctggatgaaggttatgtgaaagcgcgtgttgatggtcgcttaaaaggggcacatattgtaatggataaagtgagcgtaggtgccactattaccattatgactgctgctgttttagccgaaggtaaaaccattattgaaaacgcggcgagagagccagaaattgaagataccgcgaattttcttaataccttaggcgcaaaaatcagtggtgcaggcaccgatagcattactattgaaggggtcgaacgccttggtgggggaacctatcaaattttaccagaccgtattgaaacagggacattcttagtcgcggcggcggtttctcgtggtcgtgttgtttgtcgcaatgctaaaccagatacgcttgatgcggtattagctaaattacgtgaagcgggtgctgatattgaaacgggcgaagactggataagccttgatatgcatggtaaacgtcctaaagcggtcactctgcgtacggcaccacatcctggtttcccaaccgatatgcaagctcagtttagtcttttaaatcttgtggctgatggagcaggaatgatcactgaaacgatttttgaaaatcgttttatgcatattcctgaacttatccgtatgggggcccatgctgaaatcgaaagcaatactgtactttgtcatggtgttgataagctttcaggcgctcaagtgatggctaccgatttacgtgcttctgccagcttagtattagccggttgcattgctgaaggtacgacgattgttgatcgtatctatcatatcgaccgtggctatgaaaatattgaagccaaattacagggtttaggggctaaaatcgaacgtctacattctaatgactaa

SEQ ID NO: 1770 - DNA, 564 bp, Proteus mirabilis
caaaacaggtacaaagcccaaatgaaaaaaacagatccattgagtttgtttaaaaaacagatcgacaatctcgccgaaaccttagcgccaattgcaaacaaaaaaattgcagcaccttgcttcgacacagcactatttcaccaccgcagtgattctcttggtggttatatgcaacagatccgcgataattttactcagttaataacttgtgttgaggcacaacgtagccagcaagttaagtttctggcaacacaaatgctacaacaaattgaagcattaactcgtgaattatcgacacaaacactaagaaagcaagaaaaccagcttagtcaacgcaaaaaaagtgtcgatttataccaaaaacttgcccaacatcaggattacgagcgccgattacagtcgatgatccaagatagagagcttgctttaactcaagcacaaggctttgtacgccaacaagaattacaaaaagagattgctgctcttgaaaatcgcctagcgcgttgtaaaagtgccctagtttctatagaaaagagtattgaacgacaagaagataaatattaa

SEQ ID NO: 1771 - DNA, 2031 bp, Proteus mirabilis
aaaaggtatctgatggcacactattcttatttatttactccccttgatttagggtttactacgcttaaaaatcgtattttgatgggctcgatgcataccggactagaagaagatccacatgatgcacctaagcttgctgaattttatgctcaaagagctgcagcaggggtggcacttattgtcaccggtgggatctcccctaataagcaaggtgtattgttgccacatgcagcaacgctaatgtcagaagatcaactcgcttctcatcaattagtcactgatgcggtacataaacaggatgggaaaatcgctttacagattttacatactggtcgttatagttatcagcctaatttagtcgccccttcagcgatccaatcacctatcaccccttttatgccccaagcaatgagtcatgagcagatagaacaaactattgaagattatattcattgcgctaagttggctcagaaagcaggctatgatggtgttgagatcatgggatctgaaggctatttaattaaccagtttttagtaagtcatacgaatcaacgcgatgatcaatggggtggctctattgaaaatcgttgtcgttttgcattacgtattttagctggcataagagaagctgtgggtgaacactttatcattatctatcgtttatcaatgttagatttaattaccgagggagctaatgcctcagaggtattttatcttgctcaagcagtagaaaaggccggagcaaccctaatcaacagtggtattggttggcatgaagcccgtatccccactattgccactatggtaccaagaggacaatttgcttatgtcactcgccaattgatgggaaaaatcaatattcctcttatcacttctaatcgtatcaatacacctcaagtggctgaagctattttagcggaaggctgtgcagatatggtgtctatggcgcgtccttttcttgccgatccgcaattcgtattaaaagcgcaacttggtcgcgaggatgagataaacacctgtattgcctgcaaccaagcctgcttagatgagatattcagtggtcacccggcatcttgtcttgtaaacccttttgcctgtcgagaaacagagcttattttaaccccgactcaagcccctaaaaaaattgctgtcgttggcgcaggccccgcaggattagcatttgccattacagcagctaaacgtggtcatcatattactttatttgaaaaagaagaccgtattggtggacaactcaatattgccagtcaaattccgggtaaagaagaatttaaagagacattgcgctactttaagcggcaattgcaaatcacaggggtgatcgtaaaaaataatacggaagcgacactttcccatctgcaacattttgatgaaattattttagccagtggtgttatccctcatattccagagattgatggccatgataatccgatagtaaaaacctatcttgatgtccttaaataccatcaaccaaccggcgaaaaaatggtaattattggcagtggtggtattggttttgacactggcctttatcttacccaaactggccaatgcagtagtttaagcccttgtgcatttaataaagagtggggaattgacccaacacttacgcatcgcggagggatcacctcagcccatccttttattaaaaaagacaaacagattgttatgacgcaacgtaaaagtgggaaatttggcttaagtttaggcaaaacaacaggctggatacatcgcttaacattgcagaaaaaaggggtcaaatggctaacgggctgccattatcaaaaaattaccgagcaaggggtaataattgaacataatgaacaacagcaactgctcgcggctgatagcgtgattttatgtaccgggcaacaatcttatcgtccgctactgcaagcgttacaacaagaaaataaaaccgtccatcttattggcggggcaaaagaggctaaagcattagatgccaaacgagccattaagcagggaacagaattagcacttactatttaa

SEQ ID NO: 1772 - DNA, 1530 bp, Proteus mirabilis
atatattttcagtatgaaaataaacttaacctaaatttatatctggaggatattatgggatcttttttattaaaaaaagccgttgggttatctaatatttctgatttattagataaaagcgggatcttctataactattcaaccaaagtattaccttcttttgattatgataccgcaggaaaacatatagcccgtgaagattccacttggaatggcaaatatgttattgggcaacccgctgaggtgacttattcattcccaaaatgggaaggcaaatttaatcaatttggtaataagaatccttatgaatttaatgaattacaaaaagagcatgcaagaaaatctttagatgcatggtctgacattgcaaatattaaatttactgaagttgctgttgggaatgttgatggaatgaaggcttctgacgtaaaaacagatattacttttggtaatatctatgatcccaatggcacatttcaggcttatgcaacattgcctaatacctatgcttatggaaaagatctttctggccaagcatggtttagtgattatcattatgcaggtaatactacaccagaattgggtaattatggtcgtttaactattatccatgaaattggtcatacactgggtcttatgcatcctggtgattataacgcaggtcagaatgttccaggttatttaaaatctgattatgcggaagatagtcgccaatatacagtaatgagctattgggatgaatatgaaacaggcgcccacttccaaggtgcttatgccggagcccctctccttcatgatatttctgctatgcaatatctctatggcgcaaatacgactaccagaacaggtgatgatgtatatggtttcaattcaaatactgggattgattattatacggctactgatagcaatgataaattaattttctctgtatgggatagtggtggtaacgatacatttgatttctcaggcttctatcaagatcaactgattgatttacgtgctgggaacttttctgatgtggggggattacagaaaaatgtttctattgcacaaaatgttaccatagaaaacgcaattggtggttttggtaatgatattattcatggtaatgatgctgataatactcttattggaggcgaaggagacgatattatctatggccatagtggtaataacactatttatggtggtcgtggacaagatacattacatggtggcacaggaagcaatacctttatttataaagaaattgcagattctttagtatcagccgcagataaaataatggatttcaaaaccggtattgataaaattgatttatcaacattaattcaagatacatttagtagcaaaattcttaactttgttgataattttacaggaaatgctggcgaagcaactcttagctataatgaagtaaccaatgcttctgaattagccattaatgcttatggctataattataatcctgattttaaaattgatatcgtaggttttgttaattacgaaactgattttattgtttaa

SEQ ID NO: 1773 - DNA, 1176 bp, Proteus mirabilis
gttactcttcaaaaaacactaaccaaaaataggttattaatcatgatattacgatttatattttctattgtattgttgtattcatcaatggcttacgcttactcacagcaagttgtaacacctgttactgatctacttggcagaaccgtgaatgtcaaattaccggtacagcgcgtcattttgggggaaggacgacagctttatttagtggctatgtttgataaagaaaatccagcacaaaggatagtcgcttggcgaaaagatttaatacagtccgatccggccacatggcaacagtaccgacaacaatttccacagttggcaaaaatccctacctttggtggcagcgaacaaggaacgtttgatatagagcaggcgattaatctgcaacctgatgtcatcatcatgaatatggacgcacgcaatactattgttgatgctggacacgaagctgcactagcccgagcgggtattcccattgtttatgtcgactttcgctatgatcctattgcacacattcctccaacagtgacgttatttggtaaattatttggccaaccagatcgcgcagaagcttatttaacattccgtgataaagagttacaacgagtgacatctcgagttgaacaattacagggggcattgccaaaagtatttttagagcgtcttgggggctattcagaagagtgctgtatgacctttggtaaagggagttttggccgttttgttaaaatagcggggggggataatattgccgacaatcttgctccgggaaccttttttacgctaaatccagaaaaagtggttgttgcaaatcccgatattgtgattattaccagcggcaattttcaggcatttgtgccgggtggaaagtggatcccacttgggccggggattaatattcaacaatcaaaacaccgactcgcatggtttacgactcgccctgcttatgttgatagtaacgctcgtcgtcgtggcgcattttttgctatttggcatcagttctataatagtccctatgatgttattgctatccagcagctagctaagtggatacatccccaattatttgctgatcttgatcctgatgacacattccgtcgtttacatcaagaatttctacccatctcatatcagccgggatatatgattgatttggaaaaagaggggaggtaa

SEQ ID NO: 1774 - DNA, 1005 bp, Proteus mirabilis
gcattgcttcatatgaaattgataatgccttgtggtgaattctccctcattaaacaatatttcacttctcagccagttaaacgcaaagatgtgagtacgggaattggggatgactgtgcaatattgactgtacctgaaaagcaacaagtggcaattagtactgataccttagtcagtggaatacacttcctaccaaccatttcccctgaagatttagcgtataaagcattagcggttaatattagtgatttagccgcggtgggggcagatcctgcttgggcctcattagctttaacattgccaaaagtcgataatgattggcttgaggcctttagtcgctctctatttgcattagcagagtattattctattcaattgattggtggggatacaaccaaagggccattgagcttaactatcacaatacaaggcttggttcctcaaggtatggcactattacgctcaggggcaaaaattggtgactggatctatgttacaggctttttaggggatagcgcggcaggactcgcggttttacaaaatagattacaacctagtcaaccagaaagccgagactattttattactaggcatttgcgtccgcagcctcgtcttttacaggggcaagcattaagatctttagcaagtgcagctattgatatttctgatggtcttatttcagatctaaaccatattttaacggcaagtggttgtggtgctcgtattaacttagatgcgttgccttattctgcggcaatgaaatcacaggtgagtaaagagcaagctgaaatttgggcattaagtgggggcgaagactatgaactatgctttaccgtgcctgaaataaatcgtggggctttagatattgctttagcccatacgggagctgactttcattgcatagggcaaattatgccaattgcagaaggtatacgttatttacgtgaaggtaaagaagtgcaccctaatctgaaagggtttgatcactttggtgataataaataa

SEQ ID NO: 1775 - DNA, 975 bp, Proteus mirabilis
aacctttatcatttgggtcgttggatgagacttatgaaatacataaaaagtattgggacactctcgctattagcagccgctgttcttttaagtggttgcgatatggcgttaatgaatcccaaaggcgctatcggcgctgagcaaaaaacattaatcctcattgcgcttggtttaatgttgattgttgtgataccggtaattctgatggtgattgttttcgcttatcgctaccgtgaatccaatactaaagcaacttatcgccctaattgggctcactcaaataaaattgagcttgtcgtgtggaccgtgccgattatcattatcgtgatattggcaaccatcacatggaaaacaacccatgaacttgatccctataaaccactagtttcagatgagaaaccggttaccattgaagtggtttcaatggactggaaatggttgtttatctatccagaacaaggtattgcaaccgttaacgaactggctttcccaaccaatgttcctgttaatttcaaaattacctctgattctgtcatgaactcattctttatcccgcgcttaggtggacaaatctatgccatggctggaatgcaaaccaaacttcacttaattgctaatgaaccaggtgaataccaaggtatgtcagcaagttatagcggacacggtttctctgacatgaagtttaccgccattgcgacacctgatcgtgcaggctttgatgcatgggttgcaaaagtaaaacagtcatcagatacgttaaataccaccgctgcatttgatgaacttgctaaaccaagccagaaaaatccagtgacctactattcaagcgtgaagccgatgttattccaagagaccatctctaaatttggtcatacaggtcatggcgctcacaccggtagcaatcagactgaacactctgatgcaacaatgaatatgaacatgagccacgcggcacatgcaggagcagaggaataa

SEQ ID NO: 1776 - DNA, 483 bp, Proteus mirabilis
caatgccatcacattgaagataaaacaagatataatatcaatttcgtagagatatggagatcaaatttgaataaggttattaaatttatttttattgttctattacttgtagggtctattctgaatatacccattttatttgtagataatcatttttcatacacaaaacatgatttcattaggtataatttatttacctttgatgaaatcaaaaacgctcctattatttcaagcaattacattatattttacgactcacctgatggtgtagtaccaatgactaattcaattctattttcaaatgtaaatccaaaccgtaaaatagaattgataaattatattgaaaatctaggttatgtaaaagatataaatgcatattggaatacagatggaaatgaatcctggcgtaaagacaatttatttatacaaataaaacaaattaatagtgaacatacgattttattcttagtggagaaaaattaa

SEQ ID NO: 1777 - DNA, 882 bp, Proteus mirabilis
acaatgaatcaacctaatcgagcagcggtaacgacatccacactgtacatagtacccacacccattggtaatctgggcgatatcacccagcgggcacttgatgtgctgtctcatgtcgatttaatagctgcagaagatacccgtcatacagggcttctattacagcattttgccattaacgcacgtttgtttgcgttacatgatcataatgaacagcaaaaagcagatcaattaattagcaaattacaacaagggctaagtatcgcattagtctctgatgcaggtacaccattaattaatgatcccggctatcatttagtcaatcagtgtcgcaaaaacggtataaaagtggtgccattacctggggcatgtgcggcaattaccgcgctatcagccgccggattaccttctgaccgtttttgttatgaaggttttttaccagcaaaaacaaaaagtcgtcaagattgtttgcgtgatttagcacaagagccacgtactttaatcttttatgagtccacccaccgtttattagatagtttagcggatatggtgacggtttggggggaagcgcgctatgttgtattggcaagagaattaaccaaaacgtgggaaaccattcaaggaatgcccgttggggaattacttaactgggttcgtgaagatgaaaatcgccgtaaaggagaaatggtattaattgtggaagggtatcaaaagccacaagaagaccattttgccccagaagtattacgcacattggcgattttacaaaaagagttacctttgaaaaaggcggcagcagttaccgctgagatttatggcgtgaagaaaaatgcgttgtacaaacacgtcattgcgcaaaatgaagcggaacaagatcagtaa

SEQ ID NO: 1778 - DNA, 192 bp, Proteus mirabilis
gtttatgatcaattttcactgaatcacctctcactttcccgtacaatccttcccattcgttttaatcctataaagattgggagaacagatggacaagcgttttgttcaggcccacaaagaagccctcttggccttagtgcttacttttatctacttattgggttggttacttactgcctatttacccgataa

SEQ ID NO: 1779 - DNA, 921 bp, Proteus mirabilis
ggggaatgtcagatgctgtggtttaaaaatattttggtctatcgcttaaataaagagatagcgctgtcaatggatgagttagaacaacagctggcttcattagcattcaccccttgtagtagccaagatatgaccaaaacgggttgggtttcacctatgggtgatcgtggcgaagcacttatccatgttgcaggtaaacaagtcatgatgtgcgcacggaaagaagataagatcctccccgccaccgtcattaagcaagcgctacaagataaagttgaaaagttagagggtgaacaaggtcgtaaattaaagaaaaccgaaaaagcgacattaaaagatgaagttgtccacacgttacttcctcgcgcatttagcaaattctcacaaacctttatttggttagatttagataagcaattagtgattgttgattcaggtagtgcaaaacgtgccgaagataatttagccttattgcgtaaaacattaggttcgctgcccgtggttccactcaattttaatgagtctgtcgaatcaaaaatgacacaatgggttcgttccggtgaactccctgctggttttacattaatggatgaagccgagcttaaagcggtattagaagaaggtggcgtgatacgttgtaagaaacaagagcttgtctctgatgaaattgccactcatattgaagccggtaagtttgtcaccaagctttctcttgattgggaagatcgcctgcaattcatgctttgtgatgatggctctatcaagcgcattaaatttagtgataccttgcgtgagcaaaacgatgatattgataaagccgattttgcccagcgttttgatgccgattttgtcttaatgacaggtgaactaagcgcgctaattgaaagggttaccgaagtacttggtggtgaagccgagtaa

SEQ ID NO: 1780 - DNA, 1413 bp, Proteus mirabilis
tgttcacgtcagctaatgtggagtattatcatggatgcgtccaatttagccccatcggcgaaatcaagcccgataaacaaacgagggttaattattttagcaatcgacgttgtactactgctgttattgctagaatttttaccctacgatccaaaagctaatgcaggtttagcgttaatggtgtttgtgggtgtgttatggctgacagaagctattcacgtaactattacagcgttgtttattccaatccttgcggtagtgctcgggttaatgaacaccaatgaatcgctaaaatcttttgctaatccgattattttcttattcttcggaggatttgcattagcaacagcgcttcatattcaaggattagatcgcttaatcgctaaccgcttattgatgattgctaaaggcaagctctccattgctgtcttgttactttttggggtaacggcattactctcaatgtggatcagtaacacggcaactgcggcaatgatgttaccgttagtgttagggattttatctaacttagatattcgttcagaacgtaatactttcgtctttgtactattaggtgttgcttatagtgccagtatcggtggtttaggtacgttggtgggtagcccgccaaatgcaattgctgctgctcaactaaatttagattttattacttggatgaagtacggtgttccaatcatgttagtgctattgcctatcatgtttattgtgatgtatctgatgctacgtcctaacctaaaacataaatttgatctgaaattagaagtgttagagtggaataacaaacgtgttattaccatgattatcttcttagtaacggtattttgctggatctttagctcctttatcagtagcgctttcggtggtgtgaaagatttagataccgtcattgcagtcagtgccgctattgttattggggtgacgggtgtcgcaagttggagtcaaattcaggaaaatacagagtggggcgtattaatgctgtttggtggtggtttaacactgagcgcaattttacaatcttctggtgcaagtttggttatggctgattttatgaaagatacttttggtaacagccattggtttgtcattattcttgctgtaacaacctttattattgttttaactgaattcaccagtaataccgccagcgctgcgttacttgttcctatctttgcaacggtggcacaagctttaggtatgcctgttatggcgttaacgatgattattggtatcggtgcatcatgtgcctttatgttaccagtggcaacgccacccaatgctattgtatttggctccggatatattaaacagacagagatggtacgtgtaggtggggtacttaaccttgtgtgtatcttagttatctctctctttgcttggttcttctggttataa

SEQ ID NO: 1781 - DNA, 696 bp, Proteus mirabilis
agcatgatccaaattcttgcggtcttaattgtcgttattattgtcgctagaatgatcttaaaaggatataaagccgagccggttttgttagttgcaggtttagtcttaatggcgctaacaatgatattgggttggggagatattctacctaaaaatgtcaaaacaaccggtattagctggctagatccctttgaggttatgcgtgatctctttagtagtcgtgctgcagatttaggtctgatgatcatggcactcatgggattcgcccattatatggatcatattggtgctaatgaagctgttgtacgtgttgcaactcgcccattgaaaaatatgcgctcaccttatgtgttgttatttttctcttttttactcgcgagtattttgcaacttgctattccatcagccacaggattggccgttctactaatgggtaccatgttccccattatgataggactaggtttatctccagcatctgctgccggtgtcattgcaacttcattaggcgttgcttacacgccaacagcgattgatgctattcgaggtgcaaaagcggttgacttaggcgtggttgagtatgtgctttactaccaaggtcctgcagcgattgcaactgtattagctgttggtattacccatatcttctggcaacgccattgtgatcgcaaagcgggttattgtacccccaattag

SEQ ID NO: 1782 - DNA, 471 bp, Proteus mirabilis
caacacccccacctaatccgtgggggtgttgttttgcattggaacaaattggagtgtggtatgacaaagccaacaattatcatcaatgaacttgatgcagaacgtttagattcattactagagcaacctgcctttgcagacagcccaattgcagaagctttaaatgaagagttagatcgtgctgacattgttacaccagctgatatccctgctaacatcgtcaccatgaacagcaaagtccgctttatggacttaaaaaataatgaagagcgtattcgtactttagtttatcctgcttcattaaaagatagtgcgactgaattatcagtcatggcgccaatgggtgctgcactattaggtttagctatcaatgatgagatcagttggcagcttcctaatggccttgaaactaaggtcaaagtattagaaattctctaccaacctgaagctgctggtgaattacaccgttaa

SEQ ID NO: 1783 - DNA, 336 bp, Proteus mirabilis
atgagttttttcatttctgatgctgttgcttctgctggacaagcagcacctgaagcaagctttatgtctattttaccgatgttagtgatctttattttaattttctattttatgatcctacgtcctcagcaaaaacgtactaaagaacaccgtaaactgatggaatctatcggtaaaggtgatgaagtgttaactactggtggtttaatcggccgcgttgttaaagtttcagataacggctatatcgttgttgctctgaatgaaacaactgaagtaactatcaaacgtgactttgttgccgctgtattaccaaaaggcacaatgaaagctatttaa

SEQ ID NO: 1784 - DNA, 1908 bp, Proteus mirabilis
ttttttcaccaaacggagcctagtctcgttatgatggacaacattcgttcaactgctaataatccttttattaagatactattagctgtgatcatcctctctttcgtcctaactggtgtgggcggatatctctttagttctggtgttaatgatgccgctgaagttaacggttataaaataagtcgtgctcagttagagcaagcttatcaacaacgccgagcacaactacaaaaagatatgggtgacaattttgcttccctcgcatcatcagatgagggacaaaaaatgatccgccaacaagcattgaatgtgctgattaaccaagctttgctggatcaatttgctcaagagttaggtatttctgctggcgaccagcaaatcagagacgcgatttttgcgctaccttatttccaaactgatggtaaatttgataacaaaaaatacgttgagttattaacggcgaataatattgacgcggatgcctttgctgaaggaattcgtcaaaatctgattaatcaacaattacgttattctattcaaggcactgactttgctttagagagcgaagttaaagactttgccggcttaatgctacaaagtcgtaatgtgcgtctcgcttcattagatattcaaccattccttgaaaaagagacggtatcagatgaagaattaaaagccttttatgaccaaaatacctctatgtttatcgctccagcacaagttaaagtgagctatattcagttagaagcccaaaaagatttaagcaacatcactatttcagatgatgaagttaaagcttattacgatagtaatatcagtgaatttactgtccccggacaaaaaaaatacagtctacttgtcttagcagatgaaaccgctgcgaaagaagctgaagacgcgttgaaaaatggcgctgacttcgtcactttagtaaaagaaaaatctattgatactttttctgctaaacaaaatggttcattaggctggatcactattggtcaagagctaccagaattagcaaatgcgagtttgactgagaaggggcaaatttcacagccagttaaaatcagcaacggttatgctattttccgtcttgatgatattaaaccttcggtggtaaaaccttttgatgacattaaagctgacttattagtaaaaatgcgtgaaaacaaagccattgatgatttcttcgcattgcagcaaaaagtgagtcaagccgcttcaaatgataacgacacgctagcgacagcagcaaaagcagggaacgtcactgtaatcaatacagattggtttgatgaaaacaatgtaccagcagccttgaataacgaaaagttaacacagcttatctttggtggttcactggttgatgacaatggccctacaggcatgaactcagatatggttacccttggtaatgatagtgcttatattgttcgtgtcgaaggatataaacctgcatcaacccaaccattagataaagtacgtgacaaggttattacactggtcaaacagcaaaaagcttctcaagcgatgaatgcgcaagctcagaaactccttgcagccttaaaagaaggtaaaggagaggcggcattgaaagaagcaaatatctcgtttggtgaggtagaaagcgtggttcattcatcagccacagatccgatacaaagtgctatttttgctatgccaaaaccagcagaaggtaaaaaagagtacggtatgtctaatgtaccgggttcaaaagtggtcttaatccaattagatagtgtcactgatggtaagccaacggcagaacagcttgaatttatgactaatctctatcgcgcccaaatgggagaagaagctttacaacttatgctcagcgatttaagagaaaaagcaaaaatcgagatttttgataaagattatcaataa

SEQ ID NO: 1785 - DNA, 879 bp, Proteus mirabilis
actatgagccaggcattaaaaaaacttatcaacttaatggagcttgaaaaaatagaagaaggcctatttagaggtcaaagtgaagatttaggtttaccacaagtctttggtggacaagttgttggccaagctctttatgcggcaaaacaaacaattgctgataatcgctatgttaattcatttcacagctattttttacgacctggtgatagccataagcctattatttacgatgtggaatctatccgtgatggtggctcatttagtactcgtcgcgtcagtgctatccaacaaggtaagcctattttttatatgaccgtctctttccaagagtttgaagaaggctttgaacatcaagatatgatgcctgaagtcccttttccaaatgatttgatctctcaagatgagatattgaaaaaacttgccccaaaattacccgaaccgctaagaacactcgcattaagagaaacaccttttgaagcacgccccgtgcaatattttagcccgtttggttatgagaaagcacctgcggaacgttatgtttggtatcgtagtcgcggagaaatgccatctgatcctttcctacaccaatacttattaggttatatctctgattttgattttttacccacctcactgcaaccttatggtttaggttttatggatccgagtttacaagtggctaccatcgatcattccatgtggttccatcgcccatttcgtgttgatgactggttactttatgctattgaaagtccatcagcctcaggtggtcgcggatttgtgagaggaaaaatgtttaatatgagtgggcaactagttgcctcttctgttcaagaaggtgttatccgtcaaaaacgaataaaatcaaacaaataa

SEQ ID NO: 1786 - DNA, 1707 bp, Proteus mirabilis
atcatgagccaacgcattactattgatcctattacccgtattgaagggcatttacgcgtcgactgtgaaatcgataacggaaaagtcgttaaagcttggtcttccggtactatgtggcgtggaatggaggagatcctaaaaggaagcgatcctcgtgatgcatggattattgtgcaacgcatttgtggtgtttgtacaacggttcacgcaatagcctcagtacgtgctgtagaagatgccttagggatggatattccggttaatgctcagtatatccgtaacttaattctggcttctcacattattcatgaccatatcgtccatttctatcagttgtctgcgatggattgggttgatattacggcagcattacaggcagatcctgaaaaagcctcagcgatgcttaaaggggtttctcaatggcaattgaactctgctgaagagttcagaaaagtgcagaagaaaattcaagatttggttgatagcggtcagttaggtattttcgctaatggttactggggtcactcagccatgaaattacctcctgaagttaacttgattgcggtagcccactatctacaagcattggaatgccagcgcgatgcaaaccgcattgttgccgtgttagggggtaaaacaccgcatattcaaaacttagcggtgggcggtgttgctaacccaattaaccttgatgcaccgaatgttctcaatttagaacgtttaatgtatgtaaaacactttattgataacttgggtgattttattgaacaagtttataaagtggatactgctatttttgctgcttattatccagagtggttaaaaatcggtaaaggggctaattactacttatctgtgcctgaattgcctattaatggcaataatactgagtttttactctcaggtggctatatgaaaggcgttgatttttctacttatcgtccaattaaagattggaaagatcaaaacctgaaagacggcatcgaagagagtggtaaacacgcatggtatgaagatgatgaaccattaaaaccatgggaaggtttaactcgtcctaaatacaccggttgggatgaaaataataaatactcatgggttaagtcacccacattttacggtaaacctgtagaagtaggtactttagcatggttagtgtgtggtttagcgggtaaacatgaaggcacagtaaaacactataacgaagttaatcagatctacaccaaattaaccggtcaaaccttggtgacagagcagttagagtcaacttggggacgcattattggtcgtaccgttcatgcttgtgtattacaagattcgcttaacttcttatggcaatcactggttgataatattggccgtggagatactgcttcctttattaaacctgagtttgagccgggtaaagagtatcgtggcgtcggttttgaagaggcttcgcgcggtatgctatctcactggatagtctttaaagatggcaaaatcacaaactatcaggctgttgttccttcaacatggaatgcgggtcctcgtaactttaatgatgaaccgggtccttatgagttatcactagtgggaacgccggtggctgatcctaacaaacctctggaagtggtaagaaccattcactctttcgacccatgtatggcttgtgctgtgcatatggttgatttaacaggtaaagaattaagtaaggtgaaggtattgtaa

SEQ ID NO: 1787 - DNA, 1275 bp, Proteus mirabilis
aactcaagtctcattgtgattataatctacacgtcaataatcataaaaggtaagggaaggcttatgaaacagtatgctggcttcatttatattgcgactacgcttgatactaaaagcgctgaaattttttatgtcagtgaattaataaaaaaagcaggccttcctgtcaaaaccgtagatttgacaaccaaacctacagcattagaaagagaagctgacgtcacagctgcacaagttgctagttaccatccagatggaaaaaacgccgtgttttgcggtgaccgcgggaaagctatcgcagcaatgtccgtcgcttttgaacgttatttaacccactgtgacgatgtcctcgctattttaggattaggcggctcagggggaacggcattgattacaccagcaatgcaatctttgcccattggcgtacctaaattgatggtatcgactatggcttccggtgatatctccggatatatcggcgctagcgatatttcaatgatgtactccgtaacagatgtatccggcttaaaccgtatctctcgtaaggtattgagaaatgcggccaaccaaattgccggcgctgtttatttttaccaagaagaaaatagtgttgataaaccggctgttgcattaacaatgtttggtgtaactacgccttgtattcaacaactgactaaaaaacttgaaaataattatgactgtttagttttccatgcgacagggagtggcggtaaagccatggaaaaactgatagacagccacttacttcatagtgttcttgatctaacaacaaccgaagtatgtgattatttatttgagggtgtccttgcttgtgatgaagatcgttttggtgccatcgcccgtactaaaacaccttgtatcgtctcttgtggcgcgttggatatggtgaactttggtcgccctgctaccgtacctgagaaatataaagatcgtcatttctatcaccataattcgcaagtcaccttaatgcgtacaacaccaagggaaaatcgtcaaatggggatctggatcgctgaaaaattgaatcagtgtgaaggcccactgacgtttatttttccacagggcggtttttctgctttagatattgaaggggggccattctgggatcctcaagcaaaccaagcattttttgatgcatttataacaacatttaaagagaccgagactcgtcaattagtcatcagtccatatcacataaattctgctgaatttaatcagcaagtttatgatttacaccaggaacttatttgttaa

SEQ ID NO: 1788 - DNA, 321 bp, Proteus mirabilis
atagttatacaaggagtcataaataagtcatttttgttgtataaagttcatcgttataacctatcaaatagattgttctgtatgattttatcaataacgattgattatttatgctgtatacatcatttaaaaacagggcatcaccctaaatttaaaaacagggtatcccctaaatttactctaaatagttcgagtgaacgcagtcaacaacgcgacaacttgaaatatgacgagtataaactctttcaatttacaggagtacattatggttctggttactcgcaaagccccagatttcacagcagctgctgttttaggtaa

SEQ ID NO: 1789 - DNA, 1044 bp, Proteus mirabilis
atcatgacacaatcacatttcgttgaactgaaaaatattgttaagcgttttggtacaaacacggtaattgacacgctcagtttatctattcctcaaggaaaaatggtttcgttattggggccatcaggttgcggtaaaacgacagtattacgcttagtagctggattagaaaaaccgacagaaggtaaaatttttattgatggtgaagatgttactgatcgctcaatccaacaacgtgatatttgtatggtgtttcagtcttacgccctgttccctcatatgtctttaggtgacaacattggttatggcttaaaaatgttaggtctcccaaaggcagagatcaaacagcgagtggcagaggctctagcgttggtagatttagcaggatttgaagatcgttttgtcgatcagatttcaggcggtcagcaacaacgagtggcattagctcgtgctttgatcttaaaacccaaagtgctgttatttgatgagccattaagtaatctggatgctaacttgcgccgtagcatgagggagaaaattcgtgaattacaacaacagtttaatatcacctccctgtatgttacccatgaccaaagtgaagcttttgccgtttccgatatggtgttagtgatgaataaaggcaaaataatgcaattaggttcaccacaaactttatatcgccaaccggcctctgagtttatggcaagttttatgggagatgccaatctcttccctgctactctaggggctgattatgttgatatttttaattatcgcttacctcgccccgagaactttaacagcaacaaaaccgaaattagagtgggtgtcagacctgaagctattaccttatctcaacaaggtgaagcttgtcagcaatgtacaataatccatgtcgcctatatgggaccacaatatgaggtgactgttgcatggcaaaatcaaacattgttattacaagtgaatgcaacccaacttcaacctaatgaaggtgatagctattatctacaaatccatccttatgggatgtttatcttagaataa

SEQ ID NO: 1790 - DNA, 1233 bp, Proteus mirabilis
atcgcagcacaccacatctgcggctgtggaggcagtactatgagtttacaagataccagttttgaaagttgtattaaatgtacagtttgtacgacctattgtcctgtggcaaaggtcaatccactctatccaggacctaaacaagcaggccctgatggtgagcgtttacgcttaaaagatcccatgctttatgatgaagcactgaaatactgtactaactgtaaacgttgtgaagtggcatgtccttcagatgtaaaaataggggatatcatttcccgtgctaaacttaactacaatcctaaaacacctaaaattcgtgatgctattttaagtcatactgatttaatgggaacgctctctacgccaatggcgccgattgttaacactattaccggattaaaaccagtacgtaaaatcttggataaagcgcttaaaatcgaccatcgtcgtgaattacccaaatactcttttggtacatttagaacatggatgaaaaaacaggttgaagagcaagcacgctttaaagatcaggttgcgtttttccacggttgctatgctaactataatcaccctcaattagggaaagatttagttaaagtattcaataaaatggatattggtgttcaactattaaaacgtgaaaaatgttgtggtgttgcattaattgccaacggctttgtgaaacaagcgaaaaaacaagccaccgtaaaccttgaatctctgacagaaaaaattgtggagaacaatattccggttgttgctacatcttctacttgtactttcactatccgtgatgaatatgaacatattctagatatcgatacctcaaaagtacgggaaaatatagaattagcaacacgttatatttatcggttattggaagaagggcgtgaattaccattaaaacataccccattaaaagtggtttatcataccccttgccatatggaaaaaatggggtgggcggcttactccattgatttaatcaaacgtattcctggggtagaagtgattgtattagattcacaatgttgtggtattgccggtacttatggttttaaatcggaaaactacgatgttgcgcaaggcattggggcgggattattccgtcaaattgaagagagtggttgtgatttagtcattacagattgcgaaacctgtaaatggcaaatagaaatgtcaacaaccaaaaaatgtgaacacccaattagcttattagctcgggcattgtag

SEQ ID NO: 1791 - DNA, 483 bp, Proteus mirabilis
ccattgggtcttaactggaatttaaaggcttgtagacgtttcatattacctattatactttggtctatgaaaaatgaaactaatattcgccgtggcagacattgtgtattcctgatgcacgtccatttggtctttgtcacaaaatacaggcgaaaaatatttgatcaggatgcaattgaaaaattgcgaagctactttgccagtgtttgtgctgattttgatgttgaactggttgaaatggatggggaacgggatcacgttcatttactgattaattacccgccaaaactggcgatatctaatctggttaacagccttaaaggggtatcgagtcgattacttcgacgtgatcgtcctgatattgcccaacgtgattactacaagggggttctttggtcgccgagttatttcgcggggagttgtggtggcgcaccaatatccattatccgccagtacattgagcaacaggaaacacctagttag

SEQ ID NO: 1792 - DNA, 639 bp, Proteus mirabilis
tcagtgcaacaaagaagcacttttttatttaaaaagcgctatgatagtacaatgaactatcttgctcacttacacctcgcctttagagcgaaaagctccttattaggcaatatgatggcggactatgtaaaaggtacgccgagtaacgattacagccaagcggtaattgacggcattcgcatgcataggcgtattgatgtgctgactgatactcatccattagttaaacaagctcgacaactttttccgaatgaataccgccgcgttgcacccattactttggatatattttgggatcattttctctcactacattgggataaatttgaacctgacataccgctcttggaatttgttacttatgtgcgcaataccattgaaccggatttatggcgaactccggaaaaatttcaagagctcaatgaatatttatggccccaagcgtggttgactcgttatgctgataaaacttatatagcacagacgttaaaaggcatggcaaaaagaagaccgcgtttaagtgcgcttgcaggctcttatattgcactagaaacgcattataaagagttaagtgagattttttggcaattttatccacaattgttagaaagagcacaacatcatcagctggatgactga

SEQ ID NO: 1793 - DNA, 216 bp, Proteus mirabilis
catggtaaacaaccaccattaaacataatcaaacatcttgcagaaatagctggttttgaaagttggcaacaagcacaaacgtatatccatcatactgttgatattattagtcaattctcatcgttagctaaagagtatgacgtttcaaattccgttcgtgctgatattgataaaacgcttactaatcgcctaaaagaaaatcaacacttactttaa

SEQ ID NO: 1794 - DNA, 1338 bp, Proteus mirabilis
ttgataaaacagcttcagtggaggccgatgatgaaatttgacgttatcattataggaagcggattagcgggactgactgcggggatccgccttgctgaagcgggcaaatcttgcgccattatcagtaatggacaaagtgcgttacatttttcatctggatcactggatttattaacgtatcttcctgatggcacgccagtttctcatccgaaacaagcgttatcaacactggcacaacaagcaccagagcacccatatagtcgtattggtgaagcaaatgtcactcaattgatagagcaagcgcaaacgctgttatcaacaacgagaaatttagactataaaggtaacggtgatgaaaaccattaccgtattaccccggttggacgttctcgcatgagttggatgagcccacagcgcgtgccgacttatagcgttaatcaaccattcccatggaaaaaaatagcggtggtgggaattgagggattcttggattttcaacctcagtttgcaagtagtactttaaatgaacaaggtattgaggccattccttatcacattcatttacctttattggatagactacgtgataatccaagtgaatttagagcaattaatattgcgcgctatttagataagcctgaaaacacgcaagcattagcagaagaattaattaaacacatagataatagtgttgaggcgattgtactacctgcatgtatcgggctagatgaagaagcgccagttaatttattacaagagtgtgtgggtaaaccaatttgtctattaccgacattaccgccttcattattaggtattcgcctacatcaggcactaaaactgcgttttcaacaagcaggtggtttgatcatgccgggtgatcgcgcagaagaagccgatttagtcggtaataaggttgtcggtattcatacccgtaatcatactgatatccctatccgtagcgagcatgtcgtattagccacaggcagttttttcaataatggcttaattgcggaatttgatcgtatttacgagccattaatggaattagatttattagaaagtttaccgcgtaatgagtggacacaagtcaatgtgtttgccaaacagccttatatgcgatttggtgttaatacagatagtcaattaagaccgttaaaatatggtgaagcgttagacaatgtctatgcggtgggggcgcttttaggtggttttgatcctctaaacgaaggctgtggtgcaggtgtctccatgataagtgcactctatgcagctcaacaaatattacagagtgataaatcgcagcacaccacatctgcggctgtggaggcagtactatga

SEQ ID NO: 1795 - DNA, 1023 bp, Proteus mirabilis
tatatgaaacaacctgatgaaatcaccttagctcaaggaaatggtgggcaaggtatgcaacaacttatcgaagggctatttttgaaagtattcgataatccattattgaatgaaaaagaagatcaggctcgtattgcattagccgatctcacagcacagggcgatcgtctggcatttagtaccgacagttatgtgattgatccgatcattttcccaggtggaaatattggtaaattatctgtttgcggaaccgcgaacgatctttctgtaggtggggctgtacctcgctatctctcttgtggttttattttagaagagggacttgcttttgaaacgctagaaacattggtgatggcgatggcaaaagccgcacaacaagcaggtattcagattgtaacgggggataccaaagtggttcctcgtggtgctgcggataagatcttcattaatactgcgggtattggggtgatcccaagtaaaattgattgggcagcaagtcacattaaagccggcgataagatcatcgtcagcggtacaataggcgatcatggtgccactatcttaaatttacgtgaaaatttaggattggaagctgatctgcaaagtgactgtgccgtgcttgaaccaatgatcgcgcctttacgtcaaattgacggtattcgtgcattacgtgatgcaactcgtggtggcgtgaccgctattttacatgagttttctcaagcctgtggctgtggcatgaatgtatatgaaaacaaactgccaatgaaacagtctgtacgtggtgtgtgtgaattattagggctggaagcactcaattttgctaacgaaggtaaaattgtattagtcgtgtcaccgcaagcagaaaaacaagttcttgaggctttgcatcaacatactttaggtcaagatgcttgtaccattggtgaagtaactgaagagcgttatattcgtttaacgggaatttttggcacaagtcgtattttagatctcccttataacgagccattaccccgtatttgttaa

SEQ ID NO: 1796 - DNA, 546 bp, Proteus mirabilis
atcatgaaacatattgttgatgtcatgatctctgaagaagagatcaaacagcgtattgctgaattaggtcgtgaaatcacagaacattatcgttctcgtcaagaaaaacacgatttggtcttaattggcttattaaaaggctcttttatttttatggcggatttatgtcgtgaaattgaagtgccacatgaagtcgattttatgacagtatcaagttacggtaatggaatgacgtcaacaagagacgttaaaatcattaaagatcttgatgaagacattcgtggtaaagatgttctgattgttgaagatattattgactcaggtaatactttaaaccgtgttaaagagattttaagtttacgtgagcctgcctctattgctatctgtacgctacttgataagccatcacgtcgtgaagtggatgtgccagtagagtggattggctactctattgaagataagtttgttataggttacggcattgattatgcacaacgttatcgtcacctaccttatattggtcatgtaacgctactagatgaataa

SEQ ID NO: 1797 - DNA, 1566 bp, Proteus mirabilis
tcaccggaacactctaacatgcaaagaggcgcacgtttttttcttcaatctctctttttattgttgacctactctttactctggttgtcactttgggtgatcagtttttatcttagtcataatggtcaacaagccgctctttttttacctcaaggcttacggctagcattatttattttactttggcgacgtttttggttgccgatgttattggccgaatgggggctttattactggctaactcaacagcaattaattacccatgtaactctttatctctcacctttaatcagcttattggtcgcactagaagtacaacggatctggtggcgttacccactttattggcaacggttaaccttacttatcgcagcggtcggatttaatagcctattacaagcctttctactcagtttttttctcacgacgtccaccagcgcaatatttttgacctcaataacaggtggtattttattggctccctttgtttttctactttatgaatatttacgcgaattacaaagtcgagtattaatcgccgaaatcaccccagagccaccattgcgtacctccttattaatgtgggtattcctcttttgtcttattggattaagtgcacaattctttcttaccccagaaattgaacgcttattagttattctggtttttattcctaatgtttttatggcttatcgttatggttggcaagggggcgtattatccgcgttgttaggtagtttaatgattacctttgctagacaagtaaatggtgcttttgccgatttgcatgaattagagatgtttttaacaacccaagccttaattggtattggtttaggtattgctattagtcgccagcaacaacttgccaataatttacgtcattatcagctacgtttagagcaagagttacaagcacgccgagcgttgatggaacaactagtacataccgaagaagatgttaaaaaagccattgctcgtgaattacatgatgaaattggacaaaatattacagctattcaaattcagtcaatgttagtaaaaagaagtgcagataacgataaaacacgccagtcaggcgagcaaattgagcgattagcccaacaaatacatcaatctacccgacaactgctacgccaactaaggccgcctattttagaagagatgtcattagagaaggctctacaccatttaattgatgagttctcatttcatgaaaatggtattcactgtcattttcattatgctcttgaaacagagcctgaaagcgacaccattatttttacactctaccgattagtgcaagaactactcaataatatcagcaaacacgctaatgccagtgaaatccacatttcgcttactcaacatcaagcacaattacgactggttgttcatgataatggtattggcattttgcctacacaacctaataacggttttgggctacgaggtattgaagagcggatctgcgcattggggggagaatgggaagtaattagtcagcttggtactaaaataattgttaacttacccacaaattcaatagaaaagcgtgaaaactag

SEQ ID NO: 1798 - DNA, 1698 bp, Proteus mirabilis
ctcaacatgcaaaaattaaagtttttacgattttcaaaagaaaaagtttctctttttttagctgtctatattggtttatttcttaatctttccgtttacattggccgttatggcacacagaattctcacaactccctcattgaaagtttatatatactgggtgaagttgcagtaaatattgcctttactttcttcttattacgacttatttctttttgtggcacactattttttaaaatagtcgcttcttttattctgctcattagtgtttgtgctagttactatatctctttctttgatgtagttattggctatggcattattatttctacgctcaccacagatatcgatttatcaaaagagctgattagccctaatgtgattatttggattattggattatctattttacccctagcgctaacttggttatgtaagaaaccagaaaaaaatataactcagcagcaaaagaaaaaaatctggatcaaaaatacggtcaaaatgctcgtaattgctcttgcggtatttgcctatctaaaaaccttagattcgaaacaaaaagcctatgaaatcaagaataacttagatttgccaagctacagtggtggtttaagttacgcctatttaccgaccaactggattattcctttatttcaatatgcgataacacagtacgacgaccactttaatagccagaatatctttgatcccgcggataactttacctatataccgtcaaaagccaatgaagatgtctatgtggtctttattattggcgagacagcaaggtgggatcatatggggctattcggttatgaaagacaaaccaatcccctattaagccaagaaaaaaatctgattgctctgaaaggtatctcttgcgatacagcaacaaaactttcgctaaaatgtatgtttgtgcgtgaaaacggtacagaaaataacgatcagcgaacgttaaaagagaacaatattttctcagtattacatcagctaggaatgacatcagaactcttttcaatgcaaagtgagctttggttttacaataagcttgatttagataactatgccatgaaagagatgatgaccgccaaaaatagtaattttggcaaagaattagatgatactttgcttattaacgaagtcgcagattccgttgctcactattctaaaggtaaccacttagtgattttacacactaaaggttcacactttatgtactcgcaacgttacccaaacgcatttaaaaaataccaacctgaatgcttaaacgttgacgatgagtgcaccaaagagcagctaatcaatgcttatgataactctattctttatactgattactttattgatggtgtacttaataccctgcgtgataaaaaagccattgtgttttatacctcagatcacggcgagtcaatttcagaaaaaggtggcttacacggcacaccaaaagaaattgcaccaccagaacaatttaaagtgcctttcttagtgtggatgtcagatagctatttagctgagcctgaaaataaacagttatttgataatctcaaacgaaatcaagataataaccggactttctatcatcataatatttttgactcgatattaggctgtctaggttactcatcacccgatggggggattaataatcaaaataatctctgttttggtgacatagctagcaaagcacagtaa

SEQ ID NO: 1799 - DNA, 597 bp, Proteus mirabilis
caaaaggtgcatttgaggcaacagcaacgctacttgctgaatatcaataggagtatcgggatgatattacaaagattatctctgagtactgcaatctttgccgctgtgatagctatggctaatgctgatcctaatatgcgttttcatggtgagttaattgatgagccatgtgtaataaaacccggtgatgaaattattgtcatcacgctggataaagtgactgatagtgctttttacaatggagtagaaagaactaaaagccagcaatttgagatccatctatcggagtgcgatctctctatgaataacaaagtttccatcacatttaaaggtgatgaaaataaggcgatggcagggaaaggttttctagcattgagtccaataagtcgagcctctggtattgctattggtctagaagatagcgatggagtcctcttacccattaatcagccatcaaaaaatatggctttactttcaactaataacacattgaggcttagtgcttttatacaagcagaacctaccgcaattgctaatcaatcaataaaacgggggccttttagcgccattgctacattccatttaaattatgactaa

SEQ ID NO: 1800 - DNA, 1173 bp, Proteus mirabilis
aggcattcgcaaggtatttacttatgtcaaaattttaaggataagagagcatccatgaccgttagcacgccattatcactttatgaaaccgcgttacagcagggggattatcaacctgatgaggttcagcgacaaaccgttctccatctgcaacagttataccatgcattattaaaccggacatcaccagaaaaaagttctattactcagcggttgttaggaaagtttcgtgcgaaaaaaagcacaattgtccctgagcgtggtgtttatatgtggggaggggttgggcgaggtaaaacctggttgatggatatgttctatcaaagcttacccacagaacgaaaactgcgtctgcactttcaccgctttatgttacgggtgcaagatgaattaaaaggcttacaagggcaagaaaatccactggatatcattgctgacggctttaaagcgcaaaccgatgtactctgttttgatgagttctttgtttcagatattactgatgcgatgattttaggaacattacttgaagcgttatttgccagaggtattactttagtggcgacatctaatattccccctgatgatctctatcgcaatggactacaacgagcacgttttttacctgctatagaacaaataaaaaaccattgtgaaattttgaatgttgatgcggggattgattatcgcttaagaacattaactcaagcccatctatttttatctccattaacagagtataaccgccagcagatggataaaatttttactcagcttgccagcagtagtgaagttgtattcgcgcccacattaaccattaatcatcgtccaatggtaatgagaaaagtggctaatggtgtactggcggttaactttgatacgttatgtgtacaagcgcggagtcaacttgattatattgaattatcaaagcactatcacactgtgttgctttatgaaatggtgcagatggggagtagaaatgaagatgttgcccgtcgtttcttagcattggttgatgagttctatgagcgtaaggtgaaactaattattaatgctgatgttgagatgagcgagatttatcaagggcaatttttacgttttgaataccaacgttgtttatcgcgtttgcaagaaatgcaaagtgaagagtatctttcacagcctcatctcgcttaa

SEQ ID NO: 1801 - DNA, 1197 bp, Proteus mirabilis
aggatgacgcaaaaaaaaccagaaacctcactgctattaagtggtcgatcaaaaaaatattcacaaggcgcagtaaaccctattatacagcgaacttcatcggttatttttgatacggttgcccaaaaacgtgaagccacccaaaaacgagctgaaggcgctctattttatgggcgaagaggtactaccacgcattttgcactacaagaggcactaaccgaactagaacaagggatcggttgcgcattatttccatcaggtgcggcggctattactcaatctattcttgcgtttattgaacaaggttgtcatatccttgtgactggttccgcttacgatcccacgcaaaatttttgtgatcagatattaagtaaattttctgtcaccacaacctattttgatcccttaatcggcactgaaattagtcaattattacgccctgaaacaaaaattgtttttctagaatcacccggctctattacgatggaagtgcaagatttacaaggtattatcactgcggtaagacactataacccaaatattattataatgattgataatacgtgggcagcaggtttattacttaaacctcttactttaggtgctgatatttctatccaatcagcgaccaaatatattattggtcactcagatggtatgttaggttttgctgttgctaatcaacgttgttggccacaattacgtgaaaacacgtatttattaggccagtgcgcagatccggatacagcttatatggcagctcgtggtttaagaaccttagcagttagaatgaaacaacatgagcaaagtggattagaaattgcgcgttggttaaaacagcacccgctagtggataatgtctaccatccagcactctcttcttgtccggggcacacctattttcaacgtgattttactggaagtaatgggttgttctcttttagtctaaaaaagatcctcaccactgaggaattttcacgttttcttgataacttatccctgtttaaaatggccttttcatggggtggatttgaatctcttattttaggctatcatcccaatgatattaaagcgatgcgacaatatgacactcagcccactctcgcaggaaccttatttagagtacatatcggcttagaaaatattgatgatttaattgaagatctagagcaagcatttttacgtatttctaactaa

SEQ ID NO: 1802 - DNA, 1341 bp, Proteus mirabilis
gcttttcagcaagattcatttccttatactggcaaaagcaagcacacaattgcttttttaaatattattttaagtaatggaataactatggataaacaacaatccagagtacttaacctgctttttcagggaagtctcgttaaacaaatacttgctggtttaattgcgggtattttactggcttggttagcaccagaagtggctaaaatgatgagcttattaggtaacttatttattagtgccttaaaagccgttgcgcctgttttagtctgggtattggttatggcttcgattgccaaccaccgtcaaggacaaaaaaccagtatacgtcccatattagtgctttatctgctcgcgactttctttgctgcactaacagcagtagtggcaagctttgtgtttccctcagtattaacgctagttgtcaataattcacaactatcgccacctgaaaatattgctgaagtcttaaaaggtgtattaattaatgtggtggctaaccctgtagatgcactgattaacggcaattatatggggattttagcttgggctattggcttaggtttagcgttacgccatgcaagtgatacgactaaagcattaacacaagattttgcagatgcggtaactaaccttgtgcgtgtggtgatccgtttagcgccaatcgggatttttggcttggtatcatcaaccattgctacgactggctttaaagctttagctggctactttcatgtcttacttgttttaattggttgtatgctgtttgttgcgctcgttgtcaacccattgattgtattttggaaaattcgccgtaatccttatccattagtatgggcttgcttacgtgaaagtggtgttactgccttctttacgcgtagttcagcggctaatattccggtgaatatggcaatgtgtcgtcgtatgaatttaaatgaagatacctattctgtctcgatcccattaggtgcgaccattaatatggggggagcggcaatcactattactattttaacacttgctgcggtaaataccttgggtatgcctgtggatattccaacagccttattgctaagccttgttgctgctatttgtgcttgtggtgcatcaggggttgctggtggctcgctactgttaattccgcttgcttgtagcatgttcggtattagtaatgatttggcgatgcaagtagttgcggtaggtgtgatgattggtgtcttacaagattcagcagagactgcattaaactcatcaactgatgtgctatttaccgcaacggtctgcatagccgaagatgagcgtttagttgccaacccattaactgaaaaaaataatggctaa

SEQ ID NO: 1803 - DNA, 1026 bp, Proteus mirabilis
cagagcgagcataatattttggcaacaatgaaagatgtcgcccgtttagcgggtgtttcaacatccaccgtttcccatgttatcaataacaatcgttatgtgagtgaaggtatccgcgcaaaggttaatcatgcaatagcaaccttaaattacgccccttcagcattagctcgtagtttaaaaatgaactgcacacgtaccatagggatgttagttaccgccagtaataaccccttttatgctgaagtcgttcgaggtgttgaacgaagttgctatgaacaaggctatagcctcattttatgcaacaccgaaggcgactatgagcgcatggatactagccttgaaaccttgctacaaaagcgtgtcgatgggctgttattaatgtgtactgaagcccgcgcaccatcaagtgaagtattaaatcgttatccacggttacccatggtgatgatggattggtctccatttgaatacagtagcgatattattcaagataactccctattagggggagaattagccacgaattatttaattgaaaaaggttttactgacatcgcctgtattgcgggtccccaagataaacttcccgctaaacatcgcctacaaggctactataatgcgatgcaacaagctgggttacccattcgtaaagagctggttttaaccagtgattttgagtttgcgggtggctttagtgcaatgcaaacactgctctcactccctatacaaccacaggccgtatttacctgtaatgatgcaatggcggtcggtgcttaccaagcgatttatcaaaaaggactacgtgtacctgatgatatttctatcgtcggttatgatgacatcgatttagcctcttatatgatcccccctttaacgactattcatcaacccaaagatgaattgggcaaacttgctgtaagccaattattacgtcgtatggaagatattgaagcacaagccaatctattagtgttaacacccaaactgattgaacgaggctcggtgatagctcataggaaataa

SEQ ID NO: 1804 - DNA, 2019 bp, Proteus mirabilis
gccacgcggcacatgcaggagcagaggaataaaggcatgttcggaaaattaactctcgatgcaatcccgctacaagaacccattgttgtcgtaaccctaatcggcatcattcttggcggtcttgctgttgttggcgctttaacctatttccgtaagtggaaatggctatggagcgaatggttaaccagtgttgaccataaaaaaattggtattatgtatatcatcgttgcaatggtcatgatgttccgtggctttgccgatgccattatgatgagaagccaacaggcactcgcctcagcgggtgaagctggtttcttaccacctcatcactacgatcagatttttaccgcacacggcgttatcatgattttcttcatggcaacacctttcgttgtcggtctgatgaaccttgttgtacctttacaaattggtgcgcgtgatgtggcattcccattcctaaactcactgagtttctggttctttgtcgtcggtgtactgcttatcaatatctctttaggtattggtgaattcgcacaaacaggttggttagcttacccaccactttcgggcttggagtacaatcctggggtcggggtcgactattggatatggagtttacagatatccggtattggtacgcttctaacgggggttaacttcttcgccactatcctgcgtatgcgtgcaccaggcatgacaatgatgaaaatgccagtgttctcatgggctgcattatgtactaacgtactgattatcgctgcattcccaattttaaccgtcactatcacactactgacgttagaccgctatcttggtacacacttctttaccaatgatatgggcggtaacatgatgatgtacatcaaccttgtttgggcttggggtcatccagaagtttatattcttattctgccagtctttggtgtgttctctgaagttaccgcgacgttctctaaaaaacgtctattcggttatacctctttagtcggtgcgaccgttgttatcaccgtcttatcatttatcgtttggttacaccacttctttaccatgggctcaggtgccaacgttaatgccttcttcggtatagccaccatgatcatcgctatacccacaggggttaaaatctttaactggctgtttaccatgtatcagggccgtatcgagtataaaagccctatgctatggacaatcggtttcttagtcaccttctcagtaggggggatgactggggtactattagcggttcctggcgcaaactttgtattacataacagcttgttcttaatcgctcacttccacaacgtcattatcggtggtgtggtgttcggttgttttgctggtatgacttactggttccctaaagcatttggcttcacgcttaatgaaaaatggggtatccgcgcattctggttctggtttatcggtttctttatggcctttatgccactgtatatccttggctttatgggtatgactcgccgtttaagccaaaatatcaacccagaattccacccaatgctgatggttgctgctggtggtgccgctctgattgctcttggtattgtttgccaagttatccaaatttacgtcagtatccgcgaccgccacttaaaccgtgatttaacaggtgatccatggggtggacgtactctggaatggtcaatttcttctcctgcacctttctataactttgccgttgaaccgcaagtgaaagctcgtgatgagtggtgggatcagaaagaaaaaggtactgcttatcagcgccctgcaaaatatgaacctatccatatgccaaaaaataccgcagcaggcgtcattatctctgcatttagcttagtgtttggctttgccatgatctggcatatctggtggttagcgattgttggtttcgcaggaatgatagtcacttggatcgcgaaaagcttcgatacagatgttgattactatgtccaagtacctgaaattgaaaccatcgagaataagcattatgaagaactgaaaaaagcaggtgtgaaataa

SEQ ID NO: 1805 - DNA, 219 bp, Proteus mirabilis
agagaaaggcagagaactacacatagcatttttattattttaataaatttaaaagccatagtacttcgcggtactatggctttttgttttattacgcagcaaatgtgtgtttcatcttgtcgagagcccgcttataccatcggttgttttctttctatctatctatgcaagttctgctacaccaacaaattgttaacactcttagcgaggcgtttttag

SEQ ID NO: 1806 - DNA, 747 bp, Proteus mirabilis
ccctttattaaaggacgtattttcaccggggtgattatgaaatttgaacaaccactacaatctgccactttattaaaacgatacaaacgttttttagcagacgtagtgacggcaaatggtgaagaattcacgctccattgtgctaatacgggtgcgatgacgggatgcgcaactccaggtgatacggtttggtattccacgtcatcgaatgtcaaaagaaaatatcctcatagttgggaattaacccaaactcaatcaggtgattggatctgtattaataccttaagagctaatacgatcattgccgatgcgatagaagctggcgatattccagaattatctgactatgatgagataagacgcgaagtgaagtatggtagtgagaatagccgtattgatattttacttaagtcaaatcataaagttgactgctatattgaagtgaaatcggtcactttattagatgctggaatgggctattttcctgacgctaaaacagagcgaggtcaaaagcaccttcgagagttgaccgctatcgcaaaatcgggcttaagggctatcttattttacgctgtcccccatactggcattacacaagtgtctgttgctaaagagattgaccctaagtatgacttattgctaaaacaagcatgtgatgctggggttgaaattttatgttatcgcatcaatattagtgagtacgatttaacaattggaaagcaattaccttttatttcaaaaggttaa

SEQ ID NO: 1807 - DNA, 2013 bp, Proteus mirabilis
agactaattaatgcaaataatttattattaaataagaaaggaatttatatgactatagtaaaaaatgttaaagaaacgactaatttctatttacctaaagggatcatcacaacaggaactatgataggttggccaaaaaaatcaccaaatgaaataacaacaataacttatacatttccagatcataacacataccgagaaattataaaaaataaaaacccattaacagaaaacatgagaaaaaaaacgctaaaagatatatatgaatattataggttagtaaatattagagaacaaaaaaaacaagaattaaacaccattgaagataaagatagtgaggcttcaaaaaaaagaataaaagaattagaagaaggaataaaaaaaatagcaaatgatatttatactatactagataatatacctatctatatttactccactcaagaaacaatattccctcatcaacaaaaagttatcgaagaaatattacaacacacctcagatatcgtacctatattttttaaaaaaatatcaccatataccaatgctgatttaaaatttggctattataatcaatttgttaatatatctggtacaaaattcatttcaggttatcgaaaaggcagtgctagtcatcctaacgaggaaggtacacctataaaagagataaaaccagatgaagaacatgatgatccgggtactatatttattgatttttcttcacgcgaatattataaaacaattaagcaagataatattgatgaatatatagaaaatgaggcagatatctatgatatatattatattaataatgataaaactattacaatagcaaggggtaataatgagttacgcaaagaataccaacaaaataaacataaaatcggctcatttgtatatcatacttttatacatgaattaggtcattctctagggctattccatatttgggaatacatactaaatgaaaagcataaagtattagattcaattaaatactcagttatgagctataagtgtcctgatattaaagatgcagattttggtggcctttatcctatgacctttatgctagtagatatattattgttacaatatctctatggcgaaaatatgaccacacgtcttgaaaataatacctatggatttaattccaatacgggacgcgctgcttactctttaaatagcatagaggataaattagtgagctgtatttgggattcgggtggaattgatacattagacttttccctatataccgttaatcaagtcattaatctcaatgaaggctgtttttcagatattggaggattacggagtaatatctctattgcctataaaacgattattgaaaatgcgattggtggtaaaggtgatgatactctcataggaaatccttttgataataacctaataggtggtgatggcaatgatttattctatggcggtgatggcaatgatttattttatggtggctctggaaacgatgttatatacggagaattgggaaatgatgtgctctatggtgatgatggagatgatatgcttatcgattattatggtgctaatatgttagatggtggtaagggtaatgatcggatctgtgtagcatcaacagatagagggcttccaggtagaaatatcattctagggggagaaggtgatgatgaaatatatttgggcacaggaactcatcgtataacaggtggacaaggaaatgatgcctttaattttttctgttatgagggagttgaaagcaatagctcaatttgggattttgaaaaaaacaaggataaaataacgttgatcactagagattatagaaaaatagatatatcaaaaatgaaaaaagttgataagttatcaggaagtaaaaatgaattttcattaaatcataacaaaccagccaataagaccatcatagatgtttcaacatcttctaacgacaataagtccattgtacatatagagattgtcggtatatttaaccacgatgaactctttgcggtataa

SEQ ID NO: 1808 - DNA, 783 bp, Proteus mirabilis
tacgtggttaatttactagcgcggttaggcgcgcgatcactgtcgatttttgcgacttttggtagagccggcatcatgctatttcgagcattgatcggtaagcctgagtttcgtaagcagtggccattattaatgaagcaactgtacagtgttggtgttcagtcgctactgatcattatggtttctggactttttattggcatggttcttggtttacagggctatctagtactgacgacatttagtgcggaagcgagcctaggtatgatggtagcgctttctttgttacgagagttaggccctgtggtgacggcactattatttgctggacgtgcaggctctgcactgaccgcagaaataggtttaatgaaagcaacagagcagatatccagtttagaaatgatggctgtcgaccctcttagacgagtggttgcgccacgtttttgggccgggtttattagtatgccattactttcactgatctttgttgcggtggggatctggggtggtgctattgtcggcgtggattggaaaggcattgatgaaggctttttctgggcatcaatgcaaggtgcggttgagtggcaaaaagacttagtgaactgttttattaagagtgtcgtgtttgccattaccgtgacttggatagcgctgtttaacgggtatgacgcaatcccaacatcggaagggattagcagagcaacaacgcgtaccgttgttcattcatcgttagccgtattaggtttagattttgtgctaactgcactgatgtttgggaattaa

SEQ ID NO: 1809 - DNA, 3162 bp, Proteus mirabilis
tctatgcctaagttttttatagacagaccaatatttgcgtgggtaattgccataattaccatgcttgctggtcttttggcactcatcaaactgcctgttgcacaatatccaacgattgcaccgccagcgatttccatctctgcggtctatccaggagctgatgcaaccacggtacagaatactgtaacccaagttatcgaacagaatatgaatggtatcgataacatggtttatatgtcttcaaccagtgattctgcaggtatgatgaatatcacgctgacctttgaagctggtactgaccctgatattgcgcaagtccaagtgcaaaataaattgcaattggcaatgcctcttttacctcaggaagtacaacaacaagggattagtgtcgataaatcttctagttcattcttaatggttgcaggttttatctctggtgatggctcgatgtcacaagatgacatcgccgactatgtaggtgcaacaattaaagatccattaagccgtgtcacaggggtgggtgaaacgcagttatttggtacacaatacgcgatgcgtatttggttagatccagataaactggtgaaatataacatgaccacacttgatgttattaatgcgattaaatcgcaaaataaccaagtggcggcaggtcaattaggtggtacgccaccagtgcctggtcagcgtttaaatgtatctatcattgcgcaaactcgacttaatacacctgagcaatttgctgatattctgatgaaagtcaatcaagacggttcacaggttaagctaaaagatctgggtattgttgagatgggggctgaaaactacagcacgattgctcgctttaatggcttacctgcagcaggtattggtattaaactggcaacaggtgctaacgcccttgataccgcaacagcagtacgtgcggcacttgctgatatggagccattctttccttctggattagaggtcgtttatccttacgatacaacaccatttgttaagatctctatttttgaagtggttaaaacgctcgttgaagccattatgctggtgtttgtagtcatgtatctgttcttacagaacttccgtgctacattaatcccaaccattgctgtgcccgtcgtattattagggactttcgccatattgtccgcgtttggctattcgataaacaccttgacgatgttcgcgatggtactagccatcggtctactggttgatgatgctatcgttgtagtagaaaacgttgaacgtgtgatgcaagaggaaggactgtcacctaaagaagcgacacgtaagtctatgggacaaatccaaggtgcattggtgggtattgccctcgtgttatctgcggtatttattccaatggcattctttggtggttcaacgggtgcgatttaccgacagttctcagttactattgtatcagcgatggtgctgtctgttttcgtggcattgattttaacccctgcactttgtgcgacattgttaaaaccaatcccgaaaggcagccatggtgtacaaacaggtttctttggttggtttaaccgcgtttttgaaaaaagtagtcaccactatacagacagtgtttctcgtacactgcgtggtacaggtcgttacttactgatctacgtcttacttgttgctgctatggcaattatgtttgtgcgtttaccggcgtctttcttaccagaagaagaccaaggggtattactgacaatggttcagttgcccgctggatcaacccaagagcaaactcaagacgtattagcacaagtcaatgactactttaatactaaagaaaaagatgtggttaagtcggtctttaccgtcagcggctttggttttggtggtcaaggtcaaaacatggggcttgctttcgtcgtattaaatgattgggatgagcgtaaatcagaccaagacaaagtccctgctattgtcggtcgtgctaaccaagctctttctcaaattaaagaagcctttgtttactcctttaatattccagcgattgttgagttaggctctgcaggtggttttgaattcgagttaatcgataatgccaacctgggacacgaaaaactcatggaagcaagaaaccaattgcttggaatggcagcacaagagccacaaatgttgacgggtgtgcgtcctaacggtcaagaagatacctctcagtatcgtctttatatcgacttagaaaaagcacaagctcaaggtgttgcggtcagtgatatctactcaacattaggtacgatgtttggtggtagctacgttaacgactttatcgaccgtggtcgtgtgaagaaagtttacgttcaagcagaatcacaattccgcatgttgccacaagatattgctaatctttatgttcgtaacaatgcgggtcagatggtgcctttctcatccttcattgatactagtaaagatccttggttatatggctcaccacgtttagagcgttataatggtttaccagctgtccagatccaaggtagtgcaacaccaggacaaagtagtggtgatgcaatgctaatgatggaacaactcgccagcaaattaccaagtggtattggctacgagtggacgggtatgtcataccaagaacgtctatcaggtaaccaagcgccagcactgtatactatttcattaattgtagtattcctttgtttggcggcactctatgagagttggtcagtgcctttctcagttatgttagtcgtacctttaggggtcattggtgcattagcatttactacattgagagggcttgaaaacgacgtttactttaaggttgggctacttaccaccattgggttatcggcgaagaacgccatattgattgtcgaattcgccaaagacttaatggaaaaagagggtaaagggctagtagaagcgacgttagactccgttagaatgcgtctacgtccaattctaatgacatcgttagcctttatgcttggggttattcctctggtattaagtaacggtgcaggctccggtgcgcaaaactcagtaggtacaggggtattcggtggtatgattgccgcgacatcccttgctatttactttgttcctattttcttcgttgtgatccgcagaaggtttgcgaagaaaaacgaagacttagagcacccaaactatccgcaccaaactaagtaa

SEQ ID NO: 1810 - DNA, 900 bp, Proteus mirabilis
atgaatactaaaataaaagtcgctattgtgggctatggcaatattgggcgctttgcactagatgcagtacttgcagcacctgattttgagttagtgggggtggttcgccgtgatagtcaaaatattccagatgaactgcgaaatataacagtaacaaatgatattaaaagattaggtaaggtggatgttgctttattatgttcaccaacgagagccattaaagatttggctaaatcgatattgagcttaggcattaataccgttgatagttttgatgtccacagtgatatcgttgcattaaaaacagaactggatgaggtggcgaaaaagcataaccgtgttgcagtgatttcagcgggttgggatccgggttcagactctattattcgtactttaatgttagctatggcacctaaaggtattacctacactaattttggtcccggcatgagtatgggtcatagtgttgccgctaaagctattgatggggtaagagatgcgttatcaatgactattccattaggtactggtgttcatcggcgtatggtttatgttgaattagaaacgggtgctaactttgcacaggttgagcaagccattaaggccgacagctatttctcatctgatgaaacacatattaaacaagttgatagtgttgatagcttaaaagatgttggtcacggagtacaaatgacccataaaggggtgtcaggcaaaacacacaatcaattatttgaatatgctatgcatattaataatccagcattaacatctcaatttatggtttctgcagccagagcaagtatgaaacaacaagcgggtgcctatactgtgattgaaattccccccgttgattttttagcaggggatttaactacattaatcgcaaaactggtgtaa

SEQ ID NO: 1811 - DNA, 963 bp, Proteus mirabilis
tttcgttataaactaggttttcaaaggataaaggctatgacaactccccgccttgctgttttaggtagcattaacgttgaccatattatgaatattgcacaatttcccaagcccggagaaaccgtgattggtcatgactataaaatagcatttggtggtaaaggggcaaatcaagccgtcgcttgtggacgtagtggtgccgatatcacgtttatagcctgtgtgggagatgatgctattggtcgcgaaatcatcgctcaattaaaaacagataatattgatactgatgcaattcgtattattcccaagacacctacaggtgtagcaatgatcctagttaatgaacaaggcgaaaatgtcattagcattgttgccggagcaaatagtgctctcactccaagccatttgcatcagtatcgtcatattattgaacaagcagatgctttattaatgcaattagaatcccctctagacactgtctttgaggcagcaaaacaagccaaagcacatcaaacaaaagtgattttaaatcccgctcctgcacagccgttatctgatgaatttctgagttttattgatattattacgccaaatgagacagaagccgaaatattaaccggtatttctgtgcatgatgaagtgggtgcagctaaagcggctaatattttgcacagtaaaggcataaaacacgttttaatcactttaggcagtcgtggcgtatggtttagtgaacaaggcaccggtatgatcattcccggttttcgtgttgaagcagttgatactattgccgcaggtgatacctttaacggtgcatttgttacagcaatattagaaggtaaatcagctcatgatgcgatccgtttcgcccatgcagccgcggcaattgcagtgacacgtcatggcgcgcaatcctccgtcccttggcgtgatgaaattaagtcatttttagcagagcgagcataa

SEQ ID NO: 1812 - DNA, 1977 bp, Proteus mirabilis
ccaatatataaggggtgtgtaatggttaagaatgtgttgaaaatctcaacattagcaatgttggtcgcattcaatgtgaatgctgcgacagtcgatctccgtattatggagacttcggatgttcacagtaacttaatcgactttgactacttcaaagacaaaccaacagaacagtttggttatgttcgtacggcgaatttaattaaagccgcgaaagctgaagcaaccaatgcgattttagtggataacggtgacttgatccaaggtagtccactggctgactatcaagcagctaaaggcttagagaaaggggaagctcatcctgcgcaccagttaatgaataccatggggtataccgtaggtaactttggtaatcatgaatttaactatggtttagattacctgaaaaaagccattgcgggcgctgaattcccatatatcaatgccaatatcatggatgcgaaaacaggcaaaaactatttcacaccttatatcattgttgatacaccagtaaaagatcgtgatggcaaagagcacactatcaagattggttatatcggctttgtaccaccacagattttaatctgggataaagccaatctggatggaaaagtcgttgtcaatgatattacagaaacagcgaaaaaattcgttcctcaaatgaaaaaagagggtgcggatctgattgtggctatccctcactctggtttctcttctgaaccttataaagctatggctgaaaactcagtctattatctgagtgaagttgatggcattaacgctattatgtttggtcatgctcacggcgtattcccaagtaaagaatttgaaggcattaaaggtgttgatgttgctaaaggcactgtaaatggtgttccagcagtaatgccaggccaatggggtgatcacttaggtgttgtcgatatggttatcaataacgacagcggcaaatgggtgatgacccaagcaacaggtgaagcgcgtcctatttttgataaagcaaacaaaaaagcattagttgaacgtgatgccgagttagcgcaaatcattgaaaaagcacaccaaggtactcgtgatttcgtcggaaaacatattggtaaagcgtcagctaatatgtatagcttcttagctttagtacaaagtgatccaacggtacaaatcgttaacgatgcacaggttgattatactaaacactttattcaaggtgatccgaacttagacggcctgccagtattaggtgcagcagcaccatttaaagccggcggacgtaaaaatgcacctgcagacttcgttgaagtagaaaagggtgacttaacattccgtaacgcagcagacttatatctgtatccaaatacattagtggttgtaaaagcaaccggtgcagatgttgttgagtggttagaatgttcagcgggtatgtggaaccaagttgatcctaattcaactaaaccacaatacttaatcaactgggatggtttccgtacttataacttcgacactatcagtggcgtagagtataaagttgatttaactcagcctgctaaatatgacgttgattgccaagttgtcaataaagatgcaaaccgtatcaaaaatgtcacttaccaaggcaaacctatcgatcctaaagcaactttcttaattgcaaccaataactatcgtggatacggtggtaaatttgcgggtacaggtgaaagcaatatcgcctttgcatcaccagatgaaaaccgtgcaatcttagcttcttatattgctaagcaaacgaaagaaaatggcgaagttgcaacaaaagctgcgaataattggtctttcttaccgattaagacagataaacaattagatgttcgctttgaaacttcaccaagtgaaaaagccgctaactttattaaagattttgctcagtatccaatgacctttgtggaaaatgacgatatcggttttgcaatttacaaaatcgacctaactgagaagaaataa

SEQ ID NO: 1813 - DNA, 186 bp, Proteus mirabilis
aatagatataatagttatcaacactttttattactgaaaatagcttgtggtgaattgttaaatatttgtatttacaatatgttacattcggtttttacgtatttttcattaaccattatgatattatggttattaaaaaatttattctgtgactgcaatcatagaaataaaattaattatcgttag

SEQ ID NO: 1814 - DNA, 4488 bp, Proteus mirabilis
ggtgcccataaactgagtaggaagcaaactatgctctatcaaaaaacagcggaaaaagagaattgtggttttgggttaatagcccatattgaggggaaagccagccataaaattgtcagaaatgcgatccatggccttgcccgtatgcaacatcgtggcgcgatcctttctgatggaaaaaccggcgatggttgtgggttattattacaaaaaccaacgcgcttttttcagttaattgccgaagaaaatggctggcatttagcgaacaattacgcagtaggcatgctgtttctaagccaagataatgctatcgctgcacagtgccgtcaaattgttgaagaagaattgcaacgagaaacactctctatcgttggctggcgtaaagtaccaactaacacagatattttaggcagtatcgccctctcttctttaccgtcaatagaacaaatttttgtcaatgcacctgccggatggcgtattaatgatattgagcgccgcttatttgtcgctcgtcgccgaattgaaaaacgtattaccgataatgatttttatatttgtagcctctctaatttagtgactgtctataaagggctgtgcatggcaattgatttgcctcgcttttttactgacttagcggatttacggatggaatcgtccatctgtctttttcatcaacgtttttccaccaataccaccccaaaatggccgcttgcgcagccctttcgctatcttgcccataatggtgaaatcaataccattaccggaaatcgtcaatgggcaagagcaagagcctataaatttcatacgccgctgatccccgatttacaaactgcagcgccttttgtaaatgagagtggctcagactcaagctcactggataatatgctcgaactctttcttaatggggggatggatattgtccgcgctatgcgcctattagtgccacccgcatggcaaaataatccacaaatggatgatgatctacgtgctttttttgattttaactctatgcatatggagccttgggatggacctgcggggatcgtgttatctgacggtcgctatgcagcctgtacactcgatagaaatggcctgcgtccagctcgctatgttatcacgaccgataatattattacctgtgcttctgaaattggcatttgggattatcaacctgatgaagttctagaaaaagggcgtgtcggccctggcgaactaatggtaatagatacttatcaaggtcgcattttacattctgctgaaactgacgaagatttaaaaaggcgacacccgtataaactttggttggagcgtaacgttaaacgcctgatcccttttgagcaattgcctgagccacaagcgacaggagagcgcgcttttgatgatagcttactggcgacataccaaaaacagttcgcttatagccaagaagagctggaaacgattttgcatgtactggctgaaaatgggcaggaagccaccggctcgatgggagatgacacgccttttgccgtactttctcagcgcccacgcttaatttatgactattttagacaaaaatttgcgcaagtgaccaatccgccgattgatccattaagagaagcgcatgtgatgtctttagcaacctgtattggtcgcgaaatgaatgtctttagtgaagcggaaggacaagcccatcgcctcagttttaaatcacccattttgctttatagtgattttcaacaattactcaatcaagaaagcccttattattcatccatcacgctagatatcacctatcaaccgactgaaaataatttagaaaccgcactacacatcttatgtgaaacggcgcaacaagcggttaatcgtggtgcagtattactggttttatccgacagaaatatcactcaagcgcgattacctattcctgcgcctatggcagtaggcgcggtacaaaaagccttggtagataataatttacgctgtgatgccaatattattgttgaaactgcaagcgcccgtgatccccaccacttcgctgtactattaggttttggcgcaaccgctatttacccttacctggcttatgaatccttagcgcaacgagtcgataaaaaaatattgtcgggtacttatgcgcaagtcatgctcaattatcgtaatgggatcaacaaaggtctgtataagataatgtccaaaatggggatctccaccgttgcctcttaccgttgctcacagctatttgaagccgtagggttgcatgataatgtcgttaaacgttgcttcgatggggttgataatcgtattaacggtgcagattttagcgattttgaacaagacttatttaatctatccaaacgtgcttggctaactcgctatcctctagacgctggtgggttattaaaatatacccatcaaggtgaatatcacgcctataatcctgatgtggttcaagcgttgcaaaaagcggtaaatagtggtgactacgctgattaccaacattattcccaattagtgcaacaacgccctattaccaccttacgtgatctattagctctcaatgacacaacccctattgcaattgaagatgtcgaagcagaaagtgaactgtttaaacgctttgatactgcggcgatgtcaattggtgcattaagtaaagaagcccatgaagcccttgcgcaagcaatgaataccttaggcggattttcaaactctggagaaggtggtgaagatccggcacgctacaacaccaacaaagtttcgcgtatcaaacagatagcttcaggtcgtttcggtgtcacgccgtcttatctaatgagtgccgatgtattacaaatcaaagtagcacaaggggcaaaacccggtgaaggtggccagttacccggtgataaagttacgccttatattgcgcaactgcgttatgccgtaccgggagtcacactgatttccccgcctccccatcatgatatctactctattgaagatttagcacaactgattttcgatttaaaacagattaatccccgtgcgcttatttctgtcaaactggtctctgagccgggtgttggtacaatcgccaccggagtcgctaaagcttatgcagacttaattactattgcaggttatgacggcggtactggtgccagcccattaacgtcagttaaatatgcaggtagcccttgggaattagggctagtagaagcgcaacaagcattagttgccaacaatctgcgtcataaagtgcgcttacaagttgatggtggattaaaaacgggggttgatattataaaagcggccattttaggagctgaaagttttggtttcggtaccgggccaatggtggcgttaggctgtaaatatctgcgaatttgccatttaaataattgcgctatgggggttgcaacccaagatgaaaccctacgccgccaacattttcatggtttacctgagcgcgttatcaactatttccgctttattgcccaagaaacccgtgaacttatggcacaacttggcgtaaggaaaataaccgatttaatcggcagaacggatttgctttcttgcttagaggggataaccagtaagcagcaaaaattatcactcacaggattattagaaaccgcgtcctctcctacaggtaaagcgctctattgtcaggagcacaatgatacttatgataaaggagaattaaatcaacgtattgttgcgcaaaccatcactggcgtcgaacaaaagataagccaaacccactatttttccattcgtaacacagaccgttcagtgggagccacgttatccgggctcattgccaaaacctatggtgaaagtggtttatctgctacaccaataaaacttcactttacgggtactgctggtcaaagttttggcgtttggaatgcgcaaggggtggaattaaccttagtgggtgatgccaatgattatgtcgggaaaggcatggcgggtggacgcattgttatttcaccgccagtcggttctgcctttaaagcccatcagaccacgattatgggaaatacctgtttatatggcgcaacaggtggaaaactgtatgcatctggattagcgggtgaacgttttgcagtcagaaactctggcgccattgcggtgattgaaggggttggggataatggctgcgaatatatgaccggcggtattgtctgtattcttggtaaaacagggattaactttggtgcagggatgacggggggctttgcctatctgttagatgaagataccacactatcacaacggatcaataacgcctctattgagcttcttcccgtggctaattatgcgattttggcagagcatcttcgcggtatgatcgcagagcatatacggctaactggctcccaacaaggagaaagactactttctcaatgggaatattggtcacaacactttaaattagtcaaacctaaatcgagtgatgttcatgccttattaggtcatcctcgccgttcagtcgctgaattacgcgttcaggcacaatag

SEQ ID NO: 1815 - DNA, 1623 bp, Proteus mirabilis
atgaaccataaatataaactcgtagcccttgcagtaagctccgtcttattagcaggttgtgctaaaaattatgacgaagcgaacgtcgttgatgtccgtgtgattgcactcaatgacttccatggtgcattaaaagcaccaggtccaaacaagcctggtggtattgagcatatggctacgctggtcaaagagctgaaaaaagataacccaaataatattgtggtagctgccggtgatatggttggtgctagcccactgttatcttcaatgttccatgatgagccaactattgaagcgctgtcattagcaggtttagaagcaacttcagtgggtaaccacgaatttgataaaggtatgggtgagttactgcgtaagcaaaacggtggttgccatccagttacaggttgtcaaggtcctactgaatttaaaggtgctgatttccaatatttagcggctaacgtgactgttaacgaaacaggtaaaacgttattccctgaatatgtgattaaagagttcaatggtattccggttgcctttattggtttaactttagaaggtactgcggctatcgtgacaccaaaaggaactgaaggtttaagcttccacaatgaagcaaaaacaatcaacgcattagtgcctaagttacaagctcaaggtgtacaggcgattggtgttctgatccacgaaggtgctgcacagcgccgtgatggtggtccagtaaatatcaacgcatgtaatggtattacaggtaaagtacttggtgtggttgaacaattagatccagcggttgactttgttgtaacgggtcatactcaccaagcttataactgtactattaacggtagatcagtgacttctgcacaatctaatggcgccatgttaacgcgtatcgacctgaaattagataaaacaacgaaagatgttgttgatgtagaagcgcgtaatatttgggttgataaccgcaaatatgaaaaagatcctgctgtcactaaactgttggaagcttacgagaaaattgctacaccattagcgaaccgtattattggtaaactagaaggtaacttaaccaagcaaactaacgatgcgggcgaatcgggtctaggtcaagttattgctgatgcccatttatatacggcaaaaccaaaagatatgggtggcgcacaaatcgccttaatgaacagtggcggtattcgtgctgatatgacgggtggtgatgtttcttataacgctatttataccgtacaaccattctctaatgtactgttaacacaaacattaacgggtgagcagatcaaacgcttattagagcaacagtgggatcgttcacgtccacaagtattagcggtatcgggtaatttccaatatacatgggacagcaaagcacctgttggacaacgtgtgattgttgaatcaatgcgtattgatggtaagcctgtggatatgaaagcgaattaccgtgtagttgcaaatgaatacttagcaacaggcggtagtaacttctctgtactgaaagaaggtaaagatccggtttacagcgtgccagatgttgatgcagtagtgaaatactttgctgagcagtcacctattgctcaaccaaaagcgaacaacattactcgtaaataa

SEQ ID NO: 1816 - DNA, 486 bp, Proteus mirabilis
tcatataataataaatacccattaatacgtattaaaaatgcccatcacattgttgattttggagacgttatgattaataaatttaatcagcttacaaaccaccccgatttaggtaagtttgttttacgtgtttcgctaggtgtcttaatgttattacacggattacacaaaatggagccaggaggacttgccggtatacagggaatgttggcaaatattaacttacctgcatttattgcttatggcacattactgggtgaagttctatgtcctatcttactgattatcggtttatttactcgattttcagcatttgttgtggcggcaaccatgggggttgcggtgctgatggtacattccggtgatcttttagccttagatcccaaaacggggggatgggcacctgaaagtgctggcttctatatgtttgctgcgattgcggtgatgtttttgggtagtggtcgttgggcgctcaaaaaagattaa

SEQ ID NO: 1817 - DNA, 1368 bp, Proteus mirabilis
ccatccaataacgatatattaacaaatcttatggcacatcgattaacttccagagacattctggcattaggttttatgacttttgctctatttgttggagcagggaatattatttttcccccgatggtggggttgcaatcaggggagtttgtttggactgcggccattggttttttgctaaccggagttggcttacctgtgctaacagtggtggcattagcgaaagtgggagggggaattgaagcattaagcacccccattggtaaatctatgggacttttattagcaatagtcgcttatcttgctgtcggccctttatttgccacccctcgaaccgcaacggtctcttttaaagttggcattgcccctttagtgggtgatagtgatattgccttacttatttatagtgttatttactttttaattgttatcggtatttcactgtatccgggaaaattacttgatagtgttggtcgcattctggcaccgattaaaattttagccttagctgtattaggtttagctgcgctattttggccagcaggaacgccgatccccgctacacaagcatatcaagatatggcatttacccaaggttttattaatggctatcttaccatggatacgttaggcgcgatggtctttggtattgttattgtcaatgcggcccgctcaagagggattgataattcgtctttattaacacgttatactatgtgggcgggaattatcgcgggggtgttattaacggcgatttatcttagtttatttaagcttggttctgctagcggcagcattattccagaagcaaaagatggcgcagatattttacatgcttatgtgcaacatactttcggtaattttggtagtttctttttagctctgcttattttcttagcttgtatggtgacagcggtaggtttaacttgtgcttgtgcggagttttttagccgctatttgcctatttcttatcgtacattagtattgattttggctgtattttccgcggtagtctctaatcttggtttaagtaaactgattgcgttctctattcctgttctggtgatgatttatcctccttgtattgtgattattctgatgagtttcactttacgtttttggcataatccaagccgtattattgcccctgcaatggcaataagcttattttttggcatttttgatgccattaaagcatccgatcatttaaaacatttattaccggattgggcggctaaattaccattaagtgagcaaggattagcgtggttaattcctgtattagtgactattgttgtatgcgctatttacgataaagtagctggctcacaacataaaaaagtgatccactctgggataaacaaataa

SEQ ID NO: 1818 - DNA, 1485 bp, Proteus mirabilis
tcaacgaataaaccatataaaaagtttttttgctactggttcatcaatttagctattcccttattcataaagcatgtaaaatcgctccactttcctctaattatatttacaacactatttcactcgtttttaagaaggttttcaatgcatcaatctgatgtagcggatcgctcacttttttcccttagctggcctatttttattgatatttttcttcatcttgccacgctattgattaacacttacatgataagtcatgtctctactgcctatttagctgcaatgggcgtaggtaaccaagtttttgatctttttatcaccatatttaactttattagcgtgggatgtagcgttgttattgctcaatatttaggcgccggtaagcgcgataaagccagtcaagctattcatatttctatcgcctttaactttttgctgggctttagtagtgccattattattctcttttttggctacaacattctaaatgtaatgaatacgccagagcatttagtacaagatggctataactatctccatattttggggatttgtcttattcctgaagcaatttcaattatcttagcagcctgtttgcgggtttatggtaaatcgaaagcggcgatgtatgtgacgttaattgccaatattgtcactgttatcggcaatatgattgtactatatggtttctttgggcttccacaatacggtttagtgggtgttgcatggtcaacagttgtcggtcgtattattgccgttgtcttattatgtggtcttttattctatggattaagaattaaattcgatataagactattagtgatttggtctaaaaatatgttagccaaaattctacatattggtttacctgctgcaggtgaaaacctagtgtggattttacattatatgaccgcctctgcctttataggcttaatgggagaagttcctctcgccgcacaaacactctatttccaactatcattattcttaatgttatttggcattgcgattagcattggtaatgaaatattagtcggtcatttagttggtgcaaaacgatttgatgatgcatttacacggggttttaaaagcctaaaagcaggtgtgctatttactattggcgtggtgattatttattggtttatgcgtgatcctattttgtattctatcaccgaagatcaacgcattatcgaccaactgttgcctttatttattttatcggtctttttggagcctgggcgtacatttaatattgttatggttaatgcgttacgtgcagccggagatgccaaattcccactcattacagccgtttgttttatgtggggagttgctattcctattggctatttccttggtataaaaatggaaatgggtttaattgggatttggataggttttctttgcgatgagtggctacgaggcttaacaaatgcatggcgttggcgctctcgtaaatggcaagctaagcgcttagatatttga

SEQ ID NO: 1819 - DNA, 2025 bp, Proteus mirabilis
catagagataaatcttgttcatatttagcggaatcaatgagctatcaggtacttgcccgaaagtggcgcccacaaacttttaacgatgttgtcggtcaacgtcatgttttgaccgcattggctaatggtcttgatcaccaaaggttacatcatgcttatcttttttctggcactcgcggtgttggaaaaacgacgatcgcccgtctatttgctaaagggctgaattgcgaaacaggcataaccagtaaaccttgtggtaaaccttgtggtaaatgtgctaattgccttgagatagagcaagggcgttttgttgatttaatagaaatcgatgcggcatcaagaacgaaagttgaagatacacgagagctactcgataatgttcaatatgcgccggctcgtggtcgttttaaagtctatcttattgacgaagtgcatatgctttctcgtcatagttttaatgcgttacttaaaacgttagaagagccacctgaacacgttaaattcctgttggctaccacagatcctcaaaaactacctgttactatcttatctcgttgtttgcaatttcacctgcgggcacttgatgttgaccaaatagcgacacagcttgagaaagtactatccgcagaacacattgaaaatgatgtgcgagcacgccaattaattgcccgtgcagcagatggaagtatgcgtgacgcattaagcctaaccgaccaagcaattgcgagtggcgaaggtattgtaagtacagaagtcgttagtcgtatgctaggcacgattgatgatgcacaaccattagcactgattgaagctttagtaaaagcagatggccaacaagtgatgtcgttggttaatgaggttgctttaagaggaacggattgggaaaactttttagtcgaaacgctctcattattacatcaaattgcgatgttacaacttttgccgagtgaaaataatccccaagagcaatttacacaagagcgtttacgtttattagccaaatcagtgtcgccacaagatttacaactttattatcaaactttattagttgggcgaaaagagctggcttatgcgccagacagacgtatgggtgtagaaatgacccttctcagggcgcttgcttttcatcctaaaactgtcattgatgaaatccctacggctcctttagcgcaaacattgcctttagcatcacagccgaatcaacagcgagttgaaacatcggcgcctcaagtgagaagcaatatggcaacggcgacacccaaagtatcaccgtcgccagaaaacagtgctgcattaggaaatagccctgcggcacaactgttaagagcacggcaagccataaggggagctgagcaagaaacgccaccaaaaaagcctcaaccggcgacgcctaaacaggctaagccggctgctagtgcattagagcggctagcagccgtcagtgaaaaacgccagcaaagggttaatgaaaaacggtcatctgttgcagtcgagaaaaagaaaaaagaagcttatcaatggaagccacaaaatccacaggcacaagtaactgagcccgtggtctcttcaccgaaagagatcaaagaagttcttgagtatgaaaaaacgcctgaattagccgctaaaattgcgcaagagtcgcaacagcgggacgagtgggcggcggaaatagctaaaatgccattgccgaagttagtgcagcagttagcgttaaatgcctataaagagacggtcggtgaagaaacgatcattttgcatttacgcagtaagcagaaacatttaaattcagcaaatgcactacgaacactgacaaatgcgctaagtgaattgcatggaaaagcaatttcactcacaattatagaagatgataatctaacggttaaaacgccgttagaatggcgacaagccatttatgaagagaagttggcgttagcgcgtcaatcgattactacggataaaaccattcagacattacagcactattttgatgctgaattggatgaagagagtatccggcctgtttaa

SEQ ID NO: 1820 - DNA, 186 bp, Proteus mirabilis
tttaattgtaattttcttcaccttacggaaaaatataatttatttccgttcttttataaagcttcaagatcatctgatgttttattcaaattttcttacaaacttttctttcctagcgataccactaacatgctagattgcaataccgaaaagttttttctaagaaaaataacaaaaataggttaa

SEQ ID NO: 1821 - DNA, 477 bp, Proteus mirabilis
tttttcatcaatttatctatcaataaagagcttctgattatgcatgagtcattaacaatcgcgctattgcaagcacgggaatctgcgatgggattttttcgccccgttcttaaagagcataatctgacagagcagcagtggcggatcatccgagttcttgctgataagcgctctatcgattttcacgaattagcacaaaaaacctgtatcctgcgtccaagtttgacaggtattttgattagaatggaaagagatgagctaatttgtcgattaaaaccagtgagtgatcaacgtaaattattcgtttctctatcaaccaatgggcaaaatttatatgataaaatccagcctaagatagaagaagggtaccaattactcgaacaaaagttttctacagaaaaactgcaacatttgtctatcttactgaaagaactgatagcgttaaatccagaaaatagtcattcaactgaaaaataa

SEQ ID NO: 1822 - DNA, 234 bp, Proteus mirabilis
agaggggtcaatgaggtgattgctaagaaaaatcaaacggtaatttctttccattcaataatgtgcaatgcccctgttgggcatgctgaagcgcattcaccacataaattacatttaccggattttttcgtttgtggattgacggttgccatcatccacgggcaagctgttgtacaagcggcacagccgatacaacgacgagtatcaacgacaatacagccaaactcttcttga

SEQ ID NO: 1823 - DNA, 1080 bp, Proteus mirabilis
ccgcttaccaataaaaaaggaaaaaacgctatgcaggtcacaaggaaacaagagcgtgttattcgtcaagcacttgatcattggcaacaatctggtgagctatcagcacaacagcatcaacaactagaaagtacattacaacgccttccctttgattggaaaagattgagtcgctatgctttttggatagctattgcctgcttaattattgctgccgttaacctttttagtgataccgcgttaattcattatcttatcgaattatttagtatttctgagattatgcgtgtggtatttcctgcacttattgctggtatgttttatttttggggctttaaacgccaacgcaaagaaatactatggcattacagtactgagtttattctctttttagggatattatttacggcggtttttctttggcaactcggtgagttgttagatgatggtagtggtaatattgcgccacttcttttaatgggttgcattatttatgctgtgattggctttatcagtcgctcttcattagtgtggttatttttcttattaatgttgggcaattggtttggtgctaaaacgggttatatgtccggttggggcgcttattggctaggcgtgaattatcctattcgcttcgtgttatttggctctgcattattagcgggatgctattttttgcaacatattttaatgcgtcgtcgcttattttttatgacaaagataatgggactgttttatctctttattgcgttgtggatcatgtctatttttggtaattacgatccggatacgtggtattacatttcaagtgtgcagttattaccttgggctttattatttgctgttgttgctgtcatttgtatttatatcagtttaaaaaccgatgatggcatgttgagaggctttggactaacattccttggtatcaatctttatacccgcttttttgaatatttctggaatagcttacatagtgcaattttcttttttatcttggctatttctctgatttttattggacgtaaagcagaaaaaatttggcatgccattgaaaatagccgcatggtaaataagcaataa

SEQ ID NO: 1824 - DNA, 573 bp, Proteus mirabilis
cagaataccaataggagcgttttgatgaaaataaaaacattatcgatccggttcatattgggtctatctgtatccatagggttaacttcagcggcttttgcaataccggacaacctctattttcacggcatattagttgatgagccttgtaccataaaaccgggtgatgaaaccgtggtgctcgattttggcaatattcctgataaaaacctttatgcctataaaagaacgccaagcaagttatttcaattacgtctgtcagaatgtgatctctcaatcggtaaaagcgtcaaaataacctttaaaggagaggaaaaccaagcaatggcaggagaaggatttttggcaataagtccgggcagccaagcttctggtattgcggtgggattagagtctgaaaatggtaatgctctacctataaataaagaaacagacaagatgtcattaactgcgggtgacactattttgaatttttatgcctttattcaaggtgagccggatgcgattgcgaataagtcgattaaacgtggtccttttagtgcaatagccaccttctatttgaattatgactga

SEQ ID NO: 1825 - DNA, 2853 bp, Proteus mirabilis
tttcattacaagcgccgactgcgtcctcctctcaatcagctggagttactgaatatgtatcgtaagttactgattatctcagtcagtttatcacttctgggttgtgcaacaggcaactcgtctgagcataccaataatgccctttcactgcgccccgatattcgccattttacgcttgataatggcttaaatgtctatttgctacaacgcccacaaacgggggttgaaatgcgtttactggtgaaaagtggctcggtacaagaagatgaaaaacaacttggctttgcccactttaccgagcatatggcctttaaaggcacgactcattttccgggaacaactgggtttaaacagcttgaaagcctaggaatgaagttggggagtcatgttaatgcggcaacgagcttaaactcaacaacctataaattatccctgcctaatgccaatccgacccaaataaaaacagggttgaggatcttatccgattgggcctttggcatgacatttgatcccgttgagtttgataaagagcgtccggtgatcgtcgaggagtggcgattacgccaaggtattggttttcgtattaatcgccaacttgaagagttacgttattatggcagtcgttatctagatcgtgatcccattggggacttagatatcgttaagcatggtgatgtcaaagaagcaaaacgttattacgatacttggtatcagcctgaaagaatggcattggtgttagtgggtaattttaatcaaggtgatgcgattgctgatattacccagatgttcaatgcaaaaaatagtgaaaacaaaggcgttgactctccatcatggcaccgctttatcgacaataaagatttattagtaaagacgatttttgataaagagcaaggctcacgcattgtgcaattcactctacagcgtacactgcctgcaccattaaatagtcgccaaggtcaatatgatgatttaatggactcgttgtggctctccatcttaaaccagcgcttttcaaccattgttgataatgggttagtgccttccgtcagtgccaatacacaaggtgcgatgttagatgcccgtcgctcacaacaattgatgattgcccatcctaaaggggatgattatcaaggtacattagatattctatttactgaagtacagcgtttagcctcacagccagtatctcagcaagagttagataatgcccgcaatgcgctgttaaaacgtcttagccaacaagctgctggtgaagagcgctatgagcatggttatttagctaaccaaattactacggcacttgaattagaaatgccaatccaaagcaaaaagcaggcgttaaacttaagttatcaactaataaataacgttacacctgataccttaaaacactattttgcccaatacctaacacaagcttcaccacgagtggcaattatcggcccagatagtgatagtcaggtatttagtgccactaaagcctcgcaacgctggcaagagattagacaatctgatcccggtgcgtttacattgaaaacccatgcggtggtattagatattaaacctgagcaaaccggtactgttgtcaccacacaaacacttccgattgaaaaaacacagctgtggacactgagcaataacgtaaaagttattattaaaaatgaccagtggctaaaagacaatatccaagtatcactgcgtattcccggaggtgtttctctggaaacaggacaaagtttaggcttggttcagtgggcattaaacttaccagaagtgagtggatatgggcattacaacgcaagagagttagcgttatttagtaaacagcatcaaatcagtttgcgtccatacagtgagttgttattccacggcttgcgtggcgaagcgcctattgatgagttagacaccttgttggccttattgcatttaaaagtgacagcaccacaatttaatgggcaaaaattagagcaacaaaaacaagcaacggcattagggatcgccaaaacaccagttgaacgtattttcttagatcatattaataaagagagctatcaaaacggtgagcgcttagtaatttcgccacaaggcccttggcaacagtttaccgcacaacaattacaacaaacgaatcaatcacttctaggacagcctgccgatatggtattggtgattagtgggcctattaacctaaatcaggccaaaccgatgatcgaacgttggatagcaacgctgccgacacgttcatcgcaacgtctattttgggctgatccggcgattaatcccaaattaagctcatttaataaaacctaccctattgccagtagcgataagagtatgatcagtattcaatacgcagccaaagcccaatggtcacaacagcaactgttagcacttaacttgcttgataccgttgtcagccaacgtttaagacttaatcttcgtgaacgagcgggcgggatctactcgctaggcttttctgagtcactaaccaagctgccaagtagtttttataccggacgtttaaactttaccgcatcaccacagcgggcagatgaattaattgcacttgcgcgtaaagtggtcaatgacgtaaaacaagcgggtattaccgataaagaattacaagaggcaaaaaatatttggttaactgaatatgggcaagccaaagagagtgctagctattggactgatgcacttgcccaagtggcaacagatgaccaacaatatcaacgactattaactgagactgcgattgtcaacggaataagtgtcagtgatgttaatcaagttgctcgtcagtggttgggtgaaaatgaaaaaatcttcaaactaacaccaccaacaaagcaataa

SEQ ID NO: 1826 - DNA, 213 bp, Proteus mirabilis
aatagtaacaatacaattttatttataaattaccctgttttattaaaatggggtaatttatttttaactattataaatattaatccccctcctaaaaacaactattttaataattattctcattattgtttaataataatttcctccaacacctttctacaaaaaatagttgttttattttgtataaaaataacatctatgctctatagttaa

SEQ ID NO: 1827 - DNA, 990 bp, Proteus mirabilis
tcactcaacaaagattatatgctgaacttaatcaacaaactttcatttaaattaaataataacgagaaatactattcatctactgaaaatagagagaagttattactacaacaaaatcgtttattaaatgaaaaaagtgcagaattaataagtgaaataaatggttataaagcagctatcgatggcattactagtcgcctaacccatctaaagcgctcaattcagaataaaaagagtcaaattagtaatctacaaaaccagcttaatgatttacaaattttagctaatgaaggatatattcctcgtcaccgatatcaagaaatgataagagaattagctgaaaataataatcaacttaacgagacttttgggcaaataagcgcattagaaaagcaaaaattagaatatgagcaaagaatattgcaacgtaatgctaattactaccaattagctcgaacagagctaaataaaatacaattacaaatcagtgaaacagaaaaacaacttattatagaaacagataaattagctaaaatggcaattatcgcaccgatatcgggtactgtgatggatctttctgtttttacccaaggtggctttgtaaaaacaggtcagacattgatggatatagtgcctgaagatcatcaacttgttattgaagcgcgtcttgctccgcatcttattgataaggtaactcctggccttcccgttgatttgatctttagtgcctttaatcaaaataccacgccaaaaattcctggtgaagtaacgattatttctgccgatagattaattgatgaacgaacaactgagccatattatcaagttcttattaacataaaagattatacattattagcagataataaaaataaattgaaagcaggtatgcccgttgatgtatttattaaaactggcgatcgctcattattaaattatcttttcaaaccagtattggataggctccatacttcattaacggaagaataa

SEQ ID NO: 1828 - DNA, 216 bp, Proteus mirabilis
agaaaagacaacatgactaaaacagactatctaatgcgtttaagaaaatgcacctcaatcgaaacccttgaaagagtgattgaaaagaacaaatatgaactgaccgatgatgagttagagctattttattcagctgcagaccatcgtttagcagagctaaccatgaacaaactttatgacaagatcccagcatctgtttggaaatttgtaagataa

SEQ ID NO: 1829 - DNA, 258 bp, Proteus mirabilis
aaactggacaataaaaatgacactgccggtaacacgcatactatttcacccttattattggccaatccattgggatctgagggtgaggcaaacttcctcccatataaccacaacaccaatcatatatttctcttatatagggtgttggcactcgaagacgttccccaagagcaacaagaagggctagtccataggcaatgtcttcctgaaaaacccgatgttgtttgtcaaaaatataaccatgggattgtgctgtag

SEQ ID NO: 1830 - DNA, 252 bp, Proteus mirabilis
acattatgcaatgaaggatctttttgtaaaaaagggttggtagtagctaagaagaagttctgcgctcaatcattaaataatgcaggcttatcagtcagtaaagcttgtcagttgacattgctatctcgctcagcattctaccgccaacctatcaattgtcttaaaaaaggcagtgtggtgagcgatgcaattcaatcagttttagctaaatcgccacaatcaagattttggagcgcacagagtcaaatttaa

SEQ ID NO: 1831 - DNA, 1095 bp, Proteus mirabilis
aaatggagcaactttatgagtacacctttcaaactgaaaccgttagtggcgggcgttcttttaactctatctttaagtacaatcgcacaagcagcaagcgataaagtagtgattgcccatcgtggtgccagcggttatttacctgaacacaccttacctgccaaagcactcgcctatgcacaaggtgccgattatctagaacaagatctggtgatgacaaaagataaccaactggttgtcttgcatgatcactatctcgatcgtgtcaccgatgttgctgaacgctatccagtcagagcaagaaaagatggccgttactatgctatcgattttactcttgatgagatcaaaggactgaaatttaccgaaggtttcgatattgttgacggtaaaaaagtccaaagttatccaaatcgtttcccaatgggaaaatccgattttcgtatccacactttccaagaagagattgagtttatccaaggcttaaacaaatcaacaggacaagatattggtatttatcctgagatcaaagcaccttggtttcatgaacaagaagggaaagacattactaaaaaagttctcgaagtcttaaaacagtatggctatacccaaaagagcgataatgtttatctacaatcctttgatcctaacgatctaaaacgcattaaaacagaattgatgccacaaatggggatggatttaaaactagttcagttaatcgcttataccgattggaatgagacatatgaaaaacaaccagatggtacatggacaaactacagttatgactggatgtttaaacctggcgccatgaaagaaattgcgacttatgctgatggcattggccctgattatcatatgttagtagaagaagactcaacaccagataaaatcaccttaaccggtatggccgccgatgctcgtgccaacaagttaaccattcatccatttacggtacgagtggataaactacctaaatatgccaaagatggcgatcagctttatgacattatttataaccaagcgggtgccgaaggggtatttactgacttccctgatttaggggttaagttcttacaaaaacaagctaaataa

SEQ ID NO: 1832 - DNA, 1803 bp, Proteus mirabilis
tgtaagggcaataaaatgaatagagttaatgatgtaggtgtatttaataagggaatagagttatctactaagaaagattatttaggatcatgttatgtaactattgcaaagaacataaaggatatttctaatacaacggctaagcccagttttataaaaaaagttattcatatgatggaacgatttacaatgttttttgcaattagccaaaccggtagaatgggaataagtaatagagatggaaatttaaatagatatactgaaacacttactgatttaaagattaaggtgaaagatttaaagtgtaagatagatgagtttaataataaactaataaaaaaagatacagtagataaggaaaaagctgagatagctacaattacagctgaatatcataacctaaaccattttctctctttaatagagaatgaaaattcaagttttaaagatagatatagttttttcaattatttaaatgagttgcaacgagcggaggccttttgccgaaattcatcaaatacagattataatcgtctggcggatgaatttaaaaatattattaaggaaagagttgaaagaataaaaaaagaagatgttataaaaatatttaatgaagtgttggtaaggtatgataatgaaactcgatttaaaaatagcaatgaaagaatactagctaatttttcaagtaataaggagaaagaaaaatttctgtctaaaataaattttctagtctgtgtttcaaaatataatcttcctcttatggtagaggtagagcagcttaaagaagaatttccagtacagttacgggaaataatgaataaaattctttatgaagaaagtataatgggtgaaattcttaatgaagcgaatattgattgcgtatataagtattcacttaaaaaagtgcaaaatatttggattgaagaatatataaataagttttatggtggtgaagaaataataatggataaaagtacagatgataatgtcgcttattttgtgggggattttgagtgggatagttttgatggaattaataatactaataatgacaatatgaattctaaacgtaatctttctgaagcaagtgaaattattcatggaaaattaaataaacatgttaaaggcgatgaaatatctgatttaacttctattctggaacaaatagaactagataaattaggaggaaaagaaacatatactttaatttctattctgaaagagatgggactgggtaatttagaatggaaagaaatatataatttaatttctattctgaaagagatggaactaggtaaattagaatgggacgaaatatatactttaatttctattctgaaagagatggaactagataaattagaatggaaagaaatatataatttaagttctattctgaaagggatggaactaggtaaattagaatcaaaagaaatatataatttaagttctattctgaaaaagatagaactagataaattagaatgggacgaaatatatactttaatttctattctgaaagggttagaactaggtaaattagaatgggacgaaatatatactttaactcctcttctgaaagagatagaacgaggtaaattaatagggaaaggaatatataatttaacttatattcaggaagaaacagaactagatgaagataatataaataagggtaatttaaaagaaggtgatataaaatatgctaatattgttgaattagtcgaagatcaagtatttacacaattaaatgtagatggatttaacataatagatagcgactatgcgttctcatctgaataa

SEQ ID NO: 1833 - DNA, 216 bp, Proteus mirabilis
gtggctttaaatatcgttgttgcatttgatttgctaaaaagtgtgattaacctcaaaaaaattaaaagcatgatcataagcaaaagatatgtcacgaaacctgctacactttatatcgtgaaaaaaataaagcatctattctctaaaagtgatatcttagctgaaaggattaagctaaaatgcttgagaaatattttcacgggtttagttgattga

SEQ ID NO: 1834 - DNA, 675 bp, Proteus mirabilis
aattgtataaatcatttacgttttagctattgtaggatcgttatgtcacacaaaactgcagaccaagagtggctggtagaacaactaaaatatattgcacagggcattggtaaaacattatcgcctttttgtgaagttgtacttcatgatctgaccgatagtgaaaataccattatggtgattgaaaataatctatcaggtcgaaaagtgggggatagagcgactgagctaggtatggcaaggattgaatcgtctgattttccacaaattgttgcaaactatcctaatcagtttcctgatggtagaacagctaaaagtacatcgataggtattaaagataaacaaggcaattatgttgctgctttatgtttaaatattgatatatcgatgattaaaggtttacaaatggtattaaatcaattttcgactctcgaagagggaaatcatatcattgaaacttttagctcagtaacagaagattcgttgaaaaaacgtattgatgaattttctgcaacttattcagtgacaccaagagcattgaaaccacatcaacgacgcgaattgctattgtgtttacaggatgaaggttatctttcacttcgcaaagcaatggaaattactgcgcaatacctcggtgtttcaagagcaacagtgtataacgatttaaaagaatga

SEQ ID NO: 1835 - DNA, 186 bp, Proteus mirabilis
tggctaataaacgtaaaatttcacggttttctgacattatctggccttgtatataaaagtgatcgttatgtcgagttaacaaaatttcgtaaaaaaatgccaagacacattgtgcttggcattttatccgttaaggtgaccaatgtcttaatgagaaaagcgtttggcttctatgacatcaggtaa

SEQ ID NO: 1836 - DNA, 1788 bp, Proteus mirabilis
atgacgataaataataataaatccattaaaacgttattgccggccttaaaaagattattagcttatggcaaaacctatcgcaaaccgatgacattaggtgtggtgatgttatgggtggcagcgattgcagaagtgggtggacctttacttattagttattttattgatgctaaagtagcgactcatcaagttgaatggcgaggcgcattaggtcttgctgctgcttttattctattacaaattattgcggcactattgcactattaccaaacaatcgtcttcaattatgccgctgttggggtggtacaacagttacgagcagatgtgatgagtgctgcgctaaaacagccattaagtgcatttgataatcagcctgtaggacagctgatttctcgtgttaccaatgatacagaaactatcaaagatctatttgttaacgtctttcctgctctatttcgtgctatagcattggtggttgtgatgttaatcgctatgtttctactcgaatggcaaatggcattagtggcgatgacgattttccctgcggttattggtgtgatgatgctttatcaacggctaagtacaccgattgtccgcaatgtgcgtcattatcttgccaatattaatgatggctttcatgaagtgattaatggtatgtcggttatccagcaatttcgtcaacaagctcgcttcggtaagaaaatgtcagatgatagctggcaacattatcaagcacgaatgaaagcactaaaacttgacgggttattattgcgcccgttactcagtatgctctctgcattggtgctatgtggcttattgatactgtttggatatcaaggtagtgctgtgattggtgttggagtaatttatgcttttatcagctatttaggtcgtcttaatgaacctcttattactctgacgtctcaacaatctttattacaacaagcggttgtttccggtgaacgagtctttgagttaatggacgccccgatgcagcaatatggcaatgcaagctataccattaaccaaggagatatagccattaacggcttgtggtttgcgtatctaaaacagcagtgggtattaaaagagattaatcttgatatacctgctcgccactttgtcgcttttgtggggcatactggcagtggaaaaagtaccttagccagtttgcttatgggaaattatccatggcagaaaggacatatctacttagataaccatccattagagtgctattcccatcaggcattaagaagcggtattgcgatggtacagcaagatcctgttttattatcaggtactttgcgtgacaatattactttagggcgtcactgctctgaagctcacttatggcaagtattagcaactgtacaattaaatagctgggtaaaaacattacctgatggtttagaaacccccttaggtgaacagggtagtcgcttatccgcgggacaaaaacagttattagcattagctcgagtattattatttccaccccgtattcttatcttagatgaggcaacggcaaatatcgactcgggtacagagcaagctgttcaaaaagcccttacggaaataagagaaaaaaccacattaattgttatcgctcatcgcctttcaaccattatcgatgctgacgaaattgtagtgcttcatcgtggtgagattgttgagcaaggtaaacatgcacaactattggcacaaaaaggtcgctattacaatatgtaccaattacaacaagttaaagagtcattacaagttcaagagccagccgttgttgagtga

SEQ ID NO: 1837 - DNA, 1602 bp, Proteus mirabilis
ttttattcaaaggaatacattatgcaacgtcgtgaatttttaaaattaggggcaacattaagcgccgtcacactattaccaagttggagccgtctcgcattcgcccaaactaacacgccttcactcgctattccacctcaaattagcccagacaaacaacaaaagattgttcttaatatccaacaaggtgtttcccagtttactgctacagcaagtacaactacttgggggtataacggtagcttattaggcccagcattaaaattaaaacgtggtgaacctgttactattgagatcaataacacgctaccagagactacgacggtgcattggcatggtcttgagataagtggtgaacaagatggaggtcctcaagcgactatcgcaccgggtaaatcacgaacagtaacttttacgccagatcaagcggagtcgacatgttggtttcatccccatactcatgggatcaccggaaaacaggtggcaatggggttagggggattagtgatcatcgaggatgacgaaacggccaagcgaaagttacctcaccgctggggagtggatgatttaccggttattttacaagacaaacgcttagacagtaacggtcaaattgactatcaacttgatgtgatgagtgctgcagtaggttggtttggcgacatgatgctcactaatggtgcgattcaaccgcaacacattgtaccaaaaggttggattagattacgtttcctcaatggttgtaatgcacgtagtcttaatttagccaccagtgatggccgaccaatgtatgtaattgctagcgatggtgggttattagcggaaccagtcaaagtgacagaactccctattttaatgggggagcgttttgaagtactggttgatacctcagatggacgtgatttcgatattgtcactttacctgtccgacaaatggggatggtattagcgccatttgataatgtattacctgtattacgtctactgccttcagcagaaaaagcggtgggtattttacctgatcaattagccttaattcctgcattaccatcactaagtcatattgcgacacgttcattacatttacgtatggatatgcgtttagatatgcaaggtatgatggcgctaacggagcgttacggtgataaagcgttagcgggaattcaccacggtatgagtcatatgcgtcagggcaatggaaatggcatgatggggggcggcatgaattgcggtcatggctctgcggatgtcgatatttataatgcaaatagcatcaatgggatcccattctcaatgaccgaacctgcatttgatgttaaacaaggggtttatgaacgctggctggtttctggtcgtggcgacatgatgttacatccattccatgttcacggaacacagtttcgtattttatcggaaaatgggcgtaaacctgaaaaacatcgccaaggttggaaagatattgtcagagtggaagggcaaattagcgagatccttgtaaaatttgaccatttagcgacaaaggaacacccatttatggctcactgtcacttattagaacatgaagatacaggaatgatggcgggctttacggtgagtcgataa

SEQ ID NO: 1838 - DNA, 1854 bp, Proteus mirabilis
accagatcaaactgggaatacatcatgaaaatgcacaacattcaatggcattatcgcttttcaattattaatcaaatcgctattttaatgttgcttttcacactatttggtgtggtaggtatggctatttctaaccacattattttaagcgtacaaggcaatgcccacgccattaataaatccggctcactgcgcatgcaaagctatcgtttactatcagccttaccccttgatgataagcaccgtgattatctacaagaattagaaaatgatttagatagtaaagagttacgtcaagtattaagcacctcatcactgcaatcacaatatgtacaactgactcattactggaaagagacattaaaaccgactttgtcagcagccaaacagcctaatgatgcgaaacaagaagttatcttttttgtttctcaactcgatacattagtatcaagtattgaccaacttactgaacaaaaaatccgcctagtcgcttatactcaacttatctttaccgctcttaccttattactgctgtttggttctgtttggcattttcgtcgtcgcttattactgccttggcaacaattgatgtctatggctaattctattggacatggtgatttttcaactcgttttcggcctcgtcctcaccatgatgaaattgccaccctaggaattgcacttaacaccatgtcagaagagctatcgacgctctacagtgaattagaacaacgagtcattgaaaagacccatgatttacaacagaaaaataaggttctctcttatctttatcactcaagtcaacaactgcattcccaagcgccactttgcgctcgcttaaggcagatccttgcagagctacagcatattattcctgatagctatttgcagatccgtctatatgaagataatcaacatacattatttaatgagataagcttagccccttcctcacgccctgaatattgtccaacgccagactgtgagcgttgcaatgaagatgccaacatcactacaccgttaaataatcgcttattacattgggaattgaccgatcagatccatcgctacggtttattcgtaatgcagttaccggaaaatagtgtacttactgacgaacagaataatttaatgctcttattgactaagcaaatttcggcaatgcttgccatggagcaacaaaatgaacagcaacaacagctattattaatggatgagcgttcagcgattgcacgtgaattacatgattcgattgctcaatcgctatcatgtttaaaaatgcaggtcagttatctacaaatgcaatcggaaaccttgccagataactgtcaaaaactactaaaagagatgcgagaagagctaaatgtggcttatcgtcagttaagagaattactgaccacatttcgcttgaaattgacagagcctggcttattagccgcattagaaaatacactaaatgaatttaatcaacgtttagggtttgctatccattttgattatcagttacctgcaaaatgtgttaattcacatcaaagtattcatgtggtgcaaattgttcgtgaagcattaaataatattctgcaacatgcgaatgcaaactgggctgaagtcgcattaacacttaataatggcatcgttgaactgcaaattaatgataatggtgaaggtattacgcctaatcccgaaaagataaatcactacggactgattattatgcgtgaacgcgcgaatagtctgaatggctcttatagtataagggttcgcaaagaaggtggaacgcaagtatttgtcacatttccgttaatcactacccataaagatcctatcgaaaagggagcaaatcataatgaataa

SEQ ID NO: 1839 - DNA, 819 bp, Proteus mirabilis
agatcaccaaatctgctcctgctaaacgtgtctatggtggtgaagcgactgcacaagacaagcagaataaggagaaagcgaatggctgatgacatgaagcacgttaagatggaagtcatgcgctataaccccgaaacggatgatgcgcctcatttcgtcacttatgatgtgccttacgatgagcaaacctcattattggatgcattgggttatattaaagataacttagcgccagatctgtcttaccgttggtcttgccgtatggcgatttgtggctcttgcggcatgatggttaaccgagtcccaaaactggcttgtaaaacctttatgcgtgattacccaaatggggtgagaatcgaagcgttaggtaacttccctgtcgagcgcgaccttgtcgtcgatatgactcactttattgaaagcttagaagcgattaaaccttacattttaggaaatgatcgcaagccttcagaaggtccaaataaacagactcctgctcaaatggcgaaataccaccaattctctggttgtatcaactgtggtttatgctatgcagcatgtcctcagtttggtttaaatcctgagtttattggtcctgcagcgattacgttagcacaacgttacaataccgatagccgtgaccacggggctaaagagcgtatgcctcaattaaatggtgaaaatggcgtctggtcttgtactttcgtgggctactgctctgaagtctgtccaaaacatgtggatcctgctgcggctattcagcagggtaaagcagccagtgcgcaagactttgtcattgccatgctgaaaccacgttaa

SEQ ID NO: 1840 - DNA, 1842 bp, Proteus mirabilis
ctaatggcaaaagaaaaaaaaggttttttctcgtggctcggatttggccgtaataaagaagaaaatactgcacaagagaaagaacaacaacgtttagaggccgaacgtgcagagcaggcgcgcttagccgaagaagaagctcaacgtcaagcgcaactagaagctgaacaagtgcgtttagccgaagaagaagcccagcgtcaagcgcaacttgaagctgaacaagcacgccaagaagcgcaaagagcagaggcagaacgattagctgctgaacgtgcagagcaggcgcgtttagccgaagaagaagcgcaacgtcaagcgcaacttgaagctgaacaagcacgccaagaagcgcaaagagcagaagctgaacgattagctgctgaacgtgcggagcaggcacgtttagccgaagaagaagcccaacgtcaagcgcaactagaagctgaacaagcacgccaagaagcgcaaagagcagaagctgaaaaattagctgctgaacgtgcacagcaggcacgtttagccgaagaagaagcccagcgtcaagcgcaactagaagctgaacaagcacgccaagaagcgcaaagagcagaagctgaaaaattagctgctgaacgtgcagagcaagcgcgtttagccgaagaagaagctcaacgtcaagcgcaactagaagctgaacaagcacgccaagaagcgcaaagagcagaggcagaacgattagctgctgaacgtgcagagcaggcgcgtttagccgaagaagaagcccaacgtcaagcgcaacttgaagctgaacaagcacgccaagaagctgaagctgaagaaaaagcgcgtattgcacaagcacaagccgaagcggaagatattgtcgcgttacgcgaagaggtattagtcgataaacccgtagagcaagagagaccgaaaaaagaaggctttttctctcgcttgaaaaagggattattaaaaacacgacaaaatttaggctccggttttatggggctattccgcggtaagaaaattgatgacgagcttttcgaagagttagaagagcagttgttaattgccgatgtgggaatggataccactagcaagatcattaacagtttgactcagcatgctagtcgtaaagatctcaaagatgctgaatctctttatggtaagttgcgtgaagagatgggcgatattttaaataaagtggataaaccattaaatattgaaggtaaaaaaccttttgtcattttaatggtcggagttaatggggtcggtaaaacgaccactatcggtaagttagcccgccaataccaagctgaaggtaaatcggtgatgttagctgcaggagataccttccgtgcagcggcggttgagcaactacaagtttggggtgagcgtaatcatatccctgttattgctcagcatacgggggctgatccagcatcagttatttttgatgctattcaatcggcgcaagcaaaaggtgtcgatgttctgattgcggataccgcgggacgattgcaaaataaatctcatttaatggaagagctgaaaaaaatcgtccgtgtaatgaaaaaattagacgaggaagcaccacatgaagtgatgctgacactcgatgccagtacagggcaaaatgctgttagccaagcaaaattgtttaatgaaacggttgggctgacaggattaaccttgacgaaactggatggtactgcaaaagggggcgttatcttctctatcgctgatcagtttggtattcctattcgctatatcggcgtcggtgaaggtattgaagatttacgtccgtttaaggccgacgattttattgaggctctgtttgcccgcgaggagtag

SEQ ID NO: 1841 - DNA, 1980 bp, Proteus mirabilis
attgctcaaaaagtaatgaagctcgatcctactcgagccactccttcagtaattaataatgatggtttgaactatgttccaactaatcgatatgtcctatttggtcaccactttgccgctattgcgggtgctggaccacttgttgggccagtattggctgcccaaatgggttatttacccggtacattgaggctattagctggggtggtacttgctggagccgtacaagactttatggtgctgtttatttcgacgcgccgtaatggtaactctctcggtgagatgataaagaaagagatggggcctgtaccgggaactatcgcgctgttcggctgtttccttatcatgatcatcattcttgcggtgctagctctgattgtagtgaaagcattagcagaaagtccttggggagtattcaccgtctgttcaacagtacctattgccctatttatggggatctatatgcgctatattcgcccaggtcgtgtgggtgaagtttctgttattggtattgttttactgattgccgctatttggtttggtggtgttatcgcgagtgatccttactgggggcctgcattaacctttaaagacaccactattacttttgggttgattggttatgcgtttatctctgctttactgccagtatggctgattttagcccctcgtgattatttagcgactttcctaaaaattggtgtaattgttggtttagctatcgggattgttattctaaatcctgagttaaaaatgccagcgatgacccaatatattgatggtacaggaccattatggaaaggggctctattcccattcttatttattactattgcttgtggtgcagtttctggtttccacgcactgattgcatcaggtacaacgcctaaattgatcgccaatgaaatggatgcgcgttttattggttatggtgcaatgttaatggaatcatttgttgcgatcatggcgttagtggccgcctctattattgaaccaggtctctattttgcgatgaatacaccgcctgccggattaggtattacaatgccaaatctgcatgagttagggggtgaaaacaccgcaatgattatggatcaattaaaagatgtcaccgtacacgcggctgcgacagttagctcatggggctttgttatctcgcctgatgagattttacaaaccgccaaagatataggtgagccttctgtactcaatcgtgctggtggtgcacctacgttagcggtgggtattgctatggtgttccataaaattttacctgcggcagatatgggcttctggtatcactttgggatcttatttgaagcactctttattttaacagcattagatgcaggaactcgttctggtcgttttatgctgcaagatttgttaggtaattttatcccatacttgaagaaaacagactcttttattgctggtgttatcggtacagcaggttgtgtcggtttatggggttatctattgtaccaaggtgttgttgacccactgggtggtgttaagagcttatggccactgtttgggatctccaatcagatgttagcggctgttgcacttgttttaggtacggtcatcttaatcaagatgaagagaacgaaatacatctgggtaaccgttattcctgcagtatggttattaatttgtacaacatgggcgctaggattaaaactgctcagtaatgatccgcaaatggaaggtttcttctatcttgctaatgagtacaaagcgaaaatcttagccggtggggcagatcttactgccgcagaaatcaccaatatgaaccacattgtgattaataactacaccaatgcaggtttaagtattctgttcttagtggttgtttacagcattattttctacggtatccgtaccgcaatgaaagcacgtaaaaatccgaaagagtcagcacaagaaacaccatatgtacctatgccaaaagatgtgaagatatcttcaggtcattaa

SEQ ID NO: 1842 - DNA, 645 bp, Proteus mirabilis
cctaataaaaatatgataaacgttgctctcatcgatgatcacattgttgtgcgttctgggtttgcacaactgctaatgctagagccggatattaatattgtcggtgaatacgcaaatggccaagaagcttggccctatttattaaatgataatattgatgtggcggtgatggatctctctatgcctggagagagtggcctacaattacaaagtcgattaaaacaaaaacgccctgattttcggacaattattttaagtatttatgatacccccgcatttgtacaaagcgctttagattccggtgcccatggctatttaactaagcgctgtggtccacaagagctcgttcaagcagtacgtgctgtgtatcaagggggctgttatctctgtgctgatgccatgaaagcacttcgacagacaccagaaaaagaagatgctttacatagtttaacccctcgcgaaagagagatttttaatctgctagtacaaggtattaatgttaaagctatcgccgtacaactgaatctcagtcataaaacggtgcatgttcatcgagccaatatactgggtaaattgaactgtgaaacaaccattgatttagtccattttgcattaaacaaccagttaatcaccggaacactctaa

SEQ ID NO: 1843 - DNA, 189 bp, Proteus mirabilis
aattgtaaaaaaaacacaaaaagtatttcaatttgtaagatatgtttattttttatttactcaaaaaatcataatttaaattttactttttttattttttcaataagaactttaaactttattaaaaaaaataaacaaattaagaatatgccccattcattctgtttgtataaaaacagatacatttaa

SEQ ID NO: 1844 - DNA, 312 bp, Proteus mirabilis
ataataaaaaatagaaataaaaaatattttgatatttatccaagaattagaaatggtgatataacaggcgggagggaagggcgtattttatcacttatggggagggataacgcgataaaggaacaatataaaagagttgtgaacggggttgatactgtcagtcaacagcatcaaccattaacatcaaacacgcttattatgtggtatcaccacttttccataccatttttaggtacgagcgctaatctgtctgctaatcgttctccgtcatcagggaaacaaagttcaggtgctaaatccgccaatggataa

SEQ ID NO: 1845 - DNA, 453 bp, Proteus mirabilis
aaggtaaaaaaacaaggattaatatcagctaattgttctacagttgattcaattggtaatagatatcaaacagtccataaagatcaaatacaggttttaagtttaaattacacaataagcaggatgcaaaattcagtccaccatccagttttattcattaaaccaattgataagtcatccccgttattaggcgttgccatatctaataatgaattattagatgctaattttgactttttcaggataaaccaatttggtattttagaaaaatattttgaaattaaattgagtaatgcaactattgtggattttacacaatcttcaccagaatcatctaacggatactctatcgtctcccatgaaaaaatattactacgatatgagtctatttcatggaaccatatttgtgctggtacaagtggatattccataaacgagcaaaatattatttga

SEQ ID NO: 1846 - DNA, 462 bp, Proteus mirabilis
tccacaaaaaaagagagtatcatgcaaggtattaagcgaaaaattgtctatgttaccgcttatgaagtatttggttgggttatctcatcggtaggactggcgcttttagccgatagttcaaccgctgttacgggaccactcgcactcattattaccactatcgcggtaagttggaattttatttataactgtttatttgaattttgggagagtcgacaaaagtcgagaattcgcacctttagacgccgtcttgctcatgcggtaggttttcagcttacgttggtggtttaccttattccgctgatagcttggtggctaggggtttcattatggcaagcactggtgatggattttgcacttattatcatcatcccttgctatacatttgtctataactgggtatttgacaaaatttttggcttaccaaaatcagcattacccgaagatgtgcctgttgcttaa

SEQ ID NO: 1847 - DNA, 309 bp, Proteus mirabilis
atgagaaaaaatagtatgtcagcttcgttaaattggcaaaaagagggtgaaatactctcttttcaaggaacgctagatagagaaacgttattgccagtttggcaacaacgtaaagcgttattagctgatattaatatcatcgatatttctcaacttgatcatattgactcaaccggattagcactttttgtccatctaaaggccgaaatggaagcacttgagcgtcaatgtgttattcaaggtgttagtgagcgctttcaaacgctaatcacactctatgatcttgatgaaattatgaatattgcttaa

SEQ ID NO: 1848 - DNA, 987 bp, Proteus mirabilis
attatgaaaaagatggttttggcaacagtactggcatcgctcttttttagtagtgttgctatgtcagaagataaaacagccttctctttacctgcgattgaaaaaagtgcggaagaagggaatgccgcttctcagtatcaacttggtgttaaatatgaaggtggcgaaggtgtagaacaaaatacacaaaaagcattggagtggtacacaaaagcggctgaacaaggtcatgcagaagcgcaattaaatttagcgttaatgtatgatatgaatgatgatattgagcgtgatgctgaaaaagcggtttattggtataacaaagcggctgttcagggactctctttagcacaatacaatttggccgtctcttttgatgaaggggatggtgtagagcaagatcatgaaaaagcagtgtattggtatacaaaagccggtgagcaaggtgatagcgatgcgcagtataatttagcgatttcatatgatgaaggtattggtatcgaacaagatcatgaaaaagcggtgacttggtacactaaagccgcagagcaaggtcatgctgatgcacaatacaacttagctgtctcttacgatgaaggcgaaggggtcgagcgtgatggtagcaaagcggtattctggtataccaaagcggcgaatcaaggtaatcgagatgcacaaaataaccttggtgtgatgtatgacgaaggtgatggtgtagcaaaagatcaacgtaaagcgaacgaatggtataaaaaagctgcgctacaaggtaatggcttggcacaaaataaccttgcaataaactattattatggcaaaggggttaaacgtaacttgaaagaagcctatgcatggtttgctgttgctgtagaaaatggtgaaggtgatgaggctatgctaaaacgaaccgcccgtgccctcaatgctgcccaattagcagaagctaaacttttagctgcttcttatattgctaaatatcttgatgactaa

SEQ ID NO: 1849 - DNA, 639 bp, Proteus mirabilis
agaactgaaaaaagcaggtgtgaaataatgtcaactcaaactttaaataacgcaaacgcccatgagcatcatgggcaccacgatgcaggagcgacgaaagttttcggcttctggatctatctaatgagcgaccttatcctgtttgccagcttattcgccacttatgcggtgcttgttaacgggattgctgatggtccttcaggtaaagaaatctttagcctgccttttgttttagttgaaaccttcttactactgtttagtagtatcacttttggtttcgccatgcttagcatgaataaaggtagtgttagccaagtcaatctgtggctattcgttaccttcttattcggtttaggcttcgtggtaatggaagtgtatgagttccatgaacttatcgctgaaggttatggcccagatcgcagtgcattcttatcggcattctttgccttagtatcaacacacggtctgcacgtaacagcgggattagtttggattattattatgatgatccaagtatcacgccgtggtttaactgatgttaatcgcacccgtttaagttgcttaagcctgttctggcacttccttgatgttgtctggatctgtgtgttcaccgtagtttatctgatgggagcgatgtaa

SEQ ID NO: 1850 - DNA, 843 bp, Proteus mirabilis
agacgagaaaaaatgcgtttcttaaacacttttgcactgttgctaagcctgatattgacaccttgttatgttatcgcagccactcccgcacaacgtgttattactttatccccgtctgccacggaaatggcttatgccgcaggcatgggagagaatatggttgcggcgagcgcttattctgattatccacaagcagcaaaagatctcgtacaagttgccgactggcaaggcattaatgtagaacgcattttgctattaaaacctgatttaattattgcatggccaagcggtaatcctcaacgaccgctcgatcagttaaaatcattgggtatccctattatttactctgatccacacagtatcgaagaaatcattgacgatcttacccgactttcttcttatagcactcatcctgaagtcgctttagcaagtgcacaaaaattacgtcagcaatatcaagaattacagcaaaagtacgcctcaacgacgcctcatcaagcgaagaaaaaagtctttattcagtttggtatgcaacccctatttacgacatcaaaacattcattacaaaatgagattaccgaactttgtggcggtgaaaatatttttgcgaatagtgcagttccttggccacaagtcagccgcgagcaagtgatcagtaaaaaacctgatttgattttatttagtggtaaaccaaaccaaattgccgcaatacaacaattttggcaacctcaactagatattcctattatcgctattgatgaagatagttttagcagaccagcaccacgtattatttatgcggctcaacagatttgtgaggctatcgcaatccactcattttaa

SEQ ID NO: 1851 - DNA, 594 bp, Proteus mirabilis
ggtgatagaaacagaccaaggaaattaataggtatatttatgaaacagcagattaataaaaatagtcttgtatcaatattggtactattgagcttttttatcacaacaaatgtaactgctgtgacaccagttttgtcaagtacgggactatcacaaaattcgcctattacacctatttatccgatccctatcaatataaaagggtacgttatcgctcaccctccttgcatgatcaatgagggcaaaacggtagaagtgaatttcggtgatgtgctaagtacacgagttgatggcttaaattacaaacgtctggttgattatcatccaagttgtgaacaaatgcccattaatacactaaaactttctgtcgaggggaatggtactttttttgatgccaatgcattaatgaccaatattaccggattaggtatacgtattttgtatcaaaataaaccacttaagttagggcaggcaattaattttacttatcccgattttcctgtattggaagcggtgcctgtgcgtgatttttctactcttcttgtgggaggagacttttctaccacagcgacattgcgcatggaatatcagtga

SEQ ID NO: 1852 - DNA, 1044 bp, Proteus mirabilis
aaggttctgaacatgaaactgaaaactctctctacacttgttgccgccggcttagctctttctacggtaagtttatccaccagtgctgcgggtcgcttagtggtttattgcagtgccacaaatgcgatgtgtgaagctgaaactaaagcttttgctgaaaagtatgatgttaaaaccacttttgttcgtaatggctccggcagtacattagcgaaaatagaagcagaaaaacgcaatccgcaagctgatgtttggtatggcggaacaatggatcctcactcacaagcgggtgaaatggatctgctagagccttatgtatccgccaatcttgatcagatcatgccacaatttcgtgatccggctaaacgcaaaggaaactactcttctgcggtttatgtcggtattctaggttttggtgtcaataaagatcgtttaaaagagaaaggtctacctattccgacctgttggaaagatttagtcaaacctgaatacaaaggtgaaattcaaatcgctgatccacaaagttcaggcactgcatacactgcattagcaactttcgatcaattatggggaacagagcaagcctttgattatctgaaaaaactaaataccaatatctctcaatatactaaatcaggtattgcaccagcgcgtaacgccgcccgtggtgaggccgcgattggtatcggcttcttacacgactattcactcgaagttgaaaacggggcaccactagagcttatctcaccttgtgagggcacaggttacgaaattggcggtgtcagtatcatcaaaaatgcccgtaatatggataacgctaagttatttgtagactggacactctctaaagaagcacaagaaattagttggaaagagggtaaatcttaccaaattctcaccaataccacggctgaatcttccccgatggctttgaaattatcagacttaaaactgattaactacgacatggataaatatggcgatagtgatgttcgtaaagagctgataaataaatgggttaccgaagtaaaaatgggtaaatag

SEQ ID NO: 1853 - DNA, 900 bp, Proteus mirabilis
attctgctgaatttaatcagcaagtttatgatttacaccaggaacttatttgttaaccacggagaaagaagtatgacttattcacgtgaagtgttactcaaaaaatttaatgacatgatcgcacgtaaagagcctattattggtggcggtgcgggaacaggcctttccgcaaaatgcgaagaagcaggcggtatcgatctgattgttatctataattcaggtcgttatcgtatggcgggtcgtggctctctggcaggattattagcctatggcaatgccaatgaaattgttatggatatggcaaaagaagtattgcctgttgtaaaacagacacctgtgcttgccggggttaatggtacagatccattctgcaattttgataagtttttagatgacgttaaagccatcggttttgctggcgtacaaaacttcccaaccgttggtttaattgatggtaacttccgcgctaacctagaagaaacaggtatgggttatgctcttgaagtagagatgatccgtaaagcacacgaaaaaggcttactcacaacaccttatgtttttagtcgtgaagatgccattgcgatgacacaagccggtgcagatattattgttcctcatatgggtttaaccactggtggcaatattggtgcagaaacagccgttactttagatgattgtgtcgcccttattaacgattgggcaaaagcagcaaaatccgtacgttctgacgtgattgtactttgtcatggtggccctatagcaacaccaaaagatgcgcaatatatccttgataactgtcctgattgccatggtttttatggcgcaagttcaatggaacgtttaccaacagaagtcgctttaactgcaacaacaaaagagtttaaaaatattaaacgctaa

SEQ ID NO: 1854 - DNA, 1653 bp, Proteus mirabilis
ggaattatgaatatagcgatgacagaaagatataaatggttattgtttttcctatttatcttattaacttattttattcctttagaaacgcgactgttatggcaaccagatgaaattcgttatgctgaaattagccgtgaaatgttagtttctggcaattggtcagtgccttatcttcttgatattcgttattttgaaaaacctgttttaggatattggatcaattgtattgctcagtggctatttggtgaaagccattttgcggtgcgtattgttgtagtaacatcaaccttattaacaggatggcttatttataaagcggcaatggtagtttggcgcaatagcgctcttgcttttaatgctatgaccgtttttttatcttcttttctggtattagcaataggtacttataatatattagatcctattgtgacgctgtttgtgaccgctgcaatgtactcatttttagttgcgttatcgaccccgaataaaaaaggcaaaataattgcttatatgggtattggctttttttgcgcacttggttttttaacaaaaggctttattgcggttgttttacctgcattagtttttttagtcatggcaattagtcaagctcgctttaaagaagtggtttgctattcctctattgcactgttagctctcgctattacagctggaccttgggtgattactgttgcattacaagcaccggattattggaattattttttctgggttgaacatgtacagcgttttattgctaaagagtctgctcgctcacaaccaacgtggttctatatcccgatagttatattgggtgtattgccttggctaggttttttatttggtgcattaaaatcagctttctctttaaaaaaaggtacactctattttctgctgtggtttgctctcttttttgcttttttctcagcctcaaaaggaaaactattaacctatatgctaccgtgctttgtgccattatctattttaattgcacactatatcgaagagttaaaagatagacctgatgagaaaatcagcaaactgaatgcatctatcaatattgcttttgggctaatgggtatatcagccgttatctattctttatacagtgccaaatttgcgctttatgatacgaatgaaacgttaaaaatagtgttagcaataagtgggtttttattttggagtgtgattggtgcgggggcgctgtttagacaaacacagtttttaacgatgttttgctctatcggactaagtttagttattggctatgcaatcccagaaaagatagaaagtagaagtacaccggaaaatattatccaacgttattatgagcctttgagtaataaatcgtatcttttaacggacgaagttggtattggtacatcacttgcttggggactaaaacggactgatattcgtttaacagagacgaaaggtgagttggcttatggtttaaattacccagatgtaaaaaataaatactatagccttgaacagctattagcattaattgaagcaaaccaatataaaggggtagcgattgttttagtcagacctgatagaaagcagattttgactaaattgactacattaaaggaaaaaccgatagtagaaaaagagggcgatttaacgctggtgttctttaattag

SEQ ID NO: 1855 - DNA, 582 bp, Proteus mirabilis
gtaaatatgaacgaagagattagctatctgtttgtccctgctaataaaaaagttatgatttccaaagcgttaacttatggtgcaaatgcgatcattcttgatcttgaagatgcggttcatcctgatgaaaaaccgctcggacgtgacaacattcaaaattggctaacgacaataaataacaccatcattaacaccagtatatatatcagaataaatcatcctaaagagaaagaatttaaaaacgatgttgatctattaaattcattaaatgaaacgctaatgacaggagtaatgatcccaaaactggaagatgcggaaatactttcctatataaaatcaaaacttcatctggctatatcaaagcgaccatttataggcattatagaaacagcgcgtggagtgcaccattgtgaagagattgccaatagtggtgtaacgagattagcattcggctcattagattactcactagatattgattgccaacaaacagcagaagcgttgctatacgcaagaagccgaatcgttatcgcttcacgcattgccaaccttatctcccctattgattgtgtcaccccttga

SEQ ID NO: 1856 - DNA, 759 bp, Proteus mirabilis
ttgataatgaaaataaaactacttgcgacagtgatggtatccgcggcattactctctggctgtaaaaatcttgatacttctatgttagcgcaatcaggtacacaacttttccaagcggcaacattaagtgatgacgatgtcaaagcgctaactaatgatgcatgtaaagaaatggatgctaaaaacaaaattgcacctgcaaatagtaactacactaaacgcttaaataatatcgcgaaagcgttaggtaatgaagttaatggtactccagtaaactataaagtttatctcactaaagatgtcaatgcatgggcgatggcaaacggctgtgtgcgtgtttatagcggtttaatggacatcatgactgacaacgaagtggaaggtgtattgggtcatgaaatgggacatgtagcattaggccatacacgtaaagcaatccaagtagcacatgccaccgttgcggcacgtaccgcagcctcttcagcggggggagtagcagcacaattaagtagttcccagttagcagaaatgggtgaaaaactggttaatgcccagttctctcaacaccaagaaacacaagctgataacttctcttacgatctgctgaaaaaacgcggtgtcaatacttcaggcttagtgactggctttgaaaaattagctaaattaggtggtagtgattcaagcatgtttgattctcacccaccatcaaaagagcgtgctgacaatattcgtaaccgcattgccgaagataaaaaataa

SEQ ID NO: 1857 - DNA, 1710 bp, Proteus mirabilis
gaaaaaatgaaaactatctcacgtcaagcttatgcggatatgtttggcccaacaacaggcgatcgtttgcgattagcagataccgagctgtttcttgaaattgaaaaagatttcaccacttatggcgaagaggtcaaatttggtggtggtaaagttattcgtgatggtatggggcaaagccaagttgttagtgctgagtgtgtcgatgttctgatcaccaatgccattattttagattattggggcattgtaaaagcagatattggcattaaagatggccgtattgtcggtattggcaaggcaggtaatccagatgttcagcccaatgtggatattgtcattggccccggaacagaagttgttgcgggagaaggtaaaattgtcactgctggtggtattgatacccatatccactttatttgtccgcaacaagcccaagaaggtctcgtttctggcgtaaccacctttattggtggaggaacaggccctgtggcgggtactaatgcaaccacagttacccccggtatttggaatatgtaccgcatgttagaggcggtggatgaattacctattaatgtggggttatttggtaaaggttgtgtcagtcagcccgaagcaatccgcgaacaaataacagcgggtgctataggtcttaaaatacatgaagactggggggcaacgccaatggcaattcacaattgccttaatgtcgccgatgaaatggatgtacaggtggctattcactctgacaccttaaatgaaggtggtttttatgaagagacagtaaaagccattgccggtcgagtgatccatgtattccataccgaaggcgcaggtggtggtcatgcccctgatgttatcaagtcggtaggagagcccaatattttacctgcatcaaccaacccaacgatgccttataccattaataccgtggacgagcatcttgatatgttgatggtctgtcatcatctcgatccctctattcctgaagatgtggcatttgctgaatctcgtattcgtcgcgaaaccattgctgcagaagatatcttacatgatatgggggcaatttcggtgatgtcgtcagactcacaagccatgggacgagtcggagaagttatcttacgcacttggcagtgtgcacataaaatgaaattgcaacgaggcacattagcgggtgatagcgcagataatgataataatcgtattaaacgttatatcgctaaatacacgattaatcccgcactggcacatggcattgctcatacggtgggatcaatagaaaaaggtaaacttgcggatatcgtgctatgggatcctgctttctttggcgtcaaaccggcacttatcataaaaggtggtatggtcgcttatgcgccaatgggggatattaatgcggctattccaacaccgcaaccggttcattatcgtccaatgtatgcctgtttaggaaaagccaaatatcaaacgtcgatgatctttatgtcaaaagcgggtattgaggcgggagtgccagaaaaattaggcttaaaaagcttaattggtcgtgtggagggctgtcgtcatatcacaaaagcttcgatgatccacaataactatgttcctcatatcgaattagatccacaaacttacattgttaaagcggatggtgtaccactggtttgtgagccagcgactgaattaccgatggctcaacgctatttcttattttaa

SEQ ID NO: 1858 - DNA, 447 bp, Proteus mirabilis
aagttgatgaacacaggagcaatgttgatgaaaaaagtcatcacggtctgtccgtattgcgcctcaggatgcaaaatctacctgaaggtggaaaacggtaaaatcattggcgctgaaggagccaatggtttaacaaaccaaggtgagctgtgtctgaaagggtattatggatgggattttatccatgatactaagatactgactccacgccttaaaacacctatgatccgccgtgaaagaggtggaaaattagaagcggtttcttgggatgaagctattgagtttgcgagtagcaaactacttgctatcaaagagaaatatggcgctaaagctattatgacaaccggttcatcacgaggacctggtaatgaagctaacttcgttatgcagaaatttgctcgtgcggttatcggaaataataatatagactgctgtgctcgtgtctga

SEQ ID NO: 1859 - DNA, 189 bp, Proteus mirabilis
ttaaaaccgaatttgcttggcggccatagcgcggtggtcccacctgatcccatgccgaactcagaagtgaaacgccgtagcgccgatggtagtgtggggtctccccatgtgagagtagggaactgccaagcattaaataagacgagaaagccaacccgatgggttggcttttttgcgtttgaaaactaa

SEQ ID NO: 1860 - DNA, 519 bp, Proteus mirabilis
ttgatgaagaaaacactttgctctacaggtttacgctggctctggttggctattgctgtagtggtgttggacttaggtacaaaacagtatttcatgcagacattccgtctgtatgaatctgtggttgtcatgccttttttcaacttcacttatgctcataactatggcgcagcttttagctttttagccgctaaaggcggatggcaacgttggttttttgcattaatcgcactggcaatctgcattgtcttagtggtgatgatgtataaaaataaagcgagtgccaagctaagtaatattgcttatgcgcttattataggcggagcattgggtaatctttctgatcgtctgatccatggatttgtcatcgattttctggacttttatgtcggtgattggcattggcctacttttaatattgctgatgtgtctatttgtcttggtgcaggtttaattatcattgagagctttttccctgataagaatgccagcccacaagaagccaacaagcagaagtaa

SEQ ID NO: 1861 - DNA, 1323 bp, Proteus mirabilis
ataaaaaggaaattttgcatgtcgattaaatccttcagtacgcttgccatagcaatagcattatttacttcaccaacctacgcaaaaaccgaaatagagtggtggcatgctatgggaggcgccttaggtcaaaaagtcaatcaaattgcctcagactttaatgccagccaatcagaatatgtgatcaaacctgtctataaagggacttatccagaaacgatgaccagcgctgttgctgcatttcgagccaaaaaccaacctgcgattgttcaagtgtttgaggtgggaacagcaagtatgatgggagctaaaaaagccgtttttcctgtttaccaattaatggaaaaaaccaacgagccatttgatcctaatagctacctctcgacagttaccgcttattacaccaccagcgatggtaagatgatatctctaccttttaatagctcaacgcctgtgctttattacaacaaagcactatttaaacaagcaggcatagagcaacctcctaaaacatggaaagagatgggggctgtctctcagaaactacttgatgctggcgtgaaatgtggttttaccaccacttggcaatcatggacccaaatagagaattttggcgctcgtaataacttacctatcgccaccaaaaataacggctttgatgggactgatacctcatttttatttaatcaggcaccgtttgttgctcatatccaacgcatggcggattggtctaaatccggtatttttaaatatggtggccgccaatctgatgctatgccgctattttatactcaagaatgcgccatggtgatggagtcatctgcaggctttgcgggtattaaagagaatatgaaaggcattgatattggtgttagccaattgccttatgacgatactttagttgataaacccgctaatagcattatcggaggtgcctcattatgggtaatggcaggtcgtcctgatgctgaatataacggtgtcgctaaattctttacctatctttctagtcctgaagtacaagcagattggcatcaagcaaccggttatttacctgtgacgaaagccgcttatgcattaacacaacaacaggggttctatcagcaaaatcctggtgctgatacggctattttacaaatgaccacctctgactctacagcaaactcaaaaggcttgcgctttggtaactttttacaaacgcgagaaatcgtcgatgaagaattagaaaaagtgtggtcaggcaaacagagcgcacaagccgccttggataatgcggttaaacggggaaatgaacaactacgccgatttgaacgcactcagtaa

SEQ ID NO: 1862 - DNA, 636 bp, Proteus mirabilis
aacagaaggaaggcaattatgaccatatccgcactcatctgtctagctaatggtagtgaagaaacagaggttgttaccaccgctgatttactcgttagagctggaattaaggtcatacttgctagtgctgaagatgatgttgatgacttagtgatcacctgctcacgagggatcaaattaattgctgatgtcccattagttcgtgttgttgatcaccattatgatgccattattttacccggaggattaataggtgcagaaaccttacgagatagtcctcttgttgttgaaaaagtacgccgcatgcacagtgaaaatagactagttgccgctatttgtgcagctcctgcgatcatcttagagtctcataacctctttccaataggcaatatgacaggtttccccggcttaaaagataaaatcgaacctaaaaaatgggttgattatcgggtttactttgacgaaagagtcaatctgattactagccaagcccctgctaccactatagatttcgcacttaaaattattgagcgcctaaaaggtaaagcagttgcagctgatgtcgctaaacaacttgtattaccaccaggtatttataattatcaagatgaatttactgggtttggggataggtaa

SEQ ID NO: 1863 - DNA, 1242 bp, Proteus mirabilis
gttctagggaaaaacatgtcttggtcagaatttaaatctcaatacctgatccgtttctggaagcctcttccggcggttattgcagcaggtatcttatctacttactactttggtttaaccggcactttctgggcagttactggtgagtttactcgctggggcggtcatgtgatgcaatggtttggtgcgcatccagaagaatggggttactttaaaatcattggtcttgaagggacaccacttactcgtattgatggggtaatgattattgggatgtttggtggttgtattatggcagcactttgggccaataatgtcaaacttcgtcatcctcagcataaagtgcgtattcttcaggccgttttgggcggtattattgccggatttggtgcacgtttagctatggggtgtaacctcgcggcattctttaccggtattcctcaattttcattgcatgcttggttctttgctgttgctactgctattggctcttattttggtgccaaactttcattaatgccactatttcgtataccggtaaaactgcaaaaagtcagtaaagcatcacctattacgcaagataaacaacgtgcaaaacgtcgctttcgattggggatggttatcttttttgccatgatcgcatggtcattaatcattctatttgattcacccaaactcggctttgctatgctggggggaattggctttgggatcttaattgaacgtgcgcaaatctgttttacttccgcatttcgtgacttatggataaccggtagaacgcatatggcgaaagcgattattatcggtatggcagtaagtgcggtgggtatttttagctatgtacaattaggtgctgcaccgaaaattatgtgggccggtcctaatgcagttattggtggtttgttgtttggttttggtatcgtgcttgctggtggttgtgaaacaggctggatgtatcgtgcagttgaagggcagatccacttttggtgggtaggtttaggtaacgtgattggttcaacaatactggcgtactattgggatgatttttctgcggtactggctaccgactacgataaaatcaacctattagatacctttggtccagttggtggattagccatcacctacctgctacttggtctctcttttatattactactttggtgggaaaaacatttcttccgcaaaagagcgcaacaagcgcaagcgctttcaacacaaattaataaggaaatcgcatga

SEQ ID NO: 1864 - DNA, 429 bp, Proteus mirabilis
ctaaaggggaattttgtgaaacctgctgctcgtcgtcgtgctcgtgagtgtgctgtacaagctatctactcatggcaattatccggaaatgacatcgcggatgtggaattggagtttttatccgagcaggatacccaaggtgtagatattgcttatttccgtgagcttttagtgggtgttgcaatcaatgcagcacgtttagataaggcgatggagccttatttatcacgtcaactggaagagttaggccaagttgaaaaagcgattttacgtttagctatgtttgaactcagcttccgtgaagatgttccttataaagtagccattaacgaagcgattgaattggctaaggtgtttggtgctgatgacagccataaatttgtcaatggcgtgttagataaagctgcaccaactgtacgtaaaaaataa

SEQ ID NO: 1865 - DNA, 198 bp, Proteus mirabilis
acagtgtacctgttcagtgaacaaaaaacaccctgtcagtcattaactggcagggtgtttgcgatgtttatgtcagaaaaacgctctattaaggtaagagtgttgtctgatctgcaccctctttttccactttttgaacaatcaggtgttcgcgtttcatgcccattttcagtgctaatgcagaagccacataaatag

SEQ ID NO: 1866 - DNA, 195 bp, Proteus mirabilis
aatgctcaccttaacaagagaaatggagtaagttataaatctgttcttatcacaataaaacgcattgataaaaatcagataatttcgttcattaaagggatattagctacgcttttgcagtggtatgataggcaaaatagccacccttatctgctgagaaaacggcagaattacttaatcgagacactatcatga

SEQ ID NO: 1867 - DNA, 600 bp, Proteus mirabilis
tttgaggttgatatgaatgaattacgtataggactggtttctgtttctgatcgtgcatccagtggtgtttatgaagataaaggcctgcccgctttagaagcttggctaaaaaaagcaatcacaaccccttttcatatcgaatcacgtttgatccccgatgagcaactgatgattgaacaaacattatgtgaactggttgatgaagcaggatgtcacttggttttaacaacgggaggcacagggcctgctcgtcgtgatgttacgcctgatgcaacattggcgattgctgatagagagatgccaggcttcggtgagcaaatgcgtcaaatcagtttgaaatttgttcctacggcgattttatctcgtcaagtgggagttattcgtaatcaagccttaattttaaatttaccgggacagcctaaagcgatcgcagagacattagagggattaaaagacagtgagggacaggtgattgtcagtggtatttttgccagtgttccttattgtattcaattattggatggcccttatatcgaaactaacgaagaaattgtggttgcctttagacctaaatcagcacgccgttctacatctgcttaa

SEQ ID NO: 1868 - DNA, 522 bp, Proteus mirabilis
aaaatgtctgatgaaaaacaggctaacccactttttcgggatgcaatggcaagcttaggtgctgccgttaatattgtcgcaactaatggtgatgcaggatgctgtggtttaacagcaacagctgtatgttcagttaccgatactccaccgacagtgatgatttgcatcaatagtaaaagccaaatgaatagtacgtttcaagaaaatggcaaattaagtatcaatattttaaatcatgaacaagaagagatggcttgccattttgccggtatgacaggtctggcaatggctgatcgctttacccaaccaggatggcaatatggcgcattacagcaaccgatattaaccaatgcactcgctagcctagaaggtgatatttacgatgtacgccaagtaggtactcactttgtttatatggcagagataaaaaatattgcggttcgagaagatggcgatggcttaatttattttaagcgtcgcttccatcctgttaaacataaattagtcccaaccaccgcttaa

SEQ ID NO: 1869 - DNA, 396 bp, Proteus mirabilis
gcaatggctgataatcaatactacggcacaggtcgccgcaaaagttcttccgcacgtgtcttcattaagccaggtagcggtaatatcgtaatcaacaaacgtagccttgaagtttacttcggccgcgaaacagcacgtatggttgttcgtcaaccgctggaattagttgatatgcttggtaaactggatttatatatcactgttaaaggtggtggtatctctggtcaagcaggtgcgattcgtcacggtatcactcgtgcactgatggagtacgatgagactctacgttctgatctgcgtaaagctggtttcgttacccgtgatgcgcgttctgttgaacgtaaaaaagtgggtctgcgcaaagcacgtcgtcgtccacagttctcaaaacgttaa

SEQ ID NO: 1870 - DNA, 1278 bp, Proteus mirabilis
aataattatgataaaagggggccagttatggctacacaagatcctgtgaatacaacatcaccatcatttataaaaaataggcgttcatcattaattgcagcgatttttttaatggctacatctgcaattggtccaggttttattacgcaaacagctacctttacagcgacgatgggagcagcctttgcatttgggatattagcttctatcgtcattgactttgttgtgcaacaaagtatttggcgagtcattaccgtgactaacatgcgcgcttctgatattgcgaataaggcaattcccggtagtggatacttattagctgtattggttatctttggtggtttggtattcaatgtcggtaatattgctggggctggtttagggcttaatgccatggtaggactggatcctaaatggggtggggttttaagtgctttactggcgatttatatcttctcttcacgcaaagcgagtcattttattgatcgcatgatcattgttcttggcatcgtgatgattttattaacactttttgtaatgtttgcgtccaatcctcctataggtgaagcattaaaacaaacagtactgcctaatacgattaattttgccactataacaaccatcgtcggaggtacggttggtggttatatttgttatgcaggagcacatcgtctgctcgataaaggtacaacaggtattgaaaatatcgatgcggtatctagcgcggcaactaaagggatattagtggttggattaatgcgttatatcctatttttagcaattttaggtgttgtcgcaagtggagtgacactagatatttccagccatgcggctaatcctgcttctcaagcattccaacatgcagcgggcttaactggactacgaatttttggtcttattttatgggcagccgcactgactagtgtgattggtgctgcttatacgtctatgtcgtttataaccgtgtttaaaaagggtattacagagcgtcaacgcaatattgctaccattatttttatcgctatttcattggcaatttatatggttatgggaacagctcctgctgccttattagtctttgctggtggcttcaacggattgattttacctattggtatgacgttatttatttttgttgcatggcgtcgtcaagatcttatgaatggctataaatatccaatgtggttgcaatggtcggcaattttagtctgcgctttgacttggtatatggggatcatgtctgttggcgctattttcaattacctcaatattgcttaa

SEQ ID NO: 1871 - DNA, 2475 bp, Proteus mirabilis
tgctacaatgagccacagagaaagttaatcagttatggagcttgtgtgcatctattgccaatttttgaggtagcaggatctgttgttactgcattaaaacaatgtccccaagtcttacttcacgcccccacaggggcgggaaaatcaaccgcactgccgctgtatttgcttcaacaaaatatatttgatggcaaaattattttattagagccaaggcgtattgcggcaaaaagcatcgcttatcgtttagcaagtcaactcaatgaagaggtgggtaaaacggtggggtatcgcatgcgtgctgaaagtaaagtgagtcagcagacgcgccttgaagtgatcaccgaaggggtgttgacacgtatgttacagcaagatcctgaactgacaggtgtaagtttagtgatacttgatgaatttcatgagcggagtttgcaagcagatttagcattagcactgctattagatgtgcaatcaggattacgtgatgatttacgccttttggtgatgtctgcaacattagataatcaaaaattaacttcactattgccggatgcgccgatgattagctctgaagggcgtagttatcctgtttcacggcactattatcctattcaatcacacctgccttttgaacaagaagttgccacgatggcgcgacgtttgcttacacaagagacgggctctttacttgtttttttgcccggtagtgcagaaattattagagtcgcgcaattattagctgacaaagtggataaacacaccttaatttttccactttatggggcactttcattagcacaacagcaacaggccatagagcctgtagaaaagggatatcgcaaagttgtattagcaacaaatattgcagaaaccagtttaacaatcgaaggtattcgcttggtgctcgacagtaccattgaaaaacgtgcccagtttgacttaaaaagtggtgtaacaagcttattgcgccaacgaataagtcaagcttcacaaacgcaaagagcggggcgggcaggacgtcttgaagccggaatttgttggcacttaatcagtcaggaacaagctgagcgcggggcaactcaccaagtacctgaaattttatctagtgatctctcttcgttatggctttcaatattgcaatggggatgtcgtgatataaaccaactctcttggttagatacgcctacaccagcagcaataaacgcagctaaaacattattgcaacgattaggtgccattgataatcaagggggattaacctcgcggggagtacgtatggcacagtggggcatcgatccccgattggcggcaatattagattatgctagtgaaaaaagtgagcatcatcttgctaccgcagcaaggctgtgtgccattttagaacagccaccaagagacagagagattaatcttgaatggctgatccaacagaaaaatcatcaatggtcacagcgtgaaaaacagctattacagcaatgcaaagggcaatgtcgcccagaattattagcatcactattgagtgtcggatttgcagatagaatagccaaaaaccgtgataatcaaggtcgatttcgcctcgctaatggacaaggcgcaatgatggataatactcaaccaatgagccaatcgccgtggattttagcaccattgttgttgcaaaatgcacattatgcggatgtgcgaattttattagccttacctattgatattaatgaagtatcctctatctttccggaattgatacaagataataccaccgttgaatgggatgaaaagcgcggtacacttcttgcgtggcaacagcgccaattaggtcagttaaccgttagccaaatgccattagataaacctaataaagcgcaaatgcaaacggcattattaaattggttacgtaaacaaggattaagtgctctacccttaagtgaagagagtaagcaactgtttattcgccttgctttagcgcaaaagtggtgccctgaggccaatttacctgtattgaatgaagccgttttattagactcattagaattgtggttacaacctgaattaggcgatacccaatcacttaaggcactgctacaaatggatattaatgggataattaaaaatcagttaacttggcatgagcaacaattattgcaagagctgttcccaacacactatattgctccaacgggcactaaagtgatgattaaatatgatttagataatccgccgattattgctatcaggatccaagaggtttatggtgaaaaacaaagtcctattgtggcaaaagggcaattacctgtagtgatggagttactttctccggctatgcgacctatccaaaaaacacaagatctcgctactttttgggccggaagctatacacaagtacaaaaagagatgaaggggcgatatcccaaacatttgtggccagattcacccgcaacaacggcccccactcgacgtgtaaaaaaatggagttag

SEQ ID NO: 1872 - DNA, 1374 bp, Proteus mirabilis
tccatgaatgataataaaatgactccattagagcgcaaagcgacatggggactaggagctgttttctctcttcgcatgcttggcatgtttatggtacttcccgttttaaccacctacggactgcaactacaacatgcgacagaatcgctaattggattagctattggtatttatggattaactcaagcaatcttccaaattccttttggatttttctcagacaaatttggccgaaaatcaatgattgttttcggcttaattatttttattgttggtagccttattgctgctttaagtgacagcatttatggcattatcatcgggcgagcattacaaggtgctggagctatatctgccgcagtgatggctctgttatctgatctgacccgcgaacaaaatagaaccaaagcaatggcctttattggcattagctttggtattacgtttgccttagcccttgttttagggccaatactcacacatatttttggcttacaaggtctattttggggcattgccctactcgctttcggcgggattatgatcaccctcattaccgtaccgaatagcgaacatcatatacttaatcgagaatcaagttttgtacgaggaagtgtcaaaaaagttttatttgatgcgcaattattaaagcttaatgtcgggattttttcactacacactttattgatggccgcttttgtcgcacttcctttgatcatgcataatgccggattagttaatgagaaacattgggttgtctatctagtcactatgctgattgcctttatttcagtattaccctttattatctatgcagaaaaaaaacgtaaaatgaaacaagtgttcttactgtgtatctttctgctgattattgctcaagctatttttatgatttcaggaactagcttgtggctaattattttaggtattcagatattctttattggttttaatattatggaggcactgctaccttcattaattagtaaagaagcaccggcaggttataaaggcacggcaatggggatttattccaccagccaatttctaggtgtagcattaggtggtattttaggtggatggctctaccaacattacgatgctcaagcagtctttgctggatgtttattgattggcttagtttggtttgccattagcttaacattacgtcaaccaccttatgttagtagcttacgtatagaattgccggcacatttatcaaatgctcaacaacaacaattagagcagaaatttaagcaacaacctggtgttaatgaagtggtaattatggcacaagaacaaagtgcttatatcaaagtggataccaagcagacaccaagagcgacattagaatcgttagtactcggcgtttaa

SEQ ID NO: 1873 - DNA, 435 bp, Proteus mirabilis
gcacaatgtgaatttataacgataataggaatgagtgtaatgaataaagcgggaatgttaggtatcgcggtgctgattatcattatcgctagcgcaacatatcgtttttttgagcaaagaaaacagcgtatcagtgatgataattcacccgttaaattatatatggtagaagttgttgataagcaacaaataccgaaaaacgatcgacgttcaagagaaaatgatattaatgggccagaaacaacctattactatcaagtgacttttcgtttaacaacggactctcagcaagatattatcttacgtgtggataaaaccactttctcaaatgtagcgctggagatgaaagggcgattatttatgcaaggtagtcgtttcgtgcagtttgaaaccgatgcaccagataatgagagtagtaaaacatcagctaaataa

SEQ ID NO: 1874 - DNA, 348 bp, Proteus mirabilis
acaatgagtgatgatatggctctgccgttacaatttacagatgcggctgcaaataaagtaaaagatctaattgcggatgaagaaaacccaaatctgcgtctacgtgtttatatcaccggtggtggctgtagcggattccagtatggttttacctttgatgatgctatgaatgaaggtgatatgaccatagaaaaacaaggcgttgccttagttattgatccaatgagtttgcagtatttagtgggtggctgtgttgattatactgaaggccttgagggctcacgttttatcgtcaccaatcctaatgcgaaaagcacttgtggttgtggttcatcgtttagtatctga

SEQ ID NO: 1875 - DNA, 3243 bp, Proteus mirabilis
atcaggagtgaaaaaatggctaaaagaacagatattaaaacaatcctgattttaggtgcaggcccgattgtgattggtcaagcgtgtgaatttgattattcaggcgcacaagcgtgtaaggcactgcgcgaagaggggtatcgtgttgttttggtaaattcaaatcctgctaccattatgacagatcctgaaatggcagatgccacttatattgagcctattcattggcaagtggtcagaaagattattgagaaagagcgccctgatgccatattaccgacaatgggcggacaaacggcattaaactgtgccttagaattagagcgtcaaggggtgttagctgaatttggcgtaacaatgataggtgcaacggctgatgctattgataaagcggaagatagacaacgctttgataaagcgatgaaaaaaattggtctggatacggctcgttcaggcatcgctcatactatggacgaagcatttgcagtggctgaccaagtgggtttcccttgtattattcgcccttcatttactatggggggaacagggggggggatcgcctataatcgtgaagaatttgaagaaatttgtactcgaggtttagatttatcaccgacaaatgaactattaattgatgaatcattaattggctggaaagagtatgaaatggaagtggtgcgcgataaaaatgataactgtattatcgtttgctccattgaaaactttgatgcgatggggatccataccggtgactctatcacggttgctccagcgcaaacgctaacagacaaagaatatcaaattatgcgtaatgcctcgatggcagtattacgcgagattggggttgaaaccggtggctccaatgtgcaatttgccgttgatcctaaaacagggcgtttaattgttattgaaatgaatcctcgtgtttctcgctcatcagcattagcgtcaaaagcaacaggtttcccaattgcaaaagtcgcggcaaaacttgcagtaggttataccctcgatgagttgatgaatgatatcactggaggaagaaccccagcctcttttgaaccttctattgattatgtagtgactaaaatccctcgctttaactttgaaaaatttgccggtaccaatgaccgtttaaccacgcaaatgaaatctgttggtgaggtgatggctattgggcgcactcaacaagagtcaatgcaaaaagcattacgcggactagaggttggtgcaactgggtttgatcctaaagtaaacctcgacgatcctgaagcgctcaccaaaattcgtcgtgaattaaaagaagccggatcggatcgcatttggtatatcgcggatgctttccgcgctggaatgtcggttgatggggtgtttaatctcaccaatatcgatcgttggttcttagtgcaaatagaagagattgttcgcctagaagagcaagtggcacaacttggtttagctggtctaaatgctgatttcttgcgtcaattaaaacgtaaaggttttgctgatgcgcgcctagctaatatcttgaatgtgaaagagcaaaccattcgccaattaagagaacaatatcaattacacccagtttataaacgggttgatacttgtgcggcagaatttgctacggataccgcttatatgtactccacttatgaagaagagtgtgagtcggatccaaatcaagacaaacctaaagtgatggtcttaggtggtggtccaaatcgtatcggtcaggggatagaatttgattattgttgtgttcatgccgctctagcattacgggaagatgggtatgaaaccattatggtcaattgtaatccagaaacggtttcaacggattatgatacctccgatagactttattttgagccagtcacccttgaagatgtattagaaatagtacggatcgaaaaaccacaaggcgtgattgtgcaatatggtggtcaaacgccattaaaattagcaagagctttagaagctgaaggggtgcctgttatcggtaccagtcctgatgcaatcgataaagcagaagacagagaacgtttccaaaaggccgtggataagttagggttaaaacaaccagaaaatgccacagtgacgacattagaagaagcggtagataaggcaaaatctattggttacccgctggtggtacgtccatcttatgtccttggtggacgagcaatggaaattgtttacgatgaaattgatttacgtcgttatttccaaacggcggtcagtgtttctaatgatgctcccgtactgttagaccgattcctagatgatgccattgaagtggatgttgatgcgatttgtgacggtcagcaagtggtgataggcggtattatggagcatatcgaacaagcgggtgttcactctggagactctgcttgctctctacctgcttatactttaagccaagatattcaagatataatgcgcaagcaagtacgtgaactcgcttttgaattaggcgttaaagggttgatgaacgtacagtttgcggtgaaaggtaatgatgtttatcttatcgaagtgaatcctcgtgccgcacgtacagtgccttttgtctctaaagcaaccggtgtgccattagcaaaagttgctgctcgagtgatgataggacaaagtcttgaacagcaaggcgttaccaaagaggtgatccctccttactactcggttaaagaggtggtacttccctttaataaattctcaggtgtcgatcctattttagggcctgaaatgcgatctaccggtgaagtgatgggggttggtgctacttttgcacaagcttttgctaaagcgatgttaggtagcaattccaccatgaagaaaaaaggaagagcgctactttcggttcgtgaaggtgataaaaaacgtgtcgttgatttagcaactaagctattgaaaaatggttttgagttagatgcaacacatggtactgccattgtcttgggggaagccggtatcaatcctcgcctagtgaataaagtgcatgaagggcgacctcatattcaagatagaattaaaaatggtgagtatgactatattgtcaatacgactgccggtcgccaagctattgaggattcaaaattgatccgccgtagtgcattacaatataaagttcactatgacaccacattaaatggcggatttgcgacaacactgtcattgagtgctgatcctactattgatgttatttcagtccaagagatgcatgcaaagataaaaaaatcttaa

SEQ ID NO: 1876 - DNA, 534 bp, Proteus mirabilis
ccgttaaccgaggttgttatggcactttctcaacacccagaaaaaatgaaaaaaggggtgatcgaaaattggcatcctgaagataaagctttttgggaaaaaactggtcaaaaaatcgcatcgcgtaatttatggatttctgttccttgtctactgctatccttctgcgtctggatgctatttagtgcagtcgctgtcaatttaaataaggttggctttaattttaccactgatcagctctttatgctgactgctctaccttctgtttcaggtgcgctactacgtgtcccttactcttttgttattcctatttttggtggtcgtcgttggacggctattagtacggtatttctgattattccttgtctctggctagggtttgccgtgcaagatctcacgacatcttattccacttttatcgttatctctctgctgtgtggttttgctggtgcaaacttcgcatcgagtatggcaaatatcagcttcttttttcctaaagcacaccaaggcggtgcattaggattaaatggctga

SEQ ID NO: 1877 - DNA, 1143 bp, Proteus mirabilis
gtgaaatacgaattagataaaacagatggtcatgcccgtcgtggtcgtcttaagtttgaacgcggtgtcgttgaaacacctgcatttatgcctgtagggacatacggtacagttaaagggatgacacctgaagaagttgaagccacaggtgcacaaatccttttaggcaatactttccatttatggttacgtcctggtcaagagatcatgaaattacacggtgatttgcatgactttatgcagtggaaagggccaattctaaccgattcaggtggtttccaagtctttagtttaggcgcaatgcgtaaaattaaagaagaaggtgtgcatttccgtaacccaattaatggtgaaaagattttcttaagcccagaaaaatcaatggaaattcagtacgatcttggatcagatattgtgatgatctttgatgagtgtacgccatatccatcagattgggattatgctaaaaattccatggagatgtcattacgctgggctaaacgtagtcgtcaacgctttgatgaattaaacaacaaaaatgcattattcggtattattcaaggcggcgtttacgaagatttacgtgatatctcagtgaaagggctagtggaaatcggctttgacggttacgctgttgggggcctagctgttggtgaacctaaagaagatatgcaccgtattttagaacatgtttgtccacaaatccctgcggataaacctcgttatttaatgggtgtaggtaaacctgaagatttagttgaaggtgttcgtcgtggtatcgatatgtttgactgtgtgatgccaacacgaaatgcacgtaatggacatctgtttgtaacaaatggtgtcattaaaattcgtaatgctaaacatcgttcagatacatcaactctggatgaacattgtgattgctacacctgtaaaaattatagtcgcgcttacctacatcatcttgatcgctgtaacgaaattttaggtgcaaggctgaataccatccataatttacgctattatcagcgtctaatggctgaaattcgtcaagcaattgatgagtcacgtttcgaagatttcgtgcatgagttctacgaacgtattggtaaaccagttccaccgctaaatagcagtgcgagtaagtgcgattaa

SEQ ID NO: 1878 - DNA, 366 bp, Proteus mirabilis
gctatggacgaatattcaccagaaaaaatagatttagctgaattgtcatttttatgtgaagagctattacagcaagcattaagctcattagataaaggtaccgcagtttggaacaatgatctaagtagcacaaaaagcgttgaccttaatgccctaattgatcacattatgggctttagttggctgtttaagataaaatatcctgataaacacgctattaacactttaatggaagagtgcatagaagagacttatcggttattcggtagtgactccatttcctactcggaattgaataattggaaagagttaaactattcactgttaacgcttatcgataaaaatcctaaaagttatatcaagtaa

SEQ ID NO: 1879 - DNA, 1644 bp, Proteus mirabilis
aagcaacgcctgatgctattacagcagccgctcgatccgttattggcaataaaagggaggcgtattttgcgctttttacctgttaatttatctcacatattagttgagttgacttcattaaaagagacattggcgttttatgaagcaattaagcaagccaatattgctgagatagaagatattgttccagcggcaaaaacactattgatccaatatgtaccttggttaattacggcgaaagagttagtggcaatattgcgcaatatcgagataaaagcgatcgcgatgcgtcaaagtcacttattaacaatccccgttcattatcaaggagaagatctgcatgaggtggctgaattattggggatcactgcgacagaggtgatccgcagacacacagaacaaacttatcaagtcgcttttacggggtttgcaccgggatttgcttatttaattgctgataaaactgagctttatgttcctcgacgtaaaacaccacgtacacgtatccccgcaggctctgtaggattagcgggagaatttagcggtgtttacccacagcaaagccctggtggctggcaattaattggtactacagagataaaaatgtgggatctctcacgtgaacagccggcatttttattacctggtgatgctgtacagtttgttgatgtacaaaaagcgccagtgacggtttcattacctgagaaaaagcaatctattaatgctttgtcctttaacaaggataaagggctatgtgttatttccgcaggtctacaaaccttatttcaagatgaagggcgtttaggtgctgcatcaatgggggttagtgcatcaggagcacttgataaatgtgcgttacatgcagcgaatcgcttagtgggaaacccgccttcattagcagcattagaaataacacaaggtggattaatactaaaagcgcaacaagactgtgtcatagcgctgtcaggtgcagattgtacgatcagcttaaaacaaacgaccggagatatagcctttttttctacctatcaaactattgatatacgtagtggagatgaaatcacagtaggaatacctacagcgggggttcgtagttatctggcagtgagagggggttttgaattaagcccagtgttaggtagttatgcgtttgatactttagctcagattggccctcgagccttacaaaatggcgatattcttcatctaaacgatgataacgcattaacgggcattattagccaagagcaaccgagtttcagtttaccaaagcaagaggatatcgttacccttgatattgtgttaggccctcgtacggattggtttacagaagatgcgataaaaacattaacctcacaattatggcaagtgacaccacaatctaaccgtatcggattacgtctattgggggataaatcgcttgaacgtcagcaacaacaagagttatcgagtgaaggaacttgcattggtgccatacaagtaccgattaatggtcaaccggtattatttcttcatgatcaccctctcactggaggataccccgtaattggggctgttgccgaataccatctgtcattggcggggcaaatccctattaacgctaaaattcgttttaacccaattactttatttcaagaatattga

SEQ ID NO: 1880 - DNA, 696 bp, Proteus mirabilis
tggcactgcgatcatcaaaggaggtgcatgatgctagctgatctgcgcttatatcaattagttagcccctctcttccggtaggtgcttttacttattctcaagggttagagtgggccattgaaaaaggttgggtatgctcagcagaaaccttgtcagattggttaagcgcacaaatgaccggaacattagccacactcgagcttcctatattgcggcaattacaaacgagtttggcaaagggtgatagcgatacagtgaaatattggtgtgactttatggtcgcaagtcgcgaaaccaaagagttaaggcaggaagagcgtcaacgggggatcgcttttgcccgtttacttcctcaattaggcattgaattagacgatacgttacaacagcgggttaaacagacgcaattaatggcgtttgcgttagctgccgtgcattggcatatcgatagtgaaaagctctgttgtgcctatgtttggggctggttagaaaatacggtgatgtctggggtaaaactggtgccattagggcaaagcgcagggcaaaaaatattgtttgctctagctgagcagatccccgctattgttgagttatcggcacattggccacaagaggatattggcagttttacgccagctcaagtgatcgccagtagtcgccatgaaactcaatatactcgactttttcgttcatga

SEQ ID NO: 1881 - DNA, 771 bp, Proteus mirabilis
gctgttttagagttaatccgcaatagattcataaaatttaatactatggtgcagttttattcccctaaaaaacgtcctgctaaaaaacaggtaaaaaacttggcggtaaccgctaatgcattggatgctaacggtcaaggtattgctcatgctgagggcaaaactatttttgttaaaggattacttccacaagaaactgcacgcattcgtttgaccgaagaaaaacgccagtttgccaagggagaagtgatcacacggttaaccacaaacccagaaagagtgacaccaccctgtcagtactatcaacattgtggtgggtgccagcaacaacatgtgcctattgattcgcaacgcaccactaaagctgaggttttatcacatcttattaaacgtgaaactaatgtggtcatttcagcacagcctgttattgccggtgcggagtatggctatcggcgccgagcaagattagggttacgttatcaccctaaaaagggtttggtgatgggatttcgccaagcactttctaatgacttagtgatggtcacccaatgcccagtattaaaaccacaacttaatgtactgttattgccactgtggcagtgtttaaagcaactctctgtcgtgcgtgatttaggtcatgtggaattagtgttagcagataatgggccattagtgattttgcgtcatttatcaccgctatctgagggtgataagccaattgttagaagatttttctcatcacgctcaagtgataataatttggcggggtga

SEQ ID NO: 1882 - DNA, 1062 bp, Proteus mirabilis
gtgatcttagagtttatgaagcctatttttagtcgggggccttccctgcaactaagattaataatcgctgtgattatcgcgatatcgttgttaattgctgataatcgcataggtgctttttcaaaagtccgtcagtatttggatactgctgtgagtcctttctattttcttgcaaatgggcctcgtcgtttccttgatcaactctctgaaacctttgcaactcgcgaacgtttacaatttgaaaatcaagcgctaagaaaagagcttcttgttcgcagtggtgaaagtcagctactggaacaatttaaacaagaaaatgcccgcttacgagaattacttggttcacctttacgtcaaaatgaacaaatgacggtaacacaagtgttgtctggtaatagtacgccttatcgagatcaagtggtgatagacaaaggcactaatgatggggtgtatgaaggtcagcctgttattagtgataaaggcgttgttggacaagttattgccgtaagtgagttaaccagccgagtactgttaatttgtgatacctctcatgcattaccggtacaagtattacgcaatgatattcgcgttattgcctcaggggctgggtgtgcggatgatctactgttagaggcactacctgcgaatatcgatattcgtgtaggggatgtgttagtcacctcaggattagggggacgctttcctgaaggttatcctgttggggttgtttcttcggtaaaagtcgataatcaacgtgcttattcggtgattaatgtgcgaccttctgctgaattacaacgtttacgttatctgttgctattatggaacgcctcagagaagaaacaagcgccaccgttaccctcagaggtttaccgtgctgccaatgaacgtttgatgcaattaatgccacaggtactgcctaactatgaacaagcggggccaccactgcctcgttctatgtcacaagagccaacggaaaatagcgccaccccaagtgatatagcaccagtaccaccaacggaaaacaataaacctcaacctaatacgaatcgaggtagatag

SEQ ID NO: 1883 - DNA, 1296 bp, Proteus mirabilis
ctggtgttagaacgactctcatggaaagccctcgtgtgggggctatttctattttgtttacctgcctttgtattatcactatttatcggccaccttccttggttgctcgtggtctcattactgagtgccttgatatggcacgcctataatttaatgaaattatctaaatggttatggctcgatagatcggtattacccccagaaggaaaagggggctgggagcctattttttatggtatacgacaaacacagcaacgtaaccgtaaacgccgtcgagaattaggtgatttaattaagcgttttcgtagcggggcggagagcctaccagatgccgttgtgatgatcactaatgaaggaaatatcttttggtgtaatagtcttgctcagcatcttctaggctttcgttggcctgatgataatggacaaaatatttttaatttattgcgctatcccgattttttacattatttcaccgtcgccgattttagccgccctttaactattgcattaaataatggtgctattgttgaatttcgggtgatgccttatgcggatgatcaacgtttaatggttgctcgcgatgttaccgagaagaataagttagaaaattcgcgacgtgatttttttgctaatgtgagccatgaattaagaacacctttaacggttattcaaggctatcttgagatgatggaagagaataccgcagaaaacccggctgaacataaagtgattaagaccatgcaagagcaagcaaagcgtatggacttattagtacaacaactgttacagctttcacgtattgaatctgcgcctcatattgatttgaacacggttgtcgatatgcctgcgctattaagcgtgcttgagcatgacgcgcactcattaagccaagaacaacaaaatatcatctttgatattgaccataaatgggctgttcgtggtaatgaagagcaattgcgtagtgccgtatctaaccttgtctataacgccataaatcatacccctgagggtacgactattcgcgtgagttggaaaaaagtaccacaaggtatgttgtttagtgtgtcagataatgggccgggtatcagtgctgaacatttaacgcgcttaaccgaacgtttttatcgtgtagataaagcgcgctctcgccacaccggtggtacagggcttggattggcgattgtcaaaaagtccttacaacatcatcactcaatactgaatattgaaagtaaagtcggtgtaggaagcactttttcttttatcatgccgcaaacattgttaacagaaaaaaaataa

SEQ ID NO: 1884 - DNA, 336 bp, Proteus mirabilis
gtgtggctagaagaggttcccactatgctagatcctgcattatcaccagaagagaatgaacactgggtacgttttgttgagttattacgccaagcgtttgaacagggagttgaatttcctgttttacaacttttaatgacgccggatgagcgcagtgcattagcaacaagagtacgtattgttcaagaattaatgcgtggggaattaagtcagcgagagctaaaagagctattaggggttggcattgccactattaccagaggttctaatagcttaaaaacagcaccccatgatgtgaaattatggcttgaaaaagagcttatgataaaaaaataa

SEQ ID NO: 1885 - DNA, 1275 bp, Proteus mirabilis
ctgatgacagataagcgcaaagatagctctgggaagcttctgtattgctctttctgcggtaaaagccagcatgaagtaaagaaattaatcgctggcccgtcggtttatatttgtgatgaatgtgtcgacctttgtgttgatattattcgtgaagaaataaaagaattagcacctcatcatgaacgcagtgaattgccaacgccacatgaaatccgtaaacatcttgatgattatgttatcggtcaggagctggcgaaaaaagtattggcagttgccgtttataatcactataaacgtctgcgtaatggcgataaagccgatggtgttgagctagggaaaagtaatatcctgctgattggcccgacaggtagtggtaaaacattattagcagaaacgttagcacgttatcttgatgtaccttttaccatggccgatgcgacaacgctaacagaagcgggctatgtaggggaagatgttgaaaacatcattcaaaaactactacaaaaatgcgattacgatgtgcaaaaagcacaacgtggtattgtttatattgatgaaattgacaaaatcactcgtaaatctgaaaacccatcaattacacgtgatgtttctggcgaaggtgtacagcaagcattattgaaattagttgaagggacagtagcttctgtacctcctcaaggcgggcgtaaacatccacagcaagaattcttacaagtagatacttcgaagatcctctttatttgtggtggtgcttttgccggactggataaagtagttgctcaacgtctaaatacccattcaggtattggttttggtgcagaagtgaaaagccaaaatgagaaagcgagtgaaggggagttattagcgcaagttgaaccagaagatctgattaaatttggtttgatccctgaatttattggtcgtttgcctgttgttgcaacattaggtgagctcaatgaagatgcgttaattcaaattctgcaagagcctaaaaatgccctgactaaacagtatcaagcattgtttaaattagaaggtgtagatttagagttccgtaaagatgcgttaaccgcgattgctaaaaaagctatgtcgcgtaagacaggggcgcgtggtttacgttccattgtagaagctgcattacttgatacaatgtacgatcttccttcatttgaaaatgcagagaaagtggtcattgatgaaaatgtaatcaatgggaaatctgaaccgctgattatatatagtcaacctgaaaatcaggcatcgggtgaataa

SEQ ID NO: 1886 - DNA, 855 bp, Proteus mirabilis
atgacaaaagaaatgcaatccttagcattggttccgcaaggcagcattgaagcgtatatccgtgcagccaattcctatccgatgttaacggcagaggaagaaaaggaactggctgaacggctgcattacgagggcgatttggaagcagcgaaaacgctgatcctttctcatttacgcttcgttattcatgttgctcgcagttattcaggatatggtttacctcaggcggatcttatccaagaaggtaatattggtttgatgaaagcggtgcgtcgctttaaccctgaagttggggttagactggtttctttcgccgtgcattggatcaaagccgaaattcatgaatatgtgttacgtaattggcgtatcgtgaaagtcgcgacaacgaaatcacagcgtaaactgttctttaatttaagaaaaaacaaaaaacgcttagggtggtttaaccaagatgaagtcgagctagttgcgaaagagcttggggtttctgagagcgatgtgcgtgaaatggaatctcgcatgtcggcacaagatatggcatttgacatgagtgctgatgatagtgatgactcacatcctgtagctccggtgctattcttagaagataaatcttctgactttgctgatggtattgaagaagataactgggataaccatgcagctgaccgactgactttagcgataaaaacactggatgaacgtagccaagacattatccgcgctcgctggttagaagatgataataaatcaactttacaggagcttgcagataaatatggtgtttctgctgagcgagttcgccagttagaaaaaaatgcgatgaaaaaattgcgtttagcgattgaagattaa

SEQ ID NO: 1887 - DNA, 2373 bp, Proteus mirabilis
aaacgaagagagagctctatgaatcctgagcgtccagaacgtattgaaatacctgtattgccattacgtgatgtcgttgtatatccacatatggtgatcccgttgtttgttggtcgtgaaaaatctattcattgcttagaagctgcgatgaacgacaacaaacaaattatgctggttgcgcagaaagatgcatctactgacgaaccaggtgttaatgatcttttttctgtggggacagtggcttctgttttacagatgctgaaactgcctgacggaaccgtaaaagtgcttgttgaaggtattcgccgcgcaaaaattaccacattatctgataatggtgagtatttccaagctaaagcggaatatctagacacgcccgttgttgatgagcgtgaacaagaggtactaaatcgcacggcgatcaatcagtttgaaggttatatcaagctgaataaaaaaattccgccagaggtattagcctcattgcatgcgattgaagaatctgcgaagttagctgataccattgcttcgcatatgcctttgaaattaaaagataagcaagctgtgcttgaaatgtctgatgtaacagaacgcctagagtatttaatggcgatgatggaatcagaaatcgatctgctacaagttgaaaaacgcattcgtaaccgcgttaaaaagcaaatggaaaaaagccagcgtgagtactacctcaatgagcagatgaaagcgatccaaaaagaattaggtgagatggatgatgcacctgatgaaatggagtcgttaaaacgcaaaattgaagcggcgaaaatgcctaaagaggcgagagaaaagacagaagctgaacttcagaaattaaaaatgatgtcgccaatgtctgctgaggcaacagtagtccgcagctatattgattggatggtacaagttccttggaatagccgtagcaaagtgaaaaaagacttagtgaaagcgcaggaagtacttgatacggatcattatggcttagaacgtgtgaaagagcgtattcttgaatatctcgcggttcagtctcgtgtcagcaaaattaaagggccaatcctgtgtttagtagggcctcctggggtaggtaaaacatcactaggccaatctatcgcgaaagcgacagggcgtaaatatgtgcgtatggcattaggtggggtacgtgatgaagctgaaatccgtggtcaccgtcgtacttacattggatcgatgcctggtaagttaatccaaaaaatggccaaagttggtgtaaaaaacccgctatttttattagatgaaatcgacaagatgtcatcagatatgcgcggtgatccagcttcagcactgttagaggtgttagatccagaacaaaatatcgcctttaatgaccactatcttgaagtggactacgacttatccgatgttatgtttgtggcgacatctaactccatgaacattccggcgccattactcgatcgtatggaagtgatccgcttatcgggttataccgaagatgaaaaactcaacattgcaaaacagcatctgttaccaaaacagattgaacgtaatgcactgaaagagaatgagctaacaatccacgacagcgcgattatgggcattattcgctattatacgcgtgaagcgggtgtacgtagcttagagcgtgaaatttctaaattatgtcgtaaagcggttaaacaattgctgatggatagtactatcaagcatattgaaatcgatgaaaataatctgaaagattatttaggtgtacgtaaagtcgattatggtcgtgctgatacagaaaatcgtattggtatggtaacagggcttgcttggacagaagttggtggtgacctactgacgattgaaacggcaagtgtaccgggtaaaggtaaactgaccttcactggctcgttaggtgaagttatgcaagagtcgattcaagcagcgatgactgtggttcgtgctcgagctgacaaactgggcattaatggcgacttctatgaaaaacgtgatattcatgtacacgtaccagaaggcgcgacgccaaaagatggtccaagtgcgggtattgcaatgtgtaccgcgttggtttccagtttaacgggtaatccagttcgttcagatgttgcaatgacgggagaaattaccttacgtggtcaagtattgccaatcggtggattaaaagaaaagttacttgcggcacatcgtggcggaattaagacagttcttatccctgatgaaaataaacgtgatttagaagaaattcctgaaaacattgttgctgatctggatattcacccagtgaaaacaattgaggaagttttaacgttagccctagagaaatcgccatttggcatcgaagtagtgactaacaaataa

SEQ ID NO: 1888 - DNA, 264 bp, Proteus mirabilis
agattgggagaacagatggacaagcgttttgttcaggcccacaaagaagccctcttggccttagtgcttacttttatctacttattgggttggttacttactgcctatttacccgataatactgtggggctaaccggcctaccggtttggtttgagctttcatgcctatttttgcctgtgctattttttttactgtgctatctgatggtacgctattttttcaaagatatgccgttaggagatgagcatgacaatgcaaactga

SEQ ID NO: 1889 - DNA, 384 bp, Proteus mirabilis
tgttgtctggatctgtgtgttcaccgtagtttatctgatgggagcgatgtaatgagtcatccaaatacttctccttcaggcgcaagccacggcagcatgaagtcctatctgattggctttattctgtccgttatcctcaccgtgatcccattttggatggtgatggaaggaacagctacaacctcaactatcttatggacagtcgttggtatggccgtcgtacagattgttgttcatttagtctgtttcttacatatgaacacgtcctcagaagagcgctggaacgttatcgcattcctattcaccttgttgattatcggcattgttgtgattggctcactgtggattatgtacaacctgaacatcaatatgatgatggattaa

SEQ ID NO: 1890 - DNA, 261 bp, Proteus mirabilis
gcaattatggatacaaatgaaatcaaacaagtattaatggataccctatctttagatgaagtcattgttaatggtgatggcagtcattttcaggttgtggttgttggcgcgatgtttgaaggaatgagcagagtgaaacaacaacaaaccatttatgcccctttgatggaatatatcgcagataatcgtattcacgctttatctattaaagcctacacacctgaagagtggaaaagggatcgtaaactcagcgggctttaa

SEQ ID NO: 1891 - DNA, 1371 bp, Proteus mirabilis
aagccatcggaggctaatatgttaagtctgtttagacctgcgccacataaagcgcgtctgccaaaggaacagatagatcctgtctatcgccgtttacgttggcaaatctttatggggattttctttggttacgctgcttattatttagtaaggaaaaacttcgctttagcaatgccttacctcgttgaagagggattctctaaaggggatctgggttttgctttatcagggatctcgattgcttacggtttctctaagtttatcatggggtcattctctgaccgtgctaacccgcgttacttcttacccgcaggtcttattcttgcatccattgtgatgttaattatgggctttgtgccatgggcaacttcgagcattatgatcatgttcgtgctgttgttcctgtgtggttggttccaaggtatgggttggcctccttgtggacgtaccatggttcactggtggtcacaaaaagagcgtggcggtatcgtctctatttggaactgtgctcataacgtcggtggtggtttaccgccattgctgttcctgttaggtatggcatggtttaacgactggaaagcagcattatatatgccagcattcgcggctattttagtagcgatgattgcgtttgcattaatgcgcgatacaccacaatcttgtggtctacctcctatcgaagaatataaaaacgattatccacctgattataaagaaacagacgaacaagaactgacagcaaaagaaatctttatgaagtatgttttccctaacaaacttctgtggatgattgcaattgctaacgtatttgtttacttacttcgttacggcgtattggactggtctccaacttatcttcgcgaagtcaaagatttcgccatggataaatcctcatgggcatacttcttatatgaatacgcaggtattccaggcacactgctgtgtggttggatgtcagataaagtgttcaaaggtaaccgtggtgcaactggggtattctttatgaccttagtaaccattgccactatcgtattctggatgaacccagcaggtaacccgaatattgatatggcatgtatgttaatcattggtttcttaatctatggtcctgttatgctaattggtctgcacgcccttgaattagcgccgaaaaaagctgcgggtaccgcagcaggcttcaccggtctattcggttacttagggggttctgttgcggcaagtgctatcgtaggttataccgttgactacttcggttgggacggtggctttatggtcatgatcggcggtagtgtattatctgttgtgttattacttatcgtgatgataaatgaaaccaaacacaaacgtgaaatgtcacagaagtatgaataa

SEQ ID NO: 1892 - DNA, 1176 bp, Proteus mirabilis
gttatggaggaaacaaccatgcaaaatttcacttattactcccccactcgaattcattttggtcaaggacaaattgcaaaattacgttctgaaattgggaaaaatgaaagaattttattaacttatggcggtggaagtattaagcgcaatgggatacttgatcaagtgcatgcggccttaccagggtatcaaattcatgagtttggcggtattgaacccaatccttcgtatgaaacgctaatgaaagctgttgcttacgctcgttatcacggtattactcatttactggctgtaggaggaggctctgttgttgatggaaccaaatttattgcggctgcaataccttatcaaggagagccttgggagattgtcactagccgaggtcatgcaattgaaaaagcactgccattaagctgtgtactaacccttccagcaactggctctgaaaccaattgtttttccgtgatcagtaaaaaacaaacgatggataaacaaagttttgctagcccacatgtttatcctcattgcgctattttagatccaactgcaacgttttctttaccaccaagacaaaccgctaatggcgttgttgacgcatttattcatattttagagcaatatcttacttatccggtaaatgcgcttgtacaagatgaatatgcagaaggcctattaaggatcttaatcgaagaaggaccgaaagccctcacctcaccacaagactacgatatccgtgctaatataatgtggacagcatcccaagcacttaatggtattcttggtgtcggtgtaccgcaagattgggcaacccatgcattaggccatgaaattactgcattacacgggcttgatcacgcacaaaccctcgcgattgtcttacccgcgctattaaacgaaaaacgtcaggagaaatacgctaagttgatccaatatgcacaaaaagtgtgggggatccatcaaggctctgatgcatttaaaatcgatagcgccatcaatgagactcgtaagttctttgaacgcatgggactaaaaacacggctgtctgactttaatatcagtgaagcggatattcctgccttagtgcaaaaactgcaacaacatggacaaaccgcactcggtgaacatcaggatatcaccttggaagtcagccagcgtatctatatggcagcactctaa

SEQ ID NO: 1893 - DNA, 492 bp, Proteus mirabilis
ggcgtggaggatgtcaaaatgctagctgaggcaacacacacaaacctctctttagttgatgaaattaatcaaagactttgtgaatttagagatgagcataatatgtcaacaggacttgttattgctcaaggtaagaagctctatttagtgagatataatcgtagttttaaacatgtcgatattgattttctgccaaatacacccgttccacataaattgagtgcggcaggcgcgacttatgcagtctttagtcatttagaaattgatgctgatttatcaatacagcaaaaaaacagtatacatcaacaaggttttgctattcgccaacaacccgctgaaggtattcctggggctcaatctattgcatgtcctgtatttaataggaaaggtgaaatggtcgcagccgcattgaccatgggatttattaaacctgaaaaccaaatagaattaggtaatgcattaaaagcaaaaattcgccatgtattatcttaa

SEQ ID NO: 1894 - DNA, 729 bp, Proteus mirabilis
cctacaagggagtatgacacaatgagagttggcgtaataggtgcaatggaacaagaagtcaaacttctgcgtgaacaaattgaaaactgcgaaatagtctctcgtggtggttgtgaaatttatactggcaaaatcaatggtgtagatgttgcattactaaaatcaggcattggtaaagtggcagccgccatcggtaccacactattacttgaacattttcgccctgatgttgtgatcaacaccggctctgcaggtgggttagatgcaaaattaaatgttggcgatattgtcgtatcaacagaagtacgttatcacgatgccgacgttactgctttcggttatgaaccaggacaaatggcacaatgcccaccggcatttattgccgatcccaaactggtcaatattgctcaagagtgtattggatcactaaaattaaatgccgtgcgtggattaatctgcagtggcgatgcttttattaatggtgccgagccattagcgcgtattcgtcgtacttttccagaagtcgtcgctgttgagatggaatcaaccgctattggacatgtttgccatcaatttgatacaccttttgttgttgttcgcgccatttcagatgtggcagataaagaatcgcatttaagttttgatgaatttttatctgttgccgcacaacaatcaagcttaatggtcaccactatgcttgataaattaaaaacagaaactcagttttaa

SEQ ID NO: 1895 - DNA, 2640 bp, Proteus mirabilis
ttaggtttacttatggctaaattattcaagacgattgatttaaatgttaaacataaaagtaagcagtgcagaggtcgttctgctaccacactgatctatttcgtgattatagggatggcaagtattgccagcgagtcatttgctgttagcaaagatattgaatttaactcagatattcttgacttaaaagatcgaggaaatattgatttatcaagcttttcccgagcgggatatattactcctggcaagtatgagttaattattaatattaataacaatgaattaagtggaacttatcgtgttgactatattgtgcccaaagatgatcccaaggcaagcgaaccttgtatctcacccatattagttaagcagtttgcactcagaccagaatggttaaaaaagttaacttggaaagataagggtaattgccttaatgaggcatcgttaccaggtatgagcctgaggacagatttaggtagtggggttttttttattactcttcctcaagcttatctagagtattcatcaccgaattgggaatcgccttctttttgggacgaaggtattgctggattattgtttgattataacgttaatgccaatgtcagagcgcctagtgatggcaagcagaaacagcagatcaccgcaaatggtacggcgggagcaaatttaggtgtttggcgttttcgggcagattggcaagcaagttatgagcacactacaggtgtattgcatagcacagaaaatcactggaattgggatcaattctatctttatcgagcgataacgaaatggggcgcccgtttagtcatgggggagacttacttacgttcaaacctattagataatttccgttttacgggaataagtttacttacggatgagcaaatgttgcctcctaatttacgaggttatgctccagagatcacgggagttgcaaaaacgaatgcaaaagtcactgtgagtcaacaaggacggattatctatgagacacaaatcgcgcctgggccatttcgtattcaagatctgcaagatgcggtaagtggacgcttggatgttcgtattgaagagcaggacggaacaatacaagaataccaaattgatacagccaatattccttatcttacaagaccgggacgccttcaatataaagtatctgcgggtaagccttctcgcttagatcataaaactgaagggcctatttttgcaatgggagagttttcttggggagtgaataatggttggtctctttttggtggcactttagtttctaaggattataactcggcctcgctaggttttggacgagatctaatgatgttaggtgctatctcttttgatacgactcattcatgggcaaccttcgctaatgagaataaacactatcatggcagttcatatcgaattagctattcaaagcgttttgaatctattgatgggcaaatcacttttgcaggctatcgattctctgatcgtcattttatgagtatggatcaatatttagataggcgttatcgctatggcgcacaagaaaataataaagagctttatacccttacactgagtaaacaatttcctcaatggggacttagtacctatataaattataaccatcaaaggtattgggatagaccgaataacgactattacaacttctctttatcaaagtatctcgctatcgggaagtttaaaaacattaacattagcttatccgcttatcgtaatcgttttaatggcaatcatgacaacggcgtgtatttcaacattaatttgccttggcgtgatagagcaacgataagttataactcggtcataaataaagaaggtaactcacataatgtcagctatttcgatcgcattgatgataacaataattatcgtctaagtgcaggagttagtagtcgaggtaaaccatcggcggatggtttctttacacattatggtgatgttgctttagtaacggcttcagccagtcatattaacggcgactatacttcggcatctttatctttccaaggtggggcaacattaaccactaaaggcggggattttcaccgtagcaatatgccgggggcaacccgtttgttaattgatactcaaggtgtttctgatgtcccggtaaaaagtcttagtgccatatctcataccaatatttttggcaaggcggtgatccccgatattaatcactattatcgaggcagtgcttctatcgatcttaagcagctaccagacaatgttgaagcactacgttctattcatcaattaactttgactgaaggcgctattggctatcgtcaatttgatgtgattgccggacacaaagcgatggcaacagtacagttggctgaaggaggcgttccgccatttgcagcgacagtaacaacgcttaatggtcgagaattaggtgtttttaacgacggtggaaaggtttatttaagcggtattaattcaggcgatgtcttgtatgtacattgggatggtaaaaaccaatgccaattatccattcctaaattggcggatacacaactgatcacatcactgcttttaacttgctttcaaagacagccgactatttcaacatcattcctggaaacagataaaacgcaagcattacctcaacattcattccttagtaaataa

SEQ ID NO: 1896 - DNA, 585 bp, Proteus mirabilis
tttttcttactaacggagaaaaatatgaatcgcaagatggcaccactattgctatgccttgttgccagtttagtgactgcgtcaacgatagccagtgatgtaaaacaagataaaaacatgcatcagcgatttgggtggctcaatctacaaggaaccatattagagccgtcatgtgcaatatcagcgggaagtagtgatcaagtgatcccgctaacgacggtatctatcccaacgttagtcactgaaggtcaaggaccgattgaatatttttctatcagattaacggactgtacgctaattagccagaaagggcaagaagcggataatccacgttttatcgcaacgttcgatggtccttctaatggaaatggcaactttgagttatccggtgaggccaaaggtgcttcattagcgatagcggatcgttatggtcgacaagctattccaggacaacccctaccgcccgttggcattgattcgcagtcaatggcattgctgtaccaagctcgaatagtcaaaaataacgatacgccaaaagcggggaattaccgtacgacgctgcgctttaagctggaatactattaa

SEQ ID NO: 1897 - DNA, 639 bp, Proteus mirabilis
tgcatattacttgctatagtgatgctgcaactgacttttgttgtttattatctaattgaaaaggttacgaaaatgaagcaacgtaaatttcttacacgttttgaagtgaatgctattttaaagcaagctaaggaaggtaggtatcccgaaagagattactgtatgtttttaatgtgttttttacatggttttcgtgttagcgaactatgtaatttaacattaagcgatattgatctagaaagtagaatactctatgtcaggcgtttaaaaggtgggctttcaacaacacaacctattattgatgaggaatatgaagccttatgcaactggttgaaaagtagagaaaactggagagaatcagattctgaatgggtatttttatcacaaaaaacgggccccatttcccgtcaacaagtttatgggctattacgccgtttaggtaaaaaagccaatgtttctattagtccacaccctcatatgttacgccacgcctgtggctacgcactggcggatttaggcagagatacacgtttaattcaagactatttaggccatcgtaatatttcccatacggttatttatacagcaagtaactcaaaacgatttatcaatatgtgggaaacgcgaaactcacaatag

SEQ ID NO: 1898 - DNA, 987 bp, Proteus mirabilis
gtgttgttacttttattgtgttttggttggtggtcgcactgttatttaaacaaggggatcgtcatgccaaatagcgccctattgaaaggtgatcatattgtcatcttgctattgatatcgctatgctctttttctgtttctgcaaaaaaaatcattcaaggcattactcaagatagtgaaaatattgttgttgctaaaggggatattcccactcctgaaaaatttacaaccaatattcttaactatcggcagaaagctgttgatcagttgaccttcgttgaaactgcattaaaaaatgtcattgttaacagtgaaaaaaatcaactgactgatgcccaactcgcctatcaacaagcgcattatcactatgaggtgatccgcccgattattgcattgtttggcgctactgaacgcctattaaataatcgggctgatttctttcttgaaagagaaaactcgccccgttttagtggatttcatttggttgaatatcaactctttaaattagaggatatgcaatcgtcagccgagtcagccaaagcactgttaagaggcattagtgatctaaaaaaacgcttagcgattgaagatattcccatagctaaattagtgcaatctgcaggtgatagtttagagctgattttaaccgacaaattagccggcattgaaaatcaatatgcaaaaagtgatctgggggatgggtatgccaatttatacggttcacgcctaatcattgagtctctatctaaccatattccacttcaggaatatcaatcactacgcaaacagtatgacactattagcaaactatttttaaaatatcagcgagatgaagaattatttcagcctttagatacgctttctgatagtgagaaagccgtgctctttgcacaaataacacaattagcggagcaagttgcacaattacgtaacgtgctcaatattgatgtctattattactataaagaagcatatggtgaaaaataa

SEQ ID NO: 1899 - DNA, 426 bp, Proteus mirabilis
aggcagttactaattagcttaattattgatagccctgtgtatagggctatctcctctgttttgttaagtgaaatttcaatgattaaacatctctatcaatacacgctattactgctattaatgatagcaagctctactttagccgcagaaaaatacaccgttgaattagaaatgaaagagggggaactgatccctcgagttttaaatgttcctgctaaaactcctatacggatcaaaattcgcaataccggtagtagccccgttgaatttgaaagcactcaattacgtaaagaaaaagtattagcgcctggggcgagttctgtcgttgtgattgcgcctctaaaacctggacgttacaccttctttgatgattttcatctgtctcaccctcaaggtgaaatcgttgcgactgaaaaggctgaataa

SEQ ID NO: 1900 - DNA, 1221 bp, Proteus mirabilis
tgcgcggtactgaacagaagattactaaattttagagaatcaatgagaggattcatcatgtctgtaattaagatgaccgatttagacctggccggtaaacgagtactaattcgtgctgacctgaacgttccagtgaaagatggaaaagtaacttcagatgcacgtattcgtgcttcattaccgactattgaagcggctttaaaacaaggcgctaaagttatggtaacttcacacttaggccgtcctactgaaggtgagtacaacgaagagttctctttaaaaccagttgttgactatctgaaagagaaattatctgcacccgttagcctagcaaaagactatttaaacggtgttgatgttaatgcaggtgaattagttgtacttgaaaacgttcgttttaataaaggcgaaaagaaagacgacgaaacgctgtctaaacaatatgctgcattatgtgatgtctttgtcatggatgcattcggtacggctcaccgtgctcaagcgtcaacacacggtgttgctaagtttgcggatatcgcttgcgcgggtcctctgttatcagcagagcttgaagcattaggcaaagcattagataaaccagagcgtccaatggtggctatcgttggtggctctaaagtatctactaaattaacagttttagattcattatcaaaaattgctgaccaattaatcgttggtggtggtattgctaacacctttatcgcagcagaaggtcattctgtaggtcgttcattatatgaagcagaccttgttgacgatgcgaaaaaattaatggaaaaatgcgatattccagtaccaacagatgtccgtgtcgcgacagaattctcagaaacagcgccagctgtactgaaatcagcaaatgacatcaaagatgatgaacaagtattagatatcggtgatgtgacggctgaacgtttagctgaaatcctgaaaaacgccaaaaccattctgtggaatggccctgtgggtgtctttgaattccctaacttccgtaaaggtactgaagtgattgctaaagcgattgctgatagtgatgctttctctatcgctggcggtggtgatacattagcggctatcgatttatttgatatcgcagataaaatctcttacatttcaaccggtggtggtgctttcttagaattcgtagaaggtaaaaaacttcctgcggttgctatgctggaagaacgcgctaaacagtaa

SEQ ID NO: 1901 - DNA, 465 bp, Proteus mirabilis
aatatttcactcatggccaagattttgattatgccaagatgggataaaataatagtttccatattctttcttattttatttatcgtaattggaatacttgtttatggttacactatttcgttatttctgatggaagatattattatattttcagggcctattgttatgttaacactgggggtaccacttgtcatatatacttgtttcgcaatgacaattgagttttttcttggtgtaaaatcaattgtttttatgtctttaatgacatttaataaattaataatgcgatatttagtctatttaggacttgctggtgtattgctcagttttcctatctcatttgtagtaaatatctttcttcttgatgaaggatataaaacgtgtgataaaatttcgtggctatcacccactacatatgtaaaagaattatcgttttgcaataacaaaaaagcccttaacaaataa

SEQ ID NO: 1902 - DNA, 324 bp, Proteus mirabilis
agagttggtttgagcataattgagaaggaagacactatggaacttcaaatcactggtcataatattgaattaactgatgctctgcgtgataccgtcaaagcaaaaagcgctaaattacctcagttctttgacaaaattaataacgtccaagttatcctcaaagtcgaaaaagtgactaaaattgcggaagcgacgattcaagtaaatggcggtgaattacatgcctctgcggaagcagaagatatgtacgcagcaattgatggattaatggataaactggctcgtcaattaaccaaacacaaagataaactgagacaacattaa

SEQ ID NO: 1903 - DNA, 387 bp, Proteus mirabilis
ataatccaactatcacaaaaacggcaaacactatttcttcaacaccagcaacctcaaataacgcttaatttttcggaattgatcatgactatagaaaaaaatgttataccactgtcagaaaaaatttcagatgatccaaagaaatttctcgttattggatggactgtggttttattaggcttagcaatttttattttttgggctgctttcgcgccccttgataaaggcgttcctgcaataggaaacgtagtaatatcggggaataaaaaaagtgtacaatcttctgttgaaggtattattactcatatttttgtaaaaaatggggatccggtttttgccgggacaaaccctgatacaactaaagccctcttcaatctcaagccttag

SEQ ID NO: 1904 - DNA, 1353 bp, Proteus mirabilis
attattaaactatttattggacataatgcaatgaaagaacaattatcttcctactggaaaatattaattgaagctgttaagcaacaagtgaagccagctttaggttgtaccgaacccatttcacttgcattagctgctgccactgcagctcgttatctgcaacataatatcacccgtattagcgcagaggtttctcctaacttaatgaaaaacggaatgggagtgactgtaccgggcacgggtatggtgggattatctattgcggctagtttaggggctgttgctggagatagtgaagcaggtctagaagtattaaaaaatgccacaccagaacaagttgagttgagtaaaaatctattaaattcaggcattgtctgcgtatcaataaaaaaagcctgccaagaggtgctttactctgaggttaccgttgaagatggtgaaaacagtgccaccgtcattattgcaggtgatcatactaatattgttaaaattatccataatggtcaggtggtgcttgataaattatcatcacaatctgaacaaacggcctcaccttgccaaattaagcaagccttaaccaacactaacacacgagaaatctatcagtttattactcaagctcctgtagaagaaatttcttttattttgcaatcggcgcaattaaatgacgcattatcaaaagaaggcttgaacaatacttacggtttgcatattggtcaaaccttacaacgccagcaacaacgtggcttgttagctaaagatctgctttctgaaattatgatccgcacttcagcggcttctgatgcacgtatgggcggtgccgtactccccgcaatgagtaactcaggttcaggaaatcaaggtattgcagctacaatgcctgttgtggtggttgctgaatatttacaggttagtgaagaaaaaatggcaagagcattaatgctttcacatttattagccatttatattcaccacaaattcccggcactctccgcactatgtgctgcaacaaccgcatcaatgggagctgctggtgctattgcgtggttaatggaagaacgctatgaacccatggcaatggcaattagtagtatgattggcgatattagtggcgtgatttgtgatggtgcctctaacagttgtgcgatgaaagtgtcgacaggagcaagtgccgcttataaagcggtattaatggcgctagatgatacctgtgtgacgggtaatgacggcattgtcactcatgatgttgatatgacaatcgagaatctttgtgcattagctagtcgagcaatgcaacatactgatgtacaaattattgaaattatggaatataaagctgttgctaatggctaa

SEQ ID NO: 1905 - DNA, 1533 bp, Proteus mirabilis
aaggaattttgcatgcttcaagccgcctttaaacagaccacttggtataaatcttttattttactgttacttggtttcacttcgggcttaccccttgcattaacagcaggaaccttacaagcatggatgacagtagaaaatatcgatttaaaaacgattggttttttctcattggttggccaagcttacgtgtttaaattcctctggtcgccgtttatggatcgctatacaccttcattcttaggccgccgccggggatggatgttattaacacaaatcggtcttgtgttaggtattgcgggtatgggctttttaaaccctagccatcatttatggtggttagcctcgttagccgtcatcgtcgctttctgttctgcctcacaagacatcgtctttgatgcctataaaaccgatatcctaaaagccgatgaacgaggcacaggtgcagcagtctctgtgctgggctatcgaatagcgatgctggtttctgggggcatggcgctatggcttgcagataaatatattggctggcaaaacatgtactggctaatggctgccttaatgggcattggtattatcgccacgctattagctcaggagccagaaaccgccgtcaaacctccacgtacactctatgaagccgttatagagcctttatatgagtttttctctcgtaataatgcatggttaattttactacttattgtgctatacaaaatgggagatgcctttgcgttaagcttaagtaccacattccttattcgtggcgccggatttgatgcaggtgaagtgggattagtcaataaaacgcttggattggcagcaaccattgtcggagccttattaggcggtttattaatgcgccgttggactttattcaaagcgctgatgatctttggtattttgcaaggggggtcaaatatcggctattggtatttagctatctctgagcaaaatatttatagcatgggagcggtaatcgctttcgaaaatatttgtggtggtatgggaacggcggctttcgttgctctactaatgacactatgccatcaatctttttcagcaacacaattcgcccttctttccgccttagcggctatcggccgtgtctatgttggtcctgttgcaggctggtatgtagaatcccatggctgggaagcgttctatcttttctctattgttgcctctgttcccggtattattttgctgatgatcgctaaaaatacactcacttatacgcaaaaaactggcgaatttttacaacgaacattatttattaaacaataccgtttagcgatttatggtttactctttgccgtattactatttttgtgtagcttaatattacttattattaattcgttaccaaatttagagatgtttcagtcagttgattttatacaatctattaatagtgaattattaagcgagcttacttctacactcttcttatatggtgtcattattggcgccgttagcttaattatcgggactattttagattacttggcactgaaaaaaacagctaattaa

SEQ ID NO: 1906 - DNA, 696 bp, Proteus mirabilis
ggctctgtttgcccgcgaggagtagttgtaatgatccgcttcgaacacgtcagcaaggcttatttaggtggaagacaagcattacagggggttgattttcatcttcgccctggtgagatggcttttttaaccggacattctggtgctggtaaaagtacattgcttaaattaatttgtggcatagaacgtccaagtgatggcgctatttggtttgctggtcatgatatcagtaggctaaaaaatagtgagatcccttttttgcgtcgtcaaatagggatgatcttccaagatcaccatttgctgatggacagaacggtttatgacaatgtctctctacctttgattattgcaggcgcaagtgaagaggatattcgacgccgagtttcagccgccttggataaagtcggactacttgataaagcgaaaaattaccctatccagctttcagggggtgaacagcaacgggtgggaatagctcgtgctgttgtgaataaacccacggtgttattggctgatgagccaacagggaatcttgatggtgaactttcagaaggcattatgcgtctgtttgaagagtttaatcgcgtgggggttaccgtgttaatggcaacgcatgatatgacacttgtagagcgcaggaattaccgtattctaaccttaggtcaagggcgtatggtgggaggacaaaatggctaa

SEQ ID NO: 1907 - DNA, 336 bp, Proteus mirabilis
acgatttcttgcattagaaaagctaaatcacgtgtggggactaaaacctctaacttaccattacgactcatttccgctaagtttttcgaaggtcgtttatcttggctggtgatactaagtgtaattgggcgcatagttggatctgatggtggtacagacatcactggctcaatcgataatttattgcttggtgttgcacatcctgccagcattgtgagcgcaaacacggcacaaagtaaattttttatcatgatagtgtctcgattaagtaattctgccgttttctcagcagataagggtggctattttgcctatcataccactgcaaaagcgtag

SEQ ID NO: 1908 - DNA, 318 bp, Proteus mirabilis
tttatgtcttggataattctctttgtcgctggcctattagaaattgtgtgggcggttggtcttaaatacactcatggttttacccgtttaacaccaagtattattacgatcagtgcgatgatcgtgagtatggggatgttatcgtatgcgatgaaaggcttacctgcgggtacggcttacgccatttggaccggtattggtgccgttggtacggctatctttggtattatcgtttttggtgaatccgccaatatttatcgtttattgagtttagcgatgattgttttcggtattattggtttgaaattggcgagttaa

SEQ ID NO: 1909 - DNA, 405 bp, Proteus mirabilis
aataagtattggcatatctcttgctctatcagtatggcgctttctaaaaccgtatggagcaattatatgaaatatatcatcgcgattattaaaccatttaaattagaagatgtaagagagtcactctctgagcttgggattaatggaatgacaatcagtgaagtaaaaggatatgggcgacaaaaaggacatgccgagctttatcggggagctgagtatgaggttaactttcttcctaaagtaaaaatagaattagcggtttgtgatgggcaattagagcctgtgctacaagcaataagccaagttactgatactggtaaagtaggagatggcaaaatttttgttttagagttattgcaggcgatccgtattcgtacaggagagtctggtgaagaagccttgtag

SEQ ID NO: 1910 - DNA, 1080 bp, Proteus mirabilis
ttagtcaattgctcgattattctaggcggttgcataattacgagttatcaaggaagttacatgacaattagagttgctattaacggttttggtcgaatagggcgtaatgtgttaagagcgctttatgaatctggaaagcgggctgaaataagcgttgttgcaataaatgaattggctgatgcgacaggtattgctcatttgcttaaatatgactcaagccatggtcgttttgcttgggatattcgtgttaataatgacttattgcaagtaggtgatgatgcaatccgtcttttccatcatgccgatattgcagacttaccttggggtgagttaggtattgatgtggtacttgattgtagtggcgtttatggatctcgtgccgatggtgaggcgcatattgcacaaggggcaaagaaagtgctcttttctcatccgggaacgatagatcttgatgctacggtggtattcggtgttaatcaacatgaactgaaaaaacagcaccgcatcgtctctaatgcttcttgtaccacaaattgtattatcccgattattaaaatgatggatgatgcttttggtatagagtcaggtacagtgacgacaatccatgctgcgatgaatgatcaacctgttattgatgcatatcataaagatttacgtcgtacacgagccgcaggacaatcgattattccggttgataccaaattagctgccggtattacacggattttcccgaaatttaaagatcatttcgaggcaatttctgtacgagttcctacaattaatgtgacagcaattgatttaagtgtcacggtaaaaaatgctgtaaatgtgttagatgtcaataagttaattcaaaaatcagcaactggcgcatttcgtggtatagtggattacacagaattgccattagtctcaacagattttaaccacgaccctcatagtgccattgttgatggtacacaaacaagagtcagtgggcagcatctgattaaaacgttagtctggtgtgataatgaatggggctttgctaaccgaatgcttgatacgacgttagctatggctgcaactggttttaaataa

SEQ ID NO: 1911 - DNA, 1212 bp, Proteus mirabilis
ttaattcgttgtaccggaaaccattcgcatagggagtacggtattttttttatcagcacaattccactaactatgaaaaaaacaaaacatttatttaaaacaaagggttgtaatattccttttacttctgtgatgatggtaagttttgtcttaatgggctgtaacgatcaatcgactcagccaaccaagcctgctatcccagaagtgggagtctatactgtcaaagaggaaattcttccattaacggtcgatttgccagcaagaacggcatcttatcgtgtctcacaggtgcgcccacaagtcgatggtattttagaaaaacgtctatttactgaaggtagtgatgttaaaaaagatcaaccactgtatcaaatagataaaaaaccttacgaaactcaggtagctaaagcgcaagcggcttacgataatgtgaaaaaattagctgcccgttataaatctttacgtgccactaatgccattagtcagcaagaatatgacgatgtagtatcacgccttgatcaagctaaagccgatttaaatcaagcaaagattaaccttggctatacccaagttttatcacctattagtggcaaaatcagtcgctcttttgttagtgaaggggcattagtgagtagtggacaaagccagccattagcgaccatcacacagcttgatcctatctatgtggatattactcaacctattactaaccaactgaaattaaagtcactgatccaacaaggtgtcgtcactgatagtgaagataaaatggatgtgacgctgtttttagaagatggctctcagtacccttataccggtacattaagtttttccgaagtccaagttgagccaagtacaggctcagtgacattacgcgccaaattccctaatccacagcaccaattattaccaggaatgtataccaaagctcgcattatgcaaggaactcaagagaaagcgattgttgtgccacaacaagcgattacctttgatgcccgtggtaaatccatcacatatatcgttgatcaacaacaagtattacaagcaagagatgttgaaatattaaaaccacaaggtaatggatggatcataaaacagggattacaagctggcgataggatcatgacagaaggtcatcatcgtgcaaaaccgggcgtaaaagtcaatgcggttcctgctaacaacatttcattaaagaccaccttagagtaa

SEQ ID NO: 1912 - DNA, 606 bp, Proteus mirabilis
agctatctctgctttgttatatggaaagtcaagagtaatgacatgagtatggcttttttgctgagtgaaaaacagctattattcaggttgtttttatttattgaggaagaacgaatgccatcttttgatatcgtatctgaagttgacttgcatgaagtgcgcaatgcggtagagaacgcacaacgtgaactgactactcgttgggattttcgtaatgttgaagcaagttttgaattaaacgaaaaaactgagtcagtaaaaacaactagtgtatctgaatttcaggtgcagcagttattagatattctgcgtgagaaaatggcaaaaagagggattgatggtgctgttttaaatatccctgaagagatgactcacagcggaaaaacatacagtgtagaagcgaccttaaaacaaggtattgatactcctttagcgaaaaaaatcgttaaaatgatcaaagacagcaaattaaaagtacaagcacagatccaaggtgagcaagtacgagtaacaggtaaatcacgtgatgatttgcaagctgtgatgaaattagttagagagggtgaattaggtcagcctttccaatttaccaattttcgtgattaa

SEQ ID NO: 1913 - DNA, 462 bp, Proteus mirabilis
aggacgtactgttttaaccgcagagcaagtaatggaaggggtgccagagatgataaaagatgttcaagtagagtgcactttccccgatggcaccaaattggtttcaattcactcacctattgtgtaggtaataacatgatccccggtgaaattagagttaatgcagcattaggcgatattgaactgaatgctggtcgcgagacaaaaaccatacaggtggctaatcatggcgatagacctgtacaagtcggctctcattaccacttttatgaagtgaatgaggcactcaggtttgcacgagaagagacattaggttttcgtttaaatattcctgctggtatggctgtgcgcttcgagccaggtcaaagccgcactgttgagttagtggcttttgcaggaaaacgtgaaatttatggttttcatggcaaagtgatgggtaaattggagagtgagaaaaaatga

SEQ ID NO: 1914 - DNA, 237 bp, Proteus mirabilis
aaaacttgctgcaacgtggggtcgcaagattatagagaagtcagaaaaaaaaatcgagtcataattgaaaaacaattggattctttttcaatatttcagcaaaaaataccttatggcgctatttttgttagcctactcgccatctctgtcatcaactattaccacctgaagagaagcattctcccttgccaaagcgattgtaatcacttaataagtaccgttttgccatttttataa

SEQ ID NO: 1915 - DNA, 996 bp, Proteus mirabilis
tgtcactgctgctggggtatttgcagatgtattacgtacactatcatggaaattaggagtttaaaggtggttaaagtttatgcaccggcgtcaattggcaatgtgagtgtcggttttgatgtgttaggagccgcggtttcgcctattgatggtcaattattaggagattgcgtaaccgttgaagcggcgcaagaatttcaacttcacagcaaagggcgctttgttagcaaattaccttctgatgctaagcaaaatattgtttatcaatgttgggaactattttgtgaaaaattaggtaaacaattacctgtctcgatgacacttgaaaaaaacatgccgataggctcaggattaggatcaagtgcttgctctgttgtggctgcactcgttgcattaaacgaatttgctcacaaaccatttagtgaaagccacttattattaatgatgggagagctggaaggccgtatttccggtagtgtgcattacgataatgtcgcgccatgttatttaggtggtttacaacttattttggaacaaaacgacattatttgtcagcctgtgccagcttttgacgattggtattgggtgatggcttatccggggatcaaagtctcaacggcacaagcaagggctatcctccctaaacaatacgataaagctgatattattaatcatggtcgttatttatctggatttattcatgcttgtcatacacaacaaccaaaacttgccgcaagcttaatgaaagatgtgattgcagagccctatcgaacacagttgctccctggttttgataaagcgagagaggctgcattacaaaaaggcgcgcttgcatgcggtatttcaggctcagggccaacgctgttttctattactgattcattggctattgcccaagatgtggcgcaatggttacaacaacattatgtacaaaacgatgaaggctttgtacacatctgccgtttagatactcgtggcgcaagagagatagggtaa

SEQ ID NO: 1916 - DNA, 858 bp, Proteus mirabilis
cttggtatatggggatcatgtctgttggcgctattttcaattacctcaatattgcttaagagaataataacgatgataaaagcggtagatttaaatagtgatttaggtgaaagctttggtcaatggcgtatgggcaatgatgctgcagtgcttgaaattgtcagcagtgccaatattgcttgtggttttcatgccggttcaccagaaggcattttaaaaacattaaaagcagcgaaacagcatcaagtcgcgataggtgctcatgttgcttatcctgacttagtgggttttgggcgacgcaatatggatattgccagtgatgaattaaccgctgatgtcatttatcaaattggcgctttgcaaggtttagcaaaagctgtcggtatgaaggtgacttatgttaaacctcatggtgcgctttataacaccattgctcatgataaacgccaagcattagcggttattgaagctattttatctattgatccacaacttatattagtggctttagcgggatcaccgttgatcacacttgcgaaagagaaagggttacgtgttgttgccgaagcttttgctgatagagcttatcatgctgatggcacacttgtttcgcgcaaacaagagggggctgtattacacgatcctcaattggtggctcagcgtatgttaaagctagtacaaaaagggggcgttgaatcgatagagggtacttttactgctatacaggcggattctatttgtgttcatggtgatagtcctgatgcggttaatctcgcaaaaagtgtcaaagagatcttaataacacacggtattgcgataaaacctttcacatctgcaataggaataaaggaggcgtaa

SEQ ID NO: 1917 - DNA, 246 bp, Proteus mirabilis
atagaaatatgtttagatgcaaacgttcaacgatacgattacgatgaagaaagtaactggataaaaaatagcgggattgcaatgcagaaattgggtggggccttgccagcgacatcccggcacacacgacacctgccatggctgcttccttccggacctgaccgagttaacaagttagtgttgcgggagaaccaacaagaccccatagattgtcttattgctaagacgatatgcattatcttttaa

SEQ ID NO: 1918 - DNA, 1371 bp, Proteus mirabilis
aataggatatgtgagaagagagcgcgtatctctcttctcggaaatttaacttgtacagaggaaaaccgtatgtccaaaatcgttaaagtacttggtcgtgaaattatcgattctcgtggcaacccaacagttgaagctgaagttcacttagaaggtggttttgttggtatggcggcggctccatcaggcgcatcaacaggttctcgtgaagctttagaattacgtgatggcgataagtcacgtttcttaggtaaaggtgttctgaaagcggttgaagctgttaatggaccaatcgctaaagctcttttgggtcaagatgctaaagaccaagctaatatcgataaaatcatgatcgatttagatggtactgaaaacaaatcaaactttggtgcaaacgcaatcctagctgtttctttagcaaacgcaaaagcagctgctgcagcgaaaggtatgcctttgtatgagcatatttctgatctgaacggtactcacggtcaatactcaatgcctttaccaatgatgaatatcatcaatggtggtgagcatgctgataacaacgttgatatccaagagtttatgatccaacctgttggcgcgcctactctgaaagaagcggttcgtatgggttctgaaatcttccatcacttagcaaaagtgctgaaagcaaaaggcatgaacaccgcggtgggtgatgaaggtggttatgcgccaaacttagaatctaatgcggctgcattagcggctatcaaagaagcagtagaagctgcgggttacgttttaggtaaagatgttactctggctatggactgtgctgcatctgaattctataacaatgagactggtaactacgaactgaaaggcgaaggtaaaactttcacttcacaagaattcactcattacttagaagagctgactaaacagtatccaatcgtttctatcgaagatggcttaaacgaatctgactgggatggtttcgcataccaaactaaagtacttggtgacaaaatccaactggttggtgacgacctgtttgtaactaatactaagatcctaaaagaaggtatcgataaaggtattgctaactctatcctgatcaaattcaaccaaatcggttcactgacagaaacgttagctgctatcaaaatggcgaaagacgcaggttatactgctatcatctctcaccgctctggtgaaacagaagatgcaactatcgctgatttagcagtaggtacagcagcaggtcaaatcaaaacaggttctatgagccgttctgaccgtgttgctaaatataaccagctgatccgtatcgaagaagcattaggtagcaaagcacctttcaatggtctgaaagaagttaaaggccaagcataa

SEQ ID NO: 1919 - DNA, 891 bp, Proteus mirabilis
cggataaaatgccaagcacaatgtgtcttggcatttttttacgaaattttgttaactcgacataacgatcacttttatatacaaggccagataatgtcagaaaaccgtgaaattttacgtttattagccattatggcgcaattacgtgatcctcaaacaggctgtgagtgggatagggtacaaacctttgacaccatagccccctatacattagaagaaacctatgaagtactggatgctattgcccgcaaagattttagcgcacttaaagaggagttaggggacttactctatcaggtcgttttttatgccagaatggcgcaagaacagcaattatttgattttaatgatgtctgcgaagctatcagcaataaattagaacgtcgtcatccacatatttttgctacagaaaatgaaaataatttagcgactgaaaagcatcgttgggaaaaaatcaaggctcaagagcgtgaagcgaaagcacaatattcattacttgatgatattcctgctactttaccggcactgatgaaagcagagaaaatacaaaagcgctgtgcctccgttggctttgattggcacgagctttctcctgtattagataaagtgtatgaagaaatagatgaagtgatggcagaggtgaaaaaagcccctagagatgatcaacgtattgaggatgagttgggggatttgcttttttctgtggttaatttatcgcgccatttaaaacagaagccagagcaggcacttaatcgagcttgtcgtaaatttgagcaacggtttaggtttgttgaaaaaatgctcacagagcagggtataaacatagaaaatgcttcattagaagagatggagatcagttggcaaaaagcgaaggaaaaagaaattgagtga

SEQ ID NO: 1920 - DNA, 660 bp, Proteus mirabilis
cggaaaaaatgtatgttacaggtctatcttgttcgccacggtgaaactgagtggaacgtggcgagacgtatacaagggcaatctgatagcccactaacagcaatgggtgtgcgacaggcacaacaagttgctgaaagagtaaaatcagcaggtattacccacataatttctagtgatcttggccggacttgtcagacggcagagattattgcacaagcttgtcgctgtgacgtaatcacggatccccgtttgcgtgaacttgatatgggcgttcttgaacagcgagagatcgccacattaaatacacaagaagaagcttggcgcaagagtttaattgatggtacacctgatggacgaattccccaaggagaatccatggtggaattagctaatcgtatgcaggctgctttaaacagttgcttggcgttaccagagcatagccgtcctttactggtgagtcacggtattgcattaggttgcctgctaagtactgtgttaggcctacctgcttacgctgaacgacgtttaagactacgtaactgttcaatttcacgagtagactatcaaaacagtccttggctcgctaatggatgggtaatcgaaacagcaggggatgtgagtcatcttactgatatcgctcttgatgaagtacagcgttaa

SEQ ID NO: 1921 - DNA, 1242 bp, Proteus mirabilis
tgggagcgatgtaatgagtcatccaaatacttctccttcaggcgcaagccacggcagcatgaagtcctatctgattggctttattctgtccgttatcctcaccgtgatcccattttggatggtgatggaaggaacagctacaacctcaactatcttatggacagtcgttggtatggccgtcgtacagattgttgttcatttagtctgtttcttacatatgaacacgtcctcagaagagcgctggaacgttatcgcattcctattcaccttgttgattatcggcattgttgtgattggctcactgtggattatgtacaacctgaacatcaatatgatgatggattaagagttgtcgctatgattaagcaatacctacaagtcaccaaaccaggaattattttcggaaatttaatttctgtgataggtggtttccttctcgcctcaaaaggcgagattgactaccccctatttttcgcgactctacttggggtgtctctggtcgttgcttctggttgtgtttttaacaactatattgaccgtgatattgaccgtatcatggaaagaacgaagaatcgtccattagttcaaggattaatcgacccgcaaattagccttatttatgcctcagtattaggtattgcaggtgttgtgctgctctatgtagcagccaacccacttgcaatgtttatcgctgtattcggctttattatttatgttggggtatatagcctctatatgaaacgtaaatctgtttatggcacactgatcggtagtttatcaggctctgcaccaccagtaatcggctactgtgctgttagcggtgaatttgatgcgggtgcagcaattttattacttatctttagtttgtggcaaatgcctcactcttatgccattgcgattttccgttttaaagactaccaagcagccaatatccccgtattacctgttattaaagggatctcagtcgctaagcgccatattattctctatattctggcctttatggttgcaacgctgatgctaactttagtgggatatgcagggtataaatacctgattgttgcctctgcagtcagtatctggtggttgggcatggcattatctggttataaagcaaccaatgataaagtgtgggcaagaaaattatttatattttctatcattgccattacatcattaagtgtaatgatgtctgttgatcccaccagttcaacagaaacggttctcgcttatctgagataa

SEQ ID NO: 1922 - DNA, 2142 bp, Proteus mirabilis
ggcgagagatgctctcgctcttttttttacataataataatgagctttactgtcgggggatttatgtctcacacactcgctttgtctgaaaaaaagaggtgggatcccatatttttatggatcctgattgcatggatggcatttatattaatgccttcatggagccttgattatggtctatttgattctaccgcagatgaattacttacctcttatggctggagtaacttaaatatcagtctgctctggtttttacttcccagcatactattaattcgtcctttacatcctgtagggcgagaaaatcgtattcgtcactattttgatgcaagttttgcctttttctgcgcctttatcactattgttaccgcaacgatggaaggtcgtggtctgggttattcggttatcgtgctatttatttcattaggaatgatagccaagcatgctttaacacgcttagagtggttagggggtgatagctttgtgattggctcattaatcacagttgtcgccttaatcggtgtttttattatctttccaagtgtcgctatctttattccgatgtttcaagatagtgctggcaattttgccccctttgaatttattgccattctcagccaagcccatattgttcaggtgatgatcaattcaatcttactgtctatcgcagttggtattggctgtactttttttggtttgatcctcgccatttatacatcacgtattgcagtaagatcagcgattattggtcgagtattttctattttacctattgtcactcccccttttgttgtgggtttaggtgtgaccttgatgatgggacgttcaggttatatcactgaatttttggcaacttatgcaggtttagaaaataccaactggttatatggctttacgggaatttggcttgcacaagtacttgcctttacccctatgtcttttatgatcttagatggtgcaattaaaacaatccatccgtcattagaagaggcttcttatacccttagagctaatcgctaccaaacattctttcatgtttttatgccgttactaaaaccagcattagccaatgcctttttgatcgttatagtgcaatcactggctgattttagtaacccattggtgctaggtggcaactttgacgtgattgccactcaaatttatttctatatcaccggctctcaacttgattaccaagcagcaagtacgttaggtgcttcactgttggtattctcattattagtgttctgcattcaatatatgtggattggcaaacgctcatatgtcacggtgtcaggtaaatcctatcgtggtgatgttcaaccattacccacctccttagtaacctttgtcactagtgtgctgggtatttgggttatctttaatatcttactctatggcagcattttctacggcagttttacggttaactggggagtggattacaccttaacctttgataactttattaaattatttggtcaagggatgagcgatggcgcatggccatcattacttgataccttactttatgcgggtatcgcagcacctattaccgctattttagggcttttgatcgcctatattgtcgtgcgccaagattttaaaggtaaaaagagtatcgaatttacgaccatgctctgttttgccgttcccggtactgttgcgggtgtctcttatatcttggcatttaatgattcgccgttttatttaacaggaacggcagccattgtgattatctcaatgaccatgcgtaacgtgccggtgggaatacgagcgggtattgcaggattggggcaaatcgataaatcgttggatgaggcgtcattaagtttaagagcaaattcaatgcgaactattttgtatgtgctattgcctttattacgccccgcgattttatccgctttaatttatagttttgtccgcgcaataaccaccgtcagtgcgattgtattcttagtcacccctgaaactcgcgttgctaccgcttatattttaaatcgtgttgaagatggtgaatacggcgtcgcaattgcctatggctcgattttaatcatcgtgatgttggctattattttcttatttgactatttgattggcgaagcccgtgtttcacgctctaaagccaaaaatgcacagtaa

SEQ ID NO: 1923 - DNA, 375 bp, Proteus mirabilis
ataaatggatgcatatccgaggtattcatatcatctttttcataccatgtggcggttggtaacacgatatcggagaacagacaggtacttgacatacgaaagtctaaagtcaccactaaatcgaccttaccctcaccgcctttatcttgccattccacttcttgtggcttaacttggccttgttcacctaaatctttaccttgtaatccattttccgtccctaatagatatttcagtaaatattcatgccctttacctgcagatcccaataaattagaacgccagataaataagttacgagggaagttttgcggattatccggttgctctgatgcaaaacggatctcacctgatttcagagcattaatggtataa

SEQ ID NO: 1924 - DNA, 963 bp, Proteus mirabilis
cgaagtctgtgtgatgagatcacagaagttgaaaggaaaatcactatgcgtgtgtcacatctcaattttaatcatctttattatttttggcatgtgtgtaaagaaggctctgttgtaggggctgcggaagcgctgtatctgacacctcagacaattacagggcaaattaaagcattagaagaaagattagggggaaaattattcaagcgtcaagggcgcggattagttccctctgaattaggtcagcttatttttcgctatgccgataaaatgtttatgctgagccaagagatgctagatattgtcaactatagtcgagaatctaacctgttatttgatgttggggttgccgatgcgttatccaaacaacttgttagtcgtgtattagaaacggcggttattgatcatgaacaaatacatttacgctgttttgaatcgactcacgaattgttgttagagcaattaagtcagcataagttagatatgattttatctgattgtcccgtagattcctcacaacaagaggggctgttctctgttaaattgggtgagtgtagtgtcagttttttctgcagtcagccaataccagaaaagccattcccagaatgtttagaagatagaaaattgcttatccctggtcgacgctctatgttaggtcgtcatttgttaacttggatacgcaataaaaatcttcaagtagaaattttaggtgaatttgatgatgccgcattaatgaaagcatttggtttaaatcataatgctatctttgttgcaccttctatttataccaatgagacatttgtccaaagtaatattgaggaaataggcacattagactcggtaaaagaagagtattacgttatttttgctgaacgtatgatccagcatccggcagtacaacgtgtgtgtaataccgatttttcagctttgttcagtggtgaaaagaaagccaataacgaatga

SEQ ID NO: 1925 - DNA, 459 bp, Proteus mirabilis
agcagccagtgcgcaagactttgtcattgccatgctgaaaccacgttaaggaggaaacaagacatgacaacaaaacgtaagccttatgttcgtggtatgcagccaaactggtggacgaaactcggtttctatcgtttctacatcacccgtgaaggaacttgtctaccacaactttggttcagtctggttgtactgttcggtgtatttgcactgaaaaatggaccagaaagttgggcgggattcgttggattcctaagtaacccaatagtgatgctgattaatattgtgacccttatcgcaacggtattccatacggccacttggtttaagcttgcaccgaaagccgttaatatcgtcgttaaagatgaaaaattaccacaagagcctatcgttcgtggtttatggggtctaaccatcgtcgtgactgtcgttattctggcagtggcgctaattgtttaa

SEQ ID NO: 1926 - DNA, 519 bp, Proteus mirabilis
ctgacagggtgttttttgttcactgaacaggtacactgtttaggagttttgtcaacagtaggaataactatgcattgtccattttgcacagccgtagataccaaagtaattgattcgagacttgttggtgatggctcacaagtgcgccgtcgtcgtcaatgccttgtttgccatgagcgctttactacctttgaagtcgcagagcttgtgatgcctcgtgttgtgaaaagtgatgaaatccgtgagccttttgatgaagaaaagctacgtagaggaatgctcaaagcattagaaaaacgccctgtgagttctgatgatgttgaagctgctattaatcatatcaaatcacaattaagggcaacgggcgaaagagagataccttccaaacagatcggtaattttgttatggaacaactaaagaaactggataaagttgcttatatccgttttgcttcggtttatcgcagttttgaagatgtgcgcgattttggcgaagaaattgcaaaattacaagattaa

SEQ ID NO: 1927 - DNA, 201 bp, Proteus mirabilis
attgttcttcgtgttcatggctatgttcgtgatcatggctatgttcatgttcatggctatgagtatgttcatgagaatgtgcatgatgatcgtcatgcccatgatgatgctcatggaacacttgggcttcattttgctgtgcatcatgataaaaatggagatgaacatcgccactattatggtaatggtgatgatgaataa

SEQ ID NO: 1928 - DNA, 189 bp, Proteus mirabilis
tttgacttgctatattcttatttaggtaaatttttaagaattaatattttgaataacaatttattcgcaagaaaaaaggtgaaaaacaataaaaaaaaagcccataatactgaacctgaaaacaacaatgcggtcttaaagacctctacaccccaaaaatttgataatagctcaacatgcaaaaattaa

SEQ ID NO: 1929 - DNA, 324 bp, Proteus mirabilis
tcgtttattttaggagcagaaatggaattaacaccaagagaaaaagataaattactgctttttactgcaggccttgttgcagaaagacgtttagctaagggattaaaacttaattaccctgaagctgtcgccttgattagttgcgccattatggaaggcgcacgagaggggaaaacagttgctcaattaatgagtgaaggacgtactgttttaaccgcagagcaagtaatggaaggggtgccagagatgataaaagatgttcaagtagagtgcactttccccgatggcaccaaattggtttcaattcactcacctattgtgtag

SEQ ID NO: 1930 - DNA, 369 bp, Proteus mirabilis
agaaaaaatcgcaggccaagtcgcctatcgtctctatattcgcaatttatctgcttaatttgttatggagctgctatgttaatctttttaggtcgatttttaatgatcggtgtgtggggatttctttgtttaaatcttatttccccattccctaaacctttaaagtactttatggatatcgcattaatctttatggtgattatgcacggcttacaaattgccatgtataaagcaggccaacccgaagataaaaaaccttctggcttactccaatttaagatcttcttttttggtatttttgagctattgagaatacaaaaagagttgcgcaaagagtatctagaaaaacaaaaaaataaaaaccaataa

SEQ ID NO: 1931 - DNA, 915 bp, Proteus mirabilis
tccgaaccccgacaggaatatattatgaaactaaaaaaaatagcaacgcttctctcagtggttgctctaagcgctaccataagtgccaatgcattagcaaaagagtctatcgccctcgttatttcaacgctcaataatcctttctttgtcaccatgaaagacagtgcacaaaaagaggcggataaattaggttatgacttagtcgtacttgattcaatggataatccagccaaagaattggcaaatgtgcaggacttaaccgtaaaaggcacccgtttaatgctcattaatccaacggattctgatgctgtaggtaatgccgtgttaatggcaaataaagctaaaattcctgtagtaaccctagatagagtagccaataaaggtgaggttgttagccatgttgcttctgataaccgcctaggaggaaaaatggcgggagattatattgcggaaaaagtgggtaatgatgccaaagtgatccaactagaagggatcgccggaacctccgcttctcgtgagcgtggagaaggctttaaacaagctgttgatgctcacaaacttaatatattagcaagccaacctgctgactttgaccgtactaaaggccttaatgttatgcaaaatctattaaccgctaatccttcagtgcaagcggtatttgctcaaaacgatgaaatggcattaggggcattgcgtgcattacaaactgcaggtcgtaccgatgtcttagttgttggcttcgatggcacaaatgatggcattaaagcggttaaccgaggtgttttaggtgcgactattgcacaacgccccgatcaaattggtattattggtattcaaaccgctgataaaattctgaaaggggaaaaagtggatcccactattcctgttgagcttgaattagtcactcaaaaataa

SEQ ID NO: 1932 - DNA, 588 bp, Proteus mirabilis
gtccaggcccggtacgtaaaaggacacgtcctcgtaaacgtcctcgtcaccctaatgcaaaaaataatgcaccaagacaagagaacaaacatgagtaagcaacaacagcgtgtgtatattattctgggcagtaatttaaactcaccagaacagcaagtaaaatcggcgataaaagcgattagtgaaatccctaatactacactgattgcccaatcaccttggtatcgcacacgccctatgggacctcaagatcaacccgattatctcaatatggctgtcgccgttgatactactttagccccagaagcgttgctcgaccatacacaagcaattgaacttgcccatggtcgtgaaagaaaagcaggtaatcgttggggacctcgtacccttgatttagatatcatgttatttggtgatcaagttatacagaccgaacgtttaactgtgcctcattatggacttaaggtgcgtgaatttatgctttatccattggcggatttagcacctgaactttgtttccctgatgacggagaacgattagcagacagattagcgctcgtacctaaaaatggtatggaaaagtggtga

SEQ ID NO: 1933 - DNA, 1302 bp, Proteus mirabilis
caaatgaaacgatttattagttatttttttacgttagcacttacatactttttattacctcagttagcgattggagccaccacaatagacatagataaagcggacaacagttttatgctgatctgtagtgcattggtgttttttatgactattcccggtatcgcactcttttatggcgggttactacgcagtaagaatgtattatcactaatgacgcaagtgatgttgattttcagtgtagtgattatcctttggattatgtttggctatagtttggcgtttactgctggaaataagatttggggtgggtggtcacttacttttctcaataatatttcagtcgattctgttgctggtgaaattaatcaatatgtgcatgttgtatttcaaggctcttttgcggtgatcaccgtggccctgattgttggcgcattaggtgaacgtattcgtttttcagcactgcttatctttactgttatttggtttactttttcatatattcccattgcccatatggtatggggagaaggtggttggcttatcgatgatggagcattagattttgcgggagggacggttgtccatattaatgccgctgtagcagcgcttgttggtgcttacttactaggtaaacgaggtgattatcaacatactgcgattaaaccacataatttacctatggtctttactggtacagcggtactttatattggttggtttggttttaatgcaggctctgcagggagcgctaatggtattgctgcattggcgtttttaaatacagttgtagctaccgcaggtgcagttcttgcgtggacatttgctgaatggctagtgagaaggaaaccttctatgttaggtagttgttcaggatgtattgcgggattagttgctattaccccagccgcgggaaccgtaggccctattggtgctttggttattggtattattgctggcatcatcgggctttggggggttgtggttcttaaacgttggttaaaagcagatgatgtctgtgatgtttttggtattcatggtacttgtggtattgcgggctgtttattaacgggcatatttacggcttcctttttagggggcattggttatagcgagcatatgacgttaggtaagcaagtgctaactcaattatttagtgttgtgattacgcttatttggtcaagtgttgtggcttacattgcctttaaaattgccgataagctagtgggattgcgtgtctcacaagaagaagagcatgatggattagatataaccactcatggagaaagagcgtacgagcagtaa

SEQ ID NO: 1934 - DNA, 216 bp, Proteus mirabilis
ctagtgccgcttcacaaagttgtaatgatcttgctgatttctttgctgtgtgaatttaaagccgtaacgctacctcgcattagccaagagatcaatctttctttgttacaacctgttaactttatctcaaaaagtcgtgagacaaccttatcgctggttgttattattcctaataagtcaagaaaagcgataggtaaatcaagtgatttagcctag

SEQ ID NO: 1935 - DNA, 1260 bp, Proteus mirabilis
cagcgcttgcgggcattacttatttggttaaccgtaatagtaaaaaacaagagcaggaacaccataaggaggataacgatgtcgagtcatgatcctcgtccacttggcggtaagttatttactttagctgttagagtgtttttaccgcttgctgtgcttggttttattcttattggtaagcgtttggtattgggtcttggggatgtttccgatctaaatggcggttatccttggggtatttggatagcctttgacttacttatcggaacaggctttgcgtgtggtggttgggcactggcatgggctgtttatgtttgtaataaaggtgaatttcatcccttagtacgtcctgcattattagcgagcttgttcggctattcgttaggtggattatccatagcaatcgatattggtcgttactggaacatgcctcacttctttatgcctcaatactttaacgttaactccgtattgtttgaaacagcaacttgtatgaccatctacattatggtgatggcattagagtttttacctgcactactggaacgtttaggttggaaagtttcgttaagacgccttaataaagcgatgttctttattattggtctaggcgccttattgccaaccatgcaccaatcctccatgggatcattaatgatttcggcaggttggaaggtgcatcctctgtggcaatcttatgaaatgctaccgctgttctctttattaaccgcctttatcctcggtttcactattgttatttttgaaggttctttattaaaagcgagccgtactattaatgacgatgaaacaccgctatttaccaagttaactaaaatcatagaagtacttctgatcaccttcttggtattacgttggggtgaagtgatctggaacggtaagctgagttatatcgctaaaggggatatgttctcttggttattccttgcagaaagtgccttgttgtttattcctctggtattgatgcacctgaaaaataatcgtcgtagcccaagaatgttatttgtctgcgcattatttatgttagtgggtgcggcaatgtggcgtatgaactattcattagtcgcttataacccaggcaacggctatcactatttcccaacagcaagtgagttgttgatttctattggcttcgttgcattcgaagttactgcttacattcttattatccgtttactgccggtactaccagcacaaacagagtcaaatatacaattaaaaaaggctgaggttaaatcatga

SEQ ID NO: 1936 - DNA, 189 bp, Proteus mirabilis
ggtttactgcgccttgtgaatatttttttgatcgaccacttaatagcagtgaggtttctggttttttttgcgtcatcctttatacctacttgttatgtaatgatgtgtttacctcaagttaatgcattttttactgaagtacaaaagaggatcgcgacagttgataaaatttcacgttatatgaaataa

SEQ ID NO: 1937 - DNA, 1218 bp, Proteus mirabilis
aatagtatgcgtgttaccggcagtgtcatttttattgtccagtttttatttatcgtacagctactctcaatgggagccatggaaatgagtggccctttttggccgcttcatctcgaaagtatggcgtcgacagagctactgagtatcgtgggaaccggcgtgtatatcgcacctatgttgggcgttatgctaaccagtaccttttggggacgaataggcgataaaactggcaataaagtgatgatgatccgtgcactgatggggctggcattaacgcaattggggctcgcttttgccaatgatgtctgggtaatactgctactacgctttttacagggaacttgtgcggggtatattgcacctgctcaagcttatggtattgccatgatccccatagcacaacgtactcggcttttggcatggttacaagtatctaccaatgcaggatcgttagctggagccattgctggtggggccatcctcgatttactgagtttcttttggataaatttcggggcatttatcatttgtacgttatgtgcactactggtttttttcatactaccgaatgatttaccgcgccacgcttcatccaattgcgtcacttcctcaacaaataaagcaaaagcaatatcatcaattaaccacagcgccattgttggcttacttaccgtactgggtttgttattagtgagccgcatgatcacacaaacccctttttctctttatgtcagtagcgtatttaatgcccctaactggttaacaggggtcgcttacggattgcaggctacaggtgtgattgtctcagcctccctctgggcaagatggtttgaagcacacaacatatctcacgcactctatcgaatggtggggatcattgcgggatgttttattgtgaccttactgctagcagcagtaagagaaataagctggtttatcggactttattttttgtggggcattcttcttggggcaacaacgccagtattaaccgcattaatatctcgctcaaccgctgaaagtaaacagggttatattttgggactggtgcaaagtattagccagtttgcctctatggttggcattgcactggggggcggaatacttgtttggcctgggttgaccacgttgtttttgtgtgtggcggtgatgtattgcattactttaattattacgctgaaaatgagttactcttcaaaaaacactaaccaaaaatag

SEQ ID NO: 1938 - DNA, 897 bp, Proteus mirabilis
tgggtagtgcggtatatattcgtctatttcctgatttatttgatcaattttgccaagttggcaggagtgggtatgcctgacttttctgagaagggttggcttgctgacatcgctttacgatatgagttaaagcgaggaaagacatgtcttactgaaaaacgtcatctcggccccttaatggttcagcgacctttttatccagagcaaggtgttgcacatacctatttgttgcatcctcctggtggggtggtcggtggtgatacgttatccattaatattaatgtgcaaccttacgcacatgccctattaacaacgccgggggcgacaaaattttatcgtagtgcaggaggcactgcatcgcaaacgcagacattgacggttgcacaagagggctttttagagtggttaccccaagagaatatcttttttcctgatgctcaagtgtgtttaaccacacatattcatttagcctcatcagcgaaatttatcggctgggaaatgcagtgttttggacgcccagttttaaatgagtggtttgaaactggcaaggtaaaagggcgcttaaatttttatgttgatgagagattaattttaacagagtcaatgcgggttgaaggcttacaaaaacaagctgccgcaatgcgtgaatttcctatgtttggctcgctttatatttatcctgcaaccgatgcattaaaagagattattcaacaccatttagagaaggtaaatcccctagttgaatatggtttaacggatgttgatggcattttagttttacgtgtattagggacgcaaaccgagccgatgatggcgtgttttgcgcaagtatggcaaatcgtcagacagcactggctaggttattgccctgagccaccgcggatctgggcgacataa

SEQ ID NO: 1939 - DNA, 390 bp, Proteus mirabilis
tattatatttttatattatataaaaatatatattgttatagggagagtaaaatgagcaagtaccaagaaatagtaacagacatctcggggaatatgggggcattatctaaaaatattcctgaagttatgaagtcatttatgagtaccaccaaagcaagctctaaagatggtgtgctcgatgctaaaaccaaagagctgattgctattgccattgctgttgctaatcgttgcgatggttgtataggttttcatactaaaactctagttgaattagggacgacagagcaggagcttgcagaagcattgggcgtcgcgatttatatgggagggggcccttctgtgatgtatgcgtccaataccatgggtgcttttaaagaatttagtcaatag

SEQ ID NO: 1940 - DNA, 402 bp, Proteus mirabilis
gaatatcggcgctatcttaatttattcttaaacataaggaagaagttcatgagcaaagtattagtgattgcaaatggtgcagcatacggtaatgaatcattatttaacgcactgcgtttatctattactttaaaagagcaacatccagaaacgcaattaaatatctttttaatgtctgatgcggtaaccggtgcactggctcatcagcaacccaaagaaggttacaacctccaacaaatgttagaaattttaacggcacaaaacgtccctgttaagttatgcaaaacctgtacagatactcgtggtatcagtgaattacctttagtggatggtgctgaacttgggacattggtggacttagcacaatggactctcgacgcggataagattttgactttctga

SEQ ID NO: 1941 - DNA, 1329 bp, Proteus mirabilis
tcaaatatttttcgcctgtattttgtgacaaagaccaaatggacgtgcatcaggaatacacaatgtctgccacggcgaatattagtttcatttttcatagaccaaagtataataggtaatatgaaacgtctacaagcctttaaattccagttaagacccaatggtcagcaagagcgtgagatgaggcgctttgcaggggcttgtcgttttgttttcaatcgggcattagcacgtcagaatgaaaatcacgaagcagggaataaatacattccctatacaaaaatggcttcatggctcattgagtggaaatctgacacagagacacaatggttgaaggaagccccatcacaaccgttacaacagtcacttaaagatttggaacgggcttacaagaattttttccagcagcgtaccgcttttcctcgattcaagaaacgcggtaaaaatgacgcttttcgctacccgcagggcgtgaagctggatcaatccaatagtcgtatatcattgccaaagttgggatggatgcgctaccgcaacagtcgtgaagtcgtcggagaagtgagaaacgtcacggtcagtcagtcatgcggtaaatggtacgtcagcattcagactgagtatgaagcgacagaaccacaacatgaatcaacctcaatagtagggcttgatgcaggcgttacaaaactggccacgctttcagacggtacggtatacccgcccgtcagcagttttaaagtaaaccagcgaaagctggcaaggcttcaacggaaattaagccgtaaaatcaaattcagtgccaactggcaaaaacaaaagcgcaaaattcaacgtctgcattctcatattgccaatatcaggaaagactcccttcacaaagtcaccagcgaaatcagcaaaaaccacgcaatgattgtcattgaggacttaaaggtcagtaacatgtctaaatcggcaaaaggtacgacagaacggcctggacggaacgtaaaagctaaatctggtttaaaccgctcaatactggagcaaggctggtatgaaatgcgccgtcagtttgagtacaagcagctctggcgaggtggtcaggtactggcaataccaccggcctacaccagtcagaagtgcgcttgctgtggtcatacagcaaaggaaaaccgccagtcacaaagtcaattcgagtgccttgaatgtggatatacagcgaatgctgatatcaacggggcacgtaacattttagcggcaggacatgccgtgcttgcctgtggagggagggtgcagtcagaccgcccgtcgaagcaggaacccgccgaggtgattcagacatcagtctga

SEQ ID NO: 1942 - DNA, 2130 bp, Proteus mirabilis
cccctctttagattaggaagcaatattatgattaacggctggactggcaatatactaagaattaatttaactaccggtgccatctctcgcgaaagctcaagccaatacaaatccttaattggtggtatgggctttggctacaaaattatgtatgaagaagttgcacccggtgtaaaaccttttgatgaagaaaacaaagtggtatttgcggtaggcccgctaacaggatcaggcgcaccctgtagctctcgcgtcaatatcacctctctttcaacctttactcgcggtaatttagtggttgatgcccatatgggaggcttttttgccgcatggatgaaatttgccggctatgatgcgttgatcattgaaggtcaggcagataaccccgtgtggatccatattgatgatgaccaagtttccattgaagatgcctcttttttatggggaaaaggaactcgtcaaacaacagaagaactttgtgctcaaacaagccctgaagcgtgtgttgctgctattggccctgcaggtgaaaaccttgtccctctttcaggacttatcaatagtcgtaaccacagtggtggtgctggaattggtgccgtacttggtgctaaaaaattaaaagcgattgtggttgaaggaagccgtggcgttaatgttgccgatcgtaaagcgttaaaagagcttaacgactatatgatgacacaactcattggcgcaaataataatcacgttgtaccaagtaccccgcaatcttgggcagagtattcacatccgggttcacgctggactgcacgtaaagggctttattggggagcggctgaaggtggccccattgaaacaggggagatcccaccgggcaatgccaatactgtcggctttagaaccatgaaatcaaccttcgatcttggcccagaagcagaacaatacacggtaaaaatggggggatgccactcatgccctattcgctgtatgtcacaacttaatgtcccgcaagcaaaaaaatttggcgtacctcaaacaggcggaaacacttgtgtcgccaactttgttcataccaccattttccctaatggcccgaaagatattgagaaaaaaggcgatgccaatgttgttggtaatcttgtcggcctcaatatttttgatgatatgggcttatggtgcaactacggtcagcttcatcgtgactttacttattgctatacccacggggtttttaaacgcgttctttctgaagaagagtataacgatattccttgggataaacttgaagaaggtgatcccgcatttatcaaagatttctattaccgcttagcccatcgtaaaggtgaatttagtcaccttgctgatggctcttatttaattgcacaacgctggaatttaggtgaggaatattggggtaataagaaaaataaactttggtcaccgatgggtttccctattcaccatgcaaatgaagcttctgctcaagtaggctccatcgtcaactgtatgtttaaccgcgatgcgatgacacatactcatatcaactatatcggtagtggtttaccgctaaaattacaaaaagagattgcaggtgaactatttggctctggtgatgcttttgatgaaaccaaaaactacacgccgattaataaagcaaaaattgcctataccaaatggaccattttgcgtagttgcctacatgatgccgtgacattatgtaactgggtatggccaatgaccgtatcacctcataaaagccgcaactatcgtggcgatttagatatggaagcaaaatttttcactgccattaccggtgaaccaaccacttctcaagatcttgatttagcctcagaacgcatcttcactttacatcgtgcttacacggttaagttaatgaacacaatggatatgcgtaatgagcatgaccaaatctgttcatgggtatttgataaagatcctgatattcctgtctttacggaagggacagacaaaatggatagagaagatatgcaactctctctcaccctattttatgaagaaatgggctgggatccacaattaggctgtccaacaaaagcaactttagtacgccttggattacaagatgttgctgacgatttagcatcacgtggcttattacccaattaa

SEQ ID NO: 1943 - DNA, 1503 bp, Proteus mirabilis
ataataattaggggcattaaagatatggataaacccgctaaagtcggtttattacaacagcctaaaccattctttatgattttctttgtggaattatgggaacgttttggttactacggcgtacaaggtattcttgccgtttattttgttagtaaactcggattctctcaagaacaagcttttattacttttggtgcattctccgcattagtttatgggcttatttctattggtggttatgttggtgaccatctattaggcaccaaacgaaccattgttttaggggctatcgtattggctatcggttattttatgaccggcatgtcaattatgtatcctaatttaatcttttatgctttagccactatcgcagtaggtaacggtttatttaaagcaaacccagcaagcctattagctaaatgctataaacctaaagatccccgtcttgatggtgcatttacactattttatatgtcgattaatgttggttcattaatctccttatctattgcccccgttcttgccgatcgctatggctatgcgctgacttataatatttgtggtatcggcttaataatggccatattggtctattttttctgccgtaaaatggtcgtgaatattggttctgaaccagatcacctgccaatgaatttcaacaaactgctattagttattgcaggctctgtcgctatggtctttatttgtgcatggttgttgcacaatgtgatgattgctaacatcgttttaatcagcttgtctattgttgtggttatcatttattttcgtgaagcctttaaacaaaaagacagagtggcacgtaataaaatgtatgttgcatttgttctgatgttagaagctgttattttctatattctctacgctcagatgccaacctcacttaacttttttgctatccataatgttcaccataccctgttaggctttgatattaacccggtgagtttccaagcattaaatccattttggatcattattgccagccctatcttagcaatggcttatagccattttggcgcgaaaggcaaagatttatccatgccggcaaaatttaccacaggtatgcttttatgctcattaggcttcctaaccgctgccgcttcaggtatgtggtttgctgatgctcaaggcttaacatcaccttggtttgttgtactgatttatctcttccaaagtctaggggaattgatgatcagtgcattaggcttagcgatgattgccgctttcgtaccgcaatatatgatgggctttattttaggtatgtggttcttaacacaagcgacggcttacctgttaggaggccatgtagcaacctttaccgcgccacctgaaggtattaccgatccactacaaacactgcctatttatactgatgtgtttggcaaaatcggtatcgttaccttagtggttggtttgattatgtgggcaacagtacctttactaaaccgcatgatgaaagaagagagtaaaatgattaagtaa

SEQ ID NO: 1944 - DNA, 2619 bp, Proteus mirabilis
tttatggttagatcattcaaaaccgtttgtttagagaagcgagaaaagagaaaaaagcatgctattcggcctgttgctatattgatctatttaattgttactggggcatccagtctttcaaattcagctttagcgaatagcgatattgagtttaatgctgatattttagatcttaaagataaacaaaatatcgatttatctgatttctctcgagctggctatattatgccagggcgctacgaatttgttgttcgtataaataataatgaacttcccgatatctacaacattaattatgttgtacctgcagatgatcccaaaggaagtgaaccttgcttacctcctgaattagttcgtcaattaggactaaaaccagagtggcttgataaaattcgttttaacgataatcaaacttgccttgatacatcatctattcccggaatgacaataaatgccagtttaggtagtggtaatttattattaacgatacctcaagcttatttggagtattcagcaccaaactgggatccgccttctcgttgggatgacggtatttcagggatactttttgattataacgtcaatgccaatgtgactgatcctgctaaaggaaaacaacgtcagcaagtgacggggttaggtacgttaggggcgaacttaggtgcttggcgttttcgcgctgattggcaagcgagctaccaacatacgacagggatccctcaaagtacagaaaacagctggaaatggaatcaatactatctctatagagctatccctcaatgggaagcgcgctttgtcatgggagagacttactcgcgctccgatatttttgatagtttccgttttaccggggttcatctcgcaactgacgacaatatgttgccacctaatttacgtggatatgcgccagaagtcacaggtgtagcaaaaaccaatgccaaagtgacaattagccaacagggtcgagtgatctacgagacgcaagttgctccaggaccatttcgtattcaagatattaatgatgccgttagcggtaaattagatgtacgtgtcgaagagcaagatggctctgtacaagagtttcaaatggatacggcaagtattccttatttaactcgaccaggacgagtgcaatataaattctcggcaggtaaaccttctaatattgaccataataccgaaggccccgtttttggtatgggggaattttcatggggggtgagtaacggttggtcactttatgggggctcaattgttgcgggtgattataacgccttgtctgcgggtatcggccgtgacttaatggcttttggtgctctctcttttgatgctactcactcttgggcaaaaattcctcgtgatgataagcgttataacggtggctcttatcgattaagttattcaaaacgttttgaagctattaatagccaagtcacctttgctggttatcgcttttcagaacgcgactttatgaccatggatcagtatttagagcgtcgctatcgcgatggtaatgctgataataacaaagaactttataccattatgtttagtaagcaatttcctgactggggattgagtacttacttaaactatagtcaccaaacatattggaataagccaactaatgataattacaacttatcgttagcgaaaagcgcggatattggtcgttttaaaaatatcaattttagtctctccgctttccgtaataaatttaatggcaccaatgataatggcgtttatatgaatgtcagtatgccttggggtgatcgtgcgaccatcagttacaacactgtcattaataagagcggtaactctcataatgtcagctattacgatcgaattgatgacaatagcagttatcgtgttggcgctggggtaagtagcaatggtaaaccttcagccgatgcttattttatgcattatgctgatgcggccttagtcaccgccagtgcaagtcatatcaatggtgaatatacctctgccactttatcgctacaaggtggtgccacacttacgccgaaaggtggagcattacaccgcgttagtcgtacaggtagtactcgcttacttattgatacagacggtatcgctaatattcccgtgaagaattttggtgcgatttcccataccaatatgtttggtaaagcggtattgccagatattaatgattactaccgtagtagcgcgagtatcgatcttaatcgattacctgaaaatgtcgaagcattacgctcaattcagcaattaaccctaaccgaaggggcgattggttaccgtcgatttgatgttatcgaagggcaaaaagccatggcggttattcggttaaaagatggaaccttcccaccatttggcgccagtgtcacaacagaaaaagggcgtgagttaggcatcattaatgatggtggaaatgtttatctaaccggtattaataccggggatgtattgagtgttcgttggagtggtaaagagcagtgcaaagtacttattccaacattggtggagaatgtgcaaatttcatcactgttattgacctgtagtgatgatggcacagcaacctctactttcaatcaaagagaagtctccttacctaaaacgaagtttctatctcgttaa

SEQ ID NO: 1945 - DNA, 330 bp, Proteus mirabilis
tcagcccctagagtagcagggaagagattggcatctcccataaaacttgccataaactcagaggccggttggcgatataaagtttgtggtgaacctaattgcattattttgcctttattcatcactaacaccatatcggaaacggcaaaagcttcactttggtcatgggtaacatacagggaggtgatattaaactgttgttgtaattcacgaattttctccctcatgctacggcgcaagttagcatccagattacttaatggctcatcaaataacagcactttgggttttaagatcaaagcacgagctaatgccactcgttgttgctga

SEQ ID NO: 1946 - DNA, 210 bp, Proteus mirabilis
gtattttataggaaaagaggaataattatgtctcattatgaggaagtgattaagcaggttgatgaggccattgccagtgctagcatacaaacgatgaacgaattgctggtggaattaggtaaagataacacaatagcctttgctcagcgttatgaacagcaagagcgtctacgtactgctatttttcatcatggtgaaaaacagcgttaa

SEQ ID NO: 1947 - DNA, 708 bp, Proteus mirabilis
ctctcatatagtttttttgtgatgcgagttcgccgaatgggtacattaaaagagataattcacgcgctactgcaacatgattatatggtgctagctgatccaaatattttgtggattatttatattgttctttttgttattattatgctggaaaatggggttctacctgccgcatttctacccggcgatacattattaattctctgtggtgcattaattgccaaagatgttttacatttcttgccaaccattattgtgttaggtactgccgcgagtattggtagctggcttggatttctgcaaggccgctggctaagtgatactaaagtggtcaaacgttggatggctcaattacccgaacaatatcaccataaagccaatgatcttttccatcgtcgaggcctgtacgcactattaattggccgttttatcggttttgtacgtacattactaccaactttggccggtttatctgaattacaacaacgtcgcttccaactatttaactggattagtggcttcttatgggtcggtcttattgtctcattaggttatatactgaacctgatcccttttattcaaaaacatgaaacattggtgatgaatattcttatgacattaccagtattactattaactgccggtttaattggctctattgtgatgtatattcgtcatcgtaaaagtagcaataacagcgccaaataa

SEQ ID NO: 1948 - DNA, 684 bp, Proteus mirabilis
aatcagtatagtagccacgaaaagtggagtaatagcgaaggaatttttatgagttttagtcgtaatgaaatagatacaatgtcaggtactcgaaaaagaacctaccaattattggtgacaacggcattgcaactttttgaacaagggatgttacctaccgtatcagagcttgcagcacatgctggtgtttcaagggcaacggcgtatcgctattttcccactcaaagtgatttaattagtgctactgttgatgcaagtttagcaccgatcattgcatggcagcccactccagaagataatacacaacagcgtattactgcgttgctcaatcttgcttatccacaaatgtttaaacatgaaggggcgttgcgtggcgcattgcaggtttcattacagcagtgggctaaagagcggcaatcaagcgaatatacagaaaaacgatttattcgtggtcatcgtaaagagatcttacttaaagtcatcgaaccattaaaagcgcattatccgcaagaaatgtgggataaagtgataaaagctttctcacttatttatggttctgaagtttttttagtaatgaaagatatctggaaaatggatgatcagcaggtcattgatatgacccaatggatggctaaagctattttaaatcaggcaaagtcagattttccgatagataacgattaa

SEQ ID NO: 1949 - DNA, 270 bp, Proteus mirabilis
aataaaaatagtatcattaacttatttagtcagtattctgtcgacactcacgtcttctattacagatatctaagtttattacttttgtctctgttttctacctccatttataacgccactattatttgcctattaaataagagcaattcatatcaactggtagctttattttacctattacatcttgttattgagaatagtaactattatcgttatagttttaattcgtatttgcttgctataatatcgcttatacctagcgtggggtga

SEQ ID NO: 1950 - DNA, 1818 bp, Proteus mirabilis
agtgaaaatagacgcttctttaagaccaacaaaagatatttagtactaaaaatagacaaattaaatcaggaataccacatgccacaaataaaatataataacgagataacaagtatcataaaagagagacgaaaagtttttctctctattgggctatttaccgctttaattaatatattaatgttagtcccttctatttatatgttacaagtttacgatcgagtattaccatcaggtaatgaaatgacactattgatgctaacaatcattatgttagctctttttatctttatgggaggattagaatatttaagaagcattattgttatacgtatgagtaataaattagatttatcacttaattcacgcatttatactgcagcttaccgagaaaaattaaacaaaatagcgaatattaatccaacgttagcattaacagatctaattactttacgacaattcattactagtcatgccatattcactttctttgatctaccttggttccctatttaccttttagttattactttatttaatccttggttaggattatttgcactttgtggtgcccttatcttatttgctttggctatccttaatgaatatctatctaaaaatcatttaaaaaaagcgaacaattttgccaatcaagcacaactaatacaaagtcatcatttagaacatccacagactatcgaagcgatgggaatgcttagtcaattacgtaaacaatggcaaacctctcatttcaaatatttacaagcacaaacacaagccagtgataatgcagctggtattaacgctatcacaaaagtaacacgtatggcattacaatctttaatgctaggtttagggggatggcttgctattgataatactatcagtcctggaatgatgattgccggttcaatacttttaggtcgagcattagcccctattgagcaagtgatcaatgtatggaaaagttgggatagtagtaaagcagcctacaatcgattgacaactttattaaaaacataccctcaagaaaataaaaaaatggccttacctaagcctcaaggccaattacttgttaatatcgatgaagccgtgtatccacacagtgacagaatattactaaataatatcaattttgctctattaccgggagatatactaggtattattggcccgagtgcttctggtaagtcttctttagcaaaatttattgtcggtatatggcaggtcaaaaaaggcattgtgcgattagataatgcggatatctttcagtggagtaaagaagaaattggcccacatattggttatttacctcaagaaatcgcccttttccccggcactatcgctgaaaatattgcacgctttactgaggttgatcctcaaaaagtgatccaagccgccaaaatggcacatgtacacgagatgattttacgctttcctcaaggatatgaaacccaaattggtgctcacggtgaaggattatccggcggacaaaaacaacgtattgcattagccagagcattatatggcgatcccacgttagttgtcttagatgagccaaattctaatttagatgatttaggtattagagcgttaacacaggcgatcgaaacattaaaacagcataaaaaaaccgttattttaattacccaccaaaaacagctactttctgtcaccaataaattattagtgatatttgatggaaacaccaaattattcggtccaacggcgtctgttattgctgaattaaataatccaactatcacaaaaacggcaaacactatttcttcaacaccagcaacctcaaataacgcttaa

SEQ ID NO: 1951 - DNA, 1017 bp, Proteus mirabilis
acggtgaataggcgtcatttctttaagctggcatcaggtggggttctccttgcgggaatggcacccactgcgagtcatgctgcggcgcagaaccgtcctccaattcctggggctctcggtatgctctatgactctacactctgtgtaggctgtcaagcatgtgtgacaaaatgtcaggaaattaatcatccggaacccatggagcgtggtgatacttatgctaatggtgatccgatctggtcaaacaatgacaaactaagtccttacacaaataacattattcaaatttggcgtgatggaacaggtgaaaataaagatcaactggaaaacggttatgcctttattaagaaacaatgtatgcattgcgttgatgctaactgtgtttctgtgtgtcctgtttcagcgttaaccaaagatccgaaaaccggtattgtgcattatcatgcagatatctgtacaggttgtcgttactgtatggtgggttgtccttataacattcctaaatacgattatgatgatcccttcggtaagctttataaatgtgaactatgtaaccaaaaaggggtagagcgcttagataaaggcttattacccggctgtgttgaggtttgtccaacaggtgctgtgatttttggtactcgtgaagagttgcttgaagaagcaaaacgccggttagcgaaaaaaacgggtgaagaatatcactatccacgccaaaccattaatggtggcgatacttatctacataagatcccagaatatcaagatcatatctatggtgagtttgaaggtggtggtacgcaggtgatggtactttccgcggtgccttttgaaaacctaggtatgccagaagtggctccattatcaacgggtgcgcgttctgaacatattcaacatacgctgtataaaggtatggttttaccaatagcagcgcttgcgggcattacttatttggttaaccgtaatagtaaaaaacaagagcaggaacaccataaggaggataacgatgtcgagtcatga

SEQ ID NO: 1952 - DNA, 8334 bp, Proteus mirabilis
actatgggtagatttaagaaaattaatatcaatgatgatattgaaagaattacactagaaatagtgaaatatattaaagagcatagtgttgaattaccttttaatattgagtcagtaagacgtgttttaattgagaattatatttatattcttacttataaaaatgaatatgctgctaatgattttttaataaaaatagaaagtaatttatctctttataatcgggataaatttactaaagcgattgattttattgtaaaagagattaatgcaagtatagagaatttatttgttaataattcttatcttacaaacaaaaattatcaaaagctaaataaaacacgtattaattcagtatttcagcattacccatcaggattttttcacttaaaaatagaaaataaaaacttatttatacagatagataataccaatcaattatttaaaatcattgactttgaaggtacagtggaattcttttctaaaaaagatgaccttattcatactattaatcaaatggttaaaaacagtgttgctgataactctatatcttaccgattttacgctaagaacgaatattttaatttctttactctcgataaatattggcaagtaacacctaaagatatttatgccgaagttattaatgatattaaggcaaaaaaacaggtacatattgatagtcatttaactattgaattaatagatagctattcatataaaaatatttttattgttagagactctaatgaaaactcagaaaaaatactccatatatatcttaataatattgatgaagcattcttgattgccgtagctaaacatcgtcagctaaaagaaaatggtgaacatttactttataaattaaataaggattggttctttactaaaatgaaagataaatccgttaaatatttttcacaaacttctgatttattaataccattagaaaagataatgggcagaattaatcttgtcgcttcagctgaaaataattataattttagccattttgatccactttcaggagtatgttatggaataagtttgaaatatttattggaggttagaaataatggtatagaaggagggaataaatatttacattggctaaaggaaaatattaacctttacaaggacaaaaaagaaaagatatctgataagcttgaaaaaattatatttgatagtgtacaagaatatgaagtattaaaattgattaaagaaatcaaggaaattaaattcgcacagatttttcaaatggagagaatatatgaaaaaataaattatacaatttttgatttaacaaaggcgaccgaataccgaaaaattttagcagaaaatggcttgaaagcatcgaatgcaaataggctagaaagtagtctctcacaaataaattatcacttagaatatataatgcaatattataatgaatattatgcgattattgcatttaaaacgcatgccattgctcttgcttataagagatattctaataatcattataaatttacgctatttgattctaattctgaattgacggaattttctaatatagaatcaataaaagacgctttgataaaaacaatgggctcttatactctaaataaagctgatggaaaagaatattttataattgatgaatataaaagaaatcctacaacaaaatatcgtagtttatgggatcaaaatgaaatcgagttacataaaggtattgctgaaaatataaaaaaaattggtttttcattgccttttaaagatggtgttgttggacgagttattcattacagtgaacagcgtgatctcattttagaacttaaaataaatagtaaattagttgaagtagtggccaaaaatgtttttgttgatgagggaatatttttagttaaaaataatttagataaaattcttgagaataataaatccagtaaagtaattataatgagcaatagtgatggtattgatattcaatttactgaatttaatgcacatcaaaaaatgagtaagccaaaaggatatctggaatttaatgatgtttattatcgagatttaattaagattaatagttatttattaaatggtaaaaaatcattttcattgaataaaattgtttcattaattgatacactaagggggaatatttattttgataaaataacagccagtttttctataattgatgaaattatactatttaatcaaaacaatgaaaatatttctcttgttgatatcctgaatcaagtgaaacagaaaatagaagataaattattctatagcgatctcctttatggaaaagaaaagttaattgcattagcacaaaaaaatagcctagtagcagcaattttttatcgaatgatggttaatgaaatcaatgaaggttatactggaattagtaattttatttatgagcaaattattgataacccttttttaatattagataaaaatagaaatgtcggggttgttggttatgattatacgattaattttaaaaataattataaagcgttaaaagaaattattgatggtattgatatttctgaaataaaaaatatttttcttttagatgatgaaaatagactgcacttaaaagtaacttatcaaagattatcagaatatagaaacaacaagtatgttaataagcttcttcatttgattgaagatgaaattgattctataaaaaaaatagataatacaggtatttatcgtgatttatatctggagttttttagcaatcatcagtttaataatagagtgattattcatgaaatagcacaattagaaagttattttaataataattatcaggagcgaaaccatggctatcatcctagtaatttttatattaatgaaaatgatcctcttaccctactagaaaagtcatttaatcagaacaaaaatgaaatagatggtagttatctgttatttaatgaaagtaaagaaaatttttattttttatttgttgataataattttattactagagattttgtagataatattattattgaaagcattagtggcgtttatcaagatgatatcgtcatttatttctataatggtgtaaaaagtgaacaattaacacaatacttaaaagataaaccagaaataggccgttttcttgattattgtttaaaacatgaaataagagtgattgctgctggaaatgaagaatactttcctgccaccaatgcgcttgttaagcagaaaagccgtgttgaatcactacaaaatgttattttacaacatcaatttgttggtgaaagaacaattgtttttgccaataaggagactttatttagttatcaaagtggtcatttatttattgaagggattgctcagcggctaaatatgcctatttatacggtgacggataacagtgttatacttgaaaatgaatacattatggtaaaaccgacgactgaaagtcagtttattggtcaccctttacttgctgatacaggtgcatctaatacgctacttactgaaacagtacctaatgagcctaatacagtgtctaataggcaaagagtagatattgaaaataaaaactatgctgcagaaatctatcaattcgtctcacacaattacactaattatagagataatcaagagtttaagttaggttatcagaatgagattagcactatttttcctgactattctgacaatatgaccattgctgatattttaaattacattcagttaaatcgctatcagatcaattatgctcaattaggtgcaattattaggaaagtcgatcaaattaaccttaaatatcataaagaaaagcttgcagagttcagtgataaaataataaatcacgatttactcattgataatgcaattgagaaatatttggttgaattatcggcaatatttaatacgtcagataatagtttaataaaaaggaatttaattcaatcactttatgatccctctgttaataaagaatttaaccaatttttaatggatggaacgaactttgaacagtggcaagaaataactaataaagactatgggaactatagtttaacggaaagaacgtatcaagttattgaaattattcatgcgatttatgatactcctcacttaatagataatttaagtgaactatctaaaaataggcttaatgctttttttgatgagggtaataaaggtattttatcacgagtattattgagcaaaatttcaagctttgaactctataaagagaccataaataatttaaaaaaactcgctgttatcagtcagtctgatgaagagattagcgctttatcaccagtagaagcattaaataaactcaatgagtttaaaggtgaagttaacttagccacaagtgaagatagctctaccatttcttctaaagtggaaattaataatcttgtcattgacaaaagattactctgttatttaggtgcaaagataaatggtgaaagtatcgatgcgatagatcttaatcagatagagaactgggataaaaaaattacttttgatcctcagcatcttaatgattattttttatctgtgacgggcaatgaaaaagataaagaagttattgcattattacgttatctattaaataacaaacaagataaaattaaatattttctttctcatatgtccagtagagctgattatgtcgcggctcatgaaagattaatgaaaataatagcattaggtagtaaacagtataatcagcaagattgggaaaatttaagaataccttcattaaaaattcccagacatatgagagttatcagtaaaattggttacgctaatattagcttcggtatatggcaatcaatcaattcaacctttatgcttgctgagcaacttaataatccgctattaacccctcaagagcatagagagaccatcaattatcttgccataacatggtcagaaatggcctataatggcttatctgaactcattgaaatcgctttagctaaaggattattaaagtaccgtaataatcctttggagtatattagtaaaaccagcactcgaataggtatcgggcttaatatcctgtctattggatttgatatctataatatctacgataactttagtcgtatctcagtagaaaaaaatgaaaaacgacggattgactatattgtgaatggctctttagctatagtttccggattggttactttgggggtttctatcgcaatgcttgctggctcgacggtcgcggggcctattggtattgtcgcgggcgctgttatagctttagccatttcaatttataatgccgcaagactgatagaagaagcgaaagaaaaaataggatttacaccactagaagaacttaataatggtttttatgcatttttaatgggggatatcttaccaagcaaaaagaatgaaatcgtctatttagagacaatatcacagttagaaaccatgattgcccaaaatgcgcaagaacatcttaaagaaataaaaaaacaggagcctcacagttattatttttattcgaatgagaaacaactttatgaagaacatcattattataaagtgatccctcgtatattggggaaaacgttagataatatacttaatccgtttggagaaattgttgtacaacgagtggcgaaaaatttaagtaaagaagaagcagaaaagatagctgcgctttctcattatcttagtgtcgaaagaacggaatataaatactatgttcctaaagaagccatcgcaacagatgaaattctcatttttgatatggatttttatgttaatcaattaaatcgttatacgattaattttgcatttgaagatgataatcctgtttttgaggatgaggtggatatctctttttttgataaaataagaacaacaaaagaaaaaacatggcaaaatttatcatcaggagaattaacagatgatttaattaaatcaacagctgaaaaacaatattttgagccaagttggcgtgagaatgagctattttattttaatacttataatggggatgatattattgctgcaccattaataacacaaaatatatttgatgttcataatgggactaaacgattaagtggaggagaaaaagatgacacctttaatgtgttcacttctgaatctcctcgttatgccagccgtttttatggtagagaaggtaatgatacattacgtattattcagacagaaaaaaaatatatagggtatgaagttaacctatctaaaaattatattaaatttatcgggggagaaaataaatccaatagccagagttttcatgccagactttttatctttcaagagcaaggacaaatctatacccataaattagcggatacaatgcctaatataacactacaaaaacaacccgttattgcctatttagagagtattgaaaatgtagtaggcagtgaaataggtaatgatattatttatggtgaccaaaaaaataactatttaaatggcatgggaggagtagattcattatatggattagctggagatgatacgctggtattacgggaaggttatgcacaaggaggggcggggaatgatagttatacgattctaagagcatcaaatacggataataatgttaaacaacttgaaactattattgatgaagagacgcatacagaagctagtcttatccagttaaattatacttttgatgaaattaccgctatttctcgtcgtgaaacagatattgtttttacgcttaaagttagtaatgataaagatcctgatcaatttatcgagcatttaattgcattaagtcatgtataccaagataaaaatagtcaattattagcccatcgatataccattgtgactatggatggttttatacttactattaatgaaaataataatcaaccaagagaggtatcatataactttagttatttagaaaagtataatcagcaagagaagcttcaacagctttctattaatgacgataaacacacattgtctattcaatctgaaaataaaactaaacttattcaattattacctgagctacaatacagtggtttctcttctggagaacatttaaagcttaatctacagggtaatagcgagaataatcattatgctggaattgcggctcattcatcaattaaactgagtcgcggttatgacaattatcaaataagctcattgctagctaaaaatagaaatgaaaagatcattatttctctgagtgataatgataaacaattaacatctgattgtactagtcatttctttttatccgatgtgagtggatttgatttgatgtttagtgatggcgttttatctcatcgctataatcctgatgctcatattaaacttgttttcgatacggaaagtgttagtgctatttttaactcaggaatgacacttcaatttattgataaagataatcgagtttttcatttgcctaagccagacagcggtcagcgtttactgatccccactatcactttggatgttaggttgagtcatcaaagtgatgttctgatgatcccaccctccctacgtttaaataaagaggcattatcattgtatcctcagtattttcatagagaagaaccatcatcacgttcaacgcaattacagcgtattatatccactcaaacactagagccttatccattaaaggtaacagaattactgagagatgatattgctgttaatgataatcaacctgttaattctattttgtctctcaataaactattttcaaacagatcacaagatatattctctcaagctatagatttattaccaatgatagaattaatggatggtgatgatattgttgttaatcataatcaaagtagctcagtgattgatgggggtaaaggtgatgatcatattgttgtcaatgaagggcaccatattttaattgctggagaaggtaatgataatcttaatggcggaagtggacatgatctgtttatttcaacctcaggaaatgattatctaggtggaggaagtggtaataatgtttatgtggtacaaaaacgtcatggtgaagtgacggtgtatgatgaaggtgaaatgagccatatttttgtatcaggattatctgagcatgaaaaattaatatcctctcaagcaggtaaagataaacagtatcgaacggctgataatcaatttgtcttgactgttaaaacaaaccgagtagagaaaatagaaactgatcctgtgaaggttatcgaaaaagaacagacattatcaatgggatcccttgcgacaattattcaacaaatggctcaatttaatcagcaacaactatcgacgatgcaaggcagtgacgttattccctcatcaaactggtcgcctttagctgtggtcgttaagcatttataa

SEQ ID NO: 1953 - DNA, 1200 bp, Proteus mirabilis
atgggtattttaatcatgaaaagcttaaagcctttagcagcgctggtaggtttattggttctgtcgggatctgcaaacgcagtaaatgtgtacaacgataaaggtacacgttttgatgttaacggtcagttccgtttaaaaacgcaagtgactagccaaaatcatgaaatgaaaatgaatgatgatggtagccgtatcggtttctttggttcccatgaactgactaacgatatcaaagtgtttggtaaattagagtggggttcagatactcaaaaaaccaatagtgataaccctaaatctaattttgagatgtataaccgtgtaggctatgttggtttttctcatcgcgattatggacaaatccaatttggccgtacttatatcccgattgactgggtaaaaaaatcaagctacggctatggtaatacaggggtattttactttagtgatgtattaggccgcgctgtgggttatagcaatggttatgctgatggtaaaggggttggtaaaaacaactttatgactcgtttaccacaaactatctttattgaaacaaaccgttatgaagggtttaagcttgcaggtacgataacgggtaaaactggggatgataatactcgtactaccggtgatattactcgtgcttactccattgttggtttttataaatcaaccttcggtttagagtttgatgcgggttattctgcagctaaaggtgaagcaacccatagcagtaaaagtacggttcgaggtaaaacaccagaaaatagtatcttagcattcggtgcagaatacttcttccctggtcgcgaattctctatcggtatcgactatggtcaatctcgtgggaaaaactcaggcttaactttagcgagcaatgcctcagaaaaagattacagatggaactcagttaaaggcgattggaaagcgaatttatatggtgttggtgtgaaatggcactgggatcgtatcgaaagtggtatgtatgcgggttattacctgcgtgatggcgatgctaacactttcaactacaaaaaagaaacctatactgtgggtgtagataaacgttttgcggtatctaaatacaacaacttacgtttattcgctgaaatggcatatgatgatgctcgtagcgaaaacccagcttatgaagataaaaaacaatatatctttgaaactggtatgcgtctgtacttctag

SEQ ID NO: 1954 - DNA, 672 bp, Proteus mirabilis
attaacttcagtcaaaatcgaggaataatggcacgaaaaactaaacgccaagcacaagagacaagacagcagattattgatgctgcacttaggctatttactgtgcaaggtgtttctgccacatcactttcagatattgcaaccgaggccggagtaactcgaggtgcaatatattggcactttaagaataaagtggatttatttactgaagcgtgtgaactcaccgacttaaaaatagaatcattagaattagagtatcaatcaaaatatccagatgatccactatttgtattaagagaattgcttatttacatattgacatcaattgtcgaagatccgaaacataatgcacttctagaaatatatttccataagtgcgaatttgttggtgaaatgacaccaattgttgaaatccgccgagaattatgtgcagccgattactctagaatagagcaatctttatttcgctgtatcgaaaaaaaacaacttcctgtcaaccttgatttaagaagagccgcgattatgttaagagctatgatgacagggcttgctgaaaattggttattttcaccagaaagtttttctattaaagaggaaagtcaatatttggttgatagttttattgatatgattaagcatagcgtaaatatgagaatatcggcgctatcttaa

SEQ ID NO: 1955 - DNA, 804 bp, Proteus mirabilis
agatcatacagaaacagaaaaaggagagagggaatgattcagttgtattgggtagccctcaagacgatttggattaaagaagtgacccgttttggccgtatctgggtacaaactttaattcctcctgttatcacgatgtcgctctattttgttattttcggtaacttaattggtaagcgtattggtgatatgggcggtgttgattatatgcagtttattgttcccggcttgattatgatggcggtgatcacaaactcatatgctaatgtctcctcttcattttttggcgctaaattccaacgtagtattgaagaattattagtatcgccagtaccgacccatgttgttattgccggatttgtggggggtggtgtcgcccgtggtatttgtgttgggatattggtcactctggtttcactattttttgtaccactagagatacactcttggacaatggttgtggtgacattattaatgacctcgattgttttttctctcgcaggattgttgaatgccatttttgcgaaaacctttgatgatattagtattatccccacctttgttttaacgccattaacttatttaggtggtgtgttttattcactctccctattacctgcattttggcaaggtgtttctaaattaaacccgattgtttatatgataagcggtttccgttatggttttttagggatcactgatgtgtcattaacggtgacaatcacggtactatgcctgtttattgccgtgttttatatcgtagcctggtacttaattgaaaaaggtcgcggtttaagaagctaa

SEQ ID NO: 1956 - DNA, 939 bp, Proteus mirabilis
ggaaggtacagaatgaccaatttacgcactgtatcaaagcacccagagcaattagaaaccacaccattagttgcggaaagtcatcactatgatgatcctttagcacctcaaaaactggtatttttaaaggcagttaatcaacagcgttgtgtgattaactcaccacagcgcaatagccaactcaccaatacaatacccttttttatcgttcttttagttatggcttgttatacattatttaattttatggaagggcatattggagccaaagctgagctagaaagcatgtctcaatatttatttgaaaataataaagatattaacgcattaaatgagattgagcgtaaatctattttaaaatatcaacctttttgggaaacagaaaaaattagctggtgggagtatataaaagcgtataactccggtgaattttttattgatagccaatatgataaatacctcgtcattggctggctaatttttttccccggttttttatggctatttggctatctctctttctttacgcctcctgtatatcttattgctgataggcaaagaggaatgctgtatagctatggcatgggaaaagtacgtttaacccgctataaagaggcgcaatttggttatgcgggcaatatgttggcaattaaactatatagcattaatgaaaaaacaggccaattaaaaacgatcctctatcgccccaatgtgtcccactactccagtttcctaaccagtaccgacagtgaaaaccaccgttttatcactttccttaatgcctatatgcaacaaggtcgagatgccgtttcgcctgttgattaccaagcccgtaagccctttttatcttttggtaaaaacccacttcctgctgattttgagcaacaggtcgaacagattctggcaaagcttgatcaggagaaaaaacaccatgcgtaa

SEQ ID NO: 1957 - DNA, 507 bp, Proteus mirabilis
agaggtaacagcatgagtgaattaaattgggatatcacgggatacgatgaaccacctattgaattacttgaaagcagttttcgagagattgccaaaaaagagatgcaagcattgcctttttatagagaaaatattcccgtaaaagcagggggatttactttatttgaaaagcaatggattggaacaattttaacgccttggatgctagagcttattgtgttgcccgggccatcacaagagtggccaagacgtaaaattggtgagcgtatcgccttagcgcttccttgtggtcaggttaaatttgtcgttggtgaacttgctaatggtgctcaatatctggcttgttcattaatgtcgccacttgatcgccatttacaaggtgagcaggcggttgagttagcagaaaacagtgcaaaaatggctctttctcttcctgttcagacacaatccgtcacagaagttgatttaagtcggcgttccctgtttcgtggtcagttaagatcataa

SEQ ID NO: 1958 - DNA, 3804 bp, Proteus mirabilis
atgaagcggctgtctaaatctttattattgataacccttttttgcctgattattttcgccgtagtattaagtggatttcgttattttctgcctcgtttagataattatcgccctgaaattgaaacctatttatccaaacagttcaatagcccagtcaccatgacacaggtgaaaggagaatggcaaaactttggccctgatatccaaattactgggctgtatattgataataacagtgttgaagtgagtgctgaacagatcactttctcttttgatgtttggcgttcactgcttcattttcaactctattttcgtgaattaacctttgaacaattagcagtaaattacaaaaagcctatttttactgggcaaaatggtgatattactttcactgaacccgatgatatctcttccattttcttaaaacagtttgatcgatttaaattggttgatagccgtttcgtgtttttatcaccttctggtgacactagcacgctccatattcccgaattaatgtggctcaatcagaaaaaccgccatcgtgcgcaaggggaagttactttagataccccaataaatcactatggtggactaaaagtacgtcttgatctctatacgaaaaagcagggggcactggataaaggacaggtgtttgtcaccgctgatgaggttgatatttccccttggttaagccaatgggttaaaagtaacagtggccttggtgaagcgaaagccagcctatctaattggatagagatcagcaatgggcggatcacgggtagccagttacaaatccatcaaggtgaaatggattggcgtaatgaagggcgcacacatgtattaaaggtagaagatttaattctacgtatgagacgccaagaaaatggctggcttgctgatatcccttatacccgaaaaataacgatggatggtgatgaatggccagatggttatttagcggtactttatcaacctaaagaaaaacaacaggatgaagcttggcgtatccgtgctaaaaatattgaattagaacggttatctgcgttattgcctttgttctcctttttaacgcctgatgtcgtgcgccaatggcagtatcgtcaattttctggcatggtcgactcatttgctcttgatttagcccccgatgattttaaacgtagtgccattgatatcagttggcaaaatgttgcttggaaacgctggcaagaaatcccttctgtggcacattttaatggtcatttaaagggcacattacagcaaggagcgcttaattttgcgcttaataacagtgaaattgatactgctgggctttttaaagcgccacttaatatagaaaaaggcactggtacggtttactggcagcatcagggagattctctgtcgttatggagtcaagggattgatataaaagccacctccgcttgggttgccggtgattttcgttatcaaaaacaaggagagcatcaacaactgtctattctttcgggagtgaatgtgaccgatgccggtgagacatggcgatatttacctgaaaaatatgtcggtaaagatttaacacaatatctctctgacgcgattattgctggaaacgttaaaaacggtacgtttatttttcatggtgatccgcgggatttcccttttgaacaacataatggttggtttcaagtctatgcaccagtaaaacaggcgaccttcaaatatgatagtgaatggccggcactgtttgatcttaatgttaatcttaattttaagaataacggcttatggatgtcctctgataatgttcaggttggtaaagccaccgctaaaaatttgacggcgattattgaggactataacaaagaaaaaattgttattgatgcagatattgaagccacgggcgatgatttaaaagagtattttctagcttcgcaaatggcaacgattggtcatacacttgaaatactaaaagtggctggaaaaattaacgggagtttgcatctcgacattccttttgatggcgagcaggtggtcgcttctggtcaggtaaacttaaacaataacgatgtcacattagcctttatggataccaccctagaaggtgttacgggacaatttcgttaccataatgataaattagagagtgatactttaaccgcgaattggtttggtcaacctctgacattttcttttgctggtggtgatcaacgggatgcttatcaagttggtgttgatctaaaaggacaatgggatatcgggaaaattaagggattacctaatgatatacaacataaattaagcggttttttaccttggcatggcgcggtaagtgttaatattccagaaacagcggatgtcaattatcaagtggatctgaccggacaagtgaatgcgctacaaagtcagttagctgcgccaagtaccgatgattttaaaaacgcttcccccattgtgatttcagcaaaagggaatagtgaaaaacttaacgttagtgccgatgcacaagatcagtggtcattaaatagtgaatgggcgttaggtgaaccattacgtctattacaaggtaatttagtctcttcctcgctcacactacctcaattaaatgatcaatcacgattgactattgcattgcagggattgcaaggcgataaatggctacctactttaatggctttttcatcattagccccttctgaaaacgcaatacgtttccctaccaatattcatattagtttgcctgagcttaattttgctggtcagcaatggattgcgccacaaacagaaattatgcgtgctgatgatggcgtaaaattatccttctcagggagtgagttacgaggtgacttatttgtacccaatacggcacaaccttggcaggtgaatattacctatctctattttaatggcgctagcccaacagaagaaaataaatccttaaaaatggcaaatgtgcctgatgccaaaaaagcagttcaattttcacttaaagatattcctgctatcaatttcgcctgccaagagtgttgggtgaatggattattactagggaatattgaaggtgcaatacagcctcgtgacggagcattattgttaactgcaggtaagcttaaaaatagcagtggcgagctatctgtgagtggtgtgtggtcagaagatagtttaggcaacagtatcactaagttggcaggtaaactaacggcaccggaagtcgatgaaatggcggcttactttggttatatcattccgattgttcagtcaccacttacggcagatttctcactgcagtggcacaataccccttggaattttgatctaaaaacactcaatggtgaagtgaatgcttctcttggaaaagggcgtattgaaaaggtggatgttgggcaagcgggaaaattattacgtctagtcagttttgatgccctgttacgtaagttgcaattcgactttagagatacttttagtgataattttgagtatgattccattaaaggtgatttgacgattaaacaaggtgttttaaacgcgaaaagtgttgctgtagatggtgttattgccgatattgctataaaaggtcaagtggatctgttggcgcgtaaaatggacttacaagtagtggtaactcctgaaatatcagctacagtaggcgttgctaccgcatttgctattaaccccatcgctggtgctgctgtatttgcagcttcaaaagtactggggccactttggagtaagatttcagttatacgttatcatgttaccggaacggtagaacaacccaagattgacgaagtactgcgtcaacttaaggaggatcaggcgttatga

SEQ ID NO: 1959 - DNA, 243 bp, Proteus mirabilis
catattggcagactgtgctttattaataaaaaagccactaattttaactacttagtatgcaaagtagttaaaattagtggcttttattttttatacaacaataatgttggggaatgtcgctgccattctccagatgattactttgctcttatagctagaccatcatcaaggtgcttgcgcgaacccacatcttttacaaaatgcttcatatttatagagctaagggtgtatgttagctcttag

SEQ ID NO: 1960 - DNA, 2139 bp, Proteus mirabilis
ataactctaagatctgagagaataataatgatcacaaacaaacattttttagcattgactattgcagcaagtttaattcctgatttcgtcagcgcggaagagagaattattgttaacgcagagcgcgttaacccccaaactaaaggtaggttatcacaacaagccaacataggtttattgggaaataaagatatccaagatattccatttagtattaagggatatacctcgaaatatattgagcaacgacaggctaaaacacttggcgatgtaataaaagatgatccatccgttcaagtgacatctccgtcaggtggtattcttgattcctttatgatccgaggattccctatcggggaaggcaatattggtgaagttgccctcaatggtgtttatggtgtagcgccaaattatcagttattacctcaatatttagagcgaatagaattactaaaagggcctggggcggggctttatggtatctcccccaatggcggggttggcggtgttgttaacgcggtgacgaaaagacctactcgtcagggaactaaacagattactaccacttggggatctgataatcaacttggtgcctatatagatgtaggtaaattgtgggtaaccccagacggtgaaatgtggggcgtccgatttaatggtggtggtagtggtggagatctggcgcttgataatactcataaaaaaacggcattaggtgcactcgctcttgactatggaaaagatggattcaccgtttcagttgatttattcgatcaatatcaatatgtcaaatcacctaatcgtccttttattgtcttagcgggtatcgatgttcctaaggcccctaatggtcgacgcaatattgcccaaaaagggatgtggtggaacactcgcgatcagggcgtattactgcacagttcatacgagattaacgataatctaacacttttcatgaatgctggtggtggtcgttcaatcgtttcacgtatctctgagcaaaccccaaagattattaacgacaatggagatgttgaatcggcaatcactaattatcgttttaatgtacatcgttatatttttgaaaccggtgtcagaagttacttttcaacaggcgctattgatcatcagatgacattacaggccagctattatcatgaccgtcttgctgttgcgggtaatgtaggaaaacaaaaggtgatttctaatatttattcaccatcagaagtcgatgttaccctaccatcatctccagcaagcgtccccaaagtatcttctagtcaattaactagctttgccgtttcggataccatgaccatattgaatggcagtgtggatattatccccgggatacgtttgcaaagagtacaggccgataactttatggctaatggacagcgtttggccacttatgatgaatcagcggtgacgccaatgttggggctggtttaccatcctttagagtctgtttcgctctatgccaactatattgaagggttaagcaaaggtgatatagccccgagttttgcaaaaaatgccggccaagtgatgcgtccttatcgctcgcgacagtacgaagttggggttaagtatgataacgcgggaatacaaagcagtttggcttttttccagataaccaagcctagtggtgctatcgacagcactgataatatatttaatgctaatagtgagcagcgaaatcgtggcgttgaagttaatctttcagcgcaggtgctggaaaatttacaaatctcaggcaatctttctcttattgatgccgaacttatcaaatcgcctaaatctgatatccgtggtaacaaacccgttggcgtttctcctctacaagcaaatgtgggagtggaatatgaccttcctattttgcatggattgtcattaaacagttatgtcaattatagcgcaaagcaatatgtcaatcaggcaaatacacagtctatcaatccttggacaacggtagatatgggagcctcctataaaacacgtgtgtatggtgcgcctaccactttccgttttgatgtacagaatctatttaatcaccattactggtctggtgtcgcgtcatataccactattgcacagggagcaccacgtactttccttgcctcggtaagtgttgacttctaa

SEQ ID NO: 1961 - DNA, 2868 bp, Proteus mirabilis
ttatcaataagtaaaaacaaacatgaaaaatattcttttttacaggtgaggataattctcatttcaccctcttacttagtaacaaaaattattaagtctatgaatgggattggtgaaatgagaataaataataaaaaaaggcctctaaaaaggtcgctactcacattattaataacggctaccgtggcagccccttatagttatgcggcaacgctatcagtctctttaccagagcaatctttagctgattctttaaacactatcgctaaacaaggtcaggtacaaattctgtttgatgccaacgcaataaaaaacttacgggctcctgcactctctggtcaatatgaaacccataccgcattacaaaaggtgttaatcggtagtggtatggaaattatttcacagggaaatggctttgttattcgtccattagcaacaagcagtacgattgtgatccctgaagttaaagtcacaggggtgggaagcagttatcatcctgctacagatgttgtttcagcaccacaatacatcacctctgaagagataaagcaacgtaatactggcgatggcaatgtcaccgacttacttaaaagtaaccctgcggttcaatttgcaaataacgatagcaactcgatgaaccaaggtgaaattaagccctcacgtatttctattcatggctccagtagctatcaaaatgcctataaacttgatggcgtcagttttaataatgactttgatccggcaaattcgggcaatggtgaaaccaatacccgtattaccagtgatgagcaagggatgtatcttgatagtcgacttattgatagtgtcaccgtttacgataacaatattcccgttgaatttggcggatttactggaggcacagttgaagtacaaagtcgtcgttggtctggtgagacccatgccaatgcctattaccgtactacccgttcaagctggaataatattttcaccgatcccaaattaaaatttgatactgcaaataatgattttagtaatccagcccgtttccagaaaaaatatgataaacaaaactatggcggttggtttgaaacaggtttaacggaaaatacaggattaattttctcagcttctcgtcgggaatcaaccattccgatgatgataagtgctgaagggggaattgttcacacccctgaaggcgcattagagcatgtattacaaagcccacattatcgtgatcaaacgcgtacttcagataactactttatcaaatattcttggaatatctctgataaacaatcttttgatctatcaagtaatattgcccgctataagagctatctgttctccagctctgtgtataactccggttatgataatgagcataatggactcagttttactgccctttataagcatcaacttgcgctaggaaccttagagttaaccgcaggttatcaaaatctggaagataaacgcaccaatgatcaagactactttatcaaagtagaagattacactgattggcaacaccctgatcaagtctccagtggtggtcaaggtgatctgcgtagtaaacaagaaacctatagcgccaagagtattatgcgttttgatcccatcgtgtggggtaccgtcactcatcgccccaccactggatttgaaattagccgcaccaaaggcgcttatattcgtgataaaacctattacaactatacctatcgcggcatgacggtcaatgatgaatggatgggaagcttatcacaaacgacgcgttttctagcgggtacccataatgcgtcttataccaattattcattttttattgacgataatattcaatataaacgcctcaccttacgtcccggtgtacgtttagatcgtgatgattttgtacaaaaaaacaacctctcacctcgtttaagtgctacttacgatatttggggcacaggtaatactttaattattggtggggtaaaccgttactatggacgttcaatgctcacttacgccctttatggtgcgcaaaatgccggtttacaacactgctattttgactgtcaaacatcggaggaaaagtggactaatcgtaccgactttgatggtgttgattcactaaaaaccccttataacgatgaattcactttaggtctacaacaagagatagcctcaaccacttggcgtttacagtatgtgcatcgcaatggtcgtgatgaggtgcgtagtgatactaaatatccagactcaaccattgatgaaaaacgtgctattcgccacttcaataataatggtcgtagtacacacgataccttaacgctctccgtgagaaatagccaaccatgggagcttgctaaagccgatcacgtctttaatgcttcgattagctggcaaaaaagcaaaaccaatacgccaaaagactcaggttatgccaattttgatcccagcgttcaagggatgaactatgacaaggtgtggtatggcggaaaaataatcaatgccaaagacttaccttctgacaactttaactcgccgttaaaagtgaccgcagagctaaccagtgtttgggatgaagtaggggtgacttggtttaaccgtttgcaatggaatggagctcgttcacaagcagagaaagccaataatggtgcgccaaaaccaagtgagtacggcccgctatttgaatataaaaaacgtcattacagtagtcgttttacttgggataccaagctcagttggcagcctgaatttgcttacggtgtaggtatttccgttgaagtgaataacgtactcaataccaaaaatgtcaatgattacattacctatcaagataaagagtacaaatcttacgagccaggtcgacagttctggctacaagtcagctatgactattaa

SEQ ID NO: 1962 - DNA, 189 bp, Proteus mirabilis
ccaaaaccaagaacgccttctattggttttctttactggttttttctttctactcatgaacagtttctctcattaaaacctcttcaccacacccttagggtaaagaagcctaacattgtcgctatttttccaagctatcccacaggaaagctctcaaattgttattcagcacgtatatatacgcgctaa

SEQ ID NO: 1963 - DNA, 693 bp, Proteus mirabilis
agtatggcaaggcgtattcttgttgttgaagatgaaaccgcaattcgagagatgatctgttttgtattagagcaaaatggttttcagcctattgaagctgaggactatgatactgcattgagttttctgattgacccttaccctgatctggttttattagattggatgatccccggaggctcgggtatccaagtgattaaacagatgaagcgtgaaaataatacccgtgatattcctattattatgctaacagcaaaaggggaagaagaagataaagtcaaaggtctcgaaacaggcgcagacgactatgtgattaaacctttttcgcctaaagagctggtggctcgggtaaaggctattttacgacgattgtcaccgatgtcggcagaagatgtgattgaatttaatggattaagtcttgatcctgtttcacatcgagttaccagtcaagataaacccattgatatggggcctaccgaatttaaacttctccacttttttatgacccatcccgaacgtgtatatagccgagagcagttgctaaactatgtttggggcaccaatgtttatgtcgaagatcgtactgtcgatgtacatattcgtcgattgcgtaaagctatagagcaagatggccatgaccgaatgatacaaacggtacgaggaacgggatatcgtttctctgctcgattttga

SEQ ID NO: 1964 - DNA, 1875 bp, Proteus mirabilis
tttccccaaagggaaaagggaactgccgtgctaaaccgttatcctttgtggaagtatctgatgttgatattcgctatcctcatcggtctgctttacgcacttcctaacctatatggtgaggatccggctgttcaaatcactggcgcgcggggaaccgccgccaatgagcaaacactggatcaagttcgatctttattagataaagaaaaaattgaagcgaaatcaatcgcccttgaaaatggtgcgattttggctcgtttcagtaaccctgacattcagttacgtgcccgtgaagcgttgttacctgcgttaggtgacaagttcgttgttgcacttaaccttgcaccagctacgccaaaatggttagaagccattggcggtgagccgatgaaattagggttagacttacgtggtggtgttcacttcttaatggaagttgatatggaaaccgcgttaggtaaacttcaagaacaaaatgttgatagtttacgtactttattacgtgacgaaggcattccatattcttctatccgcaaaacggataattatggtgttgaaatccgtttccgcaacgctgatgaccgttctaaagcatcagattatcttgcgcgtcgtaaccaagatctcatttttagaaatggggataataactcgttaaaagctatttttaccgacgagcgtttacgtgatgcgcgtacttatgcggtacaacaaaatatcaccatcctacgtaaccgtgtcaaccaattaggggttgctgagccgttagttcaacgccaaggtgctgaccgcattgttgttgaattaccgggtattcaagatacggctcgtgcgaaagaaatcctaggtgcaacagcaacattagaattccgtttagtgaatactaatgttgatccttcagccttagaaacaggacgcatcccgggtgactcagaagtgaaatacactcgagatggtagaccaaccattctttataaacgtgttgtattgacgggtgaccatattaccgattcaacgtcacaagccgatgagtacggccagcctcaagtaagtatttcacttgatagtgctggtggctctattatgtctaactttaccaaagataacgtcggtaaaccgatggctactctttttgtagagtataaagacagcggtaaacgtgatgaaaacgatcgcgcaattttggtaaaaaatgaagaagttattaacgtggctaatattcaaacccgtttaggtaataacttccgcattactggtatctctaatgcgaatgaagcacgtcaattatctctgttattacgtgctggagcattgattgcacctattcaaatcgttgaagagagaaccattgggccaacattaggtcttcagaacataactcaaggtttagaagcttgtttatggggtctgatagcctctgttgcctttatgattatttattatcgtaaatttggtgtgatcgcgagtacggcgctattagcaaacttggtgttaattgtgggggtcatgtcattattacccggtgcaacgttaaccatgcctggtattgcgggtattgtcttaacccttgcggttgcggtcgatgctaacgtactgatcaacgagcgtattaaagaagagttacgtaatggtcgctcagtacaacaagctatccatgaaggttataaaggtgccttctccagtattattgatgcgaacttaaccacgttaattactgccgtgatcctttatgcagtcggtactggctccattaaagggtttgctatcacaactgctatcggggttgcgacatccatgtttaccgctattgtgggtacacgtgcgattgtaaacctgctgtatggcggtaaacgcatcaagaaactgtctatttaa

SEQ ID NO: 1965 - DNA, 351 bp, Proteus mirabilis
cttttacaaagagagacaattatgttcggaaaaggtggtttgggcaatctgatgaaacaggcccaacagatgcaagaaaaaatgcagcaaatgcaagaagagatcgcaaacttagaagtcaccggtgaatctggtgctggcttagtgaagatcactatcaatggtgctcataattgccgtcgtgttgaaatagatcctagtctgctagaagatgacaaagagatgctagaagatctgattgctgccgcctttaatgatgctgcacgtcgcattgaagagacacaaaaagagaagatggcatcagtctctaatggtatgcaattgccaccaggctttaagatgccattctaa

SEQ ID NO: 1966 - DNA, 540 bp, Proteus mirabilis
gtcatgcaaagtaaaaaaattgaagtttgggttggtttatttgttgttattgcactgatagcggttgtctttttaagcttaaaagtggctgatatcaaagaagtgggtaatcaacctacttatcgtgtctacgcaagttttggtaatattggtggtttaaaagagcgttcaccggttaaaatcggtggggtggtaattggtcgcgttgcctctattaccttaaaagaagagatggaaggtaactatcgtcctgaagttgctctcgatattttaaacatttatgaccatattcctgacagcagttctctttctattcgcacatcaggtttattaggtgaacagtttttggccttaaatctcggcttttatgatgaagatttaggttctgattttctaaaggatggtggcagaattaccaatacccattcagccatggtgcttgaagatttgattggtcagttcctttataaaaccggtgacggagatggaaaaacaacctctgactcaaaaacgcaaactgaacaaccagcattaccttaa

SEQ ID NO: 1967 - DNA, 321 bp, Proteus mirabilis
  unsure (261),(302): Identity of nucleotide at the above locations are unknown.
ataaataaaagagctgacagaactatgttcgaacaacgcgtaaattcagacgtactaaccgttgccactgtaaattcacaagatcaggtaacccaaaaacctttacgtgactcagttaaacaagcactgaagaactattttgctcaattaaacggtcaagatgttaatgacttatatgagctggtattggctgaagttgaacagccattgttggacatggtgatgcaatacacccgtggtaaccaaacacgtgctgcgcanatgatgggcattaaccgtggcacactgcgtaagaaactganaaaatacggcatgaattaa

SEQ ID NO: 1968 - DNA, 1938 bp, Proteus mirabilis
aaaataaaaagagcagcttacctgctctttccctattacaagtcattaattaataggcatcacatgagcattgatatcgaaaaatatcccacattggcgttggttgaaacacccgaagatttacgcctattaccaaaagagagtttacctaaactctgtgatgagctaaggctatatcttcttaacagtgtcagccgctcaagtggtcacttcgcctcaggtttaggtgctattgagttaacggttgcgcttcattacgtttataaaactccctttgacaatctgatttgggatgtgggccatcaggcttatcctcataaaatattaacgggtcgtcgtgatcgcattgatactattcgtcaaaaaaatggcctacatcccttcccttggcgtgaagagagtgaatatgacaaactctgtgttggtcattcatccacctctatcagtgctgggctgggtatggctgttgctgcagagcaagaaaacctaggcagaaagactgtttgtgtgattggtgacggtgcaattactgcaggaatggcatttgaagccatgaatcatgccggtgatattaatccagatatgctagtggtacttaacgataatgaaatgtcgatttcagaaaatgtcggggcactaaataaccaccttgcacaacttctatctggcaaactgtataccacgctacgtgaaggtggcaaaaaagtcttttctggtattcccccaattaaagaattactgaaaaagacagaagaacatattaaaggcatggttgtgcccggcaccatgtttgaagagttaggttttaactatattggtccagttgatggtcacgatgttattgctttagtacaaacgctcacgaatatgcgcgatctaaaagggccgcaacttttacatattatgaccaaaaaaggtcggggttacgctcccgcagagcaagatccaatcagttggcatgcggtacctaaatttgatccaaagacaggtactttacctaaaagccccaatgcacgcccgacgttttcaaaaatttttggggactggttatgtgaagaagccgccactgatgaaaagttaatggcaatcacccctgctatgcgtgaaggctctggtatggtgcgcttttctaaagagtaccccgcacaatactttgatgtcgcaattgcggagcaacacgccgtcaccttcgctgctggattagccattggtggttataagccgatcgtggctatttactccaccttcttacaacgcgcttatgatcaagtgatccacgatgtggctatccaaaaactcccggtactctttgctatcgatcgtggtggcattgttggtgcggatggtcagacccaccaaggagcttttgatctctctttcttacgctgtatccctaatatgattattatggcacctagcgatgaaaatgagtgtcgccaaatgttgcacacaggttaccattatcaagaagggcctgtcgctgtacgttatcctagaggatcaggggttggtgcgccattacaaccgctgagcgaacttcctataggaaaaggtattattcgtcgccaaggtaaaagtattgcaattttaaacttcggaaccttattacccgaagccttagatgttgcagaaaaactggatgcaacagttgcagacatgcgctttatcaaaccactagataaagaactgatcctttctcttgccaaacaacacgacatactggtcaccttagaagaaaatgccattatgggtggcgcaggtagcggcgttaacgagttattaatgcaagagcgttgtttagtgcccgtactcaatttagggttacctgatctttttgtgtcacaaggtggacaagaagagatcagagccgatttaggacttgatgcaacaggcattgaaaaatcgattaaagcttatcaggctcattctttgagctaa

SEQ ID NO: 1969 - DNA, 471 bp, Proteus mirabilis
tttggaaaaagaggggaggtaaatatggagtatgatgtcgtgttatatcccattgccttgctccgtccttcagaagaagtcaacatggctcatgttgaagctttaactaaggaaatagtccgttgccaaagatggacaacacctatacccattgaaaaagagaccggaattattatggacggtaatcataggtatcaagtcgctcatcatcttgctctcacttatattccttgtgtgttgcttgattacactgatacacgcataactgtgtatgattggcagaatggacgagcgtttagcccattaagaataagggagcagatattaaagcaaggtaatattttcccttataaaactactcgacatctattttctccaagccttccggccgttaattttccgcttgaacagttagttgaaaaaatagccagtaatcatttgaatgttttcaagttaggtgttggtaggtga

SEQ ID NO: 1970 - DNA, 207 bp, Proteus mirabilis
acatacgaaaggataatcctgcaagccgggacggaaaaatccgtctactctaccaaccacaataagcagcgacaaggcgcgatccgctacttagttaaaagtggacacgtgaataatcataaaggcacaatattctacgttacttttcccaattggagcagaaaaaaactgcataaaaatgggctaattaaaacgattaacgcataa

SEQ ID NO: 1971 - DNA, 414 bp, Proteus mirabilis
agtcatatgagtacattaattaaagtttatggattccatttagatgtttttgagcatgtgaataatgcacgttaccttgaatttttagaacaagcgagatgggattggattgaacaacacttagatctcgcttggtttaaacggcatggtctagcactcgttgtcgcgaatattaatatcaactatcgtttgcccgctaatttaggcgatgaactaatcattagttgtgatattgcagaagtcggtattaaaagtggcgtgttgtctcaaaaaatagtgagaaaacaagatggtgcattgatttcagatgcattagtgacttttgtactcgttgatatcaatactaaaaaagcattaacacttacagatcagttacgagaaaaattggagtatgtacgccagtctgctgattag

SEQ ID NO: 1972 - DNA, 417 bp, Proteus mirabilis
tccataatgagtgatactcaaagaccacagggccccgcatccggggttctgaattctcttagtcgtattggcgctgttatcgttggcatggttgaaacccgcctaaaattaatcgccatcgaactagaagaagaaaaaattacacttattcagcttattttaatggcggggatcaccttattactcaccgcctttggcttaatgagtctacttattctcctcttttgggtgatcccacctgaatatcgtattcatgctttagcgattacaacggctattttgctagttggtgccttaataggtgccatcatgacattgagaaaagcccgcaattcaacgctgttaggtgatactcgccaacaactagaattagataagcgtcttttggagcaatatcgcgatgagcaaacaaaatag

SEQ ID NO: 1973 - DNA, 1089 bp, Proteus mirabilis
cattcaatgagcgaaaatagagcgtctaaacaacactcaagtaaaacaacaaaagcaaaggtagtgaaggaatatcagcgacagatacttcgtcgtttcttttacttaatgatattagggggcgtgttatgtagcgttttgatccttgattttactttagggccttcaggattatcgctgactgaactgtggaatacactaatatcgccagaaattgccgatgctggtactcgggttattgtgtgggatatcaggctaccttactcccttatggcggttatcgttggaatgtcactcgggttagcgggtgctgaaatgcaaactatactcaataacccgctggcaagtccctttacgcttggcgtctcttctgccgctgcttttggtgctgctttagcgattgttttaggaattggtattccgggggttcctgctcagtggtttatttcagttaatgcgtttattttcgcattactggcaacgttgttactggactttatctcacgttggatgcgagtttctacctctggaattattctctttggcatagcgttagtgtttacttttaatgctgccgtttccattatgcaatttatcgctaacgaagatacgcttcagggattagtgttctggacaatgggtagccttaatcgggcatcgtgggataagttatacattttattggttgtattagtgattatcttccccttgtcattgatgaatgcttggaaactgacggcacttcgtctaggggaagatcgtgcgatgagctttgggatcaacgtcagacgcttacgcctaacaacattacttcgtattagcatcatttctgccttggcggtagcatttgttggcccaataggttttattggattagtcgctcctcatattgctcggatgacttttggcgaagatcatcgtttttatttgcccgcaagtgcccttattggtgcattggtattatcgatagcttctttagtctccaaaaaccttttgtctggtgtgattattccggtgggaattgtgacttctcttgtgggtatccctttctttgttagtatcattttgcgtcatcgcgggagaatataa

SEQ ID NO: 1974 - DNA, 963 bp, Proteus mirabilis
ataatatcgagcgcctgtttaccatttagcaggagaaaaatgatgaaaataaccgtattaggatgtggttcaattggtaaactttggattgcaggattaacgcaacaagcccatgaagtacaaggatggttaagaatacctcaacctgattttgacgttaacgttgactccattaatggtatcccatttcaacaacgcattatagccaaccaaaaaacatggctacaacacagtgagttactgcttgtttgcttaaagtcttggcaagtttcagacgcggttaatgcacttatccctcacctctctgctgattgcccgattttactgatccataatggtatgggaacactagatgagctcaccctacctgaaacaccgactaaaagagcgatattacaaggtataatcactcatggtgcttatcaacaagatcaaaaagtgctccatacagcagaagggatcacccacattggtccattaaatacaacagcacgtcaatacggttatttagctgaaattttacatcaagctttaccggatgtagcttggcacaatgatattcatactattagctggctaaaattagctgtaaattgtgttatcaaccctttaacggtgttttatcaatgtcgcaatggtgatttattaaaataccctgagcatatccagaaagtctgtgatgaagtttatcaggtaatggagcgagaaggtgttatacctacctctagatcacatttacatggttatattatcgataccatagagcaaactgctaataattactcatctatgtatcaagatgtgaaatatcaacgccataccgaaatcgattatatcacaggctatctattacgtagggcatcagagcaaggactcgtgttacccgaaaataagcgactttttcaatttataaaacagaaggaaggcaattatgaccatatccgcactcatctgtctagctaa

SEQ ID NO: 1975 - DNA, 645 bp, Proteus mirabilis
aatatgacgagtataaactctttcaatttacaggagtacattatggttctggttactcgcaaagccccagatttcacagcagctgctgttttaggtaacggtgaaattgttaatgattttaacctgcattcatttatcaaaggcaaacctgcggttattttcttctggccaatggacttcacttttgtttgcccttcagaactgattgcatttgatcaccgttttgaagagttccaaaaacgtggtgttgaaatcatcggcgtttctatggactcagaattcgtacataacgcatggcgtaaaacagctatcgatgatggcggtattggtgaagtaagatacccaatggttgctgatatcaaacacgatatcattaaagcatacggtatcgaacatccagaagcgggtgttgcactacgtggttcattcctgatcgacaaagaaggtgtcgttcgtcaccaagtggtaaacgacctgccattaggccgtaatattgacgaaatgatccgtatggttgatgcactacaattccacgaagagcacggtgatgtttgccctgcacaatgggaaaaaggccaagaaggtatgggcgcatctccagacggtgttgctaaatatctgaaagcgaactcaggcaaactgtaa

(The sequence listing continues in the following parts.)

What is claimed is:

1. An isolated nucleic acid molecule encoding a *P. mirabilis* polypeptide of SEQ ID NO:7520.

2. A recombinant expression vector comprising the nucleic acid of claim 1 operably linked to a transcription regulatory element.

3. A cell comprising a recombinant expression vector of claim 2.

4. An isolated nucleic acid molecule selected from the group consisting of:
   (a) SEQ ID NO:3348;
   (b) an RNA of (a), wherein U is substituted for T.

5. A recombinant expression vector comprising the nucleic acid of claim 4 operably linked to a transcription regulatory element.

6. A cell comprising a recombinant expression vector of claim 5.

7. An isolated nucleic acid molecule of at least about 40 consecutive nucleotides in length, wherein the isolated nucleic acid molecule is selected from the group consisting of:
   (a) an isolated nucleic acid sequence fragment of SEQ ID NO:3348;
   (b) an RNA of (a), wherein U is substituted for T.

8. An isolated nucleic acid molecule of at least about 40 consecutive nucleotides in length, wherein the isolated nucleic acid molecule hybridizes under conditions of high stringency to an isolated nucleic acid having a nucleotide sequence selected from the group consisting of:
   (a) SEQ ID NO:3348;
   (b) an RNA of (a), wherein U is substituted for T.

9. An isolated nucleic acid consisting sequence of SEQ ID NO:3348.

10. A recombinant expression vector comprising SEQ ID NO:3348 operably linked to a transcription regulatory element.

11. A cell comprising a recombinant expression vector, wherein the recombinant expression vector includes SEQ ID NO:3348 operably linked to a transcription regulatory element.

12. An isolated nucleic acid molecule that hybridizes under conditions of high stringency to SEQ ID NO:3348, wherein the isolated nucleic acid molecule is at least about 40 consecutive nucleotides in length.

13. A recombinant expression vector comprising an isolated nucleic acid operably linked to a transcription regulatory element, wherein the isolated nucleic acid hybridizes under conditions of high stringency to SEQ ID NO:3348 and is at least about 40 consecutive nucleotides in length.

14. A cell comprising a recombinant expression vector, wherein the recombinant expression vector includes an isolated nucleic acid operably linked to a transcription regulatory element, wherein the isolated nucleic acid hybridizes under conditions of high stringency to SEQ ID NO:3348 and is at least about 40 consecutive nucleotides in length.

* * * * *